United States Patent 10,563,263 (GENETIC POLYMORPHISMS ASSOCIATED WITH STATIN RESPONSE AND CARDIOVASCULAR DISEASES, METHODS OF DETECTION AND USES THEREOF) - sequence listing, part 16

SEQ ID NO: 384 - DNA, 21287 bp, Homo sapiens
ccccagccttggcgggaagatcctggaggattccgcgggcggaaatgaaggtgaagcgcaggccaggccaagtggcgctctgcgggaggcgacatcagggctccccaaccggtagtgggagggaagattgccctcaagtccacaggactgactgaccaagatcattctagcctcaattgtcccaggagccctttcgatgattctgttttactttattgaaagactgttacaactttggtgttgcatttcctccagaataaaatgacttttacagcctggacgttgtagcactctgtcttctttgctgttgtcctctctcccttaacatacagaataatgtattattttgtgtataattattgtaatataatgtataacacattgattatatcatatatattacagttctgtggcttactaagttcaatcagatatatttgaggcacacacatgtatacgtatatgtgtattgattagactcaagtcaacactggactcagttctgtgtacggcactcacaaatatataaagcaaaacatgagtaaagattgctgatggacttgaacttaattttcctctgacagcgcttgcaatatgtttttctaactcaggaatgttatccatcccatcttattaagagttgattaaataagaaacctactaaaatatttaccatatgattatttgattttccaattttccaattttccaatgcatcacgtttgagccctactatttgaaaaacatcattgtaatgtgccaaaggttgagcaaagattatttcgtcccctacccatctttattgacctcaagacagaatttgacatcctgaagattcttaaagtttgacaagaatttgtcacagcattctggatgcttacagaaaagaatgctggagcagtggttagatataaattacattaaagcagtggttctcaaaacgtgatcctagaacctagcaacagcatcacctgggaactatgtagaaatacaagttttcaccgctgatggggttcaggatatgctaccccaaaatatggccccttgacatttgagaaaacaacaaaacctaagatcactctctgaccttctcccatccttcttccctgaggcgggtcattggatcctcaatccagaggtgctcttcctatacccacaggaaagaaatatccttatctctaaagaaacggagacatagaaaagaatctgaacaaaaagacctttgacaacttaccccagtttattaccattagaccatgctttgtccaaccgtacttccccacaactgtccactgttccttctaaaaatgcacaggttttcctgtttctttgggcttcatctctgaaggctcccatgccacataaaacttaaataaatttgcacgcttttctcttattaatctgtcttttcttataagggactcaaacaggaatctagcaacaggaaagaaagatgtttctcattccctacaggcccctatttcaaacctcgggaatcccaaacactggcaatagggctcagcagtctgcgttttaacaagctctccaggtgattctgatgcatgctaaggtttgaggatctctgcaggggcaggacataacacctgctttattttgcaactcggtaattaaggacggccatgctacatgttttcctataagaataaagtagaggctgtgcaaaagtgggatcaacacaaagattaagagaacatatagtcccttacttcaagcactttataatttatctgtgaattaagatctttattgtatccagtatgttaaacttccccaccaccacactttcccccatggaacttctaccctttctttaaagttcttctcaagtgctatgtctttttggaaagcttttttaatcttctgaaaattattgctctccctaatcatttagcatatttcctgctgcatcgtaggtgctaataaattatttactaaatatcttaatttgggttgttatagcagaataccataaactggataggtaatccgcagaaattaattatttcttagttatggaggctgagaagtccaaaatcaagacgcaaggacaagatttggtgtctggtgaggagtcacttcctggaacacagtcttttggctgtgaccttacatcacattcacctttactattgatacactggacagtgtgaccacttgccaaaagcagttggctccttgattcggaatccccataattaggtaactagacttaaagatttccagcacgtttattgctaatttatcatcttagattttaaagaaaagacatccaagtcactgttatgatagttgaacttgtaaatgagcattccttatcaataaaatctataattgaagaaatccaatgaccaaggaacaaggtaagataccatataaaaactttttaattcaattactcgactattatccttaggtgttcaagactgaaagttggatactcactaccatcatcaattcatacgtggttgtgctggaaccatttatatatagcccagttgaagtcagccaccccaaaatccaaaaaaaaaaaaaacaaaaatgctcaatatgtttaaagatcagaaagccaaggaactacttctaccaccatcagcatgatttcaattttggaatcactctgacaaactgcacaaagatcctcattaaagttcaagttccaccaggtatcctaggcaggatttcatttatatactttgccacaaaaattactactatttaaatgctattgcctgaggaagaactttatattctaacacagaaaaatatccaaacattttgacaaataaaaagcacaaattccagaatggtatgcttactattataacatttatattcaaatatataagtaaagttgctctgtattactagcaatggttactttaggggagggagatgggaacaaagaatggagataatggcccatggagacttttatcttttatattttaattttttaaaggagaattattagtcttaaaattaaaaattaaaatttaaaatgcttataccattccaattagcatctgttatccttattttatagcccaaatgtttagccatgtcccaagagtttcttctcccagttcccaccagtaatggaagaagataggatgcctgccattaacattaataagattaataaaggagagattgtttgagtctgctgagaagaaagatgaaggaagagacttgcgaaatgtgaaaataaagggaaaatgaaaattaggggaaagtgaaggaagaatagccatttaaaagagttttcaaaaaaactggaaaagcaagccaataatatcctattctctgtggcactgtgtcatagaatggaaaagacagcagatagtcaagattaaggcatgatcaggagtgtaaaatgctacctaaaggttgaaaaaactgagaattatagagaggcctttggatttgatcacgcaaaagcatttattaatttgaaagatcagtttgctcttgcctgtttttctatccatgcactaaacagcagtttataaattgcgatgtagtgaataatttttcagccttgaaaagaccatatccataagaaataaactacaaagacttaattatgtgaccaaagtctggtagggtgatatatggagaagacaacctggctcctataaccctaccccaactcttttggagcacactcccttggtaggtaggttttaccaataatgagtctagatccattgcaggtacagaataacaatttctgcttcactctgggctgtagacttgaggagcaatggtacccacaacccaactacaggtaaacaaaagaccatttaagggttaagtctgctaaaagagttgatgggttacaaagattgggctggaatcagaagaatatttatggggtcatcatctaaagaaaggataagaatgtaaacgggccgtttaaaagtatagaagaatccagattattaaacaaccctcttcttagcaaagcacgaagaccctcttcccaagaaacaccatccccacacccagtgaaagccactgattagagagattaacagctcttttgtactttttaataagccactgggagaaatgtcctcagattactagcatctaacaaaaattacaactcaggaaataaatgttgcagttgacagtggcagaatagaagagacctatttacagggggtgcaagcttgagaaggccacagttgtagaggttaggagaaaaaagagaataataagtacataggattagagaagagtagttgttaagaggaggaggaagcatgcagcaagagaaatcaaagggaaaaatgactctatgtttattttgaaattctgcttgaggctagtcaatcccacttgccctaagataccaaaaggaaagcaattccatccctgagaaaaggatttccaacatccaaagaggaaagaagatgcacaaatccctcacttttactctggaaactcgagctaatagatcaaagggaatgagaggaaacagatttaatcttactcattctcaataaaagtttctaatactgtccctaaaccatcaaaatcattttaaaatattttaatacataggtgcctaggtgatgctgaaaggttctcaaaagtatgatctctggaccagcagcatcggcatcaccttaaaagaacacaccaactctgatctactggatctctcatttcgggaagaaggattcaacaatctgttttaacaagtatgtgtgtaccaaattcatgggccaggcgcagtagctcatccctataatcccagcactttgggaggccaaggcaggcagatcacttgaggtcaggagttcgagaccagcctggccaacatggtgaaaccccatctctactaaaaatacaaaaattggccaggcatggtggtgcactcctgtaattccagctactcagaaggctgaggcacaagaattgcttgaacccgggaggcggaagttgcagggagctgagatcacaccactgcactcccgcctgggtgacagagtgagactctgtctcaaaataaaaataaaaaacaaaacaaaacaaaaatttatgttttaattgggcaaatctgatacaagctaacaccattaacctagacttagtaaacccaaattctcatatctgattttattgtgcagctataattgaaagttattgcattaatcaaatgaataattgttcagacagaagttttacagtgccaaactcagagttagcctggcacatatttaaggcttagaggacatcagctaaaaaaatgtagtctgttagtgtcaagccattatttaaaagaacttcttaatgtaaaaattattttagttataaacagataaacttttttttaagctaaaaaatctatctcaatttggatcagacattagggagctgaaattttcttgacccgtccattgcagtcccagatggctgccagaactctaaccataactagagggaaggacaataatagctttctcagaggtcctttcgaacactagccattctcatatgcaaaggggctgggaaatacagtttttttaagctaatatattacctagagttctattagtaagaataaagaagagaatgtttacaagatgcactactccccatttctgcaacactatgaaatccttctaacacacacaaaaattaaaacttttttggcattgcattactaataaaatgtatactctatatgacgaattttcagactgaaggtccaatatgatcactgtaattccaaagatattacagtatgtttaccaggtattttctattttttcaaaactattttttctttcatgtgactactaaaattaatttatattttgttgcttacctgaagtgaacatcatctatgaaaatactaaagatggatgggtaacattataagaagcaataaggaaccagttttacattttagagaatgtgtgatctatacagtaatgaaatatgctcaaataaataaggagataatgaaattatagtttttttatcctaaaatgtccttcatctatgaaaaataaataagatttggttatggcctatgccatctcttttaaacaatcctttgttgattgggataggatttgctgaaataacaatttggtttctatttaatgttgtttgtttctaaatacaacaaataaaataacatataatacctgtaatctgaaaatacctgactttatgaaatgttgttaaataaattttaaaaagttaattaacttttgttccaaaatttaaaatggatttttataagtatacagtaatttcaaaataacaaaaacatttcaagtatcttagcaacactttcttatattctacaaaatcttaagtatataaaagtcattattagcagatataattatgcatttgctgatggttatgtgtaattggcaaaaggttttttttaaaaacaatctacttaaatacagcaggaaacataaaaatgattttcttttgagcaagtaccacatatagaagtatataccaaaaaaaaaatccggaaatgttcctagaaataggagacaaccaaatatccagtaagttggaaatgggtaagttatagtaacatagtagaatgtctaaaagccattaaaattacatgtaggcatacaatattggaacataagaagtatatataagatacaaatgtgtgaaaaagaccaaaacaatgccaagatgaagagaaggatatataattagctgatattttaaaagtaaagaatctttcatttttctatttaaagcaagttactttacaatgaatttttaaaaataagacattagcaaagattttcagaaatctaaatgctgtcagaattaaaaagtcatctattaaattaaaggaagcacagtaacatgaaaagagaataaagaaacttgggttcaaatagttgattttattgttttcacttaatatatcttagagtttattgcacaccagtaactatagatcaacctcattctctctaaaggtaacataaagtttattttgagaagactaatactaacttttctcattttaaaaaattaagatatgatttacataaattttactctttttagtgtgtataagttttgaccaatgtatacattcaagagtaatttttattgatactgcaaaattgccctcttgagaagttgtaccagttcactctcccacagttatttatgagtacttgcttttctatagccttatcaattcatatgtgtcatcaaatgctttgatctttgccaatatgttagtgaaagtggcattgtgttataatttaaatttttatttcttttattatgataaagccaagcatcttatatataagatccattaatagttccttttcttgaattctccatattttttgggggggtgctcattttccttttgtgggttggccttcttttcatgaatgctagacttcagttttgggggattttgtttatttctttctttgtttgagacaggatttcactttggtgcctaggctggagtgcagtggcaagatcatgactcactgtggcctcaacctccctggaatcaaagaatgctcccacctcagcctcctgagtagctgggactacaggcacccaccaacacgcccaactaattcttgtatttttttgtggagatggggttttgccatgttgcccaggctggtcttgaactcctgggctcaaatgatccacccgcctcggcctccccaaatgctgggattacaggcgtgaaacactacacctggctgaatgcttgacttcggataagttacttaatgatttctgaggttgtttgcaactataaaaatgcatttgtgaaaaatgaatggttttacaaaataattacagttaaatatgaattatctggatgataaatctaaaaaagaacttactttgaaactgttattcatattgtttgttactctgtttaataaaaatgtttgtgaaatctaaagtgaagtgccaacattgggtattttcactatttcgtcaacaacagagaagaaagtttaaccttacacattttcagttggaaaataagtactttcgggaaatgatgttgtaaagttatgaaccaattattgcactgggagatgaagttcatgttcagtatagagtgagcaacaacaagcaattgaggcaaaatatctttacataaagttttactattttgtttgatgaaatgagaattcccgaaatttattagacgcttatattcaaattatgaacataaaaaccttacaaattcagatgtagataatctcctttctgtaggtttatatcattcaaaaatgattatatattatcattttaaaatgacaaaaacattttaagtaactattgaaaattaacaggaattcaaaactattctttaaactcttcctaagtcgataaagttgtttttttaaaaagaaaaatggttattcttcaaatagtccacttgaggaggattcaatttaatctcatttcctttatggcctaaaaaataaggcacaaagaaaaagatattatggaaggaaaaaggcacaaaggaaaagatatcacatgtcaaggctgactagtccaagttttatagctgggcttctaaatgaaaaccggactgacaaagataaaagataaaatcgtacaagttttaggacttttagaatattgatatttatcctagtaaacaaatataaataaaatctggtaacattaacataaagttattttctacatttaaaatttgttcaattttctaaaactaagtatttttaccttaccttagtgttccatcatttcatagacagcacaacctaaattacacactcttcatctactgtcctgagactgaaaaacagatgtagattcagaagaatgtgaaattttaatggccccattggataagcaaatgagttcactcaatgaagataaatccccataggcaattccttcccaagaatagtcttggcttttcctttagtcaattttcagtgaacctaatttaattgaaatacaactttatatactgtggaggatgtattgagctaaaaccctaagtctttaggccatttaaaaatggagtaacaacacccatattagatgtgactatggatagtaatggacaaagataaatcttgcaagaaagggtggtgtagagccagggaccacagagaacaatggacttctttccaatgatcagaattaaaattgattcaagaaatattttctcctgccagagcagaggctttttccagttcttaccctgtaggatttcattactgctatgaaccggcaactgttctgtattttctgctattcctttttcaaaataggtaagcttattgtatttatcctactcctgctgtaccactgtattttgcatctccgatgttgtatgtgtgtctgtttgtatcaggtgtgtgtctgggtggcgggagggtagttgcagtgaccagaggaatctaaatccagattctcatagaaggacatgcaccaccagcagtcctggaatttgagataaatacagttgggttgtccactttgggaaggggatgagtaaactttatgtgagggaagaagaaggctattcagctatcagaagggtaaactacagtagagtctgttaagtgctaatcaagctcatttccttttcctcttgggcccatagctaagctacattttcccacctttctttcagattgatgtacaagtgattgagtggcagccaatggaatgtgggtggtccattaaaaacctactatgcttgattcaacattctcttctcctatccgctagtttgaataacggattctggggccctcggaatgataaacctacaaagtaaaagttgtgtctcaaatgtcttccaatcggcttgatacgaactaggaataaactttttggtattaaggcactgcaattgtgaggttcatttgttacactcgtatacagcatgcattattctaagtaaaatggtgagtatcatatttagattccatttgaacgtttgaaagtaaagcttattctcgacaagatggccacaccggcggtaccagcaagtgctcctccggccacgccagccccagtcccggcggcggtcccagcctctgccccagcctcagttccagcgccaacgccagcaccggctgcggctccggttcccgctgcggctccagcctcatcctcagaccctgcggcagcatcggctacaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacaggccatgacatcacagagcactctgtgctgatccatgagtactacagccgagaggcccccaaccccatccacctcactgtggacacaagtctccagaacggccgcatgagcatcaaagcctatgtcagcactttaatgggtgtccctgggaggaccatgggagtgatgttcacacctctgacagtgaaatacgcatactatgacactgaacgcatcggagttgagctgatcatgaagacctgctttagccccaacagagtgattggactcttaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccgagtaccgaaaatagttcccgatgactttgagaccatgctcaacagcaacatcaatgaccttttgatggtgacctacctggccaacctcacacagtcacagattgccctcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaattaaaaaaaaaaaaaaagtaaagcttattgtaaaaagctttattgtaaacaattttatgtaaaaagccaaacatttacaatatgcctaaagcatatcctttggaactaaacttacaatgaaaaattttagatgtcaacagaaatatatgcaatcaaaaatattaatttagagaatattcatgtaactgaaaacatttaaagaccactgctctgatgcaccgtaattattcttccattagtttctatgataaaacctgaatgatatagtgcagattaaggatgcacactcagacacattcaatgagtctaaaacaactaccctgagataaacaattataaataatattgtctatttatcaaagtttttttctgttgaacttccatttgaaaacacttcattagcctcttgttactgtggagtaatgaaaccgaatacctttaggaacactaattactacagactggtaacaaattcatgctgaatttctggaatattttattacacctaagtttgctcttgccttttttattccttatttctaaggtcaataattctgaacatctaaaaatctcagaaagggctgggcatggcggctcatgcctgtaatctcagcatgttgggaggccgaggccgttggattacttgagcccaggatttcgaggtcagcctggcaacgtggcaacatttgtctctataaaaaatacaaaaaattagctgggtgtgatggtgcatgcttgtggtcccagctactctgggggctaaggtgagaggattgcttgagcctaggaggcagagattgcagtgagctaagattatgccactgcactccagcctgggtaacagaacaagaccctgtctcaaagaaataaaaataaaatgaaataaaaaataaaaaccccagaaggtagaaaaaagtcattaaaatgagaaaaaacttatcaagaattaaagcttttaagcttttggggaaaaaatgcattttaaactgacttttaaaatctttgcaacagcagtccaagtggatgattccaatggaccaatatgttagcatacttttattgtttaagaaaaaggaaaaaggcttttgtgttaaaagtaaattaatttatcttatgatataatcaattttctatgtgcctcagatttgtttattaccaaagtattttaaaacccacattattttgctattctaattatcttaaagtagactgttttccagatgtatacaaaacttcaacatcaaagtaacttaatgccggtaaaatagaaatgtatatctgatgcaatcaataatttctctgtaccaaatcttcctaatgaacttatttcatgaaaagaaattctttttttagcaactaaaatgatctaatgactacatttaaatattttgactacttatcttttcaataatcatgtcttttttttttttttctgagacggggtcttgctcttttggctaggctggagtgcggtggcacagtcaggctcactgcagcctcaatctcccaggctcaggcaatcctccttcctcagcctcctgagtagctgggatcacaggcgtgggccaccacgcccaactaattttttttattatttgtagagacagggtctccctatggtgcccaggctggtctccaactcctcggctcaagcaatcctcccaactcagcctcccagagtgctgggattataggcatgagccaccacgccgggccagtcttttctatttaaaacattaccaaaaatggacacagttaaaatgatcttagtcattgatttacataggaagaaggtgggttttttctgaattaggtaattgagacaaaaacagcaccaattggcctgacttatccaaatgggaaattttttggtagaatttacctcatgactggcaaacttctactttatcatttttaaggatgaggtgctgtgctgcccacattctcctcaggactgattgacattgcctcacctgctgagaaggttgtccagccacagtgctcaactgccagctttttctgtgaattgacctttgctgaaaagtgagctgaatgcttaaagtcaatgctcaagttcccaggttggcactgatttaatgcctgccagtgcaggagtaagaaggctgtgccccctccttccaatagagaataactctgaagggctatctcagcttcagatctccttttacaatcagatgatgcctttttgtgcctaaatcccagtccagcttctccctccagtcatcccggcttccttcccttttcccacaggtgttgactccaccaggggtcccaagaaacttccttctcagaaactctctttctttcttttttttttttttccttttgagacagggtctcactttgttacccaggctggaatgcactggcaccatcatggcttactgcagcctcaacctcctgggcttaagcaatcttcccacctcagccttctgagttgctgggactacaggcatgcatcacaacacctggttaatgttttatttgttgtagaggcagggtcccactatgttgcccaggcttaacccaaacctctgggctcaaggaaatccttccgcctcagtatcccaaagtgctgggattacaggtgtgaaccaccacacctggcctaaacattctctctcacagactgcttcatagacaatccaaccagtgatgatcataaaataatatttgaataaatatatttgcagggtagctgatgctgttgtttaagactaatgatttaataagggtgattactttcatttgtatatttttcaaaactccttcatatacattatgtaatttgggcttgccaattattctgcgaggtagcctgagcaaggattactatacattttacagttttgtaaactaaggcttggagagaagtggcttcttgattccaggcagacataatttctattttctcctagttttattatttgcctatagcaccgtttctctaaaagacttttattcctaattgttataaaattctagctcaaaatttcttatcatattccccaacccaagaatgcatagtaagttcctactcatcctggcagtatgaaattcaatgtcataactgtatttgaatgtttttcaagatcttactcccaattctttgtccacacactttatattgccttcttccatttattttttaacgtgtttattgagcaactgctgtaaatgcagcataacatttcttgagaacttactatgtgctaagcactatagtgagtgtttttcatgcattatctcattgaatctctgttgacagttctatcatctccattatataaatgagaaaactgaggcttagggaacttaaatgattttcccaaggtcacacaactagtatgtcacaacactaggactcaaacttaggtttatctaattctgaaatccatgctctttgcctctgtactagacctctatgatacaagaaaaaagataacataagatgtagctcctactctctgctctctaactacactctactgtgctcctactctcactatactatatagtgtcttcctaatattaggaagacactatagcacttgattatatttttataacagttttattgatacataattcatatatcatataaccatccctttaaattgtataattcaagcattttaactaattcacagagtggtgcaaccatcattaccatcaattttagaacattttttatccccccaaagaaaccccatacttattaactgtcactccctatttcccctacctgcacccccaggcaaacagtaatctactttgtgtctctatagatttgcctattctctacatttcatataaattgaattatacagtaagtggtcttttgcaactggttgctttcacttagcataatgttttcagggttcatccatgttgtagctcctatcagtccttcaattatgattgaatattgttccattgtatggatatgtcatattttatttactaaccacttatcagtagatggacattttggtggtctccacttttgggctattaagaataatgctgctaagaacattcatgtacaagatttatgtggttatgtttttatttctctagagtatatacctagaatgtaactgctgggtcataaagtaattctggagatatttaaccttttaaagaactgtcatcctgttttccaaaatgctgcactgttttacattctcaccagcagtatatcagttccaatttcttcacatactcctcaagagttgttgttatatccctgtttgattatagtcatcttcgttggtgtgaagtgatgccttcagtgtggtttatttgcattttcccactggctaatgatattgagcatcttttcatatgcttattaggcatttgtataccttatttttagcttatggctcccattatgagacctacacggtataagcaagctgaagcgcacgatcagagaccctaatgttccgtgccatgctgcacctaggataggacctattagtaggggctagatggaggaaaggagtctgacttcttaggtgcactcaccagaatctaggctctgcagcttggagctagaggggataagaaatgccggtggcggctgggcgccgtggctcacacctgtaatctcagccgtttaggaggcggaggcgggtggatcacgaggtcaggagatggagttcatcctggctaacacggtgaaaccctgtctctactaaaaaatacaaaaaaaaaaaaaaaatcagccgggcgtggtggcgggtgcctgtagtcccagctacttgggaggctgaggcaggagaatggtgtgaacctgggaggcggagcttgcagtgagccaagatcacaccactgcactccagcctgggcaacagagtgagactccgtctcaaaaaaaaaaaaagaaaaaaaagaaatgcctgtggcctgcctctcccagtgagattttgtacccataactgtgaactgaggggagagggagcaccattttggtgaaaaccatccaaagtagagcttctgtcatgctgagctagaaggcagaagagaaacaatgtgttatggctcaagtgacacagatgccatcattgctgagatttagtagagtttcttgaataactgtttcctactttaagaagaaactgtatgcccttaagacaatttccaaagacattaaatgttttgttttgtttttttaaataattttcaccagttgtggtagtatcactggggaatggtctccaacaggttctcctgccttttttccagaagtggaactctcacttgattatatttttaatgtaaggagttcagagaggggatctcggaagtcaaactgaatgaatggacttgagtccagactctgaaagttactagtgtattattgggggaaaattacttaactcctctttccccctattttcttatctcttaaatatggaataacaaaatatatacctttaggactgttgggaggattaataagatatatgtaacatggcttagtacatagctctcaatagatgttagcaattattaaaaataatgttagtattattatagttataattattaggatatcccaccagaaattaaacttgtaaggtttcttctttctttcccattgagagagatgcccacagaggacaagttactctgaggcattgtgattagttctacttttcaaagggaagtgtttggcttatctggagtcccataaggttagctaagtcaaaaatggcttggtacatctactttcctgaaaaggatatacatgaattagatattttttttcagagtcaaaaatgatagctataccatctgatatggtttggctgtgtctctatccaaatcatcttgaactgtagttcctgtaatccccatgtgtttgttgtgggagggacccagtgggaggtaactgaattatggaggtggttaccctcatgctgttctagtcatagtgagttctcacaagatctgatggtttgattaggggcttccccctacactcagaactcattctctctcctgctgccctgtgaagaggtgatttccaccatgattgcaagtttcctgaggcctccccagccatgtggaactgcaagtcaattaaacctctttcctttataaattacccagtctcgggtatgtcttttttagcagtgtgagaataatacagcatccctgatgatatgtatctctaagggtagtcgatacaggatcacaagaagcaggcagaagaaccagttctaatgccatgattctggggtggctggagtgaggaagggagtgttttttgccccatggactggaagagccacaccttaaaaactctgaatctgggaacccaatcaaaggcacactgacagaactcaggattggcagggtgatatttctccctctaagatctatagtagcctgtgtacagtgtttcaacaacagcagacctgaatgccctaaaacaatggttttcgactggggcaatgttgacccccaggggacatttggcaatgcttggagacagtttggttatcacaacttgtgtgtggggagtactactggtgtctagtagatagaagccaaggatgttgctaaacatcctacaacgcacaaagtgacctccctcaacaaagaataatccccccaaaatgtcaaatgtgcctaggttgagaaaccctgcactatagggatgtacattaagactctccagatgccaggcttggttactagccttacttgcgacaatcatcagactctaggttctccctgtttggtgtgtatgtcagccaggattggctctgttttccagtgctaacgaacaattctaaatctcagtggcttaatacaacaaaatttatctcttgctcatgctgcattccaacacaggttgaaacaccaccacagcagcagagggcagggaaggacaaatcaagtagtaggctttaaaggcttcttcagggaagtgaaacatgtcattcctgctcacatttcattggtcaaagcaagcaccatagccacttctttcttcaggggagcagaaaagtacatacccctttgtgctcaggagaaccagtatatttggttaatagctctaatgactatcgtaaagtgactatctttctggttaccctttttagattgtgtaagcctctggaaccttggaaaattaggaggaaggagcaagaggaaaatattttttatttttatttattgtacatggtttttaaggtctactttaggtattactttagatgtataattgtcatctcagattgtctgtgccaaaattgaatctccagaaaatgaccatttaataattcctgaagaaataagtgacttaaacaataagcctcaagagatgcttaaacctctttaagcatgaaagattgtaatgaaaggtagtaatgaaagatatatacatatgatacaaaattgtcaactttataatggtataatcaggacatgacattctataactaaaagcaggacattatgtgtcaactgatatgctgcaatgtaaagtacagcaccaaaaatagatttgacctgaatccaatcatgcttttggatataactcctagtttacagaaaaaaaagggggtgggtgggtaaaggaaccagttaaatgacatcaggaggaagtgatcaggcaaatctggaatgtcaaatatacaattggacaactgacccaattccttcagctgggcaatggcatgaggagaaaaaaggcagaatgggactggactgctctagtttaaaagagacttaagaaataaaagactcaagagcaatatgaaactttgtccgttttctgctgctataatagaaaaccacagaccgagtaatttataaggaaaataaatttaacggccggtgcagtgactcacacctataatcccagcactttgggaggccaaggcaggtggatcacctgaggtcagaagttcaagaccagcctggccaacatggcgaaaccccatttctactaaaaatacaaaaattagccaggtgtgggggcaggtgcctgtaatcccagctatttgggaggctgaggtgggagaatcgcttgaactcaggaggcggaggttgcaatgagaagagaccatacactccagcctgggccacaagggcaaaactccgtctccaaaaaaaaaaggaagaaattttatcaggagtccactcctatgataagtaacccacacttgtgactatagtgtgaacccattcacgaaggcagagccctctagacccatttgctgtttaagggcctcaccttccaataccattaggttggcaactaaatttcaaataagttttggaggggacatttaaatcataacagaaaccttgtttgaatcctgatttgaacacaccagctctgtgagaatattcatttttcccagaaaatacagagttctggattggtgaagtattggtaatggtataaacatctaagattaggaacaatggaggagaaatgaatatattttgtatgtaacaagttaaaatgtaggttcttgggaaacctttatgtacagacaaccataagccaatggttctcaactgacgacaaatttaaaccccaggggaaatttgataatatctgaattcatttttgtttgtcataatgggggtgtagggaatattaatggcttcctgtgggtagatgcctagaatgctgctaaacaccctacaatgcatgggagggtcaccacaacaaagaatgattcaccctaaaatgtcaatagtacaaaggttaggaaacactcaataggcaatcaaatgtaagcacaaagaaggtagggactagaattggtttacttgctgtgagcttgggcacagatcctggcatatggtaagtgtgaaaatacctgataatctcttttatattgtgtaagcctccagattcttgacaaattagggagaggaagcaaagagacattgttttgaggagggaagctcagagaaagttcttagaatgatttataaatgtatgttatcagcatataagtggtactagaaaccttgggagttgatgaaagaaaaacttcagctgaattaaatttaattgagctacgaatgattcatgaatcgggcagcctctgagacagaataggttcagagactccagtgcagccacatggtggaagatttacagacagaaaaaggaaagtgatgtacagaaaacagaagtaaggtacataaacaactggattggttatagctccatgtttgccttatttgagcacagtttgaacagttggctacatttgattggccaaaactcagtgattggcacaagtgtaggctacagtctgtttacatctccatggatgttatagttcacaacgcatggagaaacctttaggctgaacttaaaatatgtaaggagtttagccttaggctaaatttgatttaataacagtgaatgaggattttttggcggtagttctcaaacctccttgtggatcaaaattatttgggcaggtttgaaaaaatgcaatgcttggtctaaccccagaaattcttatttaaatttttgggagtggggagtgtgactagcatcatattaaaacaacaacaacaatttaaaaacctccttttattattttaatgtgcaatcacattaaaatggtgttgaaatctaaaatttcttcctttccccagaacacaaataagctgtattcattatgatggcttcattcataagacgtactacattcaatatggaagctcaagcagttggctgtcattttaacagttcttttttttttttttttttttttttttttggtttgctaaagcaaacccttggcctcatttggtgaaataaaaggccagaaagtccttggcaaagcatagaagaaagaatgtaaagaatttaggagataagcctaactcattgtatgaggccagcatcatcctgataccaaagccgggcagagacacagccagaaaagagaattttaaaccaataaccttgatgaacattgatgcaaaaatcctcaataaaatact

SEQ ID NO: 385 - DNA, 283252 bp, Homo sapiens
tatgaaggataagtatggtatgttaatggggggctgttcagcatggcacagtaaggttatttttgatgctatgccctcttacacagattcaaaggaaacttagatagaatttatggggaaatcaagaagacatagctgggctcaaaaccaagattaacatctccagagatcattaatggaaaagagacacaaagcagtgggtaatgttgaagccacacccagcaggtaatgaggctaaagtgttacaggtcaagctggatgtcgggctgaacttgtcgcttgtatccagagctaagatagactccccagatgtataacagaagaaaaaatgataaagtgatgtttttcactgggagccctgaatctacagctttataggaagcagtgaaccttggaaagtgaaagataaagacacacttcttgtgatgaggaacaaaatcaagctactatctggctcagtaaattaacctatgatttcttcaatcaaacaacaaagaagggactttgaaataccattataaggaatggttatggagaggggaatttcaacactgaatataggtaactataaagttactagataatgataagtgaacagagaggaagaaagtaaggcaggtgagagtgagggggagagagagagagcaaaaaccttattactcaaaatgagcttgcacaccaagattcaaaaataagtttaagaatattaaaaaaattaaatttcaaaatagaagaactcaacaaaatcaacactctgaacttaaatttactcccaattaaattaattgtatgagacactatgtaaaacaataagtaatgtacttaaaatgttcatatctgaagaaaactctgtgagttcatatatatcaataaaagtaagaaaggtaataaaaatagagctgtcagtcacagttgaagaattaataaattagaaattgatattgagtgagcttcaaaagaacagatagacaataatgcaggaaaacaatatatgaaaaaaatgagaagttcaacaaagagatggacacaatataaaagaaaccaaacagaaattttggagctgaaggacatgactgaattgaaacagtttataggggttaaacaatagactcaatgaagcagaagagtcagcaagatcaaagacaggtcactgaaaaattatctaatcagagggatgacaagaaaaataataaaaacaagtgaaaaatatctacatgacttatgagacaccatcaagtgagccaatatacatgttattagaattgtagaagaaacagaggaaaacaaagattaggaagtttaatgaaagaaataatgacagaaaagttcccaaatctggagagagaaataaacattcagatccatgaagcctaaagaaccccagagagaataaacatgaagaaatcttcaagtaaacacattacaaccaaattctcaaaagccaaaggcagagagataataattttggaggaagcaagaaaaatgtgccttgctacataaaagaagctgccaggaaagagtgagataatatatgcaaatatatactcaaagaggaatgaatactaacttaaaacctgcagacaaaaatccttaactaaactacatgttattaagtaaaactccacaagaagctgtattattggtgaagacttcggaacccagccacaaagggttaggaagaggacaaaatagtttgtttttccatataatgaaataagagaaaatgtaataattcatggactgatgaagagaaataagacagtaccagtatagagagaagtggttgagcaaatatataaaaagttgagagagggaaatcaggaagcggcaacatttttggactagaaaatgaggctagaggtagagtgagaattttctcgtagtgggtatatgaatatactcttttgaatgtatagattttaaggaatttcacatttcctggctggctatccttccacccattctccctttccctcagttcccattgcctttactctacactgaataactgtctccaaaagcttgcttttttttttctctcaatactgctttaagacagtggttttaaaacatttctttgaagagccctaggaattctattcagggctgtaaatggtgagtatatgtggtaaaagagatagatggtgagcaccacaccattttgccagagcaagtctgcttctatcattttatttgtttatgcttctgggcataattttttttaagtaaaaaaataaagttagtgaaaaatgtgttggcaaatccttaggttcttggttgtaatattagaaaaactgtatcaacatgctttgctataaaagaaatctgtctattttatatcttgctggaacccatacagaaaaaatgaaaacccacattttaaaatgtgagtataaaggttataagtaagttgccaaaagcaagtatcaggcctgaaggttaatatagaatttgtatttcttgctagcttctcagttttgattcaactaatagaaggctaaataaataacacattaagtcctatatagcatttaataaaccctcattccacccaaaacccatactgaaatagtatttgttttttggtaccaatagaatagtgataattaatattgttttaagcatatttaaaatgatgtaatcctttttattttattcccgtatataaatttgaagattccatcagggcaaactatctgtttcagggatgttctccatgattatagctttgcatttagtaaaaggagcttgaaatttttaatacatcataagagagtggtatattctgttgacttttctagtgacatattcaagatgccaaaagagaaggactgtttttagattaaaaggattatagtctcattgtgttctaggctagtcaaacactactgaaatatttttattttgatgacataacttaaaaatattgccaaagtggtacaggatcagagatttccaagtttataaaggaactgagttcgacaaaatttgatgtcatctgataggcagttaataggtttctgtggagagtttagtgaagagaagccttgaaagttggtagtagaaattttagttttcttcagtcaaaatagaagattagaagataactgtaccttattagccagagagcaaaagtaagacttagaagttataatgaaggaaattatataaacagaaaccaaaattatgaatgtatacatgttaaaaaatagaatgtggtcccttctgaagtcctatattttttttagcacctctcacccacacagtacaagatttgggattgcatttgtccaaatgttaaagagatatcctttggattatttttagataaattcaaggttttttctaactctcagtttataaaaaaggccactatcatcctttgagagatactctttgaatattttaggtctttttacatctcaagtatttaaagggcctctgctgtgtttcaagaattaagtaaacattttatgtacattatctcatgtcatggcattcatttgttaattcattgaacaaatatttcttgaacattatttatctgataactatgctaggcactaagctgagattttgtgtcacgtatctgaaaaagatttaccagggaaaaggaatgctggactaaggaagagtaaaatagacgaaggctaagtctgcatagcacacacaggagtacatactccaggtagttttttctttaggcagctggaacttgatctcactgggtgcttttgaaaatacactttggagtcacttgtctaagagacagaagagggaagacttaatttgcttccatatggccttatgttccactggtcaagatgtcctccatgacacatttaccatcatgcatatcctgttttcataaggacatgggaagttttcataagcattttagccatagagcagagaagccatagagcagaaagcgagagcttttacagtgcagctgatgggaggtgctgtcaggtacaacttccatgaagctggctgctatggccatgggctggataaaatgctgctcaagattaggcactggcttgagggaatgttttggctggtttcaacttttattcagacaactcagacattctccaatcatcagtaagaatggatatggtctgactctgtgtccccacccaaatctcatgccgaattgtaattccgagtgttggaggagaggcctggtgggagtggacttcccccttgctgttctcctgatagagttttcatgagatatgattgtttgaaaatgtgtggcacctccccaccagctctctctcctgttgggcatatgaatacatgcctgcctcccctttgccttccaccatgattgtaattttcctgaggcctccccagagaaagaagcctgcatagcccacagaaccatgagctgattaagcctcttttctttataaattacccagtttcaggtatgtctttacagcattatgagaacagactaatacaaagctgttctgctttcttatcacatatgtactcaccagggtagcacttttattttcattcaaaaacttttctattacattcacagcttggccaactgtttggtgcaagaggactaccttttggcctgtctcagcttttgacatgtctttttcattaagtttaatcatttttagcttttacagtgagagatgtagtattctacctttcatttgaaaatttagaggttattgtagggttattacttggcctacttttgggattgttgtgtcttaggtaacagagaggtctacagggagggagagaaatggggcaatgggtggtgagtgaggcagtcaaaacaggcacaatgtttattgactaagttttctgtcttatataaatgaggtctgtggtatcaaaaaacaattaaaataacaacatcaaagatcacttatcatggatcactataacagatgtaatagtggtaaagtttgaaatattggtagattagcaaaatgtgacatagagacaaggagtgagaacatcttgttggaaaaatggcacaaattaaggccgggcacagtggctcatgcctgtaatcctagcacaatgggaggctgaggcgggtcgatttttgaggccagaggtttgagaccagcctgggcaacatgacaaaatactttatctgctaaaaatacaaaaatattaatagccaggtgttgtggcacacacctgtggtccaagctactcaggaggctgaggcacaagaattgtttgagcctgggagacagaggttgcagtgagttgagatggctctgctgcactccagcctgggtgacagagtgagaccttgtctcaaaaaaaaaaaaaaaaaaaaatggcactgatagacttgcttgattcagggttgccacagtcctttagtttgtaaaaaacacaacatctgaaaagcaatgtaaggtgaagcaaaataaaatgagatatgcctgtactataaattgctagaaagaaaataaaagatgatttgacattatagatttaatatggatcagctttttagctatcttgacagaaaatagatatttttacagacataagcacaaccagaaatttccactcctccttctgcaccattggaatgttatattttcaaatgtgacacttaaaatataaataaactttgtctttgttccatgttggttgaagaagagtttagagatatcttgataaaatgtgaatactgaggtaaagatgtatacccatttatcttttttgtagtttgaaataggactgttctgtttggctggcatactacttaatttttaattgaatgcaaatgctttttggctggctgtgaactccctagttttccttagtgctcaccattcccaatattgccaaggctacttcatgtataaacaccttgccttgtctctggaagcatctgagcttgatagccttgatacagagatcaaatcacgtggaacacttagttagatctggactgtggaaggagaagtggctggaacccaaagtcatcacagaggtgcttgagctagagatgacagcacaaaaacagaaattatgttcagatgttaacagcagaggaaaccatagtctgataagagctcaggcaatttggtgctggttctggtaactgatggcttttagagcttcatacaggagatcttgacttacctaccctccttctctttgctgtctgggaggaagaggaatataccagcaattttttcagtggcctatgtgagatggaagaaggcaagccatagatgttttaatcttatgcttctgtggcctgagatatcttatgtataaaatataaaacacatgcagtaaattttccttatgttatgctggcaattctgttatatactatgttaaacatttcatagatagctataacttataatacactctaaatatatttgccatgtatttttttatctctatgttttgtttctttggcataatttaataaagtaaagtatagcagttgttaagagtttaatttgattttcagcctatgttattccttatctatacaaatgtttcaaaatgagcaatatttttgaaatgagaatcccaaacatatttctctgggaagaaaaaaatcgatatttattaatagtcttttcctacttcttaccaagttagcagatgcaaccagactccaaagtgggtaatataagtttcaggagaatagaaaatttaactaaaaagggaaatttcatttaaacatttgtaaagtataaaattagcatacctgagacttccagagagcttaaatacatgtcactctcttaatctttccatggtgcacaatatatatttttgtcctttattgcttacttactctattaggccattcttgcattgctataaagaaataccagagattgggtaatttataaagaaaagaggtttaattggctcacagttctgcattatgaagcatggtgccaacatgtgctcagcttctgatgaggcctcagggagcttttactcatgtcaaaaagcaaagagggagcaggaacatcacatggtgagaactggagcaagagagagtgtgggagagaggtggcacacacttaaacaacaaccagatctcaggggcactcacttattattgcaagaacagcacaaagccatgagggatcctgcccccatggcccaatcatctcctactatgtcccaaccccaacattgggtattacattttgacatgagattcaggtgggggcaaatatccagacagtatcataaacctttccagttttgtcttttcataataccctcccactctcacccccacttccactttatggaaaaatttatagtctataaatgttccagctgtctctttgatcagttgcaaatattaattgactgggtccctcaacactatttctatttcctcaaattcctattcattcttcagcaaactctttgtaagtttgcacactatttgtaaatttgttattgtaacaaatgtagacatttggttttttgtggagaagggggagtagagcatatggggtaagagtagtgttgagtgtcgctgtctaaatgttatttttaaaattgttatgattttttaaatcaacagcttcaataactcaacagacataatgcatattaagtgtattgataacatcaaaaccaggttgaaagtctcatttaggtcctggagtgaaataaattaagacatttaactgacattggcagaagtatatcaagaagttatggttaaataggaaaaaagcacaggggagtgtcactatttttttaaaaaaattgacaaatagaatgaaaaataatttctacaacctggtacagcaagaacagtttgtatggaaatagaacaaaaagtgattccatcacaaatgtaaagcctttttctccaagataattaaagaaaggacagaaacccatttgacctgctaaattaaatacctttaaatattctcttcttcacagtagtcagagtgatgtattaaacttctctaatactatctatggaacttaaaataatgtctttatatcatcctatgtcccacaaatccctacatgaactggttctggtagcttccaataaacatacctttcaccctccttgcttacagagctccagtttcaccagccttttgtctattttacaaacaaggtattttccatcttaggatttcttcatactttctctacttgttcacctctttttctggaattttgaataaagggctccttctcttcattcaggtctgtgctgacatgtcaccttctttagaagcctttcctaatcacatgtttaataacctgcacttctactgtatcctaccccctaccgattactattttattttcttcattacatgtattagtgatgtctaatgttatattaatttctttatgttggtgtttattgcttgaatttccagattgaatgtaagctccataagcatcaggaatttttctctcctgatctcccttttcctattgccgagaatgtgactggcattggagaagacaaaataaaaaatttgttgaaggaatgaccatttgcaaattaaccatttgggaaaaaggaaagctcaggaagaaaaatctcccttctcccgtttaaactaatggtaagagattaaatatattgaaatggattgctcggggacatttgagaaacataatgagcactcagtttctttatggtggtttattcaatgaaaatgggtaggttagatgccctcttcttatagccttttagatttattgtgtgtttgttttctcagtagccactcttcctttctttccccagataaaagctctaattattattattatttctattctgaaacccatttaaaatgtccaaaaactatagtcaaaactggctttttctcaatttttaaaaatttttgtgagattatttcagagtaagatgtaaaatgttgaagtcattttgtgacatttcagcttaataccaaaacatttttttccttaatatgccaaaagacattttttttaaatatactcttacagatattaaacagtaaaagcacaagaacattatgaacacaagatctgatgaaataactcatgaagatgttttattttaaaatcatttttctatgagttcgaagcaacatatttaagatatataaactgttcatttagtaaattggaaaaggcttctgttcagtatcagcatgccaagaattctagctctctatgtatttcactatttgttggaaaataacatgtagaaaaacaacagtgcattccctctgctgttttactatagtaaatatcgacattcttggaatgctaggatttgttaaagctcatttagggcagactgtattctgtttgagatcaagtgtgtgtcttctacttgtagaatctacacagaattcagtaaatctattccctaatttatttttgtaagggcatatatttcaagattttcattgtctaaaaatctagtaagtccttcttaaatggaatttatatctggattaaagtaggtagcacttattgttgcaacctataatactagtaaaagtaatataagtaacgtatcatagttcattttagtatggtaataatttacacttcaattctcactaggcatatgtgtaacaaccaccaaggacatttaaaataacaagagattcagtgaaatcacatgcaaagaattattattgaacgacctggaaatgcttctcattttcagtcagtgataaaggagatgtctgctgccttttactgtttcaaaatggaatcttttagctaatgtttctgccatccttttaggccttgcaatcttcgtgcattcattttctcaagttttgtgtgaatataagccacatcttccataatacatggttttagtaccatttgactttagcttctgaacagatttttttttctttttttctttcattttaatgacagaagaccttcaaaagcaacaagaattccttgattatttctagctatctagttcttgcagcgatcatgcagattgctttggtcacacactgagaaaaccccataattacaaggatatttatgatagcagcactgctatttcagggaattacattatagttcacactaaaaataaaagggcaacacattttacatgctggtagctggtttcccttgatagatgcacttgctttttctgcagacttaaatttatccttcaccatatgctcttcaagtactccagaaaatacaatattgcaactgaattcccttgaaagtaagttactcttcctccctacagacttccttgtcagattcatagtctctctttgttgtattcttagtcttacctgcatacaaatgcccagtatttgcagagctctagtaattttgtactttgatttagagaatacttggaggaacagccaggcaatcactcctataacgttttgggcatgactggggagatgacataggcaatcgtgttattaaaatgattgaaaaaagttggtgctcaagtagcaatatttttgtttttctttatttagtcattcttttcacaaaaattcattgaaatatttttgctttaagcagtttggaaataattgtactaaccctgcttatgcagaacacaacataatcctgttgcattatttgcatggtagtgaaaggacacttatacactctctgcctaaaacaatctcccagtccaggtggcaccaactaaaatttgttcatagatacttggtcctttagtttctcttggaagtgtctttaaaaatatatcctgcaaatggccatgctaatccttgttatacaattacttccctaagcaacagagtttcagggcaattataagatacttattatggagaaaaggaaaggagcaggaaaattttaaaaggaagattctgaataccgggaggagtagtgcatttaatagtctatatagtccatagatactattttttaataaatgtgaaagggtgaacagaaaatgttaaaataaggctggcctattgtaggatagtgcctagccagttcttctaaggattctgactttgcctttggcttccaaattaatttgaaatcctacttcatttcagccactgcattctatttttcccccaaaacgaaagaagatattttgccttcatttgatattgataatttatcaagatatcagaacattaaaataaaaaatcttgatgtgagaccaaccaaggaattcctcatgtatctttaatcagttttaaaactgattgctacagagttggtgaaaaccgaaaaggtatctagcctcctttattttagaaaaatctttccacattcaaagcaaaccaagggtgtctgcaaagtatgtagaaacttagaaatggtgcaattggtaaatagatgagaaagtgaaggtgtttgttccagtgtgtgcatgtgggcagcttgcctagggatcaaatgaatctgatcaaaacttttgtgattgtttatttgtgaaacagcaagtcagacttgatgttgtttgggtcaccttttgtgccatcactctaattgcagctctcttctctgtaggcctagaacatgcaggtgttcagtgctaggagaggaggatgcaaaagctcccaatcacagcttctggtcatctgagaaaggttccaacatatgaccccaaaagactgacctcacttccctgcaagtataccacagagagaaaatcttcctttgtcaaggacattgttttaggcagaaataatagccacacctgcctgacacagtgttttatttatctttgtttttgtgtagcaaattagaaaaacatgcactatagtattttcacattatttttaaagggatctatctagaatcatataattttaaggctgaatgaaacttcaaaggcaatctggtctttttctaatgcataaatccctttacaatacccactaacatgatttattagctcaagtcgtttaagttattggaactcattgcctcatcagacaacccattttactttagcagcttggagtgttagaatttttgtcttatattgagttgaaatctgtagccctttcttctctataacctgaacccatttgtcctaatttggcttcccagaaggatgcagaaaaagataagttctcatttacttgatagtgtttcatttttaagccacatatagcctaagtcattcatacagtctttttgatttttaaaaaataacaaattatttcaaatatcttcaacatctttctaaagattcacagatgcacagatttttataaaatggaagacattttggaaattatctgtttttctcttgaaaacacagttctataaaatcctaattctagagatgagaatagtaaaaaaaaaaaaaaaaaaaaatcaccataagatacttatctttggttcagtctctgtattagtctgttcttacattgctataaagaaatacctgagactgagtaattcataagaaaagagatttaattggctcacagttctgctggctgtacaggaagcatagccgtgtctgctcctggggaggcttccagaagcttccaatcatggtgaaaggcagagaaggagcaggcaggttacatggtgcaaacagaagcaagagagggggcagggaggtaccacacacttttaaatgatctcagaagaactcactcactatcacaaggacagtaccaagagtgatggtgataaccattcatgagaaatccaccccactgagccaatcgcttcctaccaggccccacctccaacattggggattgcatttcaatacgagatttgggcaagaatacacatgcaaactatattggtctccttatgcctgtgatgcttgaactagaatactccttctcctggagttaggtgaaaggagtcataggtaaacctggtgaatctttttttttaacattaactttctttaaagttttctctcaaaggagtctcaggatttttatattaaataaaaactttgacataagaagaattcaaataaaaatttggcatgaaatatgagatttcaaataatttgtaattttcagaatgctgctttagtctagtccagttgttctcagccatgggtgattttgttcactgaggacatttggccatatctgaaaacgttttgggttatcacaaaatactagagtgctactagaatcaagtgagtagaagctggggtatgctggtaagtctgcaatgtacatgaaagacatccacaacaaagaattattttaactaaaaatgtcaacagtttgggtttgagaaaccctgaatttctcaatcctggttaccattacgggtacctcaatggaatgtttattattcgtcattaatgatttctcatcttttaagtgcagaatagaaagtactaccttgatagtataaaccaaaaaaatatctgagacaggtctcaatcaatttagagatttattttgccaaggctaaggacatgtccgggtaaaaggaacacaaaatcacagaaacagtctgtgatctatgcctttttctaaagatgattttgaaggctttaatatttcagggggaaaatgagctggaggtgaaaaagagagaatattatatggtcacattactgaatccacatgttgcaagagaaagaagcaggtagaggaatagtcaattatgtatttgtctcgtgctctgtaaatcagcacttcacataagataaagtgaacatagaatagttacctgtgggagacctggcctttttagctgtggccatctgcttaggaacacaaggaaaggcagttttgtttcttgtattactcagctttcagcttattttttttttccttttggcatagtgaaatgtggtcctgatattttattttcctttcacaaaaggaaaggttttctctttttttttcttttttaaataaaggagtctagatgccttttctgttttcaccaactctggagcaatctgagtgatctccaatcatatcttttgttctggttttctcggtagtcccatgaagaaggttgaccgcctcctatattaaaaaactgcatacggggccttaacactgagactaggtttcatagagtgctgtgtttctcaggattctccaaacagaaccaagagaatgtgcgtatagagagaaacagattattttagaaattggctcacatgattatggaggctgacaagtccaaaatctgcagagcgggttggcaggctggagacccaggaaagagctgaggctgcagttcaagtccagagaccatctgctgcagattccttcttgctcagggtagaaaagtcttttgttcttatcatgtcttcaagtgattgaatgagacccacacacattatggagggcagtttgctttactcaaagtctattaatttgaatatcaatctttcccaaaatgcttggacagaaatatccagaataatatttgatcaaatatccaggcactgtagtctagccaagttgacatacaaaattagccatcatagtacttttctgctaaatgcattgtgtctcatcctgtgctcactctgtacctctttaggagtattagaagagatcaacgatgcagggatggccatggcttcctcaaagagcttgtatcaccagcctctcctcagcaaaacaggcaattatagcaattttggattggtccatgtgctgcatgattcatgttttactttgaatttatttgtaacatacgtatgttatcatattagggaaggctgacctctgctagaaagttccacctaagtcaggtagacctctacagctttcaggtaattccaattactctttgagttcttccctgagctccagtgagcctcttccagtgagcagggattggggtgggagatatctatgcgtggtagcagtaatgacatgtcttacttgcacccttctagacataatgtttcactttatcttttagagagattttatttgaatgtatcaagagggccttaatctttccctcaggttggctaaactttagactgttttcttcctgactataggcccctgacttatcttttcttagagcacttatttagaaaatctgcaattgtaaacaattcttctgcccatttgaaatgtatgtaaatcttcttccagcctcttgtcagttttataacccaggaaatggctgtctggaggacctgggaattatccttgtgaaatgtattcaaggaagatagcaccccatttcccagtctctatggatagctaggagcctagttagatgggcactaattatcaacacatatggcctaatcaaagagaaaaatggtttgcaaactcagcaataacttaatgtactcaatacattttatttcagcaaagttgatttcagtcttttttcactatcacaataggctgaatattcttccttgcctgtttaactttgtctggtgcacattttactttgacagtatttttaaagtaactctcaacttcctatactataaggataagtgatgatattaatttcaggtaccatgatgtatcaggaatcacaggataagcagttttctgtggtaggcaagtttcactgggcttttctaatttttcaaggagaaactagataggtattatctttgaaggatgacatgcagaaaaaaatgaaacttttcccacattttcaacagtaatgaaaactgtcttaccctcaaacacctcaaggcattattctgaaaattctaacttaaaattaatttcaatacttttcaaatgtcaaaaatgtaagtaatagtaaggatagagagaagaaagccaaaagaagcaaaagctgtgtaaatatatttagaaagaacataagaagctgtttaagttttattcttcaaatttggaaagatatccacagaccaaagaaatagaaagatacataactttgtaacttcttattactactcaatgtattttcttttagacctattgcctaccacttatcttcctttgaaatctgagatgctaatactgtaaaataaagatcaagaaacagtagattttagattttaccaacccaatcccaccatatcatatttttttttctaaatttttctcccaggtttctctttaaaaacatttgtgggtatataataggtatacatatttacggggtgcatgagatattttgatacaggcatgcaatgtgtcttaatacaggcatgaaattccccccagtaatgtacaagggtttctttttctccacatcctcatcagcatttgttcttgcctgtcttttggatataagccattttaactggggtcagatgatatctcattgtagttttgatttgcacttctctgatgatcagtgatgttgaacaactattcatttgcctgtttgccatttgtatgtcttcttttgagcaacatctatttaaatcttttatccaatctttgatcagattattagattttgtttttccttcacagttgtttgaactccttacatagtctggttattaatcccttgtcagattcgtagtttgcaaatattttctcccattttatgagttgtcatttcactttgtggattgtatcctttgctttgcagaagcttattaacttgatgtaatcctatttgtccattactgttttggttgtctgtgcttgtggggtattactaaaaaaacgtttgcccagaccaatgtcctggaggttttccccagtgttttcttgtggtagtttcatagtttgaaaacttaggtttaagtctttcatgcattttgatttaatttttgtatatggtgagacataaggatctagtttcattcttccgtatatgaatatccagtttttcctgcaacatttattgaagagactgtcttttccgctgtgtgtgttcttggcatcttcatcaaaaatgagttcactataggcatgtggattcatttgtgggttctctcttctgttccattggtctatatgtctgtttttatgccagtgccatgctgttttggttactgtagcttatagtataacttgtagtcaggtaatgtgattcctctaattttgctctttttgcttaggatagctttggatattttgggtcttctgtagttccatataagctttaggattgttttttctgtttctgtgaagaatatcatttgtattttggtagggattgcgttgaatctgtagactgctttgagtagtatgaacattttaacaatattgattcttccgatccactaacatggaattttttaaatgttttgtgttctcctcaatttctaccatcagtgttttatagtttttattatagagatctttcacttcctggattaagttaattcctacgtatttaatttcatgtgtggctattgcaaacggaattttttttaatttctttttcacattgttcactgttggcatatagaaatgctactgatttttatatgttaattttgtatcctgcacctttagtgaatttgtgtatcagttctaatagttttatgtggagtcttgaggcttttccaaataaaaatcatatcatctgcaaacaaggatagtttgattcctttgtttttaattttaataccctttatatctttctcttgtttgatgctctagctaggacatctagtactaatgttgagtaacagtggtgacagtcggcatccctctggtgttccagatcttaaaggaaaggctttcggtttttccccattcattttgatactagccgtgggtctgttgtatatgtcttttattatgttgtgatatattttgtctatctccagtttttttagggtttttgtcatgaaagagatgttgaattttatcaaatgccttttcaggattaattgaaatgatcatgtgacttttatccttaattctgttgagacaatgtatcacggtggttaatttatgtatgttgaaccatccttgtgtctcagagataaataccgcttggtcaaaatggataatctttctaatgcattgttgaatttggtttgctagtattttgttgaggatttttacatcaatatttatcggagacattggtcttagttttctttttttgatgtgtctttgagggtaatattaacctcatagaatgagtttgaaagtattcccttatcttttattttttggaatagtttgacaggattggtattagttcttgtttaaatgtttggtataatccagcagtaaagtcatcaggtcctgggttttctttactgagaatcttcatatgatggtttcaatctcattctttgttattggtctgttcaggctttggatttctcctggttcaaatttggtgggttgtatgtatttaggattttgtccattttttctagattttctaatttattggtatgtaattgctcatagtagccataaattatcctctgaatttctgcagtatcagttgtaatgtctcctttttcatttctgattttaatttatttttttttcttagttcgtctggctaaaggtttgtgaattttgttcaacttttaagtaaaccaacattttgtttcattcatcttttattcattttgttttcattgatttttgctctgatctgtattatttcttttcttcttctgattttgggtttggttcactcttgctcttctagttctgcaagacacattattagattgttcatttgaagtttttattcatttttgacgtaggcatttatagctataaacttccctcttactattgcttttgctttatcatataggttttagtatgtcatgtttccattattatttgttttaagaattttttcactttctttcttaatttcttcattgatccacaggtcactcaagagcatattgcttaatttcatgtatattatagtttcaaaaattcctcttattattaatttctagttgtattccattgtggtcagaaaagatacttgatattatttaaaatttttaacattttaagatgtgtattttggcccaaatatggcctattcttgagatgacctatgtgctgaggaaaagaatgtatattctgcagctcttggatgaaatgttctataaatatctattagattattcagtccattgtgcagattaagtctcatgtttctttggggattttctgactggaagatctgcccaatactgaatgtggtgtgttgatgtctccagctattattgtattgggatgctccaggttttggtgcctatacatttaaaatggttatacccgcttactgaattgaccctgttatcactatatagtgaccttctttgtctcttctgaaagtttttgtcttgaaatctattttctttaagtatagcaactcctgctctagtttggtttccattgtcatagaatgtctttttcatccctttatttttagtctatgtgtgtctttataggtgaggtgtgtttcttgtagacaacagatcagtcgatcttgttttttcttccagtcagcctctctatatcttttcattggagagtccatttcattttcattcagcgttaatattcataagtaaagactgactcctatcattttgttatttgttttctggtcttccttctttcttttcttcctgtcttcctctagtgaaggtgatttttatctggtgatatgattattttcttacattttttttgtgtgtatacatagtatgttatgtgtttttcttgtttttttttttggtttgaggttaacatgaggcttccaaatactgtctcataattccttattttaacctgataacaactttaacactatttacctaaacaaacaaggaaaaagaaaattaatgaaaactctacacgttaacttcacattttgttgtttctatttatatcttattgtactatgtcttgaaaagttattgtagtttgtttaaagactttagttttgcacctgatagtgatgttgacaatgctataattaattataaattgatattgttttaaagttattatatgtaataatgaaaacattacatcttttgaaaatgtaagataaatctgttatatttctttctttgttttttattttaaacctatatgtctatggttttaaagtgctccaatgttaaaagctatttatttcaataaatgtaacaaaaacagtccttaaataaaaattggactatctccttggcttggaactagatgccttccaagcccagcttaataaaaaccaaaattgcttgggtttattctctgtgcaaattaaaaagaaaataaaagatcaaaacaattttaggaacttcttagcaccaaaggcatgaaaattgtttcacagtgcaaaaattagcagtcctatagcagataaactccttttcaaatacaggatatcattttctcttgaatatcatgtgcattgtatccagacttggtgctatgtgactattggttttgcaaatttgccaaaatcctaagggcatttcagttgactttaaattaattttttaaacaatttttttttcaatttcttctgtactcaagaaagtctcagaagtctatcttaagaagtcttaagtatgcattatttactactcacattattattggaattatttttactcctaattggccactaaaatccttaatgtttgaataatgtgcataaagcatcataaaatctaaaaaatattatatgagtatttcttgtttaatgcatgtgttactgatattatgaaaatacttgtttactgaaaggctttttatgtcaggaggcatctatatgttagagaagtcacacatggccttagtacttgtccctttctctcatcatctttcttattaaccccacgggtgatattattctctactattctttgggtacagaatatatatacatcatttcctttccactggaatgtaatctgccctgtatgccatcacaagaccttcataatttataaatccatgctggagatagaaaattgtttatctgggtttggtgagtcatctacagtttgcttttggttatcctgattagaaagttcatttgttctttcattctaactttgtaggatagaataagttaattggcctgtgttccagttaaattaaatatattgagacactttattttctcagtgtacaaaggactacttttttataacctttcaaactgagaaaaatcttaaagatattttcaaaatggatgcaaaattgttcttagtgcttataatctggatgtctttaaagctaataaatagattctaacttattataacttcatctgtaaaccaaagtaattcctgaaacatatatgtagcatcttgtatgatactagttattataaaaaaagaaatgattaaaatataagcctgcttacaagaaacttacgttctagttgtccaaaggtaatgtattcatagatcatcacaattcaaatcaatatctgaaatgcattacggcagggacagactgtattaacagtttagagaaggttgggttcatttttggctctttgtagatatggcttgaggagtaatggaaagatttaggaaatagggtaggttttgctttagaggtagttggtgaagacaaatgcatttttcaggaccacagctattcttttttaaggcagtaacttgctcaggaagatcttcattgatttattcagaatttacattgttcttttgttcattgaaatgttgaacatatctgagttcaggggcattctagccagactaaggcttcattctgagagcattgattttagaccagtaatctaagatgtttttgttctgcagaggattacaaatttcaccagtaccacactccacacatttcactttattttatttttatttttggcagcaggagtggggtgtgtgtgggggacagggcagtggggttggagtgaaggatagggaattagaggtcgatgcaaaggtgacatgttttggaggtagaactctgagttatttatcagcctgagtggcagcttgccctataaagtataagcagctatagcaacagctaaatacttcatgattctaaagaaagacaagattggtcatccttgcattctacatagctatataactttaaatagagaaatgccaaattgaaacatgagctgagaagagacacagcatacatgacttgagaatacagaggaaaaactaaaatcctagatggttctgttattttttaataaaatattttgaaataattttagatttacaaaaactttacaaaaatagaacaaagtattcacatataccgctcatctagtttctcctaatgttaacagtttatataaccacaatacaaatattacaatataaggcaattaacattggttcaatatcattaactacagaaagtattagcatttcactagttttacactgtaatgtcatttttctagtctaatgtccagtccaaagtcctgcattgcattcaggtgtgtccctttagtctccttcagtctgtgttgttcttcagctttcctttgtctttcataactttgatgtttctgtattacttattttgtagaataatgtgggattattattcaatttagcgttgtctgatatcttcttacggttaaactgatgttagcatttttggtaggaatatcacagaagtgatattatatcctcctcagtaaataaatttagggactatatgatgtcaatacgccatattaccagtgatgttaacgataaacatttaattaggatgatgtctgccagattccccccttgtaaggcatgctgtttttccctttgtaaccaataaatatatattgaaggagatattttgaagctatgtaaaaaatcctatttttctgcaaatttttgcccactgaatttagcattgatcatgcctataatgattaaagttaaaaaaatagttagacagatactattgatatgtatgtaaactgattccccccaaaattacaatcccagttaaattttatatagagagtagtagttggaaatatactgctttgaaagaatcattgctacctgaatgtactaaatcttaaagtataatttttgtaattcttttataactgactctgaaattcccagttttgtagcaactaaaagtataggcaatggttgtaagaaggaattttatttctgtaaagtatcgaacattgttttgcatataacttttattgttttttataaataatgtatgttagacctttttctggcttcgtaatttttttattactagtttatcttcttttattttattattattattatttttgagacagagtctcactctgttgccaggctggagtgcagtggtgtaatctcggctcactgcaacctacacctactgggttcaagtgattctcctgcctcagcctcccaagtagctgggactacaggcacccaccaccatgcccagctaattttttgtatttttagtagagatggggtttcaccatgttggccaggttggtgtcgatatcttgacctcatgatccactcacctcagcctcctaaagtgctgggattacaggcatgagccaccgcacccagcctagtttatctttttattcttttgtttttatttttaattgattttattttttaaaaaaatttactttagattcaggggcacatgtgcaggcttgttatataggtaaactcatgtcatggaggtttgttatacagattattttatcacctcggtactaagcctagtacccaatagttatttttttccttatcctttccctcctcccacctcccaccttccagtaagcccaagtgtctctttctttctttgtgtctataagttctcatcatttagctatcacttataagtgagaacatgtggtatttggttttctgttactgcattagtttgctaagaataatggcatccagctgtatccatgttcctgcaaaaggcatgatcatgttcctttttatggctatgtagtattccatggtgtatatgtaccactttttctttattcagtttgtcattgatgggcatttatgttgactccatgtcttggccattgtgaatagtgctgcgaaaaacatacacatgcgtgtgtccttatggtagaatgatttatattcctttggttatatacccagtaatgggattgctaggtcaaatcacatttcagattttagctttttgaggaattgccacactgctttccccaatagttaaaatcatgtacactcccaccaacaacgtatgtgttcccttttctccacaatcttgccagcaactgttatttatttatttttctttttaataacatccattctgagtggtctgagatggtatctctttgcagttttgattttcattaatctaatgatcagtgatattgagctttttttcatatggttgttggctgcatgtatgtcttcttttgaaaagtgtcagtctgtatcctttgcccactttttaatggagttgtttggtaatttttttttgtaaatttctttaagttccttatagattctaaatattagacctttgttggacacataatttgcaaatatattatctcattctgtagattgtctgtttactctgttaatagcttcttttgcttttcagaaactcttaagtttaattggatcccattagtcaatttttgctttgttttgcaatgacttttggtgtctttgtcatgaaatctttgcctgttcctatgaccagaatggtattgactaggttgtcttcaaggtttttgtagtttttggttttacatataagtttttaatccatcttgagttgatttttgtatatagtggaagaaagatatccaagttcaaccatctgaatatggctaaacagttatcccagaaccatttatttgatagggagtcattttcctattgcttgtttttgtcagctcttttggagatcagatggttgtagttgtacagctttatttctgggctctctactctgttccattggtgtatgtgtctatttttgtaccagaatggtactgttttggttgctgtagccctgtaatatattttgaagtcaagtaacacgagctctcctgctttgttctttttacttagaattgccttggctattctggctctttattacttccatataaattttaaaatagttttctcaagttctgtgaagaaagacattggtagtttgatagcaattgcattgaatccataaatcgctttgggcagtatggccactgtaatgagattgattctttccatccatgagtatggaatgtttttcagtttgtttatgtcatctctgatttctttgagcagtgtttgtaattctcattgtagagatctttcacctccctggtaggcttttttcctaggcattttcttcactttgtagcaattgcaaggttgtgaatgggattgtgtttctaatttggctttcaggtgtgctatttttggagtatgggaatgctagtgatttttatacattggtttttgtaccctgagactttgctgaagttgtttgattggctgaagaagcttttgggctgagattataggatttcctagatatagaatcgtgacatctgcaaacaggaatagattgacttcctctcttcctatttggatgccctttctttctcttgcctgattgctctggccagacctccgatactatgttgaataggaatgatgacagagggcagtattcaagggaaatgcttccaggttttacccattcagtataatgttgactctgggtcagccatagattattttgaggtatttcttcaatacttagtttatacagagtttttaacacaaagggatgttgaatattatcaaaagattttctgcatctattgagataatcgtgtgattattgtccttagttatgtttatgtgattaatacatttattgatttgtgtatatttaaccaaccttacattgcgaggatgaagcctacttgattgtaatggattagcttttcgatgtgctgctgaattctgtttgcaagtattttgttgaggatttttgcatgaattttcatcaaggttattggcctgaagttttttctatgtttgtgtgcctctgccaggtttggatatctggatgatgcgtgtctcagataagttggggaggagtcccttctcctcaattttttgcaataattttgttagaaatggtaccagcttttctttgtatatctggtagaatttggttttgtatctgtctggtagtgaacttttttggttggtaggctatttattactgattcaactttgaagctcattattggtctgttcagggaatcagttctttctggttcagtcttgggaggatgtatgtttccaggaatttatccatttcttcttggttttctagtttgtgtgcttaagtgtgtttatagtagtttatgatggttattttttatttctgtgggatcagtggcaacatcccatttgtccattttaattgtgtttattttgatcttctctcttttctttattagtctagccagttccccagcagtctccaacctttttggcaccagggactgatttcatagaagacaattttcccacagatggtgaaggtgggggatggtttcaggatgaaactgttcctcctcagattatgaagcattagtcagagtctcataaggcacatacaacctagatctccttcatgagcagttcacaataggttcccactcctatgagaatctaatgccaccactgatctgacaggaggaggagctcaggtagtaatgcttgcttcccagctgctcacctcgtgttgtgcagcccaattcctaataggccacggactggtacaggtctgtgacctaggggtcaaggacccctggagtaccctctctatcttatttttttttccaaaaccaactagatttgttggtcttttgaatggttattcatatgttgatttatttctgttcagctttgatgtattggtatatctcatctcctgctaacactgaggttgacatgttctttcctctcttactctttcagttgtgatgctgggtttttaatttgagatttttctaactttttaatgttagatgtgaatattcagtgctataaatttccctcttaccactgcctttactgtgtcccagagattctggtatgttgtatctttgttctcatcagtttcaaagaacttactgatgtctgccttaatttcattattcacccgatagtcattcaggggtgagttgtttaatttctatataattgtatcattttgagtgagctttttagtcttgatttctatttttattgtggtgtggtctgggagtgtttggtatgatttggactcttctgcatttcttgaggattattttatgtctgatagtgtggccgattttagagtatgtgccatatgacaataagaagaatgtatattttgttgatatgggtggagagttctgtagatgtttatcagatctgtttggtccagtgttgagttcaggccctgaacatatttgttaattttctgccttgatgatctgtctaatactgtcagtacaatgttgaagtctgccactattcttgtgttggaatcccagtctctttttaggtctctaagaacttgctacatgaatctgggtattcctgttttgggtgcatatatattcagaatagttaggtcttcttgttgaattgaaccctttaccattatgtaatgccattctctgtctttttttatgtttgttgatttaaagtctgtgttgtctgaaattagggttgcagcccttgcttttttctgatttccacttgcttggtagattttcttccacccctttatttttagcctgtggctgccattgcatctgaaatgggactcttgaagacagcataccactggatgttgctttttttatccagcttgccattctataccttttagatgaggatacttagcccatttacattctgggttagtattcatatgtgtggatttaatcctgtcattgtgttgttagctggttattacacaagcttgtttctgtggttgctttatagtgtcagtggtctttacgcttgagtattttttttataatgactgctaaatttctttcctttccatatttggtgctactttcaacatctcatgtaaggcatgagaaggaaactttgagggtataaataaaaacagagtttacatcttttaagtccttttcttcctgatgtaagatccagcaatctacaaattttaagtgtacaatttgatgaaatatgtagaaacacccatgtaatccacacccttgcttagatagcatttcattccccattaccacaaaatgcatcactggtattcccaatcaaacccctggcccctgatgctgccgttgttctgcctttcttttacaacatattagatctgcctattgtagcagttcataaaaatggaatcacatagtgtgcactatttttgtcgatctgcttttgttaagcataaaactttgatattgatccatgttgaatcaaatatcactagttctctctttattttggagtattattccattttaattatttacctgaatttttaatatccattctcttgttggtggatgtttgagttgtatccattttaggactatggtgaacaatagcctctataatattcctatgtaagtttgtttgtttgtttgcttttatggaccttttaaaaattttttcttgggagtgcaatttttgaattatatattaagtgtatagtaacatgctgatagattgctaaacagcttaacaaagtattattactatttttatatttctgccattattgtatcagagtttcattgctacacatttattgccaacataaggaagtgacactcattttaaacttagctttactttttggtatgtaatggcatcacactgtggtttaatttgcatttccttgacaacaaagatattatgcatctttatgtgcttcttagctgttcatatatcttattttgaattatctacttaagtctttgctcatttttataattttttattgttcagttgtaggagtactttatatattcttcgttaaattctttgtcagatatatttttctaaaggcttttgcccaatcagtgatttatatatgtatggattttatttttatttttttactttatatagtgtaaaagttcacacttattcagaattgaataacagaagtctacatgagctctctgaagcaaaaatggtgggctttgagaacttaccattaagaatataacatgtattagagactaagaaaagagaaatattatggctttcaggaaataactataacaattgatttgacaggatgacaatccgtttccctgtttctgtcaccacatctttctctgacattcttcttctgcttccttctacttttaaggaccattgtgattaccttgcacacgcccagatattctaggatagcatccatatcttaaggtgagagtttactatacccttaattccactgggaatcatagttcccttttgccatgtaacataacatactcacaggttctagggattacaatatggacatctttggaagaactgtttctttgcccaccacgaatgaatttatcttctctaagaaaagactgctaataattgaatgcctccatttatgtagttgatggtggcaataataactgtattaatggtttttgataatatctttaggaggaagaattttaaatataagaatacaaaataagttctggaaggattctggttaaccttcatggcatttttgaaatgttattcctcaattaattataaaagtccaatgagaatgaggacctatttcaatattttgaggtagttatcataaatagatatgagctttcttttttttctacttaattttggcattgaatgcattagaaagctcatatatttgcatgacccatggttctatttgtgacgaataagcagaatactgaaaaaatattggcattcaggtagaaaaggtgaattaggataataatatttcaagtcaagaaaatatgtcatactcaagtaaatatgagtaattaaatgtgattaagtgtaagatgtaaattatgtatctagagagaaagctagaaagacaggaacccagtaggggtgttgttacaaacaggtagtttagacagttcctcttaaaagagtttcactttgttacaaacaaggtgttcttctccaaaaggtcttcacttccttgtactgtctgtcctgaagtcttatttccctgttctttgtctaaaataatcttgcctgacaatctgtcagcccctccttccctgctgttctcaggcatgcccgccaagaaatcatcacctccctccctcctgtagcagcttttccccaccaaaactgatcttcccaccttcccaccagtgtaactgcattcctgtacttttcaagttagcaaaccgtgttcagcttagattgtgtggtccaaccccagccaatggagggaggacatagtaacagggacaagctgtgttaagagataataaaaacccctgctctcctttgttctgtatgctctcgccattgctccatctgtgagttgcacccttctatagaagtaaaaattgccttgctgagaaaattaaatttacgttccagtgctatttcttctgtggcacctaaaatttatttataacaggccatgcaaaattattgtatttttcatctaaagtcaatgtgattcactgaagagttttaaacaggagggttatttgataagaattagtatttttgattgatttataatctccttaaataatattatcttttttctcacccatatgtgtagtgtaaatgttgaaatgtcattggacccagactacatattttaaaatgtagccaatagcatctgtcaatgtattgtacatagtatgggagaaaaagaaaggtcaatgatttcatgggttgaatctgagtaatttgaataatgaaactaaaattaactgagttgaggaaaagaaaattcttatttaggaactagaatgatcagaatattattctttgtcagtttataatttaatgcattgtaggcaaaaatctaaatggagatagtaagcaataccaagatgaaagaatctgaatttcaagagaaaggtctaaggtctgagcatatatttgggagtcattagcatataaagattttttaaaaccgtgacatcagataaggtatttaagcatataagtgcagaatagaacagctagggcctgaggcactgtaacatttaagagcttctctgagaggaagaagaacaaactaaaaaggatgaggaggagaagatcctgatgtagaaaaaaaaccctgagaatgtgctgtcttgaagccaaatcaagaaggacaacatgattaaatgctgcagataagttaagtaaaatgaggcctcaattgacccacagaactaggagcatggatataattaataacttttataataattagtttaatgaaatggtattgatgacagcctgtttagaggggctcaaggctaggagacaatgtgataaactatagatcactctttcaaggtgttttatatgaaagttatggtaggcagaattctgagatgactgattattttgcctaggtggtgtacccgttctgtgtcatctcttcttgtcgattgtggagggaagtgtgaacacgatggatttcacttctgaaattagattagattagtttagatgaaaaaggtgaaaggattttgcatatgtaatcatggtaccaagtcaacatactttgagttcatcaaaaaggagattatccaggtggccctggtgtagtcaagttatctttaaaatggatgaggcccctcccgaaatcagagattcaaattgtgagaaaaatccttctccttgctttgaagaaaaagtaaactgacatgtaaggagagggtctgtgagaagtactcttcttggaggttagagggacttccaaccagctagcaagaaaatgagtcctacaactacatggaaaggaattctgacaggaagtagtgagcttgaaagaggatcctgatgagtcccttccttatatgaaatcatagtctcaactgacatcttgattttaacccacaaagattccaagcagaggaaccagttagttcctaacccatagacattgtgaaataatcaatttgttttgttttaagccactaagttggtggtatttttaagtgtagtggacaattcatataaaaataattcagaaaaaagtaccattagctggagaagctatggaggtcacaagggtttttctttttaatttgccagtatgttgacagtaaaatattatgatgcaggaagtaaatgatttgatataatgcacaaattgatgagttgactttacatgtacaatttataaaatgacagaaaagaaggcagaatatgtgggtacaaatagtagtaggttataatgtatgtaacataatttatttaatgacatacctttttcatttagattgtttccaaactcttgctctcctaagaatgttgcaataattaacctagggtataaattatttaacatatatgtgaatatatctgtagagtaatttactagaagtagaatcctgggttaaaggcacatgcccagtttgaaagcatttacaagcaagctcttcagtggcgtttggattatgcttccacactttcatatttttgctgattacatacgtatatacatacacacacacagacacatatgtacatatatgtatgtatatacacacctatacacactttaattgtatttcttatttatgaattatattaggaataggaatatttcatatcattaaaagcagtttgaatttctttttgaaatgaatgtttatatacattacccattttgggggtaacctttttctttatgtataggtagattagtcttctctatgatgagttaaggcatttttcctagattataatttttgtattattattactactataatttgctatttttaaagtaatcgaatatattatatttaattttgatatgatttctatattatgtgtcataatttagaaagaccttactcggagattataaaagtaatcccaatgttttcttctgggttttaaaaatgtaaccattttaatgtacatatcttttgtatttagaattcttcttgggatattgaaaggagtatggatgaagagatttttacgcaagttcctcaacttcatttattgacaaatccatcttccaaatcactgtttcattgatgaatatttccttatttcattaatttctatttctatatttagttttctcctcaacttatctttatttttcctaccttctggagtataacatttagctgatttattttaattttccacatttttaaaaaattttactttaagctctggtatacgtgtgctgaacgtgcaggtttgttacataggtatatacatgccatgtggtttgctgcacctatgaacccgtcatctaggttttaagctcggcatgcattaggtatttgtcctaatgctctccctccccttgcccccaaaccctccaacaggaccctgtgtgtgatgttcccctccctgtgtccacatgttcccattgtttaactctcacttataagtgagaacatgcggtgtttggttttctcttcctgtgttagtttgttgagaatggtggctttcagcttcatccatgtccctgcaaaggacattaactcattcttttttagggctgcataatattccatggtgtatatgtgccacattttctttatctagtctatcattgatgagaatttgggttagttccaagcctttgctattgtaaatagtgctgcaataaacatatgtgtgcatgtgcctttatagcagaatgatttataatcctttgggtatattgccagtaatgggattgctgggccaaatggtacttctggttctagatccttgaggaatcaccacactgtcttccacaatggttgaactaatttacactcccaccaacagtgtaaaagaattcctatttctccacagcctcaccagcatctgttgttttctgactttttaataattgccattctaactggcgcaagatggtatgtcattgtggttttgatttgcattgctctaatgaccagtgatgatgagctttttttcatatgtttgttggccacataaatatcttcttttgagaactgtctgttcatatcctttgcctaatttttgatgggattttttgttttttttttctcataaatttgtttaagtaccttgtagattctatatattagatctttgtcagatgggtagcttggaaaaattttctcccattttgtaggttgcctgttcactctgatgatggtttcctttgctatgcagaagctctttaatttgattagattccatttgttaattttggcttttgtcacaattgctgttggtgttttagtcatgaagtctttgcccatgcctatgtccagaatggtattgcctaggttttcttctagggtttttatggttttgggttttacatttaagtaatgtcctctcttatttccttgagcagtggttactaatccatcttgagttaatttttgtataaagtgtaaggaagaggtccagtttcagttttctgcatatggctagccagtgttttcaacaccatttattaaatagggaatgctttccccactttttgtttttgtcaggtttgtcaaagatcagatggttatagatgtgtggtcttatttctgatgtttctgttctcttctattggtctatatttctgttttggtaccagtaccatgctgttttggttactgtagccatgtagtatagtttgaagtcaggtagcgtgatgcctccagctttgttctttttgcttaggattgtcttggctctacgggctcttttttttccatatgaaatttaaagtagtttttctaattctgcaaagaaagtcaatggtagcttgatgggaatagcattgaatctataaattactttgggtggtatggacattttcatgatatagattcttccaatccatgaacatggaatgtttttccatttgtttgtgtcctcttttatttccttgagcagtgtttactaattatccttgaagaggtcctttacatcccttgtaagttgtattcctaagtattttattctctttgtagcaattgtgaatgggagttaactcatgactggctctctgtttgtctgttgttggtgtataggaatctttgtgacttttgccacattgattttgtatcctaagactttgctgaagttgcttatcagcttaaggagtttttgggctgagatgatggggttttctaaatatacaatcatgtcatctgcaaacagagacaatttgactttctctcttcctgtttgaatatgctttatttctttctcttgcctgattgccatggccagaacttccaatagtatgttgaataggagtggtgagagagggcatccttgtcttgtgctggttttcaaagggaacgtgtccagcttttgcccattcagtattaattttccacattttaaaataaaatttctctattacatctttgtgtgtatcccacaaatttagatatgtgaagcctttgttgtcatttaatcataaataattcatatttttaacttttattttctctttaagattgtggtaaaaagtctccaaaatagcccccaaagatttctgcctcgtggtatttatgtccttataaaaatttcccttcctgtgagtgcatgaggaaggaggaaggtagccactcccttcaaacgattaatcattgggaagctatagatgccacttctgagattaggttacaaagagactttacctttgtcttgctcactctgtctagctctcttgtttgttcattctgagggaagccagctgtcatattgtgaacttccctatctacagaactacatggcaggaaatgatgtttctggcaaatagtgagcacctgaagattaccacagtcacatgagtggacttgaaagtgaattttctgagacctggggataactatttgtgtgaacttgaaaacaaattctcctctagttgaacccttaggctttcaacttttattattatttccaactttacttacattacgaaactactatccttaatgtattttaagtttgttttatattttgtatttttttaattacctttttctgtactctaggaaattcttattgattttacagctcactattttacttctcatctttcttcagtaagctaggtagtaaatcgatttaaatatttcttaataacaatttctgcatcataacattttattcttgatttgattgctttcacttcttcactctatagcagacattaaattgattttttaaagttcttttcagattgttctacttcactgtatgtcctgagttataattctttattttgttcagcttgggtttccctttcactgtgttgcatttcctttagtactttgggattcttggttgcaaggttatcttcccacatatatcactttcatatctagagaacatagttatttcacaggtgttcaggtttgttctttcataacacaaggcttccaaagcacgctttgcatgaatcacccaccattgggttcttatcccatctggaaaattcatttctggacttatttaatcaaatgcatgatacaaatctacatctgcttcacacataagagatcctacttgagtttccagcaaacaaattttatccttgtccttcattgtgaaacttttatgaatgcttcataaaaacaataacaacaatcaatcaaaggttctgttgcattggccctcagtcccttgatgttgatgaccagaatgtttaataaatatagtgctttatttctagtctatgggaaagtttttccatctgttatcactgttactaattctaaaattttctacttctaattttagtgcattcatgattagaaagataggtggtctttttgaaattatgacaaacacagtagaaaatactgagctaaataagtgcttccttggtgatgtcatttggctgtgtccccacccaaatctcatcttggattgtagttcccacaattcccatgtgttgtgggagggacctggtggtaggtaattgaatcatgggggtgggtctttcccatgctattctcctgatagtgagtaagtctcataagatctgatggttttataaaggggagtttccctgcagaagttcttttctcttgtctgccaccatgtgagatgtgactttcaccttccaccatgattgtgagtcctacccagccacttggaactgtgagttattaaacctctttcttttgtaaattgaccagccttgggtatgtctttatcagcagtgtgaaaatggactaatacgcttggtgaatagtcaaatcaagtgttaggttaaatgaagtcaaatcaaaagatgtacacatatcacatctccttgtgttattataggcctttcttgattattaagttctcattgatgctctggattgctgaatatacaggataagtgaccttcagataagaaagatgttactgctttattttctcttcataggacacttgagacatgattaagccatgaatgaaaggtcaacatagtttctactgtaaaaataaaatgctggcatattttcattttcatttttattcccataatattgaatgaagattgtttataagacacatacacacatgcacacacatacacaatttatgttattctaggttctgaacttcagccgagacacattggctgaaatcctccttagcttactcaaatattggctgagacgataatttgtcctcatttgttcagtagtaattcaatcataattttgcaaatttgtcattaaaaatctatttgtaaaggtatttaatggctataagaatagttaaggatcagctcaaccacttcattttagtcacctctttactgaatcaatttcagatgatgcaaggaccttgaggcctagtaatgaatgcttaagtaaggactgtgagcacatttagtccttaaagtgaagaaatattaccacttagttacacttaaatcagaaaaaaaacccatgaataaagattaactatcttttactttttcaccatttgtgagcagtaatagttagctattattacatcactctttgctaagatgcttacaattcctttatacttataaatcaatgtaatgtaagttggactttagaagtaaataacgtctctggttaaaatgaaatacagagtgtgttgttcaacagaggagtccacagaaagggaaactctaagtggtaaaaggagcttttcaattggtttccttccatccttttccccttgcttggtctattagtttttttgggctgcagtaataaactactacaaagttggtggcttgaaaaataggattcgagtctctcacaattcaggaagccagaagtccgaaatcaaggagtcagcagggttggttgcttctgtcataattccactccatcaaaatgttaccattttaccataagactttttgctattcaggctctgagggaaaaactgtcccatgcctctctcctagcttccggtgtttgtccacagtccttgaaattccttggcttatagatacatcactccagtctctgtctacattttcatatcactgtctattccatgtcttttgtgtcctttctgtcttaaaatggcacttaggttgagttctgagccaactctaattcggtacgattttatcttgatgcttataattacatttacaaagaccaaatttccaaataaaatcacattctggggttatgagtagacaaaaattttgggatgacacaaaatttaactgactatacatgagatttttctttcactgttatcaccaacactggacccatattttctgtttgtgtgtatgtgtgtgaatccagcctcactcttttagtacaactctgcctccttggctatagctgattggctgagtttaaaacctaagtagtctatgacaataagcacccctcaactgggaacttaaaattgaattaagaaatcccaactctattgtaatgaaggagttgtaaataagagctttgagtgatcactttcagccgtgtggaccaaattaaaaaatagttggcacacagagagagaagaatgatgccaagaataacaagaaggcaaaagccagagagggaagaagaatttccctttcttgttctgattttcagtctctaatacattgtttaggtcttataatcaacctcccaaaaccatcttttgctcttgaaagtgaagtttcttacttgatcctgaatagatctaaactttttttttttttttgagatgaagtctcgctctgtcggcccaggctggagtgcaatggcatggtctcagctcattgcaacctccacctcccaggttcaggtgactctcctgcctcagccttctaagtagctgggattacagttgtgtgccaccaggttcagctatttttgtattttttgtagagatggggtttcaccatgttggccaaactggtctcgaactcctgacctcaagtgatcctcccacctcagcctcccaaaatgctgggattacaggtatgagccacttggcctggtcttggtctaatatttcatggaatcctagtataaatattgacaaatattatatatgtgaagcatatgcctgtggccagctagggagaaagtgaagttaagtgaaacttaaaggaagatgcaaaccgagaatttagtctaagcctctcagaccagtgacatctcattctagaaatgtgatttgcttggtgtttggaaggttctcttcttttttcattttctttatatatctcattctttgtgatatacacacacaagttagcccacagactgctagcagagctccagaaaggtgagtatttatctgtttgatataacattaaaaatatttacaaatacaaatactatgaaaattatgctgaacataatgggaggaattgttaatattttatgaatcctcaaatatgtagaatgactcacaatcattacaacatatctataattcaacagctgactaattacaagattctattaatatcatgaaacagtatggagaatcacatgtatgccaggcttcaacatatgaagcttacaggatatagtaaagacaaaattggaaatcttagggaatgtggcagtggccaaattatggaacataaaaaactaccttcaaaaataatggttaagatttattgaacactcagtatgtgcctgataccatcgtacaaatttctgttttaattcatttagtctttaaaataacccatataagatgattatatgttattctcatttcttgatgagaaaactaaggcatcaaatggttaagtgaatcattgatatcataaaactgggaagtagtgggaaaaatattacagcctagtcagtatctctcccaagcctgagtatataactgttctaatgatcttacatatctgataaggagtattggaatttccagtttactctagctgataagtcttcccagagtcttaccatttaaacttagtctttaagtaaggaatttattaagattaaaaatttgagtaggtgcaggctggaaggaaggaaaaacaggtgtaaaggcacaaatagtgaacaatagggggcatatttttcaataagaagaaaatggggaagaagatttaagctcactaatgagaccaatatggacaaaactgatggtaaacaccaataactgtaagctatgttttaaaaatgttttatttatttgtatttccactgcattcatagtattttaatatttttacttttagtgtcagtttagtttaatttctatttttaatttagcaatccttactttaacagttagctataaaatgaacccaaaaagcaatgcatgaattcaacatacttgtattctcctattggacatgcttagtagaaagagagttctaatatttaaaaatgtatttagtgtttatattttaattataatgcatttcaagtaaagaatattatgcattatctttttacactacaaaaacttttccacatgaatacacccgtataagcagcacccacatcatgaaatagagcactaccagcctttccaaaagcccctctgagtactctctcagtcactacattcccaaaggtgtttcccgacttcttaaaccataaatttgttgtgcatatttttgtactttatataactggaatcatacattatgtactctgtgtggtttcttccactcaaccttgtgtctgtgagattagtctatgttgttgactatagtattgatcacttttaatttatgatagtccttcacttaacatttttagcaatttaaatcaatttattttaaaatttctgtcaatctattttataaaatttattttatcaggagtgggtacatttttggctattgattgggttaacttgacaagcattatatttttcgtgtatttttgaattttgtgttttagggttattatgagagaggttttctaagtttcttccactttcctttcttggtagggtggtagtgaccttaatttcctcagatcttcaggcctccaatcccaaaccaagtctccccataatatttttgtactcctactcacctgttcaattggttgtttttattttcctaaaaggattgtttcacaaccttccttacctaaagaatgtagctgttaaaatttgcatttttattgctaaatacttttggcctaagttaatgctattgtttttcagacgtgggacattttataaagctaaacatgaactccaaatagattcagtaatcaagtaaaattaaaacataaaaataaattttgttcaattctgattccttggtattatcttgataaaagggtatagataagttataacaagtaaataataccttgtgcttcaatttgtccatattactttagtgactaggaaatcattgccagaagtgctaaaaaaaaaaaataaacttagggcagagtgtattcctgcagaatttatttctaggattatagagccaagagtttaaataccaagcactaagttgaatagctctttgacctcttgtaaggacaaccccatcattttcccccatctccatgaatacaaataattttaactctagggaggctgtctttctcaattcgcaaaacaaacgaggctcgaaaatgatccattctaactcagcgcagacaaaaatgactctctgaacctcaagagatctgactcaaaacacaggtaattttccacctggctaagaggagctttctgactcagtggttcatcttgaagctgatttcttccaggagtgaaacataaaacatgtggttggttactagggtggagcaggcgtcagagcaggccctgaattaccaggattcattttctttggtggaattgttttgagagaaatgcttaccacatcttttgcctccatatcatcagtattttaatttttagaggatttgtaatgaatggaaatcttagcctccctatcatcagtattttaattattagaggattcgtaatgaatggaaatcatggtaagatttcctatgaacccagcatttttgggttattatttacataatacctctagcatagaaacttattttacacttaaacatcttataagaagccaaatgtgtacttgcaattttatgtttcaaaacaattttgttcagtagcagccaatctcacacacacaggatttagtcatccatgttctcacagaggctagtgccaagaacagtgcttgccactgatcaatttgaaattggaaatacagtcatacagtggtagtggctgtgggcattagaaagttttgaagactgaagaatttagtagagcttttcaatatgaatttttttagcatgcaaccgagatcaaaattatagtagactcattcagacacaaagagacaataggaggaaaaagaaaaagttaccatcttcccatagtcagatgtatctgtgtagctaccactcaagcaacccagatacaagatatccacagccaatttcttttttccatttcaaacatgctcttcacctatgtttctgatgtctaattgaattatcatgcaccattcaccaaataaactatcagagtagtattgttttccctttttgtaccttccctataaaccatcttcggcacaatttaattttgaagtttctctcaaatttatctcttttccctctatttttactactgtgctctcagataagattatatcctttcaggcaaccaaatgtctcagtctccgagatggcctctcttttctagttcattgtctgcactattatcagaggtgttattctatttgataatgtaaaatttcaatgaattctccatgtctatggaatacaacactcttctcagcacatgtataatctttcaacacatattctaagttccccagaagccctgtatattaaaccatcccaaattagtatataattttttgaattttccatagttttctatatttatattttgacgtttctcctatttttgcatagaaattttttctttgcatcttatagattagctcctgcccagtaaaacttcctagcttctagtatttttgatatatctctattataactgtattttatatttatatgtctctattataactataatacagtattataactgtattattctgtatttatttgtaggtttacttttctattgctccccactacattgtgacctacttaataactatctttttttaatactgttatttttcctttgattttcctactttcagaattctagtagagcctctggcaaattattggtgttaacatacatttaactgaagaaataataacttaggtagacaggggaaaaaaacaaagataaagaaaaattgtcatgttaatataatttaaatgctgagtggattacagtctagttaattattagatggttaaggacaaacaattctaggatattggtgattccatttcatataaccacataatattctatatttatgacaactcatctttgtcaattaccttttcctatgtgttaaaagatggagagatgaccgtaaattggtgccactcatttggacaaggctacaaaaaagatataaaaaggtaattgttagcatctttctatcttttaacttttccatgtctctaaagaatttgtatttgtcaagattttcagagaaacagaaccagtagaggagagagggagagaaggagagagagaggcttattaaaaggaattggcttatgtaattacggaagctgagaagtctcatgatctgcaggaccccaaaaagccaggggtatcattcagtctgagtccaaatgtctgagatccaggggagccactggtgtaaatactaatccaagggccagagaacttgtggtgagatatcccagctcgagcatgcagacaggaagcaaaaggggcaaattcctccttcctccaacttttgttctatccaggttctcagtggatgatgcacacccacattagaaggagcaatctacattgctgagttcattgattcaaatgctaatcttgttctgaaatatcctcaaagacacacgcagacatgacacttaattgggccccatgtgcctggtcaaattgacacataaaattaatcgttacagaatttaagggagaaattgcccagtaatttaatttagaaggttaatattgtgtatatttaaataaaaatgctgctcaactatacttaccatgttccctttgcatcaaggtcaaaaaagaccttgaggcagtgacgtcaccaagataagatagcagagtaaagccttcagcccccgcccccctcactcacaaatatagacaaccattcagaaaataaaatagccctgagaaggcttaagagcccatcagattatctgcagcaacacagtggggcaaaaaaaaaaaaaaaaatggagaatatcaacatagaaaaatcactgatgagactgacatacttgagataccaagagatggctaggaacaaagaagaaagtcagggactaaaaatatcagctatgattcccagcagccttcaccacagaagacacagaggacactagctttcttttccaagaagcaatcgacagccatttctgccaaggaaccccagagaaagagacaaggctaaatactcctccctccccaagaagcagccgctattgagacgcctacactccagacccaagagtgtcagaaacgcctgcactccagacccaacaactgtgtatgcactgtgcctgccctgtgcctgcctttgtttaagataccagagccaacatcttagaagactaggccccacccaaagcctaaagcccctataactctctgcatgtctatgctcccattcatggccctttgctgcctcaagcaccttgcatactgtcaccaatggcactattacccagatgcctgtactctgggcaacagtgtcattatcaccctgtaccccagagccaaagtccttccacaggtgcctgtgctttagacctcagcaccatggctgcttcacaggtgccactcgtcaaacattggtgccaccaccactgtgagtccacaagcgagacccagcaccaggaggaatccccttaattacaacttccatggtggaagacaatgagattggagggaccatagcacccatcaccaaagacctcaacaacattcactaccactatagacatccacagcattggccattgaggatcctagcaatctttgtcaacactgacctcaactgacagagctgtatctttgctggtgccagaaccactggaccccagccagcacgtgccctcagagcccccatagagaaagtctttccacagaaaaactggtctttaaagtctaaaagagaggtgacttcttcaccaaatggacaggcttcaaagtagggcaacaagaaatgtgaaaaaaaaagtgacataacaccaccaaaagaacacactgatttcctaggagctaattccaaataaacagagatatgcaaactgtcaagaattcaaaattattgttttaggaagctcagcaaacttcagaaaaaaaaattcaacaaactcagaaaaacaatatataaacaacattagatatttaatagactgataaaattcatttttataaaattaaaattctgaaactgaaaaatacaatgaaattagaaacagaatatagggtatctacagcagaatgcatcaagcagaagaaagaatctgctgatgtgaaaacactgaaatgcagaggcaaaaagaggaaaaaaataaaagaaatgaaaaaaaaagtttatggaacaccataaaaagaacaaatattcaaattataggtgttaaagaaaaagaagacaaaagcaagaggccagaaagattatttaaataaacaatagcataaaattttcaaatctggaggaatatataaatatcctgatacaagaaggtcaaaggtcgttaatcaaatttaatctaaataggattactggacaggttattacatcacactgtcaaaaatcaaagcctaagagaaaatcttgaaagcagcaagagaaaagaaggaaatcacatataaggaaattccaacaaagataatagtgaacttcatacaaggaaattccaataaagataacagtgaagcaaatcgcatatgaggaaattccaataaagataacagtgaacttcatataaggaaattccaataaatataacaatgaagcaaatcgcatatgaggaaattccaataaagataacagtgaacttcatataaggaaattccaataaatataacaatgaagcaaatcacatataaggaaattccagtaaagataacagtgaagatatcttacaggccaacaggaaaaaaggtgacatatttaaaatgaaggaaaataccacagcaaaccactagagatgattatctaacaacaaaggaagacaagagaggaaagaagaacaaaggatctacaaagcaaacagaaaacaaatataaaaaacaacagtagtaaatcctttctatcaataattaccatgaatgtaaatggattaaattctcaaatataaagacatagagtggctgaatagataaataaacaagacccaactatatgctgcctataagtgattcaatttacctttaaggacacacacagattgaaaataaaggtttgtacagagatatttcatgtaaatggaaaccaaaagagagcaaaggtagttttatacttagataaaatcgactttacatcaaaaactgtaaaattagataaaaaggataattatataattataatgaaatcaatccatcaagaatatataacaactggaaatctatatgcacctgatatcagaggacctaacaacgtaagccaaatattaatagatctgaaagaagagctaaactgcagtataatattagtaggcaacttcaacaatccactttcaacaatagtcagattattgagagagaaaatcagaaaggaaactgtggacttgagctacactttggcccaagtagacctaacagacatatacagaacattccattcaagagcagtagaatactctctgcaagtgctgacagaacattattcaggatagatcatatgttaggccacaaagcaagcctttctaaattcagatgaatgagatgataccaagtattttttttccaaccacaatggtatgaactagaaatgaaaatagagtgaattcaagaaaattcactaatgtgtggaaattacaccacgtgctcataaacaactgacaagtcaaagaataaattaaaagtgaaatttttaaaaataggacaaatgaaaatagaaacacaacatgccaaaaattatgagatgcagcaaaagcagttctaagatagaaatttggagcaatatactacattttttaaaaagtagatagaaaggaaagaaatataccaaataactttatgttaaatctcaaggaactagaaaatgaagaacaaactaagccaaatgttagtacaataaaggacataataaagatcacagcaaaaataactagagtagatattagaaagcaacagaaaaggaaacaaaactaacacttgtttttttttaaaaacaaagataaacaaaatcaacaaacccatagctagactaagcaggaaaaagcaagaggactcaaattaataaaattagaaatataagagaagatagtgaaactgataccacagaaatacaaaagatcgtaagacattatggttaataaattataggccaacaaattggatacctaagaaaaaatagataaactcctaggcacatataacctactaagatcaaattaagaagaaataaaatttctgagcaataatgaataaggaaatttaatcaataataatatctcaagagagaaaagcctcaaacctgatggattcacagctaagttctaccaaatattaaaaaaaaaaacaaaactaatactaaacattctcaaacttttccaaaaaattgaagataagggaatacattcaacctcattttataaagccaacattattcttgtaacaaagccagacaagggcactacaagaaaagtatccatcagtatccatgatgaataaaggtgcaaatacaatcaacaaaataccagtgaaccaaattcaacagagtcttaaaagtatcattatccttgatcaacatatacaaatcaaaaaatgtgatacaccacattaacagagtaaaaatcaaaaatcataaagtcatccaaatatatgcaaaaacacatttgacaaaatgcaacagtttttgacaaaaaatctcaataaattagatacagaaggaatatacctcaacacaataaaggccataaaacagaaactcatagctaacatcacacttgatggtaaaaaatggaaagtttattcactaagattatgaacaacagaagaatgcccactcttaacacttctattcaacatagtactggaagttctagccaaagaaattagacaagaaaaagaaaaaagtttcttagttgtccaagttagaaagtaaaaggttaaattatgtatgtttgttgacagtatgatcttatacattgaaaaccctaaaggcctctccaaaaacgctgttagaaataaacaaaatctgtaaagccatagcatataaaatcaacatacaaaaataatagtgtttctatatactagaaacaagccacttaaaaaactaagcaagaaaacagtctcatttacaatagctacacaaaataaaatatttaggaattgatttaaatgacataaaaatcttcacactgaaaactggaaaacattgatgacaaattgacaaaaagaaatggaaatatatcctatgttcatggactgggaaaattattattaaatttccattctacccacagcagtgtacagatttaataaaatccttatcaaattccagtgaaatatttttcacaggaatagaagagaattctaaaattcatgtggaacctaaagacacctccaataaccagagaaatcttaagcaaaaagaacaaagcaaaggcttcacactacctgactgcaaaatctactacaaagctgtagtaattgaaacagcatgatacttgaataaaagcatatacatagaccaatgaaatggactagagagcccagacataaactcacacatttatggtcaatttatttttgacaaagatgtcaagaacacacaatgggaaaaggagagtctctttaataaatgattctgggaaagctatatatccacagtcagaagaataaagttagacccccatttcccatcttgtacaaaaatcagattaaaattgattaaatactttagagtaaaactgtaaagatatttggaaaaatgggaaaaatattatgacattagacgatgtttggagtatgagtcccaaagcacaaccaacagaagcaaaaatagacatattggattacattaaaaattttctgcatagcaagtgaaataacagagtggagacacaacctatagaaagggggaatacatttgcaaaccacatatcaacaacttgaatgaaaactaggcaaagaaacttagtagacatttttttccaaagaacacattaaaagaacaaatatatgaaaaggtactcaacagcactaatcatcagggaaatttacattaaaatcataatgatatatcatctcatacctgtttggatggcaattgtcaaaatgtcaaaagaaaacaagtattggagaaggtatatagaaaagagaacccttgtatgctgttgctggaatgtaaatttttacagctattatggaaacagtatggaagtttatcaaattattaacaatagaaatgtaatatgacataggcattcctgttttgggtatacacccaaagaaaataaaatcaggactttgtagagatatctggactcccgtattcactgtagcactattcacaagcgccaagatatggaaacaaactaagcatctattgacagatgaatgcataatgaaaatgtggtatatatacacaacggaatgctattaagcctttcaaaaaaggaaatcttgtcatttgtgacagaatgaacctcctgggcattatattcagtgaaataagccaggcacagaaagataaataccaaataatctcacttatatatggaatctaaaaaagttgaacctgtagaaacacagtaaaatggtggttgccagagactggaggtgaggctttgtagacagttgtggtcaaaggacacaaaattttatttagataagaggaataagttcaagagatctatagtacatcatactgactataattaacaatatattgtatattttacaattgctgagagtagacttttgtgttctcaccacaaaaaaaatgcaagttagtgcatatgttaaatagctcatttaactattccagaatgtatacatatataaaaaatcatgttgtacaccacaaatatatatgattttacttgtcaattattagaagaaaagactttgactttaacaagcacaagttaggaaatgatgagtttccatatataccaaaaagacaaatacaccttgctatatttataatctgtttatttagctctgtctgtagtaggacataaatgtctgcatgattttatcttcatcattatgttttaaaatgcattaaatgggaagacaatatttccaaagattctagcccttacctataagctcttaattttattcatttcataatgtgctcttgaagcaaacagaaaatcaaaattaatgagaagctttaaaatttcatgtttgttaacataattttaattttcaaatttaaagtctgtagccactcagtgcttttttttttgacaaattagtgtcaagcaatagagtgactttggtggtggtaaaatataaatttacacagaaatgcttggcattgtcactcttttattacaatatcagttcatcatcttttacgtatttaggttttaattgcattggaaggtagtgtttctagttatataatttttctcacaatatatccaggtgcatgtttatattatcagctgagtttatattcttctacagatgatttttttctacttcagatgaataccatatgggtgctgcagtaatgcgtttgtgtgtgtttgtgtgtgtgtgtgtgtgtgtgtatatgttttgtgtaaactttataattttttttttttattttactttaagttctgggatacatgttcagaatgtgcaggtgtgttacataggtgtaaatgtgccatggtggtttgctgcacttaacccgtcatctagcttttaagccccgcatgtattaggtatttgtcctaatgctctccctccccttgcctcccaacccccgacaggccccagtgtgtgatggtcccctccgtgtgtgtccatgtgttttccctgttcaactcacacttatgagtgagaatatgcggtgtctggtttttctgttcctgtgttaggttgctgaggatgatggtttccagcttcatccatgtccctgcaaaagctttgaatttattctttttcatggctgcatataatttgttttcattttaatgaattagcttttaatatttttaagtgaaaaaataagcctgaatagccatcagttcaactgactgctcaattttccaaaaactagagaatctgtgcttagggaacttagtcattgaaaggtatcatgctatggtaaaggacatatatttagccaggctctctgagaagaaattagaaagaaagacttcctcatcaaacctacaatttcttttatttctagtttctgtggtcttaaagagtggtatcagacacatcatgtgtgggaagcaaatcttttcctcataagtttatttcacctgtgccatagagtaaacgttgtaataccttcatgtgtatgtgcttctcttcttttcacccacagttcagcagatgaattgtctgagcaccagacaattgatttctcccacttccaacagtgtgcagagtggcattcagaatttagaggacggtgttgagtaaattcaatatttacccatttttttaaatgtctaactctacttgtcttggcggattatttcttatttaaatcaaaataggtaatcatgaaatatagaagtagccttgatattcactaaatgaaatactcacttagaagattcactgaaatcccaatctttcccctacaatgttaacattttctaaaattaaaagatagctttataattaaagtatggtttgagatgtgagtcagtttaaaagtattatttcttgaatcacttttacaaattccatttttaaaagcaaagaaattcacttcagtcattaaaaattttcaaagtattaagattatactctacaacaaattgattttctgtttgccatttcctagattgatatttacagttaaccattaaacaacacaagcttgaactacaagggtccacctctagataattttttaaataaatgtaatggaaaaatttggggcaatttgcaacaattattaaaaactcacaaactgtgtagcctagaaataaaaaaaagaaaaaagagttatgacatgaatgcctataatatatgtagatattagtttattgtatcatttattaccatcaagtacacacaagtctattataaaagttaaaatttataaaaaatttatacacacacttcaagatcatacctggtgctattcacagtggaaagaaatattaacaaacataaaggtgcagtattaaatcataactgcataaaattaactgtagtaatactgtattactaataattttatagctacctactgttgctacttttgaaagctgaatgtgataatctggcttagtcacaggagtttggcatggtgatgggcactgtgcccctactgtggcgtcacttcaatgtcattctcttctagaaaccctgcagtcagggcagcattctaatggaagagagggccctatcaagccaacgggaaggctggatgtatctgttgagtagccacttaaaatgctgcatgatactaataatctctgcatgaagagttcatctctacagtaaattgtgtatcacagtaagaaggtatctcttgtaatactcatggattttttaaatcatgtttagtgcaatgccataaaccttgaagagcaacatggggacccacatgaagtgccactagtgattctggaattgcttctaacaggcaaagtcatgacattagaagtaaaaattgaattgcttgatatgtaccatagattgaggtccatagctgtagttgctattttttgataagcaaatctaatgtaagggctatagcagaaaaaaaaagttaggaaattaacggagctgttgatgtagctataccagcaggcaacaaaacactgcactttttgcaaaatacctttttatttcatatcaaaaatgcagctttttgatatgtgggtgcatgattgctataagaaagacatacatatagactctaatatgattcaaggaaaagtgaagtcattatatgataacttaaagaaagagaaggtgaatttaatgccagcaaaggatggtttgataattttagaaagaggtttggcttaaaaaaaaaatgtcaacaccatagaagcagcttctgccaaccaagaggcagcaaagttcccagacaacattaagaaaatcattgagaaaaaaatatatctgcttgaacaagtttttaatgcagataaaaggggacagaagccacaaaagacatttattagttagaaagaggagtgggcactaagatttaaggcagaaaaggataggctaactctactgttttgtgcaaatgcatcaggttcattatcaagactggccctatctataaagcttctaacccctgagccatgaaggaaaaagataaataccagctgccagtcttttggttgtacattaaaacctagacaatgagaacgctttttctgcattggtttcattgcttccttgtcactgaagtcaggaagtaccttgccagtaaagggctaccttttaacatccttttgatattggacaactcccatggtcacggagaacctcatgtgctccatgctgaagatgtcaaggaggcccattagctcccaagatcaatgtctctaatttagcctacggatcaaggagttataaaaaccttaaggctcattacagaaggtactctgcggaagactgacaacgctatggaagagaaccctaacagagaaaacatcatgaaagtctggaaggattgcccctttgaagatggcatcattattatacaaaaagccatgaaagccactgagcctgaaacaataaattcttgctggagaaaactatatacagatgttgtgcgtgacttcataagttttatgacagttaatcaaggaaataatgaaagagattgtagatatggcaaaaatggtgagggataaagggtttcaagatatggatcttggagaaagtcaagagcttatagacataacaccagaggaattaataaaagatgacttaatggagatgagtgcttctgaaccagtacaagagaatgaggaataaaacatagaacaagcagcatcagaaaacaagttgacattagacaattgacagaaggattcagattatttagactacttttggcttcttttatgatatggactcatctctgacatggacactgaaactaaagcaaatggtggaagcaaatggtgttggagccttatagaataatttttagagaaatgaaaaagtaaaacagtcagaaagaaattaatatgtttttctgtaaagttacactgagtgtgcctatctcttctgccttctcttacacttctttcacctcttctgcctctgccaactctgaaacagtaagactaacccttttctttctcctcctaattagcctactcaatgtgaaggtgatgaggatgaagacctttatgacgagccagttccacttaatgaattgttaatatattttctcttccttataattctcttaataatattttttctagcttactttgctgtaatgccaagtctgtcctgcagactctggccaagcaatgaatgaaagaagctctcagacacagaaacccagtgaaagagcaggctaggggaatgctagcactaggggccaaagacagttagcaactccctaatctggcaatgctcgcatttatttagtacagatttaatgacaaaggcttagagtaaagacaatttgtgggtaataaacattgctgacatcccaagtagagagcagtcctgcgcacaaatgatcaaaggctggttttaggacaacagagtcattatatgataacttaaagaaagagaaggtgaatttaatgccagcaaaggatggtcatagtatagttgttactggaattatgatatgtcccatgtcccaggtgccataaagtgtcttggggtggcatggactctacttggggtctgggatatcctatccctgcatcagcccaaattataggggaactagacttggctatgaaactgtgattgatgccacaatggatgttgacatcagtatggtcactctgcaaatggcagtgggggctccagtctaagatgttataattgcctaactggaggctacgggcttgtcccctgtgacagacctcccagccaagtgaaatcaataactttactgactatgttctttagcacaggaaggaatgttgggggaagtggcattggttgcattgcctggtttgaggctacctgcaaccaagaatgttaaggcattacctttgccattatgtagccatacttaagtttgggcaggaacatggtaagggttataacttttataacttacacacggtgggaggatagtggagtgatatgtagtgttacctggcaccttagtccaatgtgtgccattaataagggaccccactgggggtaagtcagtccctcctagccaagtagttacattattagaggctgggaaaggggtgtctgcccagggaacaggccagaaaaaaggtgtatctaagagatgggcccaatagagagtagcaggtgcaggttgcaggcaaagtgagagcataaaaaggatcaatatcctatgctagttgcaatgtacaacagagagcataccaaggaacaaattatttggagtgaatggtgtctgtgtccagagcaggattttctcagcctcctgagtcatctttttcagcatcccccaggtgatgttcggggcttgtgttgtctgaggaagctgcattgtccaggactgtgggtcatgcagggacatttctttcatttcttgtaccgggttgggtcccagccatgccatgatgtggtttgatgcatccttctggaatccaaagaggacttgagggaatgtgaacataagcatatcctcttccccatgttagcaaatcatttggacgacatcatacattactatttacgtcattccacaaaactgcaggttttatgtcttgagaggttttagcaaagtgcttttctttctatagctgatttaaatttatttaaatttaataaattaagggtaaataagacttgtgctagtagtgttgcagggtccttactcatattccccctttattgttttctgagcatatttttaagggtggagtgaggatgttctactatgccctgtggcccgccccataaacgcaaaagttaagagaacatattgggtggactctccaggaaaagcatgtgtgctaattaggttagaattggtatcaacggatacatgtacatatcttagttttccaaattcagggatgtgcataacatctctttaccataactgattaggttctagtcctctagggtcaatacctatagagccaggggatgtgcctgtgagctggcaatctgggcattgcaggataatttgtttagctagtctttgggtaagttgaaatcgtttagttaagctcctccaattttggtggaaaaaattggtgcaattgggtggcttggtaaagcagtgacgttataacttgcaggtctgcgtgattattgccataagccagtgggccaggtagtgagcttcgggctcaaatatgtgtggtaaaaataggatgtgtacatcgacccagcagttgctgaagtcatggaaaaagtgcacatagggtgggcttaagaggagactaaatgaaggctgtttctaggttctgtaataaataaacagagtaagcagagtcactaacaatattgatgggctgagtggaaaaagtttccaggggcaatattaagcgtccaacctcagctctctgagtgctagtaaatccagaatgagtgagggtattatgcagtctccactaaatagccacttttccatttttaccagaaccatcagtaaaaactgttaaagcattaggtataggggagtgaactacttttgtaggcaaaactacaggagtacgagataagaactaaagtagtttgtcagcaggaagggcatgctctatatgaagggcatgctctataatcagagggtgctacctgaaggtctagagataggggcaatactgcttcaaattgctttttactccaagaaattccgatgacatcaggatcataacctagaaactgattgcatcatctatggcctgaatagatgactttactaactagctggatatagggagatagagttttagtcctggtatgtgagcaaaaaacccattctaggaagtgtagctctggggctatctgtcctattaatcctgttggggaatgtttattaggaaaaacaaacaattggactgactgaatattttgggtttatgcaatttagttgcctctgggaaatagcttactctatttcttcaatttccctttttcctgcaggagttaaatacctgggagagtctaaagctgtattgccctttaggatagaaaacaggtttcgcaatttatcagtagttttgcccaaggtggggtgaagccagttaatatcgcccagtaatttttgataatcatttaatgtgtgtaaattgctaatatttaatttaaccttttgaggtcttactgactgggaagttaatatgtatccaagatatttccaaggagaggacaattgtactttttcaggtgctatgactaaacctcttaactgtgtattctttaccacagaggcatataaacttaaaagtactgactccgttggggctgctagtaaaatatcattcataaaatgaacaatcttgcaattaggaaattattttctattggggagcaaagcctgatttacatgatagtgacacatggtaggactgtttagcattccttgaggaagcactttccagtgaaattgactacctggcctttcgctgttgatggctggtatggtaaacgcaaatttttctctgtgctgttttgcaaggggaacagtataaaagcaatcttttaagtcaataatgattataggccaaccttgaggaatcgctgctggggaagggaggccctgttgaaggggccaggttgcaaattagcattgatagctgtaagtcatgcaaaagtctccatttgccagactttttgggaatgatgaaaatgggcgaattccaagggctgtttgatggttctatatggctggcttttaattgttcctcaactaattgattggctcattgtaatttctctctctttaaaggctactgttctacccaaagaggattttaagagagccacgttaggggtaagtgagggataataacagtggccattattagaaagaggtctgcagagtgacctcaattaaccctttcataaatgggccagcaactctgttttctctaatactttttcttttttccttatgtacctgattgcctcattgatcttgcatcctgggcaggccaagacttcccattctaatgccgcttgcctataacagggtcctgtaactgtagcatatcccttgtcttttttccagtttattggaggaaggggctcaggcaaaacctctgttttctctttggtatttttgctcattaatggctgggctgagggagaagcaggcagtaaggtaggtgacggtttctcctctcttcccttgttaggctcttctgtgtagagtgggaccaaatcagccctaactaaagcccataatgttagagatgccctcgtgcatgatgttatttaagatttctcccaacttgttcccggagctctatgtctagcataccttcttccaggaaccatgggttatgggaaacaacagtttgcattaagtcccttaattgagcctgtgaaaccgagtctccactagctttaagctgctgtttcaatatttttatatactgttgctattgagctgataactgttgtcccatgatgaaaccctaggctgaacaattcccttgaacttggaaatcccaagcaggcaccaatgacttactgacttacggactgcgtagtcccttcaccttcattttccagggttccgtcatgatcctttgcagcattcctcatgtgggggcaccaccggccaagtctgtcctgcagactctggattagtgttgaatgaaataaattctcagacacagatatccagtgaaagaggggtataggagactgccggcactaggggccgaagacagttagcagcacccctaagcaggcaacactcacttttatttagtacagatttaatgacaaaggcttagagcaaacacaatttgtaggtaataaatattgccaaatccccaagtagagagcagtcctgtgcacatatgataaaaggttggttttaggacaacatgagtaaacaagctatttaaataaactcttctacattcccttgttatctgctccttgctattagctcaaggtaagaggattaggctgccttcagccataaccctttcccaaagcttttgcaaaaccttccagccttccaagaaggtttgcacctttcctataatttttcccaccaccctgactcatttcctacactgtaaagatagagtatataatgcatataacatgcaaaatatgtgttaaactactgtttatatgattgttaagtctccaatcagcaatagactattagtatatttaagttttggggagtcaaaattataagcagatttttgactgcatgggagttggcattcttaactccttagttgttcaagatcaactactttttctttatatctattttaaatttattgtaactgtttcttgttttatcttcccataataatatatttggaacaatattatttttaattaaacagtaataataaatattactccattttttgtttacttttactgatgacagctttcagcattatccctttctcttccccttctactccacacctgagcaagcacatatgaaagctagagtggtttcacttttggtgctggtagcaagttcaaacagcttgtagcaacctgcagctaggtgtcactccctttccatcattttaaaaaaaaaaaaaaagaacaaaaaccaaaaaaaaagtcagtttctttttttttttaaattttttcccctgatctctgaagccatttgctgaccagcttggggatcttgccttgctttccccagaaaacttcatttgtgagtattaaatccttttactactcttttggtatgtgtgtggtgtcatcatccttaatatctgaaacagattttgaagttccattctacttcttcaacatcttcaacaaacaatctaattactaacagattcctgtgtctcaacactaggtatgtgataaattactaatatgtgatgaagagtagtcttttttattttggggctatttttagtctagtgagttcaaataaaaattaattcattagttaattcatatcaaggactttaatagaaaagggtaggtatcgcatggtgtgcagtcacactgtcctgaatgtgaatatttatatacctagttctttctagttttggccttaaaggtgttattgaccttcagcattcttctctgtcaaatgtagatgataatatccctcacaagaaaggtttgaggtggcctaatataagtaaatcacatagggcaggactgagcacataggcaacacaaatgttattttgctttccctgctgactacaaaagatatgtataatatggtgcttacatttatttaagaaattgcatatgcaattattaaatatcataacaagattcatgtatatatacattaaactatgctaagcctttatatgtccagtgctggagacaagaatcaaacttgcacagagtaatgatagaaccaactctcaccaactcagtcagacaggtttttcctcccaatatactaaatcatttatcggcacattcagtatgctagacactgagttttattcatttttttcatttcatccccacactttctgtgaagtgatgattatgatgatgaagatgatggtgatagtcctaatgataatactatttactggcatgtgtgcttcgaaatgcaccaagtattttacatacgtagttaaatccttgtgatatttgtgtgaagtaggtaatgttattatgcccactttatagatgaggaaattgagagagtcaagttacttgtaaaatattgtatggattgtcaccaaccaaaccagtatttgattctaagctgtgtttaactcttgtgaccataaatataatcctaattctactacagcaagataactcagatattcattttggctcatttcatgaatcacttgagaaatttaaattccagcatgtggaaatatttaattctgcatatatgataacttcacaagtatttcagtaaaatgaagctagaagaagcagtataagatatatgggagggtaggctaccagtgggctattctgtgatttatgtatattcttgtggaaagggctggccttgagcaatgagtaaacatcatggctactcttgtggtgtctggactctgctaaggtcttccacccttgaaatttctccctggaagcaaagcctgtgaggacaaagaaacttgaaaagacaaatcccatgggatggagaaaacatccatgttctagaatacaaatgcctcattccaaacctctgttagctattgttggaaagctattgttggaaacctcaggcaggacccaggttcctggttaggaatgagaagggaatactttgaggtgtatgaaggagtaagactgataagatcaatgaaactcgtggaaaatttcacaagttttactttttttattgttgaacttatgtatttgttttattttatggatcatttaagactttgtgcccttttttaaattggtaagggatgaattgtgctcttttttagcataaatataagatgcttgctaatatttattcactgtaaaacagtattaaaattcttcaactgtgcaaactatttcttttgaggtattctattttgattttcttgtgtggtcctcctcatcttcctacctagaaagaaacatagcagtcttctacttcctcaacattttggtggaacatactgagcttttcttcatctctctgagacctattgaaaataatacaaacatactatttttctcccttcaaatatttgtgaaaaaagtagctgtaatttttcttaaccgactagttggagtggtgatattagttcactggaaaagtcatctgctgcttcacaaattatgtcattaattggaagagagctaccctggcctttcccaccatattccccatcactaacattgccacataggtttaatcatatgtaccaaatgcccctttgccttttctatgtctatcctcatgcaaacactaaattctgtgcttgctgtgttgagttagttctttcagtcttcagacaaaaaataataccacaaagtccagctttttttgcttttttaaaaaattgtacatttagtccatgattttgaaagtggctttataaagattacaagctgaactatttaaaaattatgagtttctacaaaaattatattgaagtaaagttatttcagcccttattctagaagttctgtgttattaatggagataattctaagttctaatattttatcacatgacaaatgaaggctccattaggaatttggaaaccaaattaaaaagtcataaagatcaaatttctgtggcctatactcaatgatataaaataaaaaactaactgggaaagagttttttgttgttttttttttttttttgagacggagtctcgctctgtcgctcaggctggaatgcagtggcgcgatctcggctcgctgcaacctccgccttctgggttcaagcgatttccctgcctcacggtgagatcttgcctcactgcaacctccgcctcctgggttcaagcgatgtccctgcctctgcctcctgagtagctgggattacaggcacccgccaccacccccagctaatttttgtattttttattttattttattattattatactttaagttttagggtacatgtgcacaatgtgcaggagagatagggtttcaccatattggccaggctggtcttgaactcctgaccttgtgatttgcccgcctcaaccttccaaagtgctgtgagccaccgcgcccggcctgggaaagaaaattttaatgcatattcaaaaatttcctttttgggaggcaaagtgtaaaacacttataaatctagacgtcagtggtcagtccactattattttatttagatttgaatttactataggtgatttttacagctccatatttaaattttcacaactcaagacattcctttataatgccactgtactgtcattttaaaaaattatgttcattgatgtacaatatttgtacatatttatcgagttcatggaatattttgttacatgcatacaatgtgtaataatcaaatcaaggtaactgggatattcatcacctcaaacgtttatcattttttgtgtgtgctgaatgcattctaaaacttttctaatagttattttgaaatatacaataaattactgttacctatagtcaccctactgtgctatggaacactgcaacatatttcttctatatgactgcatttttgtgcccattaaccaacctcactttaaaccccctggcccctacccatccaagcttctggtaacaccattctactctctagctccatgaaagaaatacatttttgtagctactgcatatgagtgaaaacatgcagtatttttctttctgtagctggcttatttcatttaaaataatgtccttcagttctattaatgttgccagataatgacaggattttatttttatgactgaataatattccattgtgtatataagccacgttttctctatcatttatccattgatgaacacctagattgatttaacatctttattactgtgaatggtgttgaaataaacatggagggcagatatcttttcaatatctagatttccttattttggcactgggcagtgagatggtctggatcatatggtagttctatttttagtttgtgaggaacttctgtactgtttttcataatagctatactaagttacattttccttgagcttcctaattatagcacactcactgtaatgtgaagaagctatacaatcttagacttttggaaagaaaatattacttataacaggtacattcattttattgtagtcacccatcactgctgtatgacttctgagtcagttttggttgtcatgttacatttttcacacacaaattatttttttcattttatattgtggaggagaaaaaacacagatgtgtatcagagaaaaaaaattataatctaaaaattagagcagaattgaaacaaagattccctttagaatagggatgcagatctctttttcagatgataactaaatattgacataataaaatacatcaataaaagtaaaattattccagatttcttttacaggggcaactcaatagttctaattatgtctctttatttgaatgtttaagtaatttattccaaatattccattatgtagcttgtaaagtctcctctgctactgagtcagctctgcctcctttttttttttctttttctttttttttttttgagacagagtcttactctgtcacccaggctggagtgcagtggcacaatctcggctaactgcaaccttccacctcccaggttccagcgattctcctgcctcagcctcctgaatagctgggactacaggcatgcaccaccatgcctggctaagtttttttatttttagtagagatggggtttcactatgttggccaggctggtctcgaactcctgacctcaggtgatccacctgccttggcctcccaaagtgctgggattacaggcgtgagccaccatgcccagctagctctgcctccttctaaattagatctggtcagtttaccgttttttattttgggatcatactagtactcttcaactgaattttaaccttactttgaaatatttatatctggctttaagaatttaaatgaagacattttcacagactaattctagaaatagtgctctgtgtgacattaatattctataatataatttagatttccgagaactgtcttgaatatttggtaatttcaatttgccattttctcttactgaaatgcataaccacatcagtatcacaatttctctaaggtacaataatataattcatccaggagtgccagtctttttacattttgcatacattttttatcttctcctgagatagacaggttttagttttaagttgtgataaccatcatatttgtcttcatgatatatcagaaatttcaaaaaataccctttaaagcagactgattatcactgattttgataaatgtatatatattagagacagccagaactgagaactatacattttggatgtaatgtctgaattttccttttggcaacacagattatatttcacaaagaagattaaccctttcaataaatttatgtttgaaactgactcttaaattttctgtaaagaaaactgaattaatattttatgttcaaacagggaaatgctgatggtagtctctcctgtctcttataaaaccatatgctgaataatagtataagttaatagattttggtcctttttagataatgaaggcacattgctgagcgtgcatacaagacacatatgttcacaagcccaccttattgcttcattaatgggcaggaagtatccaaagaagaacatttttattaaataaaaacaaagaaacagacaaggtcctttaatgaccttgctgggattcattgcctactagaaatgttaactcttcacacagatcccatctcagtctagaatctgcgctaatagtcctagagccccaggaacagttactcattagttctatgtgcacttgccaaaatgttgtcttacttgaccgttgctctttccatattccaattgcaggcttatttttttgacagttatcaactctttcaccaacctaggaaacgtttggaatagaaacacaacaatgagtgaataaatcgttaaaatataacataggaagggcaaaaacaatgaatattaagtgtataaataaaaaacctaggagtaggggaattcaaataacttcccaaactcagagagaatagaaatattagctgaagttcaaatgcacatatcactgaggaattccttacacaacagcatatccagaaaaattttattgtgattctgaaaaagtgttacaacttattatagccttcagtttgtagcatttactatgcgatttcattagttgtcatattttagaaacacgctgactgaaagggacagacactttaatttcaaataatatctgatcaattgtacaagaaaaataatgtgctactgagggttatgtaagagcataaataataaatataggtaatggttttagaagattgtgaattcttggaaatctttcttcctgtctaggagtaggcctaaattctaaggcaattgaataaaatttatttaaagtattcctctttaagtaaaataagattttcataagcgtatgttaatgattgactgagcataaataatatcaccataataggaatatacattagggactgatacatctttaaggaagagtatggaaatagtatattttctcattcatcaatttcacatgtttaataacatttgttattcttgaaatgtgtcaacttctttctggaactacttgcaggcaatagtttcatttatatttttatacaaatttatttatatataatttacatagtatataattaacccatttagttgaagctaatcatttttgatacattcagatatgtgcaacaatcatcccagtcaatattggagaaatttttatcacctcaaaaaaaacctctgcacactttagctattaacctcctattccccacatcatcatcatcacctcagcctaagcaaatactttctgtctttatggatttccttattctggactttctttttttttttttttttttttttttttgagacggagtctcgctctgtcgcccaggctggagtgcagtggcgggatctcggctcactgcaagctctgcctcccgggttcatgccattctcctgcctcagcctcccaagtagctgggactacaggcgcccaccactacgcccggctaattttttgtatttttagtagagacagggtttcaccgttttagccgggatggtctcgatctcctgacctcgtgatccgcccacctcggcctcccaaagtgctgggattacaggcgtgagccaccgctcctggcctggactttcttaagtgttttttctctgtggctaatttattaaagactgatggaacttcttcacttgctacaggtctattccaattacctatttcttcttgagtcaacttcaatagagcgtgtaagtctaagagatgttcatttcatgtaagttatctaatttgtttgttggcaatttttcacaatatttcattataatcctttttatttccataaatgaaataacaatgcctcctctttgatttctaatgttatttgagtcttttccttatcaatctagctgaaggtttgcacattttgttgatcttttcaaagaataaagatgtgtgttcattgttttctctattgttacctattttcagtttcattaatttaactctaacttgtatcatttccttcattttaattgttttaggcttttctagtatatgaaggtataagtttgactattgattttatatctttcttcttttctaatatagacatacagcaatacatttttccctaagcactgtttagcttcatcttagaagttttgttacattatgtcttaattttcattcatttctaagtattttctgatgtatcttttgatttcttcattgatctcttagttgctttataatgtgttgtttaatttccacgtatttgtgagttaccttaatatttcctagttattgattcacaattgtatcccattgtattcatagaatatatgtactatctcattccttttaaattatttatgtttgctttatggcctagcatgttgtacatcctggagtatgttccatgtgcatttgagaataatgtatgttatattgttgttaggtggagtatttcatatatctctgttagatttctttggttcccagtgttattgcagtcttttatttttttgtttattttgtttccagttattcaattatttaaagtaggatattaaagtctgtgttattttcaattcttctatttctccttacacttctgtcagattttgctttatgaggcaaggagaataagctttgagaaatggatctaagtgtgggttctaatacacagtgggtccttgatgtgtgtcatcaaaattagttcctataaagcatgaaccaaactttcatggacataaaaggtatatataaatatatcttataaatatatatgaataaaatgaatatttattatatataaataacatattcaccaacaaatatttagttttataacttttattttagatcagtggtacatgtgaaggtttgttatattggtaaactcatgtcatgggggacaagagattctggtatgttgtatctttgttctcattagtttcaaagaacttcttgatttctgccacaatttcattatttacccttaacttatttaggaacatgttgtgtaattttcatgtaattgatggttttgagctattttcttagtcttgacttctatttttattgtgctgtggactgagaatgtgcttagtatgattctggttcttgtgcatttgctgaggatggttttatgttcaattatgtggtcagttttagagtatgtttcatgtggtgatgagaatgtacattctgttgtttttgagtggagagttctgtagaggtctattacatccatttggtccaatgtcaacttcaggtcctgaatatctttgtcaattttctaccttgatgatctgtctaatactgtatagaggagtgttgaagtctctattactatatgggaatctatgtctctttgtagacatagttctctaagaacttgctttatgagtctgggtgctcccgcattgggtatatatatatttaagatagttaggtcttcttgttgaattaaatcctttaccaatatgtaatgcccttatttgtctttttaaatctttgttggtttaaagtcagttttgtctgaaattaagattacaacccctacttttttctgttttctatttgcttggtagattttactccatctctattttgagcctatgggtgtcattatgtatgaaatgggtctctagaagacagcataccattgggtcttgcttttttatccaacttaacattctgtgccttttaagtggggcatttagtcccatttaaattgaatgtaaattttacattcaaggttagtattgatatgtgtagagttgattctgtcattgtgttgttaactggttattaggctggcttgtttgtgtggttggctgatagtgtcactggtctgtgtatttgtttttgtatcaactggtagcgatctttcctttctgtatttagtgctcctctcaaggtcttttataaagcaggtctgttggtaacaaactcctgcaacatttgcttaactgaaaataatcttctttttccttttcttaggaagtttagtttggctggatatgaaattcttggttgaagattttgtttttctttaagaatgttgaatataggcccccaatctcttttggctggtagggtttcagcagaaaggtccactcttagcctgatggggttcactttgtaggttacctaccctttctctctagctgcttttaactttctttttttcattttgaccttggaaaatcggataattatgtgattatgtgtcatggggattatctttttttttttctttttgtagaatcttgcaggagttctctgtatttcctgaatttggctgttggcctctctagcaaggttggggaaatttcatgggcaatatcctgaaatatattttccaagttgtttgctttctccccgatatggtttggctgtgtccccacccaaatctcaccttgaactgtaataatctccatgtgtcaagggcagggtcaggtaaagataaatgaattatagggcagtttcccccatactgttctcatgggagtgaataaatttcatgagatctgaaggttttataatgagagttttccggcacaagctactgcctgacgccatgtaagacatgagtttgctcctcgttcaccttccagcatgattgtgaggcttctggagccatgtggaactgtagtgaattaaacttctttcctttataaattatcaaatgtcaggtatgtctttattagcagtgtgagaatagactaacaatacattccccttccttttcaggaataccaatgatttgaagatttgccctctttacagaaaccctacttctcagaagttttgggtttttatttgggcttttattctttttattctttatttttgtgtgactggcttatttaagagatccagtattcaagttctgagagtctttcccccgcttggtctattctgctgttaatacttgtgattgcattgtgaaaatctcctgttgtgtttttcagctctgtgagacctgctaggttcttttttataccagctatttcacccttcaattcctgcattatctcattgtgattcttagtttccttagattggattttgctgttctcctgaatctcaatgattttcattcctattcttattctgaattctatttctgtcattttagccagctcagcctgggtaagaactcttgtcaaagaactgttgcagtggtttggagtgcttataacactcttgccatttgagttaccagagttcttgcattttgttctcttctttttgtgtggttgttcctgaaactacagtgtagattgagtttagtcaatagacttgttttctggatgtttccacagggatgaagctttgtgcaaggtctttatttgaagttgacttcttgtcttttgtgtcaaagtagagtatattagtgagatatttttggtgttaaaactctggggaatgtgatcctgtaggtggcacttaggcatattggtctgttggtagactcttgcttgattgtgtggctcccctatgttacctcatagttgcagctgtgttccctctcaatgttctgaaagtgcaagttcctttcccccttgagcaatggcagtagatgcagatactcaactccttggctgcccactgcaactctggtgtaatctcagggttactgttccttacccaacttggaggcagcagaggaagggaccttcatagtggttgtggccaagggtcttttgcttatcttctgggggctccaccccagagagatgcaggtcaaatcgctcagtgcaatcaacccaggatggagggtctatgctgtgggtcaaagctaggggttcctgtctgctgacaaaagtcagggatggaacaggggatggactggccttttctccttgggttgactgcaggttgttggaagtgtaaataaacacttagggtctctgacccttcattagtctggggctagaaaggacagttccactgaagaggtagtggcaaagaggctttcagttggccctagaggctctgtccagggagttgcagagctgccactggcttgatagctctggcaagagaatgactgggggcccaggcctggaggaactgcctagtgagtagatatgggaacaggcccccacataacagtctggccacttttcacagggctattacaatatgctgggggtccacttcagtccttattcaccatggattttccagtacctgaaggtatcaaaagtgaaggctgcaaaacaggaaagacagcagcctgcccctgctttgggggctttgtcctagggtggtacagacctgttgcctgcctgaatacacctgtaagaggtggctggagaccccacttgggagtttctacccagtgaagaggaatgggattggggacccactttaaaaagcagcctgttacattttcataggacatctgtgctgtgctggaaaaccacttcagtccccagttggtttgggctccccaaagcctaaaggctggcacagtgcattagtcaattctcatagttcaacattgttggtgagggcccaggaaacttaacaatcatggcagaaaggaaagcaaacaagtcctttttcacagggcagcaggaaggagaagaatgagagccaagagaatggtgaagcccctaataaaaccatcagatctcgtgagaacttactatcacaagaatagcatgtgggaaaccacctccttgattaatgacctccctctgggttcctcccaaaacacatggggattatgggaactacaattcaggatgagatttgggtggggacacagtcaaagcatatcatttcttccctggcccctcccaaatctcatatcctcatattttaaaacatagtcatgctcttccaacagttccccaaagtcttaacccattccagcattcactgaaaagtctaaattcaaaatctcatctcatacaaggcaagtaccttttgcctatgagcttgtaaaatcaaaagcaagttagttacttccttgatacaatgggggtacagacattgggtaaatacaactgttacagatgggagaaattggccaaaacaaaggggctccaggctccacacaaatccgaaatccaatagggtggtcattaaaccttaaagttccaaaatgatctcctttgactccatgtctcatatcccagtgatgctgatgcaagaggtgggctcccatggccttgggcagctccacctctgtggctttgcagggtacagtcctcctctcagctgctttcatgggctcctacaattgagtatctgcatcttttccaggtgcatggtacaagctgttggtagagctaccattctggggtctggaggatggtggcctccttctcatagctccactaggcagtgccctagtggggactctctgtgggggctccaaccccacatttctcttctgcactgccctagcacaggttctccatgagggtttcacccctgcagcaagcttctacctggacatccaggcatttccatacattctctgaaatctaggcagaggttcccaaacctcagttcttgacttctgtccacttgcaggcccaacaccatgtgtaagctgtcaaggcttgggcttgcaccccctgaagcagcagcctgagctgtatgttgaactgttttacccacatctggagctgaagcatctgggatgcaggttactatgtcccaaggctacacagaccaggggggcactaggccagacccatgaaaccatttttccctcctaggcctctgggcctgtgttaggaggggctactgtgaaggtctctgacatgacctggaaacattttccccactgacttggtgagtaacattcggctcctcattacttatgcaaatttctgcagccagattaaatttctccccagaaaatgggtttttatgctgggtatggtagcttatgcttgttatcccagcactttgggaggctgaggtgggcagatcacctgaggtcaggagtttgaggccaacctggccaacatggtgaaaccccatctctattaaaatacaaaaattagctgagtttggtggcatatacctgcaatcccagccacttgggaggctgaggcacaagaatcactttaacccaggaggcagaggttccaatgagccaagatcatgccatggcacttcagcctgggtgacagagcgagactctgtctcaaaaaataaaaaaaatagagagaaaaagaaaatggatttttcttttccacctcatgtcaggctacaaattttctaaacttttatgctctgcttcttcttgaatgcttttgacttagaaatttcttccagtagatatcctaaattagctctcttaagttcaaagttccacagatctctaggacaggggcaaaatgtcaccagtctctttgctaaagcatagcaagagtcacctttgctccagttttcaagaagttcctcattgccatctgacaccacctcagcctgaacttcattgcccatatcactatcagcattttggtcaaaaccattaaacaaatctctagtaagttcaaaactttcccacatttttctgtcttcttctgagacctccaatctcttccaacctctgcctcttacacagttccaaagttgcttccacatttctgtgtatctttatagcagcaccccactctctgcagtaccaattagctgtattaatccattctcacagtttagcatggctggggaggcctcaggaaacttacaatcatggcagaaggaaaagcaaacatgttcttcttcacagggtggcaagaaggagaagaatgggaacagcatgaaggggaaagtcccttataaaaccatcagatctcatgagaacttactattacaagaatagcatgggggaatccacccccatgattcaattacctctcaccaggtctcttccatgacatgtgggaattatgggaactacaattcaaggtgagatttgggttgggacacagccaaaccatatcaaacagctaagtcagccaaacagcaaacatggcggcccacctctctccctgggagttccatcttagggtggtgcaatgctgctatcagtggctggctggagtgcaaagccaatgggtcttatcctgcaaggcaccatggaagcagggcctgcagacagtggctgctcaaccccctggattcagcccctttcataggggtatatatggggatctaaccttccactttgctagagttgcagctgcttttctaagaaagaccaagaagcctgggtatctaaggctcctgggtctcatgtctgcctgaatgactgctctgccaacactccatcttgctctctgtgttagactgtgttgctctttgtgttagactgtgttgctctttgtgttagactgtgttaggccccagtggagtgggatcatgaggggatcttctgatctgaggtttgcaaagatctatgggagaagcatgggttcccagggctgcacattcactcaccatttccctgggtgggggaggttgccctggctctgtgtttctatccaggcgggctgtcatgcaatcttgcatttctccattctttatgggtcacgttttttcctcgattgttcccagtgcatgtatctggatgtttcagttgaaggtgtgtatttactcacgccttctgatcctctccatgacagcagcatgcactagctgcttatagttggctatctaggccacacctccaccaagtgatgtattagtgattatctttgtgggagaaaaatggaaaatcaattgcggatagttattgaagagatttttttcacagaactaaattcaatttctgtgttctatgagagtgtttctgaagtgttcaattcagtcaaatcttatagagaatttattacctttggtatctactgtctacattgtctagttaatcacagaactccttttcaatgtctttcagtggtttgccttgggtagctctggataattagtaatctctccttagataatgtattttcttcagctgcatagtgaaatcagggcttgacaaagtactgctgcaaggtcaagttggggcaatcatctaatttggtatacatcttcactgaaacataagccatactcatagatacttcttatctatggctgattatatttacagccatgtatagttgcaacagagactatatggctcctaatacctaaaatatttactctctggttatattagccagttctcacactgctaatttataaaggaaaaaagtttaattgactcatggttctgcattgctagggaggcctcaggaaacttacaatcatggcagaagaaacctttccacagggcagcaggagagagaggtgctgagctaaaaggggaaaagccccttataaaatcatcgcatctcatgagaattcactcactatcatgagaacagcatgagggtgactgcccccatgatttaattatctgcacgcagtcccacccttgacatgtgagtattattacaatttaaggtgagatttgggtggggacacagagccaaaccttatccctgctccttcatgaaaaatgtttgccaaaccctagcctagaaaacgaactcatgttttgcatacttgaaatttcatctatctttgtatttgttgttagcccagtgaacatattcgagatagaaccccttgtccacaatgtagcagtatgcaacaatgaaattatgtcttaggctgaattctaccactcataatcatttactagtgaaaaggcattaaatgatttcttatacatttgctaaatttccagctctactttgaagtgtgtcagcctgttggaattgagatatttgcttttttgtgcctctgtatttctagaaaatcgtcatatttaaacatttttaatttccaccagtaaaatcatttctaacatcctatgccaactaaccaactatctttttcatttagttagctatagttggtgtttgttatggttgtccctttactcccaactgtgccctttccatgcaatatgtatgacagccttctctaacttctcgctgtgttccatacttttttttcagttatacatatttggatgtttcagattgttctgtccaaaattttaattttgtttattttttgggataagctaccaatatggattatctattatgtgtctatatgtgtgtatctctactatgcctgtgtgtatattttcaaatggccaccttaacagaggtagttaaaattcctatattaaagcacttattttgaaccataatgatcctatatagatggcacaaatatatatacacaatttaatatttcacaagacattcataaaatattttagaaatattttggtgatacttaaatttttacatatacgtgttaagaaatactaaaatttatttagctctatataatgtttatattaaatataaccattatttaaagtgcctgtgtgattttcttgatttcttaagcaaacattgagtatatacaatttaaaatttgcttgattcaaaagtaatataaaatgtattgagtaatttatataaagagaagtgctggcataatggtgaatggtgataggataaaatataaacgaaaaagtttatattttaactgttttgctttctaataaaatatgaatgatatatatatatatatatatatatataatttttttttttttgagacggagtcttgctgtctcccaggctggagtgcagtggcgcgatctcggctcactgcaagcttcgcctcccaggttcattccattctcctgcctcagcctcccaagtagctgggactacaggtgcctgccgccaagccctgctaattttttgtatttttagtggagacggggtttcaccttgttagccaggatggtctctatctcctgacctcgtgatccgcccgcctcggcctcccaaagtgctgggattacaggcgtgagccactgcgcccggccgaaaaataatattaaatggtagttatttgtcaaatcttgtgtaccattgatgataatctccaggaagagtgaccctaatgagctttatacacaatatttaagggaataaagagaagaacagcacatgatttttttaatgttttataaaagaaagtattcaccataactttcactagaaagaattgtttcttcctctcctaaagggaaagttactgaaaataataagtagttcaattgtctctttgagacacattgtaagttgctgtttatgattttttaattatcattagttgaaactgtctcaacagctgtcttcacagatttggctattgcaaaggcaatgattcatgcccaatcatgaagctcaagcacagttcatttactacctaaaatatatctttgccaaatagaggctgatgtattgagctaattgtcaggataataacaatcaaatgaaaagtgagtgaagaatgaagaagctgtttgtttgcttttttgttgttgttcttgtttttgtttttttcttttgagatagtttcactcttgttgcccaggctggagtgcaatggcgcagtctcggctcactgcagtctccgcctcccaggtttaagggattctcctgcctcagcctcctaagtatctgggattacaggcacgagctactatgcgtggctaatttttgtatttttagtagagatgggggtttcatcatattctttaggctggtctcgatctcctgacctcaggtgatctgcctgcctcggcctcccaaagtgctgggattacaggcgtgagccaccacgcccagcctgcttagcttttaaaattagattattcttctcttatagtgaaacctcttccttgtctttacctcacagaaaattgtcttctccaggactaccataaaacaaaacctaatatgttatcaattacaagctttcttttttttttttgctgtcatgtattggctacaaaaataagccttaattccatgtcagtacagagttatacaggctttagaatattaaagattctgggcaggaattaaagtattatgtcagtaatgcattttactcatcttagttttcatgtttatgccaatgttagaagctgaaaagaaaaatatatatagtttattttagcaacaaaattatattaattacttgctatttaaaatatgaatataagtcattttagctgcatgcttcccataactatatgcagcaatcttgtggattcactttgtgaatatgagcagcgttacaaatcggtatgacgtactctgaagtttcatccaacagagtagcttacttctaattaaattataagctccttatttatacttcttgttaccccatattgcattttaggtaattaatcaattaacatagtgtttcttctatttcaaatatatcattagttattttttaccgagttttggaagcactattaaagtaaaaccatagaattaaacctgacttcacatctaaataaactgagtcatgttagatgaatttaattaaataactatgaatgatctaagtcctacagggaaagataagataaataaaccctgttttttgtaattttttgactaattgaagagaatagaaatgtaccaaaattacctaagaaattacagatgaagtgtataatctggtgttaaatgaacaaagctatttagcagcactgatctccaactattccttgtaaagaatacatctctgctgagaaggaaagcattttctacataaagattgtaattttcaattagtgcttctccccaggactttcagaggcagcttggaggttgtattataaacatgtttcctctatctaatcattaaaagcaaactaataggcaatccacccccaacacacttaaacacataccccatccccacatgtatgtgcgcagcaaagatggaaagtgaatcacgtgggcataaagaagaattagttttctataggtgtagcctaacaactgggccagctccaagcaggttcaatggaatagaaatagagaggcttataaatatgtccctgtgttatgtgtccacttctacctaggtttttgatatattctcctacgcttttagcatattctcctttagaccctctagaggatttgtgtttgtttctaaaatgattagaaataactgattatcacatccttcaagaattccttcttctgtttcagttattttataatctgtcttttcataatatgatgttttctctctaagaacttctgcttctagttattaagctaacggatatgcatacaacatctattttttggaaatattttatgttagaggcagcaaaggtttatgtaatacctactatataccaggggatacacaagaaatgaagatttgaagcttgtaaattacagaggagaaacgaaataaaaataatagaaagcatttgtgtgtaataactcatcagttgagtacaagggatgcactcaaattattaaatgagcacctgatatctggcagggataggatcagatagaagaaatagagctgaagttgattctgaaagataagctgtttattaggagactagaggtgttggccactacaagtagagaaaaacagtttaatatgaatgaaaaaacataaattgagggtatggcaggaaatgagatttcatatcacattatgtagtcagctctttaaatttcagctaatggaatatcttgtaaatgagagtgacatgatagatttttattttactaagataagtctcgccctctaaaagctgggtggccgatgaaaaagttcagggcacgtatagcatcaatgaacatttgagtttgacagcatcatcaggttcaaacaagtcaacctggtccaggtagatcgaacaaaaaactgggaaacatagctttactttgatactaagtgggaaaattatacaatgtgcattctgttgccattgggtggtatgtattttatggtatatataccgtatacgtgtgtgtatatatatgttatgtgtataccatatatatatggcatatatatatgttttgtgtataccatatatatatggcatatatatatgttatgtgtataccatatatatggcatatatatgttatgtgtataccatatatatggcatatatatatgttatgtgtataccatatatatatggcatatatatatgttatgtgtataccatatatatggcatatatatatatgttatgtgtataccatatatatggcatatatatgcatggtgtgtgtgtgtgtgtatatatatatgtgtgtgtgtatacatatatatggtgtgtgtatatatatgtgtgtgtatatatggtatctgtgtatatacatgtattctgttgtcattggatggtatgttatctatatctatatatatatatatataaacctgttatatatataaaacatatatatataaacctatgttatatatgtaaaacatatatatatataaaaccaatgttacatatatatatagaacataccacccaacggcaacagaatacacattcttctcaagtaaacatggaatattttccaggatagatcatatgttagcccataaaacaagtcttaaaaatttaagatcaaaatcacatcaaatatctttccaaccacaatgctagaaactagaaatcaataacagaaagaatcataaaaaatcaacatcatgaatcatgaaaaagtaacaaatatgtgtaaattcaacaagatgctcctaaatgactgagtcaaagaagaaattaaaatataaatttaaaaaacccttttcagacaaatgaaaatggaaacccaacatactaaaacttacaggatgtagcaaaagcaattccaagagaaatatttatagcaataaatgatcaagtaagatttattcctgggatgtaaggatggtttaaaatatgtaaatcaataagcatggttcaccatattaacagaaagaagaataaaaaccacatgataatttcaattgattcagaaaaagtatttgaaaaaatgtaacatcctttcaaaaataaaactctcaaaacttagatatagaaggtatgttcctcagcacaatagaggccatatgtgaaaaatccacagctaacatcatactcagtatttaaatttgaaaactatttctcaagatcataaacaagtcaaggatgcccacttttaacacttctgttaaacatagtactggaagttctaactagagcaattaagcacgaggaaaaaataaaaggcactcaaataggaaaaaatgaggtgaagttatctgtttgttgatgatacgatataaaccctgaaggcttcaccagtaaaatttgaactaattaaagaatttgttaaagttatagagtacaaaatcagctcacagaattactagcaattctgtacactaaaaattaactaagtgaaactaacaaaacaattccattgcaatagcatataaaatataaaatacttaagagtaaatttgaacaaggaattgatagatgtctatactgaaactgatagaacattgatgagagaagaaattacacaaataaatggagaaatattcagtgtttatggactgaagaattaatattgcaaaaatgtcaatattatccaaagctatataaaaatttaaagcaattcctatcaaaattccaatgtccttctttaaagaaatgtaatacaaaatcctaaaatttgtaaggaaccataaaagaccctgaatagccaaaacaatttgaccaaaaagaacaaagctggggccatcacactaccagatttcaaaatatattacaaagctatgacaaacaaaacagtatgatactggcattaaaaacagccacattgaccaatcgaatcgaaaagaatatgaagtccagaaatcaacctacacagttacagttcattaatttttgacaaaggtgacaagaacacacattgggtaaaggacatccttttcaatgaatggagctggcaaaactagatattcacatacagaagaatgaaaatgaacgcttatcccaacccttgtataggaatcaattcaaaatgaattaaagacttgaatgtaaaacctcaaactataaaactactagaagaagagataaggaaaaagctctgtgacattggtttgggtagagatttcttagaaatgactcagaaagaacatacattgaaagctaaaacagacaaatgggattacatcaaatgaaaaaacatttacaccacaaaaaaaataggatgaagagaaaacccatgaattgggaccaaatatttgcaagtcatacattggataagggactatgtccaaaatatgcaaagaactcaaactactctataacaagaaaaccaatagccctattgaaaatgggcaaaggacttgaataaaaatttctgaaaagaagatatatcaatggccaacaaatatatgaaaaaatgcttactatctctagtcatcagggaaatttatattaaaactaatgagataggccctcaccatgttataatggctactatcaaaaatgtgaaaggtaacaaatattggtaaggatgtggagaaaggagaactcttgtatatggtggtgataacgtgaataattactgtcagtttggaaaacagtatggaaatttttcaaaaatctaaaactagtatgaccatatgattcagcaatcccaccaatgggtatatgcccaaaggaagtgaaatcagtatgctgtatgtacatgtgtattcccatgatcttggcagcattatttatgagagcaaagatgttaaaaacaatctaattgtctatcaacagataaattgatttaaaattgtgctatatatacacaatagaacactatgcagcataacaaaaaaaagaaattctgtcatttgcaatatcatggataaatttagaggacattgtgttaagtgaaataagtcaggcacagagagaataataccatgtaatctcacttacatgtggaattttaaaaagtcaggctcatagaagtagagagtagaatggtagttactagaggattggaggggtggtgaacagggtacaaagtcacagacaggaggggtaagttctggtgttttattgcacagccagatgactatacttaatagcaatgtactgtatatttcaaaatagcaaaaagaaaggattttaaatgttctcaccacaaaagaaatgaggtgataaatatgctaattactcttatttgatcagtgtacactgtatacatgtattgaaatatgactttataccccatgaatatatacaattgttatctgtcagttaaaaaaaataaaactaactaactaaatagataaataaattctaagtggctccagagctggaacttcttgcatgacactgcattgtcccctgtgatctccatcctctaccatgtttgtatgaaagttgatgaatattgccttcttggacttcagctgggaaggtgatcattaggtaactcaaatttttcacggccctgtgcaagttcccaaatagctgcaaaagtttgtcaggaatgttgatttgggaattaccaataaatttaacaaaggtgaatttgcaaatatagaatcctcaaatatggactctaaataatttgcattgattttgcttatgtttatgcatatgtcacaataactagacttttctgtcctggaatattgtgtctcagtcaatttaggtatttgatgttaataatatgagaataaaaaataagttatattcctatctactgtagtaagacaagaaagggaaataaaagatatatatatatatcttatatatatattatttatgtgtgtgtgtatatatatatatacacatatatatatttacatatatatgtatatatatatttacatatatatgtgtatatatatatatgtgtatatatatatatatatatacacatatatatatatggaaagaataaataaaactctgctcatacttccatgattatatatgtaggaaatccaaaagcatgaacagcagcaaaaagactcttggaactgataagtgattatagcaaggttgaagaatacaaagttaatatacacaatttaatcactttatatcattgtaatagggtcctccagagaaacagatgcaacagaagatacacatacacacacacacacacacacacatgcacacacacacatacagagagagatagatagatataaatatacatgaagaggtgaagaggagacttataatgggaattagcttgcatgattatgaagactgagaaatcctacaatataccattggtaaactggctagccaggaaagccagggttgtaattctttctgaaccaaagggactgagaaccaggggagcccagtggtgtagttcccagtccaagaccaaaggcctgagaaccagaggggcactggtgtaagccctggagttgaaaggtctgagaatgaagagtgttattgcccaaggacaggagaagatgaatgtctcagctcaaagagaatgagaaagagatttcactcttcctctcagtttttgttatatccaggccttcaacagatcgtgtgatacctgcccacattggtgagggtggatcttcataatgtagttactgactcaagtgctaatttattctgaaaacaccattacagaaacacctgttttagcagctatctgaacatcctttgacctagtaatattgacatataattgaccaccacaaccagatgaacaaataggaattgaaattaaaaatatacatcatttatattagcaccacaaaaatgaaataattaggtataaatctagcaaaatatgtacaaattatatataaaaaactataaaactctgatgaaataaatttaaaaactaaataaatggagaagtatttcatattcatgaataggaagactcaatattgataagttgtcaattcttcacaacttgatctgtagattcaatgcaatgccactcaaaataccaggaagttattttgtagatatcaacaaattgattttacaggttatatggagaaaccaaagacctggaatagtgaacgcattattgaagaacaaagttgaaagagtaagactaccaaatttcaacacttatgataaagctacagtagttgagatagtgtgatattggtgaagaatgggaaaaaaaaatggaggagaatagagagcccagagaaaaacctacataaatacagtcactgatagttgacaaaggaacaaagttaatacaatgaaacaaagataaccttttcaagacatggttctaaaacaattggaaatccacaagccaaaaaaaaaaatctagacacagaccttatatcttccacaaaacttaattcaaaatggatcttaggcctaagcgtaaaacaagttgtaccactctaagaaaattattggagaaaatctagataaccttggatatagtgatgacattttagatacaacaccaagggcatgatctatcaaagaaataatagataacctgaactttattaagaatttaaaagcaaactcatgctctatggtaaacaatgctaagagaataaaaagacaagccacagaatgggagaaaatatttccaaaggacacatctgataaaaaactgttatccaaaaagtaccaaaactagtaacacctcaacaatatgaaaacaaaaatcctaatgaaaattcgacctaaaaccttaacatacacttcattaagaaaacagacagatgacatataggcatatgaaaagtgaacctatgtcatcagcaaaatgtaaattaaaacaatgagacataatatggtttcgatctgtgtctccaaccaaatttcatgttcagtgttggaagtggggcctggtggaaggtgatgggatcataggggtggcttttaatagtctagtatcattatcctagtgctgttctcataatacaattctcatgagatatgattatttgtgtggcagcccctcccaactcttcctcctgctccagtcatgtaagacatgggtgcttcccctttgtcttccaccatgcttcagagtttactgatgacccccagaagctgctatgcttcctgcatagcctgcagaactgcaagccaattaaaccttttattttttataaattactcagtctcaggtatttctttgtagcaatgcaagaatggactaatacagaaaattggtaccaaagagtgggacattgctagaaagatacttgaaaatgcaaaagcaacttaggaacatttaatgggcagagattaaaagagtatggaacactcagagtaaaacaggaggatgagaaaactttggaaccccctagactgcttaaatagttgtcactaaaatgctgattgtgatatggacaataaagtacaggctgattaggtctcatatggggaaataaggaccttattggaagccagagtaaaggtcacttttgttatgtgttagcaaagagactgactgcattgtgtccctgctgtaggaatatgtggaacattgaacttgtaagtaatgatttagagaatctggtggaagaaatttctgagtggcaaagtgttcaggagttcacctgtgtgcttttgaaagcctatgctcataggcatgaaaaagaaataacttgaaattggaatttatatttaaaaggaaagcagagcacaaatgtttagaaaatttgcagcctagttttgtggtataaaagaaaagcccttttttgggggaggacttcaagtgggctgcacaaatttgcacaactaaaaggaaggcaaattctgatagtcaaaaccagaaaaaagcctcaaaagcattttagagacctctgctgcagccactcccatcacaagcccagaggcctagaaggaaagaatggttttgtgggccaggtccagggccccaccaccctgcacaacctggggacactgatccctgcatcttagtcctagatgctctatctccagccatggctaaaatggccccagaaacagctcgtgcctccacttctgagggtgcaagtcataagccttggctgcttccttgtggtgttaagcctgtgagtgtacagagtgcaagagttgaggcttgggagcctccacctagatttcagagtatgtaaggaaaaacctgaatgtccaggcagaagcctattacaggggtgaagccctcatgaaggacctctactcaagaagtatgaagggaaaatgtggggttggagcctccacacagggtccccactggagcactgcctagtggagctgtgagaaaagggtcactatcttacagaccccagaattgtagatccatcaacagcttgctatccacacctggaaaagtcagaggtgctccacactagcctgtgaaagcagatgcaggccttgtgccttgcaaatcctcaggggcagagctgtccaaagccttgggaggctacctcttgcatcaatgttccctggatatgaggcatgaagttaaaagaggttactgtggagctttaagatttaacgactgccctgctgggtttcagatttgtggtggggcctatagcccctttcttttggccaatttctcccttttgcaacaggaatatttatgcaatgcttattacctccattgtatctaggaaataactaacttgttttcatgagagtcaaagtctcatcaaatttcaaagtcagatgagaatttcaactttggacttttgagttaatgctggaatgagttaagactttgagggactattgggacaacatgattgtaatttgcaatgtgagaaggatatgagatttaaagcggccaggggatggggacatgatatgttttggatatgtgtccccacccaaatcttatgttcaattataatcttcagtgtttgagttggggcctggtaagaggtgattgggtcatggagatggtttctaatggtttagtaccacccctctgctactgttctcatggtagagttctcatgagatctgattgtttaaaagtttgtggcactcccctctctcttcctcctgcttcagtcttgtaagacatgcctgcttcccctttatctttctgccatgaatgaaagttcctgaggccttcccagaagccactatgcttcctgtacagcctgcagaaccatgagccaattaaacctcttttatttgaaaattacccagtttcagctatttcttcatagcaatgtgagaatgaactaatacaagatcccactacatacctactagaatgggcaaaatccagagcactgtcaatacctaaagctggtgaggatgtggaacaagagaaactttcattaatttcggttgggactgcaaaattgcacagtcactttggaaggcagtttggcagtttctttccagaataaacatactcttaccaaatgatccagtagtcatgcttcttaatacttacgcaaatgatttaaaacttacatcagtgcaaaaacctgcactcagatgtttatagcagctttattcataattgtcaagacttggaagcaaccaagatttccttcagtaggtaaatgaataaatgaactgtggtacatccagagaatgggatattactctgtgcttaaaagaatgagttattaggccgggcacggtggatcacacctgtaatcctagcacttggagaggccacggagggtggatcacgaggtcagaagttcaagaccagcctggccaacatggtgaaaccttgtatctactaaaaatacaaaaattagctgagtgaggtggtgtgtgtctgtaatcccagctgcttaggaggctgagacaggagaatggcttgaactcaggaggcagaggttgcagtgagctgagattgtgccactgcattccagcctgggtgacaaagcaagactctgtctcaaaaaaaaaaaaaaaaaaaaaaagaatgagttattaagccatggaaataaatggagaaaatttaaatgcttattaataagtgaaacaagcctttttgaaaaggctgcatatgttactatttcaactatataaaattttgtaaaagataaaactatggagacagtgaagattaggattgggaggaggaggatgaataggcaaagaacacaggacttttagggcagtgaaactactctatatgatactctgatggtggatgcatgtcattattcacttatccaaattcatagaatgtgtaacaccaagagtgaactctaatgtaaactatggacttggggttattatgatgtttcaatgttggtacttcaaatgtaacacatgtatcaatctgatgggagatgtcaataatgggggaggattcacatatttggggaaagggggtatatgaaaaatctctggactgttctttcaatattgatgtgaacctgaaactgctctaaaaataaggtattcataaaaatagatataacaattattactgtgcactatcttaatagattttttgttgatttgactaacttgtgactatggctacatataaaacagctaaagtgatgtattcctctatattatttattttctattttttttgtaatttttttatgtcagatgagcaatatgctgacatcataaagaggtttgaggggggcacatcacacacgtgaatttgaaaactccatcattatacttatgaatcacaaaaatatacattttcttaattgatttactctgtcaacattgtccctctgcacctgtcctttcataattttctctcagattccttaatgtatggcttcaaccgtaattcataatgcctgcattcaattatgttttaaaatgtacggttatttaccacattatttaaattctaaataattatgaaattttaaattaaattttagctatgatagtatgtatcttttcaagtcaaaacatactctcaggaaattatcatatagtctacacaaaatcagaagtattttagctagtaaagatgaagcacaaggcatatatgcagagaccactcaaaatattttcttttttttaattttattattattatactttaagttttagggtacatgtgcacaatgtgcaggttagttacatatgtatacatgtgccatgctggtgtgctgcacccattaactcgtcatttagcattaggtatatcacctaatgctatccctcccccctccccccaccccaaaacagtccctagagtgtgatgttccccttcctgtgtccatgtgttcacattgttcaattcccacctatgagtgagaacatgcggtgtttggttttttgtccttgcgatagtttactaagaatgatgatttccaatttcatccatgtccctacaaaggacatgaactcatcattttttatggctgcatagtattccatggtgtatatgtgccacattttcttaatccagtctaccattgttggacatttgggttggttccaagtctttgctatcgtgaatactgctgcaataaacatacgtgtgcatgtgcctttatagcagcatgatttatagtcctttgggtatatacccagtaatgggatggctgggtcaaatggtatttctagttctagatccctgaggaatggccacactgacttccacaatggctgaactactttacagtcccaccaacagtgtaaaagtgttcctatttctccacatcctctccagcacctgttgtttcctgacttttaatgattgccattctaactggtgtgagatggtatctcattgtggttttgatttgcatttctctgatggccagtgatggtgagcattttttcatgtgttttttggctgcataaatgtctccttttgagaagtgtctgttcatgtccttcgcccactttttgatggggttgtttgtttttttcttgtaaatttgtttgagtttattgtagattctggatattagccctttgtcagatgagtaggttgtgaaaattttctcccatttgtatgttgcctgttcactctgatggtagtttcttttgctgtgcagaagctctttagtttaatgagatcccatttgtcaattttggcttttgctgccattgcttttggtgttttagacatgaagtccttgcccatgtctatctcctgaatggtaatgcctaggttttcttctagagtttttatggttttaagtctaacgtttaagtttttaatccatcttgaattaatttttgtataaggtataaggaagggatccagtttcagctttctacatatggctagccagttttcccaccaccatttattaaatagggaatcctttccccatttcttgtttttctcaggtttgtcaaagatcagatagttgtagatatgcggcattatttctgagggctctgttctgttccattgatctatatctctgttttggtacgagtaccatgctgttttggttactgtagccttgtagtatagtttgaagtcaggtagtgtgatgcctccagctttgttcttttggcttaggattgacttggcaatgcgggctcttttttggttccatatgaagtttaaagtagttttttccaattctgtgaagaaagtcattggtagcttgatggggatggcattgaatctataaattaccttgggcagtatggccattttcacgatattgattcttcctacccatgagcatggaatgttcttccttttgtttgtatcctcttttatttccttgagcagtggtttgtagttttccttgaagaggtccttcacatcccttgtaagttggattcctaggtattttattctctttgaagcaattgtgaatgggagttcactcatgatgtggctctctgtttgtctgttattggtgtataagaatgcttgtgatttttatacactgattttgtattctgagactttgctgaagttgcttatcagcttgaggagattttgggctgagacaatggggttttctagatatacaatcatgtcatctgcaaacagggacaattaatgaatccaggagctggttttttgaaaagatcaacaaaattgatagaccgctagcaagactaataaagaagaaaagagagaagaatcaaatagacggaataaaaaatgataaaggggatatcaccactgatcccacagaaatacaaactactatcagagaatactacaaacacctctatgcaaataaactagaaaatctagaagaaatggataaattcctcgacacatacaccctcccaaaactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagtgggaaccttccctaactcattttatgaggccagcatcatcctgataccaaagccgggcagagacacaacaaaaaaagagaattttagaccaatatccttggtgaacattgatgcaaaaatcctcattaaaatactggcaaaccgaatccagcagcacatcaaaaagcttatccaccatgatcaagtgggcttcatccctgggacgcaaggctggttcaacatacacaaatcattaaatgtaatccagcatataaacagaaccaaagtacaaaaaccacatgattatctcaatagatgcagaaaaggcctttgacaaaattcaacagcgcttcatgctaaaaactctcaataaattaggtattgatgggacgtatctcaaaataataagagctatctatgacaaacccacagccaatatcatactgtatgggcaaaaactggaagcattccctttgaaaactggcacaagacagggatgccttctctcaccactcgtattcaacataatgttggaagttctagccaggacaattaggcaggagaaggaaataaagggtattcagttaggaaaagaggaagtcaaattgtcccactcaaaatattttcaaagtgcttttgaaaatagtattcactaacatcttaattttgaatcaatactctacttccctttaaaaaataataaaaattttatttatttatttaaaaattaccttcagtgacacactacaggtaattttcaacactgggactttggagggagagtttctggtagatggtggtgtgtggcattcattgacataaagccaagatgaattgtactaaaaggtaaccttttctgccatggatcagatggagcttttaagggcaagtgcagtgtctgtcaacagcacatcactgtcaatcctcaattgctgttttcagaacaaaaatgaggatagtggtgttttttatacaaaacaaatgaactggtgaataaccaaattagacccagctttcatgctttgtttttaaaaatatattctttcttcaacttctattttagattcagggtatatatgtgcagttttgttacctggatatattgtgtgatgctgaagttggcactattaatgatcccatcacacaggtgccaatcagagcacccaaaggttaactttttaacacttactcccctatacccctcctctagtagtccccaaggtctattgccatctttatgtttatgcatactcaaagttcagctctcacttataagtgagattctggtatttagtttctgttcatgagttaattcacttatgacaatggccttcagctgcatctatgttgctgcaaatggcatgattttgtttatttttatagaggcatagtattgcatggtgtacgtgtacaacatttgctctatacaatccaccattgatgggcacctaggcacctaggttgattccatgtctttgctgttgtgaataatgctgaaatggacatgcagcattatctgtctatctgtctgtctatctatctatctatatacacacacacgtgcatgtgtattgaagatataatttatcttcacaagaagataaattattctacagttattcacaagaagatacacacacacatatacacacacacatacacacacaaatacacagtaatggaatttctgggtccaatgataaatctctaaattctttgagaaatctacaaacttctttccacggtgactgaactaatttacaattccaacaacagggtataagcattccctcttccttgcagcctcaccaacatctgttgttttttttactttttagtaatagctattctgactggtgtgaaagattatctcactgtgattttgacttggatttcactgatgattagtgacagtgaacatttttccatatgtttcttggccacttgtatgtcttcttttaagaagtgtatattcatgtcattttcccattttgtaatggggttgttttctgtttgtcaaattgtttaagttccttatagattctggatatgagcccatagtagatgcacggttgtcaatattttgtcccatttattaggttgtcaatttacaaattcaatttcagaactctgttttgatctgtttagtgttttattttttttcctgattcaatctgggaaggttgtgtgtttccagaaatttatccatttcctcttggttttctagtttgtgtgcctagaagtgttcataatagtctctgaggaactttggttttactgtgagattgattgtaatattgcctttatcatttctgattgtgcttatttggatctttttttttccttgtttagtctagctagtggtctactgatttagtttatcctttcttttttatttttttaaattatactttaagttttagggtacatgtgcacaacatgcaggtttgttaagtaggtatacatatgccatgttgatttgccacacccattaactcatcatttacattaggtatttctcctaatgctatccctccccctgccccccaccccatgacaggccccaggatgtgatgttccccgccttatgtccaagtgctctcattgttcaattcccacctatgaatgaaaacatgccgtgtctggttttctgtccttgtgatagtttgctcagaatgatggtttccagctgcatgtccctgcaaaggacatgaactaatgctttttatggctgcatagtattccatggtttatatgtaccacattttcttaatccagtctgtcattgatggacatttgggttggttccaagtctttgctattgtgaatagtgccacaataaacatatgtgtgcatgtgtctttatagtagcatgatttataatcctttgggtatatacgcagtaatgggatcactgggtcaaatgttatttctagttctacatccttggactagttggacagtggatgcagcccacagagggtgagccaaagaagggcggggcatcgccccacccgggaagtgcaagcagtcagaggatttccctctcctaggcaagggaagccgtgacagacggtacctggaaaaacgggacactgccacacaaatactgcgcttttccaatggtcttagcaaatggcacaccaggagattacatcccgcgggtcccatgcccacggagccttgctcactgctaaagcagcagtctgagattgacctgtgaggcagcagcctggcagggggaggggtgtctgccattgcttatggaatgagaccaccacttctcctgttgtccttcccagcttctcccctacctcctcttttccctagtttataagacaggagaaaagggagaaagcaaaaagttggaaagaaacagaagtaagataaatagctagatgaccttggcgccaccatctggccctggtggttaaaataataataataatattaacccctgatcaaaattacttgtgttatctgtaaattccagacattgtatgagaaagcactgtaaaactttttgttctgttaggtgatgcatgtagcccccagtcacgttcctcatgcttgcttgatctattatgaccctttcacgtggatcccttagagttgtaagcccttaaaagggctaggaatttctttttcggagagctcagctcttaagatgagactctgccaactcttccagccgaataaaaacctcttccttctttaatctggtgtctgaggagttttgtctggggcttgtccggctacagctgaggcttgagtatgtaaacaaagcagctgaggaagctccaatggggaggaacccactgcagctcagcaaggcctatttcctctgtagactccacctctgggggcaggcatagctgaacaaaaggcagaagaaacttctgcagacttaagcatccctgtctgacagctctgaagagagcagttgttctcccagcatggtgtttgagctcggagaatgggcagactgcttcctcaagtgggtcgctgacccccgtgtagcctaactgggagacacctcccaattgggccgactgacacctcatagtttatcctttcaaagaaccaactttggccgggcgcagtgtctcacgtgtgtgatccaagcacttttggaggccaaggcaggcagatcatgaggtcaagagaaagagaccatcctgaccaacatggtgaaaccctgtctctactaaaaatacaaaaattagctgggtgtggtggcgtgtgcctgtgtaccagctactcaggagcctgaggcaggagaattgcttgaatccaggaggtggaggttgcagtgagccgagattgcatcactgcactccagcctggtgacagagtgagactccatctcaaacagacaaacaacaaaaaagaaccaacttttgggttcatcagttctttatatggattttgtttccccattttattcagttttgctctcatgatagttatttcttttcttcactagttttggggttaatttcctcttgtttttctaattcttctaggtggacaattatattgttaattagagatctttgtaacttctttgagataggtgtttagtgctataaactttcctcttaaaactacttttgctgcatcccagagattttggtttgtcatgcctctgttttcatttgtttcaaagacttaaaaattcttcctgtatttcactgcgtactcaaagtcattcaggagcaagttaacttctatttaactgtgtggcttttggaagtcttcttggtattaatttctattcttattccactgtgttctgagagtatggtttgtgtgattttgattgttttgaatttttttagacttattttatggatgaggattgagctccatgttcagatgataagaatgcatattctgcagttgatgggtcaagtattctgtagatgtctattaggtccaattgctcaaatatcaagtttaagttcagaatttctgtgttagtgttctaccccaatcatctgtctaatgctgttagtgagctgttgaaatcccccgcttattattgtgtggctgtctaagtcttttagtaggtctaaaagtacttgttttgtgaagggtgatccaaagttgggtgctaatgcatttggcgtaattaagtcttgagctgagccctgtatcattatgcaatgccattttttgtcctttcttactgttactttgaagtttgttttctctgacataagaattgtgaccctgctcttttttgttttccatttgtgtggtagatctttctccaacacattttgttgagcctatgggtgccattacatatgagatgagtctcttgaaaacagcagaaaaataagtcctttttaaaaacccatcttgccactgtgtatcttttaagtagagtgtttacaccatatacattcagtgttaatattggtgtgtgaggttttgatcctattgtaaaattgttagctgtttgctttgtagtttttattgtgtgattgtttcgtagggtctgtggagtatgtacatatgtgtgttttgttaatagcagaccttgttattttgtttccatgtttagaactttcttaataatctcttgtaagactggactagtggtatgaattcccttagtgcctgcttgtctgggaaaagttttatttcttcttcatttgtaaagcttactttggagggatataaaattattggtttgaatttcttttaagaatgctggaggtaggttcctaatttctcttagcttttaaggtttctgctgagaagtctactgtcagtctgatgggtttccccttgtatatggtctaccctgtttgtctagctgcctttaagatttttttctccagcattgactttgaacattcaggtgactgtgtggtttggtgattgtattagtctgttttcatgctgctgagaaaaacatatcagagactgggttatttataaagaaaaaaagttttaatggactcagtttcatggagccggtgagtcctcacaatcatggcggaaggcaaaagacacatcttacatggtggcagggaagagagaacttgtgcagggaaactcccccttataaaaccatcagatctcataagacttattcactatcaaaataacagcacaggaaagacccacctccatgattcaattacctcccactgggtccctcccatgacatgtgggaactgtgggagctaaattaatgataggatttgggtggggacacaaccaaaccatatcattctgcccttgcccctcctaaatctcatgttctcacatttcaaaactaatcatgacttccaaacagtctcccaaagtcttaactcatttcagcattaactcaaaagtctacattccaatgtttcatctgagacaaggcaagtcccttctgcctacgagcctataaaatcaaaagcaaattagttacttcctagatacaatgggggtacaggcactgggtaaatacagccattccagagaggagaagttggccagaataaaggggttacaggccccaggcaagtctgaaatctggtgggtcagtcaaatcttaccaaagtgatctcctttgacttcatgtctcatatttaggtcatactgatgcaggaggtaggttcccatggtcttgggcagctctgcccctgtggctttgcaggatgtagtccccctcctggctgctttcatggactggcattgagtgtcagcagcttttccaggtgtgttgtgcaagctgtcggtggatctaccattctgcggtctgaaggatgctggccctcttctcatagctccactaggcagtgccccagtggggactctgtgtgggggctgcaaccctatatttgccgtctgcactgctctagcagaggttcttcatgagaacccttcccctgcagcaaatgtctgcctggacatcccgacatttccatatgtcctctgaaatgtaggcagaggttcccaaacctcaattcttgacttctgtgcacccacaggctcaaaaccatgtggaatctgacaaggatttgggcttacactctctgaagccatggcctgagctgcaccttggccccttttagccatggctagagcatctgggatgcaggacactaaatccttagactgcacatagcagagtggccctgggcccagcccatgaaaacatttttttctcctaggtctctgggcctgtgatgggagggactgcagcaagtgtctctgacatgccctgaaaacattttctccattgtcttggtgattaacatttggcttctcattacttagacaaatttcttcagctggcttgaaattcttcttagaaaatgggtttttcttttctattgcgttgtcaggttgcaaattttctgaactcttatgctgtttcccttttaaaactcaatgctttcaacaacgcccaagtcacctctttaacgctttcctacttagaaatttcttttgccagataccctaaatcatctccctcaagttcaaagttccaaaaatctctagtgcagaggcaaaatgctgcaagtctgtttgctaaaacatagcaagattcacctttactccagctcccaacaagttcctcctctccatctgagaccacctcatcctggacttcattgtccatatcactatgagcattttgttcaaagccattcaaaggaagttccaaactttcccacatttttatgtcttcttctgagccctccaaactgttccagcctctgcctgttacccagttccaaagttgcctccatgttttcaggtatctttacagcagctccccactctaccagtaccaatttactatattagtccattttcacgctgctagtaagaacatacctgagactgggtaatttataaagaaaaaagggttatttaactcacagttccacatagctggagaggcctcacaattatggcaaaaagcaaaacgcaagtcttacatggcagcaaggaagagagaacttgtgcagggaaactcccccttataaaaccatcagatctcatgagacttattcactatcacaagaacagcatgggaaagacccaccctcatgattcaattaccttctactgggtccctcccatgacgtgggaattgtggaagctataattcaagataagatttgggtgaggcacagccaaaccatatcagtgatgttcactttgcagagtatgttgcatatgttttctggatttttttatatctagatgtctacctttctagcaagatttgggaaattttcttgaattgtttcttcaaatatatttcccagattgataattttttctccttctttctcagcaatgccaataaatcatagatttggttgctttacataattccatacttctcaaatactttattcatttttaaaatttcttattttctttatttttgttgtactggcttagtttgaaagacctgtctttaagctctgaaattttttcttctacttgatccagtctattgataaaactttcaattgtatttttaaattccttaagcaagatttttcaatgccagtagtcctgattgatttctttttcagatgttaatccttctttaatttcctggattcttcagaagtttatttgtttttattctcaatcttgtcttaagtctcattgaacttcttttcaatccatgctttcaatactttatctgtaatttctgagttttcatttttgttaggaaccattcctggagagctagtgtgatcttatggttgtgtcattacattcagatttttcatagtgccgtagtccctgtgctggttccttctcatctggagacaacagcacttcttgttttttaaaatatttttgagtggataggatttttttctttattcccaatattatcattagtattatttttctctgcctttcaattttttcccctctctagggagtgtgactgtagataatgctgtgttgagtttttggctttgtttctatagcctcataaacttcttttggtaggttttgtattgggatgtgcagtttgacctacaagcccataaatggcccttatagaaaggagctggctgcagccaacatggttgtgtatatacttgatccttgattactggtagaagctccctgttgcctcaggcaatgggctgatttgtgaaatacacagtggtctgagctttttcctcggtccttgaggggtggcagccacaaagggtagggctggaatgacaagttctacctacaggtcccctgatggcaggtataaaacccagcaccaagggagaatccagtgggcagccataatccttgtagaggtgtgctcaggcatggggatggaaaacctccttgaccccaaattctttgcacagagatgggagttagactaaactcctaatccaggaaagtgggtgctgcagatgtctggtcatggagcaaagagggcctccctccatcatgatctatgtcaaggaaaaatggggtggctcaggctgctgaaccagatgagaaggtattttgaatgcctggagatctgcctggttgtggggtagagagaaccttactgcaccacaatctatgtccaggaaggccattgcagctctagctgctgagccaggtgaactgatgttctgaatgcctggagatctgcctgggtatgaagaagagaaggccctactgaaccatgatctatgtccaggaagggtagcacacctcaggctgccgaaccaggtctctgaatgcctggatttctgcctggtggtggagcagagatagactcacttcattgcagtctcagaggagcagggtagggcacacaacaatggcacatgaaaattagttccaggtcaacaagctggctttggctgcaagtctcactgcccaggagaaactgcagctgtagtagctctcctcctgctccaggcatatgatgcagaagagcacaattccagtgccaactgttgaagcactttccacagttctgtctgtagaggcccctatcttggtccagaacaggtgctcatctctggcttgaggctaaaatgcctgcacatccatgcagctcagtcaccaatgaaggtggctttgtatgtgcaggaataaaaatggtgttctgctctcagtcccagctctgggaaagtgtgtgcagtttttccagtgtttttcccacatgacttctccaagcctttcccctagttagcttcagggtttgagagaaacaatgttctctctatcagcctgggttgcttgggtccacattgaaaaggtgattcacagcaggaggctctctgtttctcttatatattagggcttcactccttttcatcagctggtcaccatcatggagactgtttggtgatgttctcctctctgggatctagtgtgtccttaatgattccagttgattcccaatttccttcttgaattaaagctcactgagttgatctttatatatttttctatttccaaatggctgaggcatgctgaaagcatccaatctgcaatcttggggaaataaaaacacaaaacaaaaaacacccatgccttttttacacttctgactctcctgcaatagcggtcacttttggtatgagtcaaggccaatcttctgttcatacactacagcatcagagaggtgttaagaatatacctcttggccaacttcattggctcatgactgtcatctcagcaatttggaaggctaatgtgggaggattgcttgagaccagcagttcatgatcagcttgggcaacatagtgagaccccatcagtacaaaataaaaattaaaaaaaaaaatcagcttagtgtgctggtgtgctcctctagtcccagctccttgggaggttgaggttagaggatcattagagtccaggagttcaaggctgtagtgagttatgatcctgccattgcactccatccccagcctgggtgacagagcaagaatctatctatgaaagaaaaaaaaaaaatagaatatacctctatttgtaatagctgactttcttattgcttaatatagcaatgctctgtatcttcccttattcaactgacaattagaaccaatgtgcaaactaaagcattgaattaagaccatctttaatgtggtatcaatattatccaaacccttccttggcccaggttaagactaggcccagccagtatttgtggattcctatatgaaatgtccataggcaatttttttggtttccagttggtaaacatgttaggagtaacaaagattgaccttaaagtagtggcagtaattcatctgtcattatttgttatggactgattttttgtgtccccctaatgctcatatgttaaagcttttaccctcaatgtgattttatttgcagatagggcctctgtggaagtaataaaggagatcatataggtgggatcctaattggaaaggtcagttgcccttataagaagagacatcagagacctatctgtctgagaatacttaaaagaagggttgcttgaggacaaaacagccacgtgcaagccaggagggtggccctcatcaaaaagtggactctgctggaagcttgactttaacttaacagctttcagtatagagaatgtaaatttcttttgtttaagccaccagtctatattattttgttatggctgcctgagttaccatgtcctttgtacatttccagctgtgtaaaatttaaatatttcttacatttcttctctggatctagcatcagagtacgttgtattttttttttccttctctctttttctttcattctttactaaaaatatcttttaagagagtttttttttcttaaagaaaaatttccttttcccctttcttgccttctttttatacacttataaaatttaaaacattatttttgttaagtaagtcagagaacacaaaaattcatacagtatgaaagttcttcattctatgtcattctgtttactttccacagaaacagtaataaaatgccattaataagatatgcattctttgagacctgtatatattcatttatacgcatctatcatacttaaagtactcaaaactgtttacttttttataaaaatattacattttgaaacttttctttttatttagcacaatttctgatttatctttcctgtgaatgtatctaggtttgttactctatttttaatggctttattttgttcttactttgagtatgtaatttttatatatccagtcttctgttaagatatatcatgttatccctaattattatgacatttgcaaatggtgtacatacgtatttgtctctgaagagaggttccttgaagtagaatgatagtccaaatatttaatgcactacttaatattgacgaatactgcaaaatgctgccgcattttagattgttcttaaaccaatgctcagttggacttcaaatcttagtttatttataactcaaaatattatgaaaaggaagtaatactctccagaggattctaacagatacagaaaaatgttaatggttatttgtttttattttgcaagtgaaaaagggactgactttcctgaggtcccttgatattatcaggaattctataaacgtaggacaaaaaggaaaaaaggcagtgataacaaaaacaagatcaaattcatgatgaatttttgagcaaactacataacctaaaatacataaagcagacatttctagtattctagaagaaatagaaaatgccagaacatagtggggtgctttcatttaccttactcagaaaatgatagattaatattggatgaaaaacaaaacaaaaccaaaaatatcacagtacattttctatgagaaaccaatttaaataaaaatagtacagaaagtttaaaaatatcagtttggaaaggaaattatattgtaaattgtagaaaaaagattaaaattgcgataaatgataaaataagcattaagtgacaaattaagattttatacatgagtgaaggaatataaatatgtaagaatgataattaagaacatatgctttcctagaaatggactctaaacacataccaattgacagaaattgtgataagaaatgtaattaaatatttcatacacacctctgagaaactcttacagaaatcagattaataattttttaaaatagaaattttaatgacataattattaactaataagaaactctaagagagggcggtggagaaattttccattatgtaaatactaaagtgtgtctggcaatcaacagtaataagaaattaagataaagtaaatcatctctacaatgaatgtggatgtcaaaattaaactgagaagccaaaacatttgcttacatatttgtttttatacagagaatttcaagaagcattctgtttcacaaaataagtgatacctgtctattttctgctagtgccatttcacttacttatggctagctttgtttttccatgtgaaatatccaagcaaggatattttcagtgttatttttatcagtctataaatttttaaacaccaatgacatcccaaacagtattctagacactacaaagaaaagtttcaaagaaatgctattttcttagaaatggttattattttaaaaatttagtactactgccgtttttcagtaacaatagacaaaaataaagaattatgtctctgcccatgatttaaccattgaattattattctttattttacctagagtcctatgatatggtgatttgttagattgataaagaaattcttctttctaactgcttgctttctcattctgacatcttttcaacaaatcgctgttgttttacatcactttctatttaagtagggttttttatgtttactcacttattttcctattgttccacatacagttatgtagattcaattgtattatttttaattgttgtggatacataatagttatacatttttgaggttacatgtgatatttcgatacaagcatacatgattccattcttaagctacagatttgcacatctgtcctcagctctgaaatgatgccacagataacgttgggatatatcagttttggaaacatatcagagagaaatgagtacacttatttcccaaatgtcacttaaagtgttgtattcaggtcctcaataactcaccagtaatattgctaggtagtaaaaatagtatgtacagaaaggcttagacttgtagtgatccaaggtcagtgcagtaggagtgacccttccagggtgcaggcaataattcaaacgtgaagacaataacaattaaactgatgaagattggtcagttttctgtcactgtaagcctatcttttttatatatactttaagttctggggcacatgtgcagaatgtgcaggtctgttacatagttatacatgtgccatggtgttttgctgtacccatcaacccatcatctatattaggtatttctcctaatgctatccctccccatgtcccccaccccccaacaggccatggtgtgtaatgttcccttccctgtgtccatgtgttctcatttttcaactcccacttatgaatgagaacatgcagggtttggttttctgtttttgtgttagtttgcttagaatgatggtttccagcttcacccatgtacctgcaaaggacatgaactcatcctttcttatggctgcgcagtattccatagtgtaaatgtgccacattttctttatccagtctatcattgatgggcattttggttagttccaagtctttgctattgtgaacagtgctacaataaacatacatatgcctgtgcctttatagtagaatgatttataatactttgggtatataaccagtaatgggattgctgggtcaaacggtatttctagttctagatccttgaggaaacaccacactgtcctccacaatggttgaactaatttacactcccaccagcagtgtaaaagtgttcctatttctccacatcctctccagcatctgttgtttcctgactttttaatgattgccattctaactggcatgagatggtatctcactgtggttttgatgtgcatttctcttggtaagaataagatagtctttcctccaaaaaatgttttgggtctcaattctaaacaattttagttgttgtgtatgtataagcatacagtacatacacatacacacacatttttgtcaaatttgcatatttgttatcctttaatgctgtcctttaataaacattttgttatacattaaaggtcatttggagagtttccagttatacagtttgcccatgccacttgcagactttgctgcatacattcctttgaaaattagtatcaggttttgggcaaagtcaccttcttcaactcctgcagagctataggagttgtagtgggcccttcaaggtataaaattatacatgaagtgacccattaaggggctaattacacttaaacattttaataaatcaatttattatatttaatttaattccattcaaatgatattaactaagtgccagctctatattaagctgctgaagacatagcagcaaagactttgagctccttgctcaaattacggattttaatgtttaatgattagtgatgtttagcattttttcatatgcttgttggccttttgtatgtcttcttttgagaagtgtctgttcatgtcctttgctcattttttagtgaggctgttttttttttgcttcttaatttgtttcccatagattatgaatattagaactcattgaatgcagagtttacaaatattttctcccattctgtaggttttgtgtttaatctgttgataacttattttgctgtaaagaaactttttcatttaattgggtcctatttatcaatttttgtttttgttgcaatctgcttgttgaactaatacatttatcattatgtattgccttttttgtcctttttgatcattgctttaaaggctgttttgtctgaaataagaatagcaacctctactcttttttgttttctgtttgcttgatagctctttctccattcctttactttgagcctgtggatgacattgcatgtgagacgggtttcttgacgacagcatatagttaggagttgcatgtttatccaatttgccatgctgcaccttttaaatgcggcatttagaagcaaatactaagggaatttataaccaccagaacagctttacaggatgtcctcaagggcacgctaaaagtggaaatgaaaggttgttaccagccaccacaaaaacacacttaaatacatagaccactgacactaaagcaacctcacagtcaagtctacataacatccaattaacaacatgctgttaggatcaaatccatacaaatcaatattacctctgaacataaatggtgttcatagtcttaacgtgactatttaatccctcagctcttgaattgttttactggattccttagataccttggattgggtttttaatgttctcctgaatctcaatctttgttgccatctagattctgagtacaatgtctatgtcattgtagccatttcagcctgattaagaatcattctggaaagtgactgcagtcatttggaggtagaaagacactttggcttttagagttgccagagttcttgcagtagttctttctcttctgtataggctgatattttcctttaatctttaaagttgctgtcctttttatggggctctttgctttcatattgtttgatggtcctgaggttttcactgtggtataagttggatatagtcaattggcttcctttctgaatgatttcagggggccaaggctcagctcagcactcctgtgttgcttcctctaatgctgggtgcctgagataaggcctatgactttcttctctagcccctttacctcaagcactgctgtgctggaggaaccaaggtgttcctggtctgctggcaacactttgactggggtgctgacaaaagcacttcattggggcagtgtcagcaggttctgtactcgtgcatatgttccagtggcaacagggtggtggtgggacagcaggatttgttcacacttacaaagtggttggaggagactgtggttgagtgcattttagcaaagtggtgcgaggaggctttgggtggctgcagattggtggagtctcatctgcaaaagctctctaacagttaggtgggatttgctggtaaaagaactacggtgatgtacactgggaagctctccagctgggcatctaagcctgtactgcaggtgggtgtggcaaggcaaggaccctggaagacgccaacagacagggggaccatcaaaacagactgccctgctctcacatgtgagatagccctgttcggtccaaatctaacagttaacaagtgctaaagtcacctagaggatcatggctttggatctctcagatatggtttttttcctttctagggctgcaacccaaagtttggaattgagtttgggacaaaagtgtctcaagggatgcatggattcagatgagccttgccaaatttgcagtcatcagccagcaggggtcattcctctgttgcctccctatcataatgtaccttatattcattattcaattcaccattaatgggtacttaggttgattctgtgtctttgctattgtgaatagtgctgcagtgaataaatcaatgcatgtgtagttttggtagaatgatttattttcctttgggtgtatatgcattaatgggattgctgaattgaatggtaattctattagttttttgtgaaatctccaaactgctttccacagtagctgaattagtttacattcccaccaacaatgtagacatattccctttctattctgcctcaccaacatctatttcctgactttttgataacagccattctgactggtgtgagataatatcttattgtggttgtgatttgcatttctctgataattaatgatgtgattaatttttcaaatgtttttgaccacttatatatcttcttttgagaagtctctgcccattttctttgctctcattttcatagagttatttgacctttgcttgttgattttttagtattcctcgtagaatctgtatatcagaactttgtttagtgcataatttgcaaatattttcttctcaacctataaaagtcatagaagaaaacctaccaagtactcttccagatatcagccttggcaaagattttatgacacacagggagtactatcaacagagcaaaacagacaacctacagaagtagagaaaatatttattacattttcagtttcattactcattattggtttgtccagattatctatttcctcatagttcaatgtaggtagtttttatgtgtctatgaatttatcagtttcttctagattttccaatttgttggcatgtagctgttcataacagtctctaaagatttcttgctttttttttttgagatggagtctcactctgttgccaggctggagtgcagtggtatgaccttggctcactgcaatctctgcctcccaggctcaagccattcttctgcctcagcctccctagtagctgggattacaggcatgtgccaccacacccagctaatttttgtatttttagtagagatggggtttcaccatgttggctaggatgatctcaatctcctgaccttgttatctacccatcttggcctcccaaagtgctgggattacaggtgtgagccactgcacccagcccagatttcatgtgtttctatggtctcatttgttatgtctcattttatttgggtcctctctctctttttctaagtatagctaatggcttgtcaattttgtttatctttttaaaaaccaacttgtaattatgttgctcttctgtgtagatttttggtctcaattttatttacttctgttctgatctttagtataatgtattttttcttctactaatttttggtttcttcagtttttgctgacctcatttcttgaggtgcattattaggttgtttaattaacatatttcaattttttaatgtgggaatttattgctacaaacttctctcttactgttgcttttgttgtattgcataaattttaatatgttgcatttccattttcatttgttttaagaaatttttaaatttccttcttaatttcttcattgacccattggtcattcaggagaattttgtttaatttccatgtgtttgcatagtttccaaggttcttctttctagttttatttctaattttattccattttggtaagacaagatatttgatataatgtctactttttgaattttttgagactcgttttgtggtttaacatatggtctgtattggagaatgttccatgtactgatgaaaataatgtgtattctgcagcagttgggtgaaatgttctgtaaatatcagttaggcctgattggtctagtgtgtattaatagtttaacttggatgtttctttgttgatcatctgaatgatctgtccactactgagagcagggtgttgaagtccctagtatgattgtattgcagtctttctatccatttagatcaattaattttgctgtaaatacttgggtggcttggtgtagggtgcatatatatttatcattgttaagtcctcttgctgaatttacccgtttatcattatatagtaaccttcctttgtttccttttacggtctaatacaattatagctacttttgctctttttcggttgccagttgcattaaatctctttcttcatccatttcagtctatgtgtttttataggtgaagtcagtttcttataggcagaatacaacagggtattatttttgtccattcatccttccagtctttttattaccaaattcagtctatttacatttattgttattgattagtaaggactgagcaatgccattatcttgcttattttcttgttattttataactcttctcttcctttcttccttttttattatatttctttgtgattttctctggtagtatgttttcatttattgctttttatttttagtgaatctagtatagatttttgcattgtggttacaatgagacaaaacatcttacagatattacaagttatttataagtgatgatcacttaccataaattaaaaataaaataatataaacaaagaaaaaatgaaaaaaaatcacctgcactttaactttgttcttcctgcattttgactttttgttatctcaattaatatatctttaaattacctatctcttgacagttttctgtagcttttactgttttttatggctttgtcttgtgcacctcatactggagttataagaggatttcataccacagttgcaatgttagaatattccgggtttgtctgtgtatttacttttaccagtgggttttataccttcaagtgttttcttttttgcacattagggggactttgttttctttcagattaaagaactctctttaatgtttcttgtaagaaagtctgatggcagtgaattttctcagcttttatatgtctgggaaagactttatgtatccttcatatttaaagaatagcttttctagttacagtgttcttagatgacagtttatttctttcagcactttgaatatgtcatctcactccttcctggcctgtattgtttccattgagaagtctgttgacagatgaattagagttcctttatattatttgcttcttttttcttgttgctttcagaatcctctcttggtccttgacctttgaaattttgattattatatgccttgggcagttttatttgggtcaaatctgttcagtgttctctgaccttcctgcacctaaatatttatctctaaagttttggcatgtttctgttattatttctttgaataaactttctacctcttgctcttgctcaacaccctcttgaaccccaataattcttaggtgtggtctttggaggtaattttctatatcttgtagatgatcttgtaccttctttttttttgtatttttttttctcctctgacacagtgtattttcaaattgtctctaagttctctggtttactctgctccatgccttctgctatggagaacaattaacactttttttagtttaacaaatatatttctttctttttcttttttttttttttttgagacagagtcttgcactctttcttgcccaggctgtagagcagtggcacaatctcaactgactgcatctctgcctctcaggttcaagtgatcctcctgcctcagcgtcccctagtatctgggattacaggcacgtgccaccacacctgtctaatttttgtatttttagtagagacggggatttcgccatgttggccaggctggtctcgaactcctaacctcagatgattccacctgcctcagcctcccaaagtgctgggattacaggcatgagccaccgtgcctggccaacagcaaatatatttcttaggtccaagatttctgtttgattttttaaatcatttcagtctcttcgttaagttcctccaataaatttctgaattggttttctgtgttgtcttggatatcactgagttttcttaaaactgctattttaaaatcttgatccgagagctcacctatcactatctcaaggccagccattggttctctatttgtctgtctggggaagttgtggttccctatttgttgttgtttcttgtgaacatatgtttatttcattgcattgaatgatgagttatttattccagtcttctctgtccagatttttttttttttttttgagacagagtctccctctgttgcccaggctagagcagtggcacaatctcagcttactgccagctccacctcccgggttcatgtcattctcctgcctcagcctcccgagtagctgggaccacaggcacctgccaccacacccggctaattttttgtatttttagtagagacggggtttcactgtgttagccaggattgtctcgatctcctgaccttgtgatccgcctgccttggcctcccgaagtgctgggattacaggcgttctctgtccagattgtttaggtttttatcaaatatatttgcttagagagtctttgtaatttaccttttgaattcatttttatttttctgccaggttgtcaccttctttttggcactcaatgctgccttaagcccaggtttgtctcagctctagtaaatgatcagagtactgcttgtcatgaatgagagaggtccttttgtggatatccaaatgttgtgtgaaggctggttatggattcatatgaagaggatctgtggaacatatcttctatagtatggtactactgaacagctactctgatttgatatctcctttggctaagttatagagaagagtttccagggctggggatggtagtctcctctctcccgtttgtcactggctgttctttagaacatttctgtcttgaggctcttctgatgcttcctgtcggttgagggaggaactggtttcttgccaggaaatcccagatgatgggaagtctggttgtccacatcactattgctgttttcagtatagacaccatgagtcagagataaattttctgcacacttaatgctgggcagattgaggggtgggacattgtgggtatggaagtcccattcattaccatctgcttggagttctttgagttctgagatattgctgataatctcagcactgtatatttgtgtctgattttctgtgcagggaggagtaaagccaactgccttatatgtcatcattttgggaacaaaatggcctataattttttttgatgtgttattgaattcaacttgttagtatttaattatttttgaaagcatatacatatattggccttgtagttttttttttttttcttgtgatgtctttgtctgattttgatgtaagggtgatgctcacctcatataataaagtttggaaatattccctctacttctattttttggaacattttaagatagatgggtattaatttttatttcgttgtttgatataattcagtcatgaacttatatgaccctgagctttccttgttggaaggtttttgattcccacttcaatctctttatttgttatttatctttcaggctttctatttcttcttgatttagtcttcagaatgtatgtttctagaatgttaaccctatctttcaggttattgaagtttttggcatactattgttcataatagtcctctttgacattcctcatggaactagaagaaactattttaatattcatatggaaccaacaaagagcccgaatagtccaggcagtcctaagtaaaaagaacaaggcagaaagcatcatgctgcccaacttcaaattgcactacagggctatagtaatcagaacagcgtggtactggtacagaaacagacacatagacaaatggaaccgaaaaggcagcctggaaataaggctgcatacctacaaccatctgatctttgacaaagctgacacaaacaagcagtggggacaggactccctattcactaaatggtgcagtgataactgactagccatatacagaaagcagaaactggaccccttcctttcaccatatataaaaatcaactcgtgatggattaaatacttaaatgtaaaaccaaaactatattaaaaaaaaactctggaagacatcctaggcaatacctttttggacataggccctggcaaagatttcatgactaagacaccgaaaacaattgcaacaaaagcaaaaattgacaaatataaactaattaaactaaatagtttctacatatcaaaataaactatcaaaagagtaaacatcctatagaaatgggagaaaatatttgcaaactatgaatctgacaaaggtgtaatatctagcatttataagtaacttaaacaattttacaagaaaaaactaaacaaccccattgagaagtggacacagacataaacagaaaattgtcaaaagaagacacagatgcagccaacaagcatatgaaaaaagttcagtatcactgatcattagtgaaacggaaatcaaaaccacaatgaaatatcatttcacaccagtcagaatggttattatgaaaaaataaaaaaaataacagatgctggtgaggttgcagataaaagagtgtgtatacactgttggcaggaatgtaaattagttcaactgttgtgaaaagctgtgtggtgattcctcaaacagctaaaatcagaactaccatcccactcagcaatcccattcttgggtatatacccagcagaatataaatcattctgttataaagacagaagcatgcatatattcatagcagcactgttcacaatagcaaagacatgtaatcactctaaatgcccatcaatagaaggcttgtaaagaaaatgtggtacatatacaccatggaatactatgaagctatagaaaagaacaagatcatgttctttgcaggaacgtggatggagctagaagccattatttttagcaaactcatacaagaacagacaaccaaaatactgatgttctcactcatacgtgggagctaagtggtcggaacacatggatacaaagaggagaacggacaccatggcctaccagaaggttgagggtgggagcatagagaagagcagaaaaactaattattgggtactaggcttaggaacctgctgatgaagcaatctgtacatcaaacctccatgacaatagtttacctagctaacaacctgcacatgtacccctgaacccaacatggaagttaaaaaaaaatcatgttgtatgtcttaagtatatacaagaaaaatagcttaataacaaaatgaaataacaacaaaaacagcatttagcttaggtcttggtatttcatgaaatatcatgatatttcatgatatttttatttattcataaataaaagtatttcatgatttttttacatataaaatattttgtttctcatttttattagcagtttcaatgtactttttcttaactgagtttgagatagtttgtgaagaagcaaaattcacttattaagtagatggcgaaagcaccacagtcccagaggaaaacactttcttcctgaaatcttacttctaacagagtagcattgttataaggcatgtctttgagaggtacattggaaagtgcctctgtggaaaagtacttttttttcagtgtcaacaaaagtttgactgatttttctctgttgggcaggtggactatctttgcatagtatgttaactccagagctgttttcttgtgataagtgtatactttctaaaaactgaagccaaagttgatgaaaacgatgagaaataaaatatcattccagtgtcaatatctaaaggcacatccttcatcagaattatattttaaatatccatgaagaaaaatatagagacttacatatgtatggataagaagttctgattcatccagtattgattggatgctcatatagcaagtaaaacagcttattggcaaatataacaagtggttttctttttaatctctaacatgctgttcttagcagaattaactgtcgtcctatcagaatgtcattgaatcatataaaagcaaccttgtttgtagtgtgtcacatggaaaacctcttaaacgtccaaaaagaatgtttctaaaaaatgtttaaagacttctcaaatacataaatgttgtatgaaggaaaatattagaccatatgtgatttactttgtaagtctggaaatggttattgtagttgttctaaaattgcttttctaaaaagctgctttttacgtagactgtgaactccttatgaatcagaaccgtatggttggttcaccactttatccctgcctctagttgcctacaacttgataggcaaataatataatacatgttttggggaaattaatgaaaagtcaaaataaaaaagtaaaataatgattaatatatactgaatgaggtatctctgaaaaaaatatatatatatctgagttctacactgtagaattcatttttattctaccttgtgattgacaagcacaggttttagtaacacatagtccttctacatatgtcctgtactgcaacatagcaggtaagaatgtggtgtgagccagccttgctaagcgggtcattactgagagcaggtctgatctaagcttttgttatcacttctgcaaaacaaatctttctgtggagatgttagataagtgtttcctaggaatcacatttccgtatcatttgagttcaaatgacaaagagcaattacatctattctctgtatcccagttcaaaatacatggaagaattcaaacttgcgtcacatgtctcctactaattgaaggcttgggagagggcctagcaaagcactgcacacaggccaaacccagctttctgctgccttttataaataacaatctgttggaaaacaaccgcacatatttacacattttccctggctactatacactaccatgacagagttgaggagttatgacagagaagatatcacccacacagactaaaagattcagtagctggccctttgcagaaaaagtatgtcaatccttggctttagatttcatagaacaattgtgtctctgtgtggaagaagggcagttttcagagtaaaacactgaatagatatcccattaagcaccttgtatagttggtgagggttctttgttgtatgaccagcaatccaaatcagacttcaaggggaacaagctactgatatcctaaggaggttttgtgggtagtgggggcttaagacacaccacaaacaacattttatactgtggtgatgtcagaaccaccacagtaatacagtgaagtctattattttaggtggccgaagggatttgggattggactttagctgctgactggaggtgaaaacagaatcaagacttaacagaggagaaaaataagagctatgcagtggttcctagcgaaggggttcaggacatatgaaagattcttaaaactaagatttaattaaagaaacaagcacaaaatatcatcatatggaccttaaaaatgtattagatgttaggaaacaagacaacaaatgtttggcacatggatactcagggcacacaacagttggataaccgccttaggacagaaaaggtaaactcaggttgctctggctggtgagttttagttcttggaaatacctgcttacgaaattattctgaaactgcatggtgaccctatgatggttccatgtctccgccactgaaaatatcttggagaatgcaaggaaagaggattgtatattacaaaaagaaaaactaataaaaacgagacatggatgacgagtagattcaatgtattaaaatcaagtgtctatttttagttcagattttctgagttgctgaacctaaagattagatttttttcacttacttgcttggttaaaaatcacagagtttgaatctattgggcaagtgccctggctggctatgaatttagaagggttggtaagagagacatatattcagaaggacagtgtctatgtggtgtcccaagacaagaaaagaacacactgtgttctaagggcaaacactgattgtacttataaaaggaacaaggcatgaatgaaagccttctgtgcaaatcgttatagttgcataaaaaggagtgattgtgacaaaagtaaataaataaaaaataatcgctataaagtgttttaacagtgtaaatcaagagaataaaaaggtagaggggatttcacagaatcatttctctaagcaacactccttttatctttgatgtctcttctgtacccaagatactttcaaacctggaaagaatcacaggttagtggaaaggaagaattagtggaaaggcttcataaatccagttgctcttatctcattttacagaggaagagactgagggctacagaggtgaattatcctgcttaacatcacagcttcctctttccaactgcaatgttatttgtactttctgtgttccaattactcaggggttttgtctctaggttttctcatatttcaattgttaatttgcatttttataggctgtggagaaaaaggcacagtggctactggcttctagggtcagaaatttccataaaccagcccctaatcctgcctaaatttgctggcctctctaattacctatctgcctcttgctttatgctatgatttgtgcttttgtgtctgaagccactgctacctagttttgttgacatagttttggatatggtaactcagtgtacatggttctccttctcaactaacctttcatatatggaaatccagaacagactttttaatttataattgatcccagaccttgagtattcttgcctttggtatcaattttgtttcttggagaatttataataagcgtcccatccccacactgagtttgacagatcttctgtgtgctgagacaaagattaggattaaccataaatgatgacccattcttctgaattctagattctcacttgcctactatgtgcacaatgtagtgctgatacgttcctagaatagggcttgtggttgaccaaaataaccaattaaccttagctcattatattctggaagactttagaaatgatctaatgcatataaatttcctggtatagagtagggcttctcaatattggcactattggtatttttgtttgtataatcctttgttgtggggtgctgtcctgggtttagcagcatcttgacctctatgcactaaatgccagtaacacctcaccccattatgacgataaaaaaagtctccaaattattaaaatttcgcagaggataaaactgtcctttaatgaatatcactagtatagactatggcacataggcagtacaaaataattagctatatttttacccaaatataaataaattttatataaataattttttgtgtaatttttaaattttttctttttatttataattttagactcgggatacatgtgcggatttgttatatacatatattgcatgatgccaaggtttgggctcctcatgtttctgttgcccatgtaatgaacatggtatccaataagtagtttttcaactcttttccttctctctacttccccacttttggaatcccagtgtttattgttcccatctttgtgcctgtgtgtactcaatgtttaacttcaacttagtaagaacatgtagtatttggttttctgtttctgcgttaactcacttaggataatggcttccagctgcatccatattgctgcaaataatgtcactttgttgtttcttatggctgcgtagtattccatggtgtacacctaccacattttctttcttttcactgttacaataatttatcttgtattttacagaaatctatgaacaatttttaaaaagcacttccttatccggtattgcattcttctggcagctgtcaagtaggcaataagtgtgtcaacagcttgaacaacagcatcttgcaaggatatcagaccaacgaaccactcaccaaagaacttggcacctttttaatcttgtttttagtgcaagggtatatccactctgatggcaatcctgtccaggcaaatcttcacagcatgctttgcaaaatcagtgattagcaaattagttagctttggcgcagagctgtgttcacttgcccatgacaacctggaagctgattttgatgctggcaatagaatctctagaatgacacatttctctttgtaaaaagtagagttggatgtgcttctacaggattgtgttccatgttcggcgtgtgtgacaagtaatgaattcattgatgtgtcttctaagacaatctttatctgtttcttttgtaatcttcctttgattacaagttggttattaccacctacagaaccatttgtacccagttcacccaacaaaaatgcagggaggtgtctggggagacaatacgtttgtttatagaaatctgtaaagttgacaaaagaagtttccttggttcctactcagacgacataaggaggttttgtgacaaatttccttttctctccagaaaccataactgcattgtccctacatgatgtggaacactctattcagtagcttctcatatgtgtagtctctttctaagcttgcccaaatagagcctgtctgattactgaatgagataacatcgtctttttttgctgtcttttatcttttaggcttcatctttctctagtaatttattctcatctgtgaacctgaaattcctcttttccttctttttatcgacaaacataatgtcaaggtcatcccctggttcagctggttcttaaatatcactttcagtcttaagaacctttacatcttcttcacctccatcaatatgaagtatcttttttgtttttctcttctttttcttttgattaaagaagatcaagtcatctggatcatcataagcatctcttttcctattgtcctcttcatcagcttccaaatctttgtcttcagttggctctggctccatttcttttatttttgagggttagctttcctctgtttaggtatccccaccctcatctaacataaatgacttctttttcttcctgctcatagtaggatcaaaaatcatcttgtccccagatgtggctgtagtttgagtgcgctcggcacgaatgggaagtcagacaggtcagccccaggccttggcagcagctctgctcccattggtatctctcccactgccacactaggctcttgcatcagtgaaagggctgcattttctttatccagtacaccattgatgggcacctgggtggattccatatctttgctattgtaaatagtgctgtaataatcatacaagtgctggtggtttttttttttttcagtaggacaatttattttcctttgggagtataaccagtagtaagattgctggatcaatggtaatactatttttagttctttgagaaatctccaaactgttctctagagggccaaatatacattcccaccaatagtgtataagtgtttcctttcttctgccaccttgccagcatttgttattttttgactttttaatagccattctgactggtgtgagatggtgttttatggtggttttgatctgtatctttatgaagattagtgattcaaagcatttttaaatgttggtgggccacttgtgtgtcttcttttgagaagtgtttgttcatgtcttgtgcccacattttaatggagttatttgtttttacttgttaagtttcctttttttaacttttaggtttaaggatacaactgcaggtttgttatataggtaaattgtgtgtctcagggattagatggacagattatttcatcaccagtgtaattaggcatagtaaccaataaacagttttctgatcctctcccttctcacatcctcctccctcaaaaaggccctagtgtctgttgttcccttctttgtgtccatgtgtatttaatatttagttcctactgataagcgagaacatgtggtatttgcttttctgttcccgcattagtttggttgagattatggcctctagctgtatcattgttgctgcaaaggacttgatctcattcactcttatggctgtgtactgttctatggcatatatacacacatacacacgcacacatatacattttatatatatacacatatactatgtgtgtgtgtgtgtgtgtgtatatatatatatatggcacattttctttatccagtctacctttgatgggtatataggttaaattcatgatgctgctattgtgaatagcactctgattaatttttgctgaaaatattttcttccattctgtaggttgtctgtttactctgttttttcatttttgctacctggatccagcagctgttcttttctgatgtatggtcttcattttatccactgttattctattaactacctcttactttattaaacaataatttctggcttattttagactaagtgttattgcttgtgtcttgcaaacaaaaaccctaattaatacaaaaattgattatgaggtaagagatcttcaggaaaatgctgaatttattcctggctgggataagatgaaatgcatgacccgagatgaaaaaacaaaaagaagattgcttctgatggcatagaataatatataatgagagaagaaaaactaaaaacacatacattattttctcaaggtccaaaaggaaatccccagccttttgaggatatatttgaaaatactaaaataatttcttagaccttatgaccctgggctaagatcagtaaacaacaacaaaaacaaattaatataccagcaccactgccaccaccaaagaaaataattctctgggatgctgggttaaaaaatcatgtgaatttgtcagacctaatgtgaaagttcatacattaattaacagagaagcaaattacagtaatatgacaggggttataagaagatgcatgaatttgtattacctcaaactcataaaccccagaaacccttggtgaggttttttcacacttgcagaaaacaattcatgcatttcttcttgcctcaatcctcatattaggccagtattcagattccaaattcatcatgttctagaggttaaaatgctacctgagaagaaaaaacaaatagaaagattgcagggatttgctaattttatcactcaaaacctgatgagtatttgtagaaatggattttgagtttgcagaaatatggaagtgaggaataaaactttagctcaggttgaattttctcataatggtgaactaatcagagactttggccattatgtcttcatgtaaatcttaatctaagattgttggatttatatatcagctgggtctatctcacttatttcttcattatatccctccagaaatttcagaagttgttcttttcaaaaagttttagggataggttaattaaggaaaatatagtattatttaaaaggaggaaaaaataagaaaacatgttttattggttgctctctttccactaagaatgagttagaaaggatttaaaatttcatctcagtgagattgggaggatcacaggaggttgagccaagaaatgataaaagtgtatgtgactgttataataggcagcagaataggtgggtattagaaatcccttacaccaataaagatctctacctatggttaattattatggggttcttaggaataaaataaatgtttctccaaggtcttacctgatttacaaaagcaagacactccagatgtggcagacaaaagaacagagagcaacctgagaatcatggatccgcaaccgtattttaaacttgagtcagtttatcaacccaagggccttgaacatagacaggattacctatcttgggtagggtggaccccatttgacatcacagataaacacagtgaactcatccctagtctttttgaaagaagcctagagcaatttgggcaactgtgctctaagaaaatcagtttattcatctgtaaaatgatataattatggtagctaacctacaaattgttgtatttaggaaaataaaatgcctaaaacgtatagagaataatacctagtacatactaagtacttaataatgttagctattattattattaaatgcaagttcttacaacacttatccccaggaaatatgccatacttgtattttacggattctgttgttagctgttgtgaacagtagttatttaagctattcagacaaataagaggtcatcaggtgtgactgtataaggtaatctgaagcaccaaagtagaacagtgtgaaagttgtcagtcatggaagtttttaaaagtccttcaatttgtcccctgtttaatcagatatctaatttccttgaacttgcgattggctctgtaggtaaggcttggccacagacccctgactttgagcaagaggtactcttctttctctaaaatttagtagtgccttagacatactccttatatcattgattgcattgcattgtagtttgttgatcctgtgtattcttaccctgaagaagaactccttatgagacaagggaaaatattatagtacacttggtggcaggaaattgggacaaaagtctgcagtcttccatttaataaccattgcattttaccccctaggtagcattttttctgatttttcaagccatataaccaaaattcgtgtctgttattacactattatatggtaaaatggtaggagtgtggagcgtagggtcaatcttcctgaatataaaacccaggttcaccatgaatgaccaggtgagctatcaacattctcagtgtctctgttttcttctttctaatatagcattgatatgaaaattaagtagatcaattcacataaatcattaaagcagtacctgacacatactaatggctcagcatattttaaattgctactgaaatattcaaataaaaaatcataaatatgcttcattcactgttaatacagatatttgttactagtatgaattgttttacaatgtgtaaacaaatgaatgaattaattaatgaataactttttttctaaatatctgatgtgtgttgattcacattgtttttttttaacttgagaagactggagtattaaaaggtcacttctgatttcactactatttatttttaagacttacatgtgagctagaacttcacatttggagaaaatacaagacaattacatgtaacctcaaaagattgccgtccctcaaggtgtccttgaccttggccatgctgagtctttgtttataaaaaggaagaactggtcctttcctcaccatttgctctcctacaacgactatgactgcctgttcccatagttctgagcaggaaacgttacttctctatgccttcatatagttgaatgcaaaggcttttcttccttaaaaaatataacatttgtttaaaatgcctgctgtcttagagataaatttaacgttccagtgaaagtgtccttgcatattaatatttctaaaataattattccttaaaaagctctaatttatattcttgaagactgcataatttttaacatttgcaatataacactaaaattgtgttctatattcaacttaaataactttttatgttttatttcatggttttatatagtgtcttactgacatttgctatccatatttgaaatcttatattattgctggtttaatagagtgcatctataaaatagtatacaagattgaacacttaccataaatctcaagaagttggaggaggaaatggctccaaactataatgttttaaaatggcttagtgaagcagaaatttcactacatttcttttgctagaaaactgttgctgcaaaaaccagcacttagaaaagcaagtagaactagacatttgtaattaatagtcaattttgaaagaattaagagcactgttgtttcaggtgaagtactttgaaatgtaattatatctccttctattggaaattgtgatataaatgttccaattaaatttaattgattttacttctattaaaaaaatcagatatataattaattatgttatagacttaatatagccatgagaccatattatgtatctgtattctctctctctctcaaatgctttcttaacagtattttttattagtatataaaagtatttttatgactcatatcaataaaatcaagaaaaatcactaaaaatttcataaagtgaaagaaaataaacacaaattattttgaatttttcagaagtatggtttcgaagttttaagttaagcttgcttttattgcaaatatatattttagggttgaatagtcaattccaatataggatttcatagagtgcatctcatcctatataggatttgactattaaaccctaaaattttcttttgtaaaatggtgtatttcacaatatatatacatatatacatacacatgcatataaatatatgcatacatatatactcacacacatgtatatgtatattttcatagccagagtattaggctattcagaaacataagaggtcatcaagtatgagagtataaaagctgcttttcagcattaatgttgtgtctataattctttatggagcagcaaagcttaaatgactaaagcacggatgaaagtaatgattaaaatacacaacttctatttagattaaatatgagaatttaggttgttctttttatttttattttttaaagttttgtgggtacatagcaggtgtatatatttctggggtgcatgagatatttaggtatagacatgctatacacagtaatcacgttatggaaaattgggtattcatcccttcaagcatttatcctttatgttatagacaatccagttatattcttttagttatttttaaatggacaattaaattattatcaactatagtcaacctgttgtgatatcaaatgttaggtcttttttattttttctatttttgtgtgtgtgtactcattaataattcccaccttcctcccagccctccactacctttccctgcctcctgtgaccatcctcctattctctgtctccacgagttcaattgttttgatgtttgtattccacaaataactgagaacatgtgatgcttgtatttcagtgcctggcttattttgcttcacataatgacctccaattccatctatgttgttggaaatgacagaatgttgttctttttgatggctgaatagtactccattgtgtttaagtaacacattttatgtatctattcatctgttgataaacatacgttttactacatcttggctactgtgaacaaacatgagagtgcagatatttctatatactgatttcctttcttttgtgtatacacccagcagtggaattgctggatggtatggaagctcaatttttagttttttgaggaacctccaaaactgttttccatcgtgattatactaatttacattcccaacagtgaacaagggttcctttttctctacatcctcgccagcatttgttattgcctgacttttgaaaaaaaagctgtttttacttgggtgagatgatatctcgttgtagttttgatttgtatttagctgatgatcaatgatgttgagcactttttcatatgcctgtttgccatttttttcttctttttagaaatagctattcaaatcttttgaccatacttaattggattattagattttttcctgtagagttgtttgagctccttatatattctgattatgaatgccttgtcagatgggtagtttgcaaatattttctcccattctgtgggttgtgtcttcattttgttgcttgtttcccttttatgcagaaatattttgacttgatccaatttgcccatttttgctttggttgccagtgccgttgaggtattattctagaaatttttgccaagaccaatgtcctggagagtttctccaatgttttcttatagtagtttcatagtttaaggttttacatttaaacctttaatctattatgatttgatttttatataaggtgagagagatagggatcaagttacattcttctgcatatggttatgcagctttcccagcactattcactgacaagactgttctttcaggtgtatgtttttggaagctttgtgaaaaatgagttcattatatgggtatgaatttgttttcatgttctctgtttgttgaactggtttatgtgactgttttgatgccaatgctatactgtattggttactatagctctgtagtacagtttgaaatcaggcaatgttattcttccagtttagatcattttgctcaggatagctttagctattttgggtcttgtgtgattctatatacagtttaggattgtttcatctatttctgtgaagaatgtctttggtagtttgataggaattacacagaatttgtagatttctttggttagtaaggacattttagcaatatttatcctttcaatacatcaacatggaatatctttccacttttggtgtcctcttcaatttctttcattagtgttttacagttttcattggagacatctttcaattccttgcttaattttttttcttaggtatttaattttatgtgtgactagtgtatatgagattaattttttggttcctttttcagattgttgactgttgggttaaaaatgccactgatttttgtatattgattttgtatcttacaattttactgaatttgttgatcaattctaatagtatttttgtggagtattttgttttttctttccaaatataaaatgtcatctgcaaacaaggataatttgacttcttcctttccaatctgcatgtcctttatatctttcttgtgtctgattgctctagctcagacttccaatactatgttgaataacagtagtgaaattaggcatgcttgtcatgttccagatcttaaaaaaaagttttcactttttacccattcagcatggtactagctatgagtctgttgtatatggagcttttattatgttgaggtatgttccttctatacccagtttttgaaggtttttataaaggaatgttatgttttaacaaatggtttttcatcatcaactgaaatagtcatacggttttgtctttcattctgttgatgtgatgtatcacgttgattgacttgcatatgtttaaccatccttgcttccctgggtaaatcccacttggtcacgatgagtaatctttttaatgcatagatgaattcagttcgctagtgttttgttgaggatttttgcattagtattcatcagatatattggcctgtagttttctattttagtgtgcttctgtgtgattttgatatcagggtaatactagcctcattgaatgagtttggcagtgttccctcttctagtttttggaaaagtttgagtagaattggtattttctttaaatgtttgatagaaatcagggccgggtgcggtggcacatgcctgtaatcccagcactttgggaggcagaggtgggaggatcacttgagatcaggagtttggaaccagcctggccaacgtagtgaaacaccatctctaccaaaaatacaacagcaaaaacaaaaatagctgggcgtggtggtacgtgcctgtagttgcagctacttgagaggctgaggcatgagaatagcttgaacttgggaggcagaggttgcagtgagctgagatggtgccagtacactccatcctgggtgataaagcgagactgccaaaaaaaaaaaaaaatgttcggagaattcagcagtgaagacatcgggtcccgggcttttgttttctttaccaggagcctttttattatgactttgatctcgttacttttattggtctgttcaggtgttgcacttcttcatggtttaatcttggtaccttgcatgtatccaggaattaatcaatttcttctagattttctaatgtattggcaggtagctgctcacagtagccactaatgagcctttaatttctacagtatcaggtgtgatgtctcctttttcatctctcattttacttatttagatcctctctcctgttttcttactttgcctaaaggtttgtcgattttgtttgaattttaaaaaaacaactttttgttttattgatcttttgtgttgctttattttaaatttatttatgttctgatctttattatttcttttcttccctagattatgggtttggtttgctcgtgcttttcttgttctttaagatgcatcattaggtttttatttaaagtgtttttcgatgcagacacttatagctatacatttctctcagtactgttttcatgctatctcagaggttttggtatgttgtgtttccattatcacttgctttaagaaatttttcgatttctttcttaatttctttatttgctcactagggatttgggagcatgttgtttaatttccaagtttttgtatagtttccaaaattcctcatcatttatttataattttatttcattgtgttcatagaagatgcttgatattgtttcaatttttaaaaaatgttttaagacttgtttatgacctaacatatggactcgagaatgatccatgtgctgaggaaaaaaaaatgtttattctgcagctgttggatgaaatgttctgtaaatatctattaggtctatttggtctataatgcagattaaatctgatgtttctttgttgattttctgtcagggagatctgtccattgttgaaagtggggtgttgaaatctccagctattattatattggggtctatctctctttagctctaataatatttcctttatatatctgggtgctcctgtattgagtgcatacatatttagaataattacatcctcttgctaacttgacccttttatcatcattagtgactttctttgtctcttctcaccatgtttgtcttgaaatctattttgtctaattcaagtatcactactcctgctcttttttggtttcctttggcatggaatatctttttccatccctctattttataaatgacaatgtttcttgtaggaaacagatcattggttcttgtttctgatccattcagccactctgtgtcttttttcacagagtgtaaaaataataatattgaatgtccatttaaattcaatatttttattgataaatagggacttactaataccatttgctatttgttttctggttgttttgtggtcgtgccttcttctttcctccctcctgtcttagttttagtgaaagtgattttctctgattgtatgctttaatttttttgcttttttctttgtgtatccgttgtttgttttctgatatgaggcttgcaaatactatcttatagctcattattctaaactgatggaaactgaacacagattgcctaaaaaattaagcaaacttgcaaaaaaaaactaatagaaatctacactttatcattgccccctagtttttaactgattgttgtttctctttatgtcttgaaaagtggtggtggtaatcattttttattgtttcactatttagtctttctacttaagtcaagagaactttacaaaccagttactgcatcctactattctgtgtttctgggtgtgcttacaattaccaatgagttgcatattttcagatgattccttcgtgttcattatcatctttttctttcagatgggagaattccctttagcattttttgtaggacaggtgtgttgatgaaatgcgccagctgttgtttgtctgagaaggtctttgtttctcctttatgctaaaaggatattttcaccagacatactattttagagtaaatttttttttctcactttaaatatctcatgctactctctcctggcctgtaaattttccactaaaaaatctgctgccaggtgtatctgggctccattgtatgctaactgtttcttttttctcactgcttttaggatcctgtctttttccttgacctttgggagtttattaaattccttgaagtagtcctatttgggttaaatctgcttggtgttctacagccttcttgtatttggatattggtatctttctctatgtttggaaagttatctagtactatccctttgaacaaactttctacccctatctcttactctaactcctcattgaagtcaataactcttagttttgcccttagaggctattttctaaaactcgtgagcatgctttattattttttattcttcttttcttttttgtccttttactatgtactttatagtagcctgtctttaagctcatgaatcttccttctgcttgatcaattctgctataaagagactgtgcattcctcagtgtgtcaactgcattttttcaactctagaaattccgcttcattgtttttaattattttaatctctttattaaaatatctgatagaattctgaattccttttctgtgttatcttgaatttctttgagtttcctcaaaacaactattttgtattctctgtctgaaaggtaaaatatctgtttctcaagaattggtccctggcaccttatttagttcatttgactggtaatgttttcctggatggtgttgatgcttgtagttgttcttcagtgtctgggtgttgaatagttaggtatttattgtactggtcacattctgggcttgtttttgtttgtccttcttgggaaggctttccagatattcaaagggacttgggccccaagccccaataacatggtttttggttggttggttgtttttttccagactcatagaggtactggcttggtagtcttggataagatccagaagcattatctggattaccatgcagagactcttgttcctttcccttactttctcccaaacatatagagtctctcagtctttgctgagccactgggaactgggagtgtggtgatgcaagcacccttgtggtcaccaccacttagactgtgctggatcagactggaagccagcacagcactggcccttgcccatggcctattctttctgggtgacaagttcccccaggctcctgacatatccagagatgctgtctgggagccagggattagagtcaaaacctttccaatttacctgatgttttttctactgcagctaagctggcactcagaccacaacacaaattccttctcactcttccctcccctttccacaggcacaggagcctctccctgtggataccagcaccaccagtccatggtggttctgccaggccactactgatattcacttaaaacccaagggatcttccatcagcttttggtgactgctaccaggcctgggactcactttcagggcagtgggctcccctctggcctaggacagttccagaaatgctgtccaagagcctaggcctggaatcagggaccctagaagcctgcttgttggtctaccacactgtggctgagctggagcttagggtgcaagacaaaatttcctttattttttcctctgatttttttcaaacaaaagaagtttttcttcatagccatcacagctgagaatgtgcggggtctcccctgacgccagcatgtctcagagcccaaggtccacggtatagtccctgggtattgctcatggtcattcagggcccaagggttctttattcagcaggtgatgaatcttgccatgactgggtccttcccttaaaggcccttttgaacaagaatatgtctaagaaatgttgtcagggagctagggcctggaatggggtccttaacaacaatgcctggtactctagtctactgtgcctgagctagtattcaagatgcaagacaaagtcctctttattctttgctcagaataaagggagcatcagtgggaggggtggcatcggtgattcaaggttgcctctccagacttcctcaatgactcttttcatgatataaagttaaaactggatactgtaattgctcacctgatattgggttcctgtggaatgcttttctgtgtatagaaagttgttaaaatttggtgttccagccagggcgataaacagtgtaggcttttattcagcatcttactctgcccccctattttattcttattttccctctgaatctgatgataactagatcatattcaaagtcttttttactttaaaaattagaaaaataccttttatatatcctcatattacagaatatttaaattggacttttaagctttgcaatattaaaaagatctaattcaactcataggttaatcagctttcaagatggtgcccaatattccatacctcccaatattcacagctttgtatcacctcatcttcacattgtaccaggttggatctgtgtgaccaaaaggatacagtagaagtggtggcatgccacttctgagattaggttagtagagcattgtggcttccttcttgagcaagttacctggtttcccccttggatagctcaccgtgagggctgtgaactaccatgtaatgactagcctatgaagaggcccatgtggaaagtaataaaaatttccttccgatagctgcatgagtgattttagaagcatatattccagtcctagaagacctctatccaagctattaacttgaatacaacctcatgaaagattctgaccaagaatcacctacctgagccattcccagaatcctgaccctgaaaacctgtggggtaatagatatttgttgttataagtggctatgtttgaggttaatttgttagcagcaataggcaacaaagaaaagaacaagaccttcaatttcacacccttcatagtaaatcaggatcagtgtctaagtgtgaataattaatggcatctggtccaggaacaaatcattttgctatcaaagactatttgtttctcatatagatgtctgtacccatacatataagggtagctgaattacaaaattaacctcaggaaattatcgagcctttctaagtggctcgcggagtcttctatgatccctggtcccactatgtacatatctacctaaggtatattacagttattctttgtctattttaattgctagattgcaatttcttcaggatagggcctgtcttttgtattcctggagataagtactcaatgcaattcctggtatatagtagttactcaatatatagtagccaaatatatgtctgagttgttacattgtaggttcaattagatccaaaaaatagaattttttttagtaaaataaaagtgttataataattgcaggtgagattaaaagaaagtggacagtcttgaaggatatcttccagactcaagtcacattgtgcacatgtaccctaaaacttaaagtataataataataataataatagtaaaagagttaaatccccaggtgccaagtttccctgcttcggacagtcctgaatatatattctgcaaaatttacttttcagttttctactttgctctccctatcactcttctcttgatatatttctttagctttacctgtgtgattcaagaatgcatttaaagaagcccctttatgccagtccacattgcataagagaatactttagagacagaactatatacattcctgctgggctatccagcagtgattgtgtaaaacattaatgaatcctttttgcttttcaccctggaagaccaaatgcacatctgttgccagacaccttggtgtatggcacatttaaagtaactgcaccagaaaaatggaaccattccagctgctctccacctttgccaaaaatgtgccagtcattttgcttaatgtggtagtgaaaagacagatatacagatgtaaagatcaaaataagttgaagttgtaatttatttatatagaaaaaaataagatttgatacattccacgatgtttttggtaagttactttgtcctaagtagattcagtggttatctggccatgtctttccaaagttgggttttaatatctattttatttaataattgataaatagtttcatttataatcaattatcatcatcttctaaagaattgcagtttcctagcttaaaggaaagagttaaagtttgtgttccagttaatagctgctttctgtgttggatgcaaatattacaccagtgacttatttcattatttagataatcttcacctgcaataaactttagtccaggcagctaatgttcccataatgttttctgagagaagctaatgttagaagcctctaaccatatttgcaaataaatccatgtgtcatgacactcaaatgattggtccagagaagctaatgactttggtgacttttgtggcatagatttcagacagtaatttttagagagcataaagattaagaagaagagaaactaatcacctattcctacagtctcatatttttaaagaccttgaaagataatgatctgcataccatgcaactacagtgatcctaaattacttcatctaaattcaaggtggtaacattaaatatcagattttatttttatttgttttacatgttatttaaaatcagcattgggggagtaggtcactcattctgaaagaataatggaggacagaaaattacatagaaattattttcagagtattttaaactcattggtttgatatgtataaaaattactctccaaacaactaactgaatgtgacatggacaaacatttggtaaaagtagaatgaatgcctgttttttttttttaaaaaaatgcaaataagcctggatttcccacactctctttgccttaaatagtgaaccaaatatgtttagtatttccaaattaaaagtcacaattattttctgtatggttcaatttcttaccagaattatttattgacattatgaaaacaaacactttttcttcacacaaccaaaggcaaatggaggcctatttcagtggggtttagacatcagttatagtgtctgagcccttttaagtttgtgtgtttctgtgtgtatgtttttatgctaatggtttctcatataaaatggaaaattgcttattgtgacacttatattgagaataaacccgttatattgaaaagatgaggtcatttggttactaatgacctgtaacttcatttttgatccaaaaatgtcctctgaatttcatacaagcaactgtgtatttgccattgtcaactagatgcttaagtccacttcaaactaaaaatatccaaaataaaacacgtgctttccctgcccaccactctcctcctctaatcaaagctgtcagacaactattacgtcttcaaagtattctctctgcctatatactcatgctgccttccaatttttttcactttctactgtctgaaccatcttttaaagatgcaactctccttgaagaggtctttcacatcccttgtaagttgtattcctaggtattttattctctttgtagcaattatgaatgagagttcactcatgatttggctctctgcttgtctgtcattggtgtagaggaatgcttgtgatttttgctcattgattttgtatcctgagacttagctgaagttgcttatcagcttaaggaattttggggctgagatgatggggttttctaaatatacaatcatgtcatctacaaacagagacaatttgactttctctcttcctatttgaatatcctttatttatttctcttgactgattgtcctggccagaacttccaatgctgtgttgaataggagtggtgagagagggcatctttgtcttatgccggttttcaaagggaatgctttcagcttttgcccattcagtatcatatgggctatgggtttgttgtaaatagctcttattattttggtatatgttccatcaatacctagtttattgaaagtttttagcatgaagcggtgttgaattttattgaagtccttttctgcatctattgagataatcatatggtttttgtcactggttctgtttatgggatggattacatttttgaagaaaaagtcccttccatataatccgtgtgtacacttttattttttcccttaatcatacttattagtttgtaatacagttactgtttgatcacttgtatactactaaaaattataaggataactctgcccagaaacatttttaacacctcaatctttagagtcacaagaaagaaaaattatataaatatgtggttataatgtctgttgtgaagaatgacatactaatcaataaaaatttttcaagcatgaaaaaaaaggtgcaaatctgatcatgtgtggtgttctggggtttcaggtgttcctcattaatcagtttccacaggagtaaccatttctcttgactcagattttcatcaaagatgaatcttaggcactatctgaacttcaagcagtctcttctgcagcactcttataaaatgggtggcataagcacaccagatacagtcagaatgtcagatgactcatgatttggctctctgtctattattggtgtataagaatgcttgtgatttttgcacattgattttgtatcctgagactttgctgaagttgcttatcagcttgaaattttgggctgagacgatggggttttctaaatatacaatcatgtcatctgcaaacagggacaatttgacttcctcttttcctaattgaataccctttatttctttctcctgcctgattgtcctggccagaacttccaatactatgttgaataggagtggtgagagaggacatccctgtcttgtgccagttttcaaagggaatgcttccagtttttgcccattcagtatgatattggctgtgggtttgtcatagatagctcttattattttgagatatgtcacatcagtacctaatttattgagagtttttagcatgaagggctgttgaattttgtcaaaggccttttctgcatctattgagacaatcacatcatttttgtctgtggttctgtttatatgctggattgcgtttattgatttgcgtatgttgaaccagccttgcatcccagggatgaagcccacttgatcatggtggataagctttttgatgtgctgctggattcagtttgctagtattttattgaggatttttgcatcgatgttcatcagggatattggtctaaaattccctttttttgttgtgtctctgccaggctttggcatcaggatgatgctggcctcataaaatgagttagggaggattccttctctttctattgattggaataatttcagaaggaatggtaccagctcctccctgtacctctggtagaattcagctgtgaatccgtctggtcctggactttttttggatggtaggctactaattattctctcaatttcagggcctgttattggtctattcagggattcaacttcttcctggcttagtcttgggagggtgtatgtgtcgaggaatttatccatttcttctagattttctagtttatttgcatagagctgtttatagtattctctgatggtagtttgtatttttgtgggatcagtggtgatatcccctttatcatttttcattgtgtctgtttgattctttcttttcttctttattagtcttgctagcagtctatcaattttgttgatcttttcaaaaaaccagctcctggattcactgatttttttgaagggtctttttgtgtctgtatctccttcatgtttttgtagtggctggtaccggttgttcctttctatgtttagtgcttccttcaggagctcttgtaggggaggcctggtggtgacaaaatctctcagaattgcttgtctgtaaaggattttatttctccttcacttatgaagcttagtttggctggatatgaaattctgtctgaaaattcttttctttaagaatgtcgaatattggcccccattctcttctggcttgtagagtttctgcgagagatccattgttagtttgatgggcttccctttgtgggtaacctgaccttcctctctggctgcccttaacattttttccttcatttcaactttggtgaatctgacaattatgtgtcttggagttgctcttctggaggagtatctttgtggtgttctctgtatttcctgaatttgaatgttcccctaccttgctaggttggggaagttctcctggataatatcctgcagagtgttttccaaatgcttcaaagagaatagaatacctaggaatccaacttacaagggatgtgaaggacctcttcaaggagaactacaaacaactgctcaacgaaataaaagaggacacaaacaaatggaagaactttccatgctcgtggataggaagaatcaatatcgtgaaaatggccatactgcccaaggtaatttatagattcaatgccatccccatcaaactgccaatgactttcttcacagaattggaaaaaaactactttaaagttcatatggaaccaaaagagagcccgcattgccaagtcaatcctaagcaaaagaacaaaggtggaagcatcacactacccgacttcaaactatactacaaggctacagtaaccaaaacagcatgttactggtaccaaaacagagatacagaccaatggaacagaacaaagccctcagaaatcataccacacatctacaacaatctgacaaacctgacaaaaacaagaaacggggaaaggattccctatttaataaatagtggggtggaaagtggctagccatatgtagaaagctgaaactggatcccttccttacaccttatacaaaaattaattcaacatggattaaagacttgaagagggcatcacaatctccctcttttagcaggaaccagtacatcttagggagggtaaggaaagtaagatctattctcatagcagtctttgagttatctgcaaatcaaagaagagatagctatgacataagctaattcctatgatgtcagcaaagaccagggaggatactcccaatgggacaagattctccatagagaaggcacaacatgttctctgtatgtgagattaatttgctgtagctgaagttcaagaagattttactgcatatttccagctttttgagtctcatctttattatgagtaattatccagaattccttcctcattgttatgcccagagacttctattaattagctaatagcctgggaattcatttaaggggtttatttacctgatataagaaaagccacgcaactcagtattaatcttttctccatgactgtatcatatctgatgactttaaattgctcttaagacaagaaaaacagatcttacaatgcctatgaccttttaaaatttccaaacagttttatgcttcctttagcttccgcaaccttgcaaatgccactacactttacctatgatattctcctctaatttcctctagttagtgcatccttcaggtctcaagtttaagtcatttccatgtatgacatcatgtttccatattgtacgtgtcagagcactcttctacaacaaattattcactgctatgtttatatgtgtcttctaattgatgtccctctctaccattagaatgcaaatttcatgaggcacaagccatgtatattatgttcatggtaccttgtacaaaccagtgatcaataaatatttgttaaatagttcaattaatttaaacaaaaggacaaaaaatagctggatactataaatttttaagcatacttataaaatgcaaaaatgtaatatctgcactcaaagcaaaatttattataggcagttaaatatttaaaaaagtgccctattaacattttaaaaatgctaattagaatatgaaacaataaaatgggaattatcagaattgtccaaataatgaagcaccctaatgttagctttcatctataaagttttattaacagttttcatttttgaggataaaatatattataggaataaaatgtttctaccacatccaactgttttcaaaatgttagtggtatcaatgtctttgtttcacaggtttcatcaaagactgaagtgactgaaatatttatgtcatttaaggtgcattgatagagggctccagtcagggcttaccattatattaaaatttcgctaaggaaaatatttttataaaacatgtgtaaatctgtattagagagacacataatatgaactttagataatccactttgtgaatcacttttttttttaaaggctattttcatgaaatacagtttcgagcgctattctctccctccaatgaggaaaaattagataaatatatgtagggcatttgaaaaactaattcatgtggactatttcagttttatgatagcagaagccaaaagggatttaaacaaatagttcttttttctgctttcctcttctgtgttaaggattcatttcacaatactattgaagcctatttcagtacacaaccaaatgctcaagtgacttatgaagtaacatttaatgtcaaaaaaacgtcattgtccagtgcaaaatcaatggcctggtcgagttaaagacatattttaaatctgattacattagatggcaactctaatgagaacatgtaacaactattatcctgttagacataatttcaatcacgaatgtcagacatcattaattttgattgcttggggatttagaaattcatttttatgaaatattgttttgtgaaatactgggaagagttttttatttatttcccagtattagcgttaggaaggggagaaaggtgttgcagtctactgaattacagaaaataagaaaggtcaaggtaaaagctatgccaatagcaaactgaatcctaggaagatataaaatggcctttaagaagaagttgagcactatatcagaaataaggtaattatttggtcatattataatataagagaaatcacttagattaaaatatgcaacctagattcattcataaaccaaatcttaaaatgatgcctgtcttttggcaagtagtcaataatacttttatgaatgaaatgaacattacagatgttataatatttgtatcttctaatgttaaagctacattaatcctgccaagccaatagaataagagttttgtgtttttcaaggaaaaaataatttcttataaatacaagtactaatataatttgttacatatgatttcagaatttgaccaaaatgcttctacctgataatttggcactatttaaagatatagaaccttggagtttttatttcttaagtgtttgaatttgtataattctcaaatctattggttttttactttctcttactcttttctatgtactttataggtaatagcattcaatttatttttaggaacagctataaattgcttaacaatttctgcccacatactttttattactaaactagaatctttcccacagagaaagatattgtgttatgactaagtggtgtgtgaaacaaaaaatatggatattgatttttgaacttcaaacccaccattttagaaaagtaaagaggttgacatctaagcacaatatattctctcatttctggtgaccacaactcccaattacaaaatgaggttgtcccaggttccattataaatttccttcagagtttataagtcagctataaaacatactctgaagcagaaacttaacacatggggattaggcttgggagtgctttatttttaattcaaatttagtttgaatttgttcagctatttctaagtgacaggacataataaaagtgaatatgggaatgcagcatgccttttttgcatttctataactaggaaattaatttcttttataaaatataattttttcaggtcattgattggagacatgattttattgtttgagggagaaatatcaacaattgctattaaataaataagcaagaaaccaacagtgaaacacagatgataaaaaattagaatatgtagtgtctccccatagcatttatttttatgattaacaagtccctatatagccactatcagtatatcaggtagataaataaattttctgttaaaataactttgaatgcaaaaaatgtataccaaacctagaagaaatgaaaaatgctcactaacagattttcagggttttgtacttaagataatttaaaagtcagtttactaaggtcactcaaactatgtaatccagcagcaatatcagcataataactcatcaatgttatacatattataattttatgtatgtgatataattggcccttgaacaacataggtttgaattgcacaggtccacttacacacagattttcttctgcctctgccacccctgagatgacaaattcaacccctcctcttccttctcctcaatgttaagacagtgaagaataagacgattgtaatgatctatttccatgaaatggatagtaaatatattttatcttccttataattttcttaataacattttcttttctctagcttactttaatgtaagaatgaagtattttatatatatatataataaaatgcacaaaattatgttaatcgactatgttgtgggtaagtcttctggtcaccaatagactattaataattcagttttggggaaatcaaaagttatttgtagctattttactgcactgggggttggtgccattaattcctatgttgttcaggggtcaactgtataatgttatgcttatggatatatatttcctcaactttacatctgtattggagttgtcaatttggaaaaaaataattatacaaattacaaaagtaaaaatgcaaattataatttctctttcattttgaggttgcataataatatttcatttaattttttctagacctaagcttaataagggaactgttttgaattatttatttaggaattgagggtagtttaactgtgccacactctgtttttctcacccagcagtagttgtatctaattatgaataatgggttaacattatagtcactgactgtgaaacagagaaggtttcaaggactaagaatgaagttgatcagttcggtctctgaaccttgagtttactgtctataatcttctagacactaacattaatccttttcaagtaccacataagttagaattttgcctgggtttttgtggatctacactcttgctgcccctccatttcctgtattacctgcattatcagcttatatctagttttctacttcatgatcttagacacagcctgaaatgtatttaaaatttggcttggataacttctgttatctaatgttgccacaggtgcattggttacaatttctgccctcctacattcagttagtagagttttctcctcgtcagcattggttctgtagctttaactttgacatggatcagtacagtgcctgacccaaacatctaagtcttcttgcatcacttatatctggatttacccatgaaaaaccagtatgttttgagaaaggcagaggaacaaaaagatttatgttggtgttttaactttttggtacaacagtagaatcctaggactttgtcagccttgatttatattttatatgggatttttcatgtattcttttgagtaacaatagctgtaattattttttccacaacatctttgtacaattttgtaaccatgatgaagaagctataagacaagttgtcaactatttcctgtctattctctggaagtgtttacctaagattaatattaattcattcataaatggttgataaaactgtcttgtgaaatcacctactttggagttctctatgtggataattttattatttagtttgtttgatttgcttgtttttattaaggatttaattttcttagaagttatggaagaattaagatttcctacttctgttaaatttgttaagtgcgcttttgttggaccaatagaaaaaataaaatgagttcaattatattgattttctgtaaagaaaacattccattgtgaatcacagtttcagctagcaagtataaccagttaagttgtgatatactatttttagtgccaactaggaagtattgtcttaagctagtaatttataatatctaaatatatgcttgaccaaaaaagttgtatatacagacctaaaatacctacatagaacaaaggtagctgcgttggagccaggttgtacaattttttgtaacccgtatgcttgagacatttgaagcactaaccaataaatatgttattaggcaattgaaacactttataaacggaaaggtaaatgtgtctatatctgaggttttcaaccatactccaaaccaattaaacaaggatcttaggagtagagacttgccatctgtgtttgtggaaattcctagattatattaacgtaaagccaaatttgaaaaacattgatattgatggatcgataagtgattactgtcaagacaaaaatgtataggtttgaagcaccaggtgtttgttctagactatcacaagttcaaattaaagtatggaatgggaattcaatcttcatgtttcattaatactgttgttgaatagttactattatctgagactaatagaaacactgggaatgaagcagtgaacaaagagtcttaactccttgtttcatggagtatatatttggattatagtaaagaaggagtaataaacaggaaaatttggtattaataagtgttatattatacatagagatatttgagtgaagaggtatatgctgtagatggaagatgaagaaagcctatctgagtggttaagaatttatgtttaaggaatgagaaagagaatgtagtgagagtggattgtagcaagaaaagatggcacaacagcaggcacaagttacctcataacaagactattgttcaaactaatgtgaatttaggtctcatttgaggttttccctttgggagagggtacagtttcatttgcaccaaaaccatgaggccatcttgggtataatgcagagaataaattaaagagaaatcagaaaagaaggaagaagattaattgacatgatattcatgtgctcatatgtggttttgtcttgtattacggtgaaaagcatcagtgatgaaaatagatgtgttttagtccactcacattgctataatgggatacttgagtttaagcagtttaataagaacagaggtttatttggctcactgttctgcagactgcacaagaagcagaggaccagcatctgtttcttgtgagggcgaccagatgcttccactaatggtggaaagggaaagtgagcctgtgtgtgaggtcacatggctagaggggaagcaagacagagatggaagggaggtgccaggctctttttaacaaccagctctggtgggagccagaatttacccattaccttgaggatggcactaagcatttatgagggatccttccccatgagccaaacacctcacattatgtcatacattcaacaagggggatcatatttcaacatgaggtttggaggggtcaagtatacaaatcatagaaaggaggaaggatgcagagtatactttggaatttgagctgccagaacttgctgaggaattttacacagagactgaaaaaaaaaaaaaaaatggagtgacttcttagtttttaaaattgtatttgttgatttttatttttctttccttcagcaacagaataggcaagaagatggtaaagactagagaggaaaattaggtgaagaaggtgaaatcaggagtggaattttgttttggccagtgtcaagttttttgttttgttttgttttgtttttttgagatggatctcgctctgtcgcccaggctggagtgcagtggcatgatctcggctcactgcaacctccgcctcctgagttcaagcgattctcctgcctcaacctccctattagctagaactacaggtgcgtgccaccacgcccagctaattttttgtatttttagtagagacggggtttcaccgtgttagccaggactgcagtgtcaagtttgagatgcctaatagaaacccaggcaaaagtctccagatggcattggatatacaattctggatctcaaacagacagaggcaggctagatgtagaagttattgagtcagatatattatgctaattgaggcagactgccactgagtaaaagagtaagggtcatggagaaactataggtcatggggactgtgacgataggattgttgcccagaaaatgaaaagacaaggcaaaactgatcgtctggggtcaggcttaggagcaaacccattcttgggaaaagttttggtagactcggaaattagatgtcaagaaagtgttggagaaaaataagtaaccagtaaaattttgtgaagcaacaaaatgtttaggttaaacagtgagcaaacagaaagactgtgactccttatgtggtctggagactttgccttctctttccaatggggctgcagtcagttctggagtgtgacaaatctatggctcaaaaatgaaatagggagctagccaagagatttgttaactatattaatatagaaataaggctagacattgacaacagatttagtcacgtagaatatgtgggctggtcagatattccaggtgaatattcaacttttctacttcatagaattctgtagacttaaatacaggaataggattgattttgctgatcaaccagaaaaatattttctttggaggaagagtgcttactatagatgcaaatacacacacacacacacacacacacacacacacacacacacatacattagcaaaacatagtgatcctagcgctggtaagcagtgtaataaaaaacagagcaattaagtaaaatcaaattttctgctcaatttgaactcattggcatgtaaagtctactgtatttttcccaagctgtgtttatgtaattaaagtgaagaaagaagattatattacagagtgtgtttgtgacagtaaagggagtaaaatgttttatgaaaacaaatacataagaaaaattctttcaagctaggattttgtattgtttttggcatagtttctttatataataaacaagccttctgcagacagctgattggtttctacatttttcttcaagaaatatcttaagaacattctttttgcacatcagcatttttgaagcatttctgatttatttcttgtgaattacatagaatctgttgcatcatcagaaaatattccaagcagaaaaaattgttactttgcaagtaggtggatgactgtagttttgaggaaatgttgcacttctacatcaggccattttggaggaagaaaacatatctgttgtttttctttaatttttcaggaaacaccaaatgagttttcaattagtattcatgaattgtctgcacaggtcagtaatcaaattattttttatgtgtcagcctactgaagaaaagtagaaaatcactgcttactttcatgtaaattcagttgttcagaggattgataatctacttgggaagacataaaccattcattttttaattcttgtctgctggttattaatgcttccgttacaggcaagaaagtgagctatttctccagctcacagttatagtaagaggtataagggacaaaagaagcattattaaaaacttcccacctgagattagatttttttaaggcttctcttagcctataccatgaccagacatctcagaacttttaaattcgtaatcacctgtataccattacttacataatttaaatatggatctagggacaaatgaagtagaaatatctatttactttatgctgatttgagggagacgtaaagtcaaatgtaattgtagcatccagcaagaaaaagggctgagaaaaaacagtgcactgaaaggcgtgtaccaggaaaccacaggccaaccactagtttaagctgtgactggaagcattgcagaaggctaatgaaaaaagactgacctctgggtaatccaccacgtacctaacctctctcttcattccagccttccttgttcaaatgtcacctgccatgaatatagttggagccataaggcttctctttaggccacactagagtcaatgtacattgcatttgccaggcttcttgactccttcaagaagccctcacctctgccttggacccccaactgtactgttgtccccaccagaaatgttaaaataattgtcccctgaaggacaatggtggcaatgctacaaagaccttagtgtaaggttgaagtataaaaggttccacttccttgtcctatactatctttaaactcttcataatactattaacaaagtaattatagttggatgacctttattgattatctagaggtgaatgactatttacatgcaagcatagcatcaacaaaacaaaagaaaacaaaaccccaagcaagccaaaatgcaacgtaataattactattggataccaatatccccgcccccctctccttacacaggtgctcactgactccactcttttcttagatcttgatcaattgctattttcataggtcccttatctttctaaaatttttgcaaatctattctctcttgctagctgcctggacgctcatagttttgcaagaacatgaatgattattctcttttttattgtacaaaataattcagatctctcttccttattccattcatttaggatatgtccagaaggcatcatttctcttcactgaaaagttccatcagggtgttttcctaaataatataatctatctaagtgttgtcactcccttgaaggtagaagatgccatagattgcattcaattatttttcaaataattacatacacatgcagatatatctatatctaggtctagacagatatagctattgataatatgtgtgtgtagttatctgtaaaataatacatatagatatgaaaaaactcttgttcatattcaagtacaaattgcttcatagttaaatgctcatgtgtttgggtgaactataggtaaacttacgtggaggactcttcttattgggcttcccacatttggagcagcttttaccttagagcatcttaaacatcagtgtttgtcccctgaaactgatggctaatagaagcctaattattcccattctgagctctttatatgatgtctttatgacagtgcaccagctgataatggtttggctccgtgtccccacccaagcctcatatagacttgtaatctccatatgtcagaggaggggtctagtgggaggtgattggatcatggggacagatttccaccttgttgatctcatgagatattatcatttaaaagtgtttggcccctcccccttttctctctctctctcctgctccactgtggtaagacatgcttgcttccccttcaactttaccatgattataagtttcctgagtcctcccagtcatgctgccttaacagcctgtccaattaaacctcttttcttcatattttcttcataaattactgagtctctggtagttctttatagcagtgtgaaaacagactatgcaagctttaggaagggaacatattaactttacaataattttaatgacttcaaattaatatattaagtatccattctattgtgtaaaatgctttcattaaatgtttattgagaacaaaatgaaagaagggaagaagaaaaactgtttccacctctttagatattttggctaaagtgtctcaaaattatagggattgcattgtttcttcaattaggacatttaacatgtatttagtatttcagtcatggttttgctctgtttggcatatagtcaattttttaagctccctttccaaaccatcagccacgtcaatcattatgtccaggggaatgtttcatgatgtttagggacaaggattttctttgagaaattttgcactcctgaaaaagatacaggcatggtagatagcttccttcaaatccttattgtttttatggtgaaaataatgcctgcatattcagtagccattgtgcacctgcaaggtaacaaacagcagacaagtcaatctctgctaagtctagcagagcagaaaaaaaagcatagataattaaatagtgctttcagaattctatctccagactgttattttttagtaaagtgttgtttaaacattctgagtgtaatatcccattaatgcaccaatttgaattcctaactgatatattctgacaaagggatttttcaagtacagctatagaactgttcagttccaagtttctactcaggacatcttgggagatactgacagaaaaataaacaaccatcctttaatcttggtttgctttattatgattcataaagtccagtgaagtcatgactgactcatcagtttctggtcctatgatgaaaaatgaggttcagtttcattaaacataattgtttcttcatgaactataaactagcatctagaattggtttatttgccaagagagactgttattttgatatattttaattggaagcaattgtagcattttttctgcaaataataatgaacattactttctattcatgtgattacaatatctttgttaatattgatataaatattgtttggatattaaaatataccatatcaacattttttcaggtgaggtagaatcaagattgtaccctgtaatttttgctggtttcataaatgatcagagttagaactcttttaaagatgggattggaaacatcataaaacaaatgaacagttatgcaaataattgctgttatatcattttaacaattcaaattgatatgggaatttgtcatttctttgcttgaattgaattttcttcatcagttggttaaaatcagactttatgcattgtacgatttaatggctgtagatgacattcatatagaaataaagatgtaaaattgaaggaagctgctgtgtattttgattctttatgtcaaaaataatgaaaaataaccacttttcagtgatcgttctaagtattgtgttatacatacataacttatcatagtctactgatgtcattattttaccagttgagtaaaatatcttctaatggccatttatcctctggtttatagtataattgtcttaatcatttcctctctatataaatttagaaccacatcggacaatgctataatttttgcttcaacaatccaacacacagtagtttcctcttatcaaaggaggatatctttgataagaggataccagggatagtaccaggggatgccttaaaccatggatagtactgaaccctatatatgctatatttttcttttctatacaatcacatcatacagggcaggtagcatgtacaatatgggtacgctggacaaaggaatgactcatgttctggcaggatggagctagatgatgggagacttcattgcactactaagaatgacaaaatttaaaatgtatgaattgtctatttctgaatttttttcatgtaatattttcatagtgtggttgaccaaaggtaactgaaaccacagaaaatgagaccttagttaaggaagaactgctatatagatgcggcttgacttatgatgtgacttatggtttttctactttaccatgggtttatcagaatgtaaccccataataagttgaggagcatatggatttacagtcttttgaattatgattttttggctttatgataggtttttttagatattaaatacgtttcggacttgcaatattttcaacttacaatgggtttatcaagatgtaaccccatcataagtcaaggagtatctgtactttagaagacttaggaggaaaagtctttttttgttttgtctattttttgattatcatgttcttccttcctgatattccaaaatttctactactattacatatccatgaaaattaaaaatatatatattttatatattccttcttttatcatttttctgtttagatagcttcctctggccattattttatggtaggtctactgtagatgaattatcttattattcctttatctgagaatgtcttcattttctgtcattcctgaagaatatttttactggatatagcattctggattgacaattcttttcttaccacatttgaaacatgatgtgtttatttctgccctccatgatttctagtgaaaaattcactgccattcacattgatttcccctatgcataaagcattccttctttcttgctatattcaatattttttctgtcttagttttcagaagttttactatgatatctcttactatggacttatttgggtttattctgttggcagttcactcaacttcttgaatctataggtttatgtctttttctgaaattgactatctagcattatttcttcaagtgctttttcaattccctcctttcctcctcctcctctccgtgtgcaactccagtgaaaggaatgatagatcttttcttgtaatcctaaggtgtccgaagctctgttcattattttttgaatcgatttcctctctgttactcagactgggtaattctaatgttctgtcttcaagtttctgcctctttcattatgctgtttaacccatacattgagctttatttttgcaaccgtacttttcgtttctaaatttttaatttagtttttttcctttttttatttctttgctggaaatctctatactttgtgtgttgctaaatggtcattcacatgtttttacggggactgctttaaaattttgttatctatacctaacatccctgtatctagtgtttggacttactgtctttctctcaattagttgagatacttctggttcttagtatgatgagtcattttttattgaaacttgggcacttggttattattttgagactctggatcttactaattttcagtttacctgattttcactactccagcagggaaagagggaggtgctgccttgttactgccaattggagattgaagtccaggcttccctctttaatctctgttgacaccgttagccttctctgaaatcatcctagaggtgggtagaagatggagtgcttgtgagtctcatcttagctgagtgcaggtagaaatctaggctacccagggaagctgctggtggtgtaggtggggttggtcctacaggttttgttgttgttgttgttgttgttgttattgttgttcttttcttgtggtgtttggttgaagaagagtagttaatgtctaaaactttaatgcgaggcttccccatttctagttttttggtaataaagagctagacatcatacttttttgttttttgatcttgttgtattcttgttgttgttgttgttggtggtggtggtgtgtgtgtgtgtgtgtgtgtgtgtgtggtgtctcattagaatttctgtgtggctggcttatttaacactcaaccttaaatgtttaaggaaaaaaagcaaatctaggaagctcactattatgggatttttgggggtgttgcttttctagctggaaacctctgtgaccggttgtgcttttgcccaagttttgctcagccctgcctggtccactcggcctggcaggctacagtcagctcttgctaccggcctggatctcatacttctgaagagactggagtggagtggcaagaggtgtgtgcgtgaacaggcatggggtccagccactgcacacagtcaagcacactggctgctgcagtgggtcaggcaactccaggtgccagcacaggtgccagctcattacaaggctgtggctggaccaggcacaccaaaagcaccttccatggctggcactggggaacatgatggtacctggaagcttgaggactccagaaacttcaggggttcaaagggagagtcacagcccttgctaggagagcttgcaggtctgggatccccaaagggccacagctcttctctccttctcccttctctccttcttgtcacccacaatgtgatgagcaaaaggctgcttcagctctgtttgtattacagctcttttaacccctccacagggtgggtcccaagttcttgtcctgtgtccaggaagaatgaggtacgtagacaagtggagggtaggcaagacagcggaattttcttgagtgatagaacagagaagacccagagaggctatctcctctccataggcaggtcatcctgttgagtattcagttctcagcacagaggtagctcttctctgcagtgggtcatcagcagatgggagaacctggagtgggaagctcctctctgcagttggtcgtcccatcatcttccagttgcctctccatcctctcctggagtcttgctgagtctgggggtttccatggcctcagaggggaggaagtgcatcctgattggtccatgggcagccatgggtgggcccagggaaaagcatcacacattccgactcctgtccttgggactggcagcctggccccaggcttcagaccttccctggcttgaaggtggggcttcaccagggacccacactcttccaccctgaagcctttcagtctcctgctgctgttcatggagcccaggctgtttatgtcaagggccacctgcagcccaggactaggatgttttcagcctccccaccccttcattctccctcccgtactcatcagtgcctaaagtctggagggggctgagatagcagggggctggtgttgtcagtgctgcctgagcatgtgcacaccggctgggctgcaacagcacccggacttggccccatttttgctctgagattggagtgagcgctgggagcagggagaggccaggcagccagagcagacacctctgagcgtatagggggtaagggggagccttcctgtctcccagagtgcagagatgcctgggtctgtcgccttagctcgatagctgcagctggaaaagcagggctcttgcctgctcccggcacccaagagggaggcctatgtccacagccaggacttgggctgctggagccatgcctgggagggtgggactgctgtctactcccggctcctgcaggctctgtggagggcggtaccccctcaggcccagctccaccccagggcccctttctgcccacccatccgtgcccgactgcactgctccccaactggcgggcaacttggcccagccccatcatggtagactctggggagctcccaggttgggctcgccggactgtccgccgcctctctgtgccctccctgcagtggtggcaggctagagtggcgacatggggccaggggccaaagcggcagaggctcctggtctgacagtgggtcccgccaggctgagcaagggcaggggcggcacagtcggctgcctccaagatacggggcataggggacacagggcacaggagtcccaacactgccattgcagctcccacccgcagcgacctgcccgcacagccccccacccccttagcagccagcaccatgacagtggttgctctggacagcccactactgccatcatcactaccacatcatttattgagttctgaggtccctagcatgtctaccttctctccgcctttcaaaagtcttcttagcttgattttacatacgatatgcagagtttttagctacacttggcagacggaatagggaaaagttcttctatcttcccataagcaaaaatgcatttgctctttttttaatttactggacagtgttctgttgtatggacagatcccatttcttcattactcaattgttgtttctagtttttgacatacatgaataaagccatattaaagacatagatcacaggatttcgtctgaaaaaaggttttcattctgttagtggtggaagaggtctgagttaccgtgatttaccagcggcgaatcacacagatatgccgcaacctcaattcttgcctcctcagaagaaagaattcgactgatgggcataaggcagaaggagaggccgaggcaagtttcagagcaggagtgaaagtttattgaatagctttagaactggaagaaaaggaaagaagaaggaaagcgcaacttggaagaggtccaagcagggacttgagaagcctagtgcacaacctgacctcttgaattggggttttatacattggcatacttccgggatctggccttacttctcctgacccctgagatattattgggaagctgctgaccagtttcagatgttttctataaggagactatctttcccgggcactggtggtgaccaattattactttagagaaacagttaccaaccacctgaccatcacctgatggtcacccaacactcctggggtgtgtgtgtggggaagccgtctcctgccctgctcatacccgaccagccactgcagcaattctactttgttaagtaccttaaaatgagattgctgtgttgtatggttagtatattttttaactatgagaacctgccagactgatttcctaagtaactataacatttttcatcacatcaaccgcacattatgtatctcgttgttatgtatcttcttattttgagcacttatattttcaatatttttttaattaagctatctaatagatgtggcaagttgctttgtcaagatattcagaaatacatatgcatccaaaaaagaaactttgaaatcgaacactattgtttcctaagattatggtacaacttcctatgtgtttagattgtgtattagtatcttttaagcgtacttttatatgagaactctattcttttcttttttacaaatttattatgaaaacgtttgtattttaataccatcattaatgaaatatgtttcccatttttatttataggaatttattattagagtagaagagaattattagttggtaatattattttgtacctaccttgcatggtttagaaaatttgttaaaactctgatagatttactctactaaggcctcttgagttttataaaatataatattaggagcaaaaatatatatcttttatgtttttcgtatgttatgtcagttattttgctttttctcttatttccttttccaaaatgtatctgcacaattttttaaacttaatttttatgtacataagtgtacatgtttatggagtacatgagatattttgatacaggtatacaatgtgtaataatcacatcagaataaatgtggtatccatcacctcaaggatttatcatttctttgtgttaccaacattctaattatactcttttagttattttaaaatgtacaataaattattgttaactgtagtcaccctgttgtgctatcaaatgctggatcttactcatttgctgtaactgtggtttttatctaataatcatccccacttcccctgtacccctcatcccctactacccttcccatcctttggtaaccatcattctaatcttcgtctccatgaattcaattgtttaaatttttaactcccacaagtaagtgagaacatggaaagtttgtcttactgcaccttcattatttcacttaacacactgtcctctagtttcatccatgttgcaaatgacagaatctcattatttttattttattttatttgtttttggctgatggatacttaattatatacacataccacattttctttatctattcatctgctgatggacactaaggttgcttccaaattgtagctacagtgaatagtgctgcaataaatatgggagtgcagatatttcctttctttggaatctatacctggcagtgacattgctggatcatatgctggctcttttttgagttttttgtggaacttccaaaatattctctacagtagttgtaatgatttacattcccaccaacagtgcatgagggtttcctcttctccacatcctcatcagcattagttattacctgccatattgataaaagccatttttgctggagtgagactatatctcattgtagtttggatttgcatttctctgacaatcaatgatgttgggcatcttttcatatacctgtttgccatttgtatagtcttcttttgagtgatatatgttcagatcttctgcccattttttaatcagattactagataatttttcctgttgtgttgtttgagctcttatatatacatgttggttatgagtcctttgtcagatggttagttcgcaaatattttctcccattctgtgagctgtgtcttcgctttgttgtttcttttgctgcgcagaagtgtttggacttgatgtgatcctgttttacgtttttgctttgtttgcctgtggggtatcaacaaatcaataaattttgctcactccaatgtcctggagtgtttctccaatgtttatatttagtagtttcatagtttgagatcttaggttgaagtctaatccagtttgaaacatttccagcacctcaaaaattacctacacttctgcagctaattcttccctctgaaccagcttgcagaacattacatatgtgatttttgtcactagcttaatttgaatttcttagaaatatacattgaaatcaaatattatattctcctttgtgtccagcttttttcagttattatagtgtttttgagatctattgatgtcgttgcatgtatttgttgttggcttataatttttattgataattagtattcaaatgtattatctattacatcctattgatgtgcattttacttgttcttgattttggatatgacaaataaagttactatgaacattatgtacatgtcttcttgtacatatatttttaaaaatgtatacttaaatgttgcctggtttggaagccatttaatgaaatggaattttattttgtgatttttatttggtagtaatatggtgatgcaatttgtgaaaagtaattttaagtactgctgtcttgtgcaacacactcaatttttagtaccttttttgtggcttccttaagattttccatttataaaaacttgttactgcaaaaaagaaaaataaaattcacttcttttgacaatctgtataatatgtaattatttgtcaaattcatttttgctaagtacactgggtaagacccctttacaatgtcgaatagcagcagcaagtgttgacatccttaacttgttataaattttaggtggaaagatacagtattttgccattatggcgctagtttgtggttttatcaaatgccctttattagcttgatgaattttcttctatgcttagtttgtataaatgaatgttgaattttgtcaaatgcttttctgcatcaaatgtaatcattatatgtttattcttttgattctgtttatatggtgaaatgttgaataaatcttgcttaaataaactttacttggtgaatagatagcatgtttttatcttgtgggacttaatttactagcatttcttttttttttaattatactttaagttttagggtacatgtgcccaacatgcaggttagtttcatatgtatacatgtgccatgttggtgtgctgcacccagtaactcgtcatttaacattaggtatatctccaaatgctgtccctccccactccccccaccccacagcaggccccggtgatggaattgaacaatgagaacacatggacacaggaaggggaacttactagtatttcactaggaatatttacttgtgtgcttttaaacgatattggtctatagtgtttctcttataacatcgtgtcttgtttggtgtcagacagcagctaatggccctattaaatgagttgggaagtgtttcttgcttccttaatacacgtagacatttagtcaacaatgaatgctaaatattattagttcttttggaatatttcaatgatttttaatataaattatatgacaaattttggtctcagtgtattatttccttaatacactactgtatttgctaacatttcataataattgttttaatctttgtaatcctaagtaagatttgaaatcagtgtccttttgtgacataaattcttcttggtttctatattaactagaattgtgcttataagttaaaagtgtttttcttcttacataattaagggttttacagcagaaattttattatctgaatataatttcctctgttacatagatttagttttggcatgtccttctttattttctagtttgtatattctcttttgatttcttctttgatgcaattgtgtagtgtccatttaaatcattaattatattgattaatttttattagcaatttctaaatatacttttcttgaccacacaggttgcttgtaataatgcacatatttggacttggtaaatgtgttgttttcaatacatggtcacattttatttccgtttctgtttttgttcttttgagacacagtctcactgtgtcacccagtctggagttcagtggcatgaacttggctcactgcaaactccacctcctgggttcaagcgattcccttgcctcagcctcccgagtagctgggattacaggcccacaccaccatgcccagctaatttttgtatttttaatagaggctgggttttgccatgttgggcaagctggtctcgaactcctagcctaaagtgatcctcctgccttggcctaccaaagtgctgggatcacaggcatgagccactgcacctgggccatggtcacattttgtataagttttacatatgtttaaccagtaatatatattctctctataaataataaaaagatgtatccatgtgtgttaatttaagattattgattatattactcaatttgtttacatttcaacttctttttccttgatcaggtctatcaaaatttgagcaagaaatgtagaagtcttagaattttcaccaaaatgtgttcagggatgtacatttttcatcactccagcctgggaacctggtaaaccccttcaatatggaggctcccatttttcctcaagtaagacaaattttcttctatattttgtttaaatattagctcttcttacctgtttttatttattattttatacatgaattttatgtatcctggcatctatttatatgtctcaccacttgtttcatgatattctcttttgttgctttgctttggaagtatttattgctcttaattttcctggtcactagttctgaactctatatgactcattcatgtaattagtttttatttttgttaaaaaaattaagctttagatattctgtcacactggatccctttacttagttgtgaggagaatgtcttatgtttagttaaaatttaataacaagttttatacattgatggtattctaagagctgagaataaaaatataatttgtgatgaaataaagaaaggggaacagcaaatgcacatttcaagacttaaatacttaggaaaaaggaaataatccatgtgataatctatagaaatggcatttcatagtgataacatcaaatgcaaaaagcctagaggcattatagttctgaaaattctatgagaccaagtttagaaattctggcttctcctcatcgcatggaatggagtcaattgagtttgccaaggctgttcacttaaagaatacagaatcgtcaggatatggatacttttctaatgcatagcaacaacaggctggaacagcctgcacttagtgtgctaaaagaaatcctcacaaattaactaaactcaaaatatgagttttctgagaatttaagccttctcagattctgatcttttggtttttggttttctcttatttacctgatcttgccaatgataaaatcatggtctttggtgcacataaaatttcttcccacctctaaccaatgggaccatttaattggttgctgtgtcatttatcctgctaattggaaaggaggggtagttatatatgtgtactcagcatgctgtctttcaatttctacatattcttttttttttttttttttttgagacggagtctcgctctgtcgcccaggctggggtgcagtggcgcgacctcggctcactgcaagctccgcctcccgggttcacgccattctcctgcctcagcctcccgagtagccgggaccacaggcgcccgccaccacgcccggctaatttttttttgtatttttagtagaggcggggtttcaccgcgttagccaggatggtctcgatctcctgacctcatgatccgcccgcctacatattcttaatacaatattttaaatttatctacttgcagaaacatgccaaatagtatttcaaattttatttctatattttcttcattaggtttgtcagagatacatgtaatcacggatttcctccaaagacctagtttatatttaaatattaattatataatttttcattttacatattttattttataattcatgccctggggctctacaatcagtaggtggcaaagccagccaagactgtgttcttcccttcaggaccgcgtgtgcccccaggccccaagtgccatcagggagccaggactagagtcacaaaccttagaaacctacatagtgtcctctgttgtactgcagctaagctggcagtgaaactgtaagatgcagtccttcctactcttctctcctaaagatagaggagctgcactgcatggccactgccaccacaggcccacggggagtactgccaggctactgccgatgttctcttaaggcccaagagctcttaagtcagcctgtggtgaatgctgcttggcctaggactcacccatgagggcagtgggctctcttctagctcaggacaggttaaaaaatgccatctgagaaccaagtcctagaaatggggtcaccaagagcctgcttggtgctactctcctgtggcagagctagtacttaaggtacaagacaaagtcccatttacttttcaatccacttttctcaagaataaggggtctcccccatagccaccatgtctgggaatgtgctgagtctaacttgaagcaagcctcagagtcccactcaagacctaccatgagtattgctgctggttattcagggcccaaggatcttcagctagcaggtgatgtattctgccatgactggatgcttcccttcaaagcagcaggttcccctgtggtccagagtatgtctagaattattatccaagatctaggggcctgaaaaaaggacctcaccactctaaccagtgccacattctgctgtggctgcgctggaatacaaagtcttccccagtcttccctctcctcttctcaagtgaaaggaaggagtctcttttggagccatcagctgtgcagcctggggtttaggtggggagtggtgccatccctcccctagataccacagctggtgtttcagtaggttgtgtccacctcaccccagttaactgactctgagcccagtttagcactaggacttgcctaggagttacagtccttgtgacctagactgcctttctagtttacttagccccagagcactccagtccaatgtgtcaatgtttactggaacttaagttccctgctagaatgggcaattcccctctggctagggttagtttaaatagtcttcccatgggaagatgtccactgagtttgttccaattttggtttctgcaataacagggaaacactgagttcaatacattttctcaaaattgctgtgctctccctctccaaagcacacagcttttctcttcatgttgcatggccattgattgccaagggattggagaggggtggcataggaaattcaagactgttttcctaccttttcagtgcctcttttagtgatataaaattaaaaccagatattgtgagtgctcacctgatttttggttcttatgaaggtgtttttttttgtttgtttttgggtttgtgtgtgtgtgtgtgtgtgtgtctgtgtgtgtgtgtagatagttgttaaattggtgtccttgcaggggagtgattggtggagccttctattcttccgtcttgctccaccactctcccattaatttgctttagtgctgattggggcatacgtgatttactaagaaatatatttatactgaataaaatgtttagctcacaaaattactagtgtttataaaataataatttactattgctcactctcatttcttttgaaaacctttagaagactgttttttctgatcaataacatgaggaaatatttgtttagttgtttcgagattatgagatttcaagctttaccaaatgaaagtttcttgtcagaatggtattaacatttgtggtataagaatattactaggaaaatgaaaaaaagtgacaaaaatgatgcattgaggacactgaaacactctacctcacacaaatcacacctgacatcacttatttatgcaatttgtttgatttctttaattctacacaaaataagttataacattgaatttaacatatatttacttttgttttaaaagcatatgataaatttcttaaattcacataaaaatctctatcagacagtagaagtcaataatgtgataccaaagatactgaaaaaactgatgcaatgtttcatatttttaaagaaatatcagcctggaaagtctggaaggggtgactagtcactccatcaaatgcaggacatcaatgcaagtcaatgagaaacatgaaaagtaaacaaggaaacagtaccaataaaataacacaattattttctcatgacagaccacaaagaaacggaaatctatgagttacttaaataattcaaaataatcattttaagaatgctcagcaaatttcaagagaaaatggaaacaatccaaatcagaaatacagttcctaaaaaacaataactttaacagagcaatgaaaatcataaaaaaataaatcctagagctgaaaaatacagtgagttaaatgaaaaatgcaacagataacattaatagcaaactttgttaaggagaagaaagaacatgtgaactagagtcagataagaattaagaaaaaaaaaaaaaacaaaaaggaataaagaaactctacaagatttatgtcacctgaggctaggagttcgagactagcctgaccaacatggcaaaaccccatctctactaaaaacacaaaaaattaactgagcatggtggcagttgcctgtaatccagctacttgagaggctgaggcaggagaatcgctggaacccaggaggcagaggctgcaatgagcccagattactccattgtactccagcctgggaacaagaacttaactccatgtcaaaaagagaaaaaaaaagaaaaaagagagagaattctaaattttctcaccataagaaatgttaagtatgtgatgtgatgtgatgtgatggctgtgttaattatgttgtaattccacaatgtatgcatataacagaacatgttgtacatcataaatatgcacaatattttttcttaaaagttgataccttgttattccccactgaatcgtgagtgacacaggctcaacctactgacacactctgatatgcaagaaaggaaatctggaatttatttaaatagaacagattgcttgttcattcacatggtctatttttacgtttttttcacttgtagccaaggatatattttgctatttttgtcaaagacttcttaataaaatccaccttgctctttctgccagttatgcattgaatgttatggaaaacaaaatattccctcaattgtatgttcccttagtagtttaggactatcccatataaaatattttctcagacagcccatcttaaatagatgatataatgtaaaaagagagtgggtaacctttggctctgctgtcttcttgtggaaaaacatattgaagaatttatctcccatattattaccacctcttggcaatataccacttacttcagagaatttcagagctcaaacatccttgggaattatccactccagccttgtcaaaatagtgtgaacactgagacaatgtttctacaaagattcattcaatttatgcttgattacataccagaacaggttcttcagttcttcaataagcagtcaaactttttgataaatcatccttataataaagtgcaatgtattttcctggaactttgacccaattctattgtctaaaccaacaatgaacaaatgcacctagttcttctgcatgacattcttagagatccttgtacatagacagcagttctttcaaagttcatctacgtgttaattatttattgtccttttacatttgattttaataacactccccatcctgttaactttatgtgactgtaatctatcacgtgagagccgctcttaaaatattgcaagaagtgggcacataattccaccatgtaagatttagttcaggcaggaattatttttagtaatctgatcaatttgacacttttaatgcagttcagcatgctatttccattttgaacatttttgaaatcatgtcaaatttagggatatatggttaatactaccaggttcattgcatattaaatgctatttctttaaaaaattattactttttggctcaattaaaaatattcccatctgttattgacaaattttaccttagatagctttatcatttcaagcctgttgatgtcattgttagctgtagaggaatcatgtaatatattcctcttgattttcttatcttcatcctctctttacctttttttcattctaaatggttttactggggttttcaattgcacaatcccacccttctaccacaagactttgtttcttttttttattattatactttaagttttagggtacatgtgcacaacgtgcaggttagttacatatgtatacatgtgccatgttggtgtgctgcacccattaactcatcatttaacattaggtatgtctcctaatgctatccctccccactccctccaccccacaacaggccccggtgtgtgatgttccccttcctgtgtccatgtattctcattgttcaattcccacctatgagtgagaacatgcggtgtttggttttttgtccttgcgatagtttgctgagaatgatgatttccaatttcatccatgtccctacaaaggacatgaactcatccttttttatggctgcatagtaatccatggtgtatatggtgtatatgtgccacattttcttaatccagtctatcattgttggacatttggcttggttccaagtctttgctattgtgaatagtgccgcaataaacatacatgtgcatgtgtctttatagcagcatgatttataatcaaaccactgctcaatgaaataaaagaggatgcaaacaaatggaagaacattccatgttcatgggtaggaagaatcaatgtcatgaaaatggccatactgcccaaggtaatttatagattcaatgccatcccgatcaagctaccaatgactttcttcacagaattggaaaaaactactttaaagttcatatggaagcaaaaaagagcccgtgttgccaagtcaatcctaagccaaaagaacaaagctggaggcctcactctacctgacttcaaactatactacaaggctccagtaaccaaaacagcatggtactggtaccaaaacagagatatagaccaatggaacagaacagagccctcagaaataatgccacttatctacaaccatctgatctttgacaaagctgataaaaacaagaaatggggaaatgattccctatttaataaatggtgctgggaaaactggctagccatgtgtagaaagctgaaacaccttatacaaaaattacgactttgtttcttaaaattctgggttttgaactcattcacctgttctttcagttctgtgagatagcatatatcccgtcgttttattcctagctcaatttcattcaatacagattgccctccaactaagaattctaactgttttgtataacactcagtttgacatccaccaaaaaattgattactaaaattaaaaattactatatatccatcacaaattagaacacatgcaccaactgcttatgtaggctttatttttcctgagaactgtgttaatcatttagacaaataactcttatttgttttctgggaatatagtttaaaagcataatttttatttttttaatttttgatttttgtgaatacatagtatgtgtatatattcatgtggtacttgagattttttatataggcatacaatgcaaaataagcacatcccagagaatggattatctgtccccttaatcatttatcctttgacttagaaacaatccaattacactctttaagttcttttaaaatgtacaatcaaattattattgactatagtcacactattgtgcaatcaaatagtaggccttattcagtctctttttcttgtacccattaattatctccaccttcccgacagcaccttaccacttttcccagcctctggtaaccatccttctattctctatgtccatgggtttaattgttttaatttttagattacccaaattagtgagaatatgtgatttttgtctttctgtgcctggcttgtttcacttaacctaatgattttcagttccaaccatgttgttgcacataactggatttcattcttttttatggctgaatagtacttcattgtgtataggtaccacgttttcataattaattccactgttgatggacacttaggctgcttccaaatagtagccatgtaaacagtgctgcagaaaatataggagtgctgatatctctttgatatattgatttcttttcttttgggtatatacccagcagtgggattactggatcatacggaaagtcagtttttagttttttttaggaacctccaaactttttcccccaatggttgtactaatttacattctcaccaacagtgaacaagggttcctttttctctatatccttgacagcatttgttattgcctgtcttttggatataagtcattttaactggggtaagatgatatctcattgtagttttgatttgcatttctctgatgatcaatgatgttgagcacttttcatatgcctgtttgccatttatatatcttcttttgagaaatatctattcaaatattttgcccatgttttcatcagattattaattttttttccctgtagagttgtttgcattccttatataatttggttattaatcccttgtcagagaagtagtttgcaaatattttctcccattatatgggttgtcatttcactttgtggattgtgtcctttgctgtgtagaatctttttaacttgatgtgatctcatttgtccattcttgctttggttggttgcctgtgctggtaggttattgctcaagaaattgttgcccagatcgatatcccggagagttcccacatgttttttttgtagtgtgttttgttttttttttttcatttgaggtctcacatttaagtccttaaaccattttgattgatttttgtacatggtgagagataggagtctagtttcattcttctttatatggacatccagttttccgaaaaacatttattgaagagactgttttttttccagtagatgttcttgacacctttgtcaaaaatgagttcactgtaagtatgtggatttgtttcagttctctgttctgttccactggtctatgttgctgtttttatgctagtgccatgctcttttggttactaaagctttgtagcataacttaaagtcaggtaatgttattctttcaattttgttcttttgctcaggatagctttgatgattctgtgtcttttggttccatataaatttgggagttttttctatttctgtgaagaatgtcattggtattttgaaagtaattgctttgaatctgtagtttactttgaggagtatagaaatttcaacaatattgtttcttccactatattaacatggaatatctttttatatctttttatttttcgtgtcctctttaatttctgtcattaaagttttatggtttttgttgtggagattgctcacttctttggttaattcctaggtatttaaatttatttgtattgtaaatgggattacattttaaatttctttttcagattttttaaaattggcatatagaaatgctgctgatttttgtatcttggttatgtatcctgcaatttgctgaatttttcagttctaatagtttttctgtggagtctttaggattttccaaatataagagcatatcatctggaaacaaggataattggatttctttcctgcccatttggatgccctttatatattgctctagctaggatttccagtactgtgttgaataacagtggtgagggtgggcatccttgtcgtgttccgcaacttaaaggaaaggctttcagttttggttttttgtttttgtttttgcttttgttttttccatttagtatactagctgtggatcttttgtgtaagggttttattatgttgaagtaggttctttctatccccaggtttttgaggacctttatcatgaagggatgttgaattttattaaatgccttttcatcaccaatttaaatgaccatatgatttttattctttattctgttgatattacagatatgattgatttgcatatattgaaccatacttgcattccaggaataaatctcactttgtcatgatgaataatctttctaatatattgttgacttctgtttaatagtgttttgttgaggatttctgcatcaatattgatcaaggatatggcctgtagttttctctttttgatgtatctttgttaggtttgggtattagggtaatactggccatatagaatgagtttgaaagtattccctcctctatttttcagaatagttgtagtaggattgttattagttctgtaaatgataggtagaattagcagtgatgtcatcagatcctggacttttctttactgggataattttattatggctttgatcttgttacttattattgtgcaattcaggttttgaatttcttcatggttcaatcttggtaggttgtatgtgcctaagaattaatcaatttcttgtagactttccaatttgttggcatatagttgttcatggtggccactaatttttctttaaatttctacagtatccattgtaatgtgtcccttttttattttttattttatttatttggatcttgtttccttttttcatagcctggctaaaggtttttcaattttaactattcaaaaaccaactttttgttttatcaaaattttgcatatttttagaatttaaatttcatttatttctgctaggatctttattattttttttttcttctagtaattttgggtttggttttctcacttttctagttctttaagatgcattgttagattgtacatttgtttttctcttttttgatgtaggcatttatgaactttcctcttagtactccatctgttatatctcataggttttggtatgttgcatttccattatcatttcttctgagaaatttttcagtttccttcttaattttttcattgactcactggtcattcaggagcattttttaaaaaattttatgtatatgtatagttcccaaaattcctcttgttatcaatttccagttgtatttctttgtgttcagagaagatgccttatattatttcaaattatttgaatgttttaagacttgttttgtgacctaacatatggtctatccttgagaataatccatgtactgaggaaaagaatgtgtattctgcagctcttggatgaaatgctttgtacatatctattacatccatttggtctataacacagatgaagtccaatgtttctttgtttattttctatctctaagattgggccagtgctgaaagtggggtgttaaagtctccatctattattgtattggggcctagctctcttgttagctctaataatatttcttttatatatctggatgacccagtgttgggtgcatatacatttaaaaatgttatatctcatgttgaacagatccctttattattatatactgacagtctatgtctgttcttatagttttggtcttaaaatctattttgtcttatttaagtatagcgactcctgctcttggtttccattgacatgaaatactttttccgcccctttattgtcagtctatgtgtgattttataagtaaaatgtgtttcttttaggcaacagatctgtaggtcttgtttgtttttttttttatcaattcagccactttatgtcttttcattggaatgtttagaccatttacatcaatgttattattgataagtaaggactcactcatgccatttgttatttctttttccagttgtttgattatcttctttcttttgttttgtctttctctagtgaaggtgatttttttgctggtgatataatttagctttctgctttttatttttttgtgtattcactgtatttttttggttgaagttgccataatgcttgaaaatattataacccattattttagcctgataacaacactatttgcataaaaaaagctaataagaactctatgccgtaacttcatctcccccactttttaactttttattttttctatttatacttattgtaatatgtcttgaaaagttgttgtagttactatttttaattggttcaatattttgtctttcatttttgtctttctacttacgttatgagtagtttacacaccacagttgcagtgttataatatactgtgtttttctgtgaacttacttttaccagtgagttttgtaccttcaagtgattatttattgctcattagtgtccttttctttatggttgaagtactcccttcagcattccttgtaggagatatctggtgttgatgaaactcctcagctttttttcagctgggaaagtctttatttctccttaatgtttgaagaatattttctctggatatcctattctagggtgatagtttttgtttcgttttctttcccctgcagccctttaaatatgtcacgccactgtctcctagcctgaaatatttccactgaaaaatctcttgccagacttataggagctccattgattattttctcttggtgcttttaggatcctctctttattcttgacctttgggagtttacttactaaatgctttgaggtagtcttctttaggttaaacctgcttggtgttctgtaatgttctcgtatgtgaatactgatatctttctctaggtttgggatgatctacccctatctctttctataactactttttaagacaaataactcttagatttgcccctttgaggttatttctagatcttatagacatgtttgattgttttatattcttttatattttgtctcctctgagtgtgtatgttcaaatagcctatcttcaagctcactaattctttctccttcttgatcaattctgctattacattactctgatgcattctttagtatgtgtatttcatttttcagctccctaatttctggattatttttaattatttcaatctctttgttgaatatatctgatactattccaactcctctgtgttatcataaatttctctgagtttcctcaacacagctattttgaattttctgtctgaaatgtcacatatctctgttttaggatgtcgatttgagatctttctagctttttgatgtgggcatttagtgctataaattttcctcttaacagtactttagctgcatcccagagattctggtacattctctctttgttctcattaatttcaaagcatttcttgatttctgccttaattttctatttacccaggagtcatttagaagcaggttgttcaatttccatttagttgtgtagctttgagtgagtttcttaattatgagttctaatttgattgtgctattgtctgagagactctttgttatcatttcaattcttttgcatttgttgaggagtattttacttccaattatgtgatcaattttagagtaggtgccatttggcaccaagaaaaatgtatattctgctgttctgggttgagagttctgtagatatctatcagttctactttatccagagttgagttcaagtactaaatattcttgttaattttctgttttgatgatctgtctaatgttggcagtggggtgttaaagtttcccacgatgattgtgtggtaatctaagtctctttgcaggttttaagaagtcattttacgaatctgggggttcctgtattgggtgcatatatacttaggatagtttgctcttcttgttgaattgaacactttgccattatgtgaagcccttctttgtattttttttttactttgttagtttaaagtctgttttgtagaaactaggattgcaagctctgcttttttctacttttcacttgcttggtaaagtttcctttatccctttattttgagcatatgtgggtctctgcttgtgagatgggtcctttgaatacagcacactaataggtcttgtctttttagagcttgccattctgtgtcttttaattggaacagttagcccatttacatttaaggttaatattgttatgtgtgaagcagtgttaatataaattattttttccttaaaagtataggtatagaatatataatcttttataaaataactgtgcatttataaaatgactgtgcattctggtaaagtattattgacttgttgtccatgaatatgctcaggtgaaaatttttatataatcaagaatttagtgcagaatctttatttctacagaacaagtacattaaaataatttcattcttgttagcataacatgttttattaattttaaaacactatacaatttatagagaaaattgtaatggtcaaacagatattattaaagtcaccaaacatgttgttatattaaaagtagataactatgctttaaaaaagcaatgacagtagaatttagaataataaagttatctttcaaactgatttatattaaggcctgatgtattttgcaaataattaagcatgtgtgtgtgtatatatatatatatatatatatatatatatatatatatatatatacacacacacacacacttaatatattaatatataaagggtaatatgttctaaaatgtataaaaatattatactacagtataacgatcatacttgatacattcattgttgctgtggaaatttttttgaatttataatacatactctgtgcacatcatactttgatttttttaggtcatttggtcttttactagtgaattgtgtcttctctgcacagataagtcaacaacataatttctatgatttccgtataattaaaattgtaaaaatgaagttaattattatggtaggcagaattctaagatggccctcataatttttgctcctttaagcccctgattatgttatattacatggcaaagggattgtgcaaatgtaattaagtttcagttgactttgagttaataaaaagagagattatccaggtgggtctaacctagtcagtcacatgagcccttcaaaagcagttttctgtggctgttttaggagaagtcagagagattcaaataatgagaattcaattgaaggaaggttttctattgctgtgagagcagaggccacagggcaaagatctaacagtgaccttagaggcaaaggtgctccctagctgtcaatctgcaagaacataaagacatcagtcctatgactataaagtaataaattctgctaacgacctgaagaaaaaaacctggaagtaatgttttccaaaacctcaaggtgagaactcagacaagctaataccttgttgtcagtcttgtgataccctgaacagagaacccagtcatatactacctgaaatcctgacctactgaaactctgagatattaaacaggtgttacttaaattttctaaatttatgttaatttgttaagcagcagaagacaaccaatataattcgtaaaatttgcttgataggtcgatgaaacctcctaaccctttcaatgagacagttttaagaacactgacaagacaagtaggctggtttatattaggttgtgcaaaagtaattgcggtttttgccattatctttcatgtaccaacataatagcagggatccccaacccctggacagcagaccagtaccagtcctgtctgtggcctgctaggaacaggggcgcacagtgggaggtaagtggccctgagcgaacattactgactgagctccacctgttgtcagattagtggctgaactccacttcctatcagatcagctgcagcattagattctcataggagcgcaaaccctatggtgaactgcacatgcaagggacttaggttgcatgctccttatgagaacctaactaatgtctgatgatctgaggtggaacagtttcatcctgaaacctcccctacccccactgtccgtgaaaaatttgtttttgccatgaaacccatctctgatgccactcatctcctgctgtgcatccagcaatagaagataataggccacagactggactggcactggtctccttcccccagggttgggaacccctgctataaaccagcctacttgtcttgtcagtcctcttaaacatatctcactgaaagtgttaggaggcttcatcaacctatcaagtaaattttactacttgtactggggattgctggtttatgggactcagttgcctgaaggcaattaggaaaatgaggaggttagaatgagatgaagtagggcccaaagaaaggcttctctaggtctgaatttcattcagatcctcacatgaatatacataaataatttggatttggagaattatagcatcttcctgggaaaaattctgcaactcaaagttacctttatagctattaagtgactggaagacattacagactaacaagtggcagcttttttatggacagttactgaggaaacagaaaacagatcaaacaataatttcacacatcataaatgacaaacctatatataaatgagaagtgaaggggctcaaagacaggaatttgtggaagttgatggggaaaagaaaagcatcctagaaagtcacagacagggaacgttatcaaagccatctagaaaccagggaaaaagaattatgtttatgttttaacagagacctacagcacctcaataaaggaaaatggttattggaaattttttcaggcattggagtagatgcaggagtaacattttgggactccctgagttacactctataggagctgtctacagctaaggtttgcacctgcacagtcttagatagcttcattatactaacactggcaaaatataatatgtttacatttgcaatataatatgcatgtaaaatatagatgacatatgctaatattttgaaaatctcagtcatatatttttagatatgtcttctttctgatagcatttgtttattctttcactttctctagttttaattattctagttaaaagaatttacttaaataacctactcattttgtcttctgaataatattaactattatccttatcatttttttgctctacagttttttcaggctggttttgttcaaattttgtaatttgaacagtttgaatatatgactaatttttttattctttttaataaggaaagcatttataagtccatggattttcctattagtaaagtgtgcctattctacaaatactgagctacaatttcattgttattattcagatatatttttcacttcctctgagatataattattaaaccgcagaactattgaaaagtcattttagtaaaggtgaaatttgagtcaagacttgttgacaaaactaatccagatatgcagacatctgggcaaagtccatatctggaaaaattactgccaaatgcgaatgtgaaaagaacttggcaggatgggaacagaagtaaaggcatacagtacattcacactttcaaatcaagccaagatttcttagttatgcctatttgaagcacccttatctgaaacattgcctgaacctctctattttagatttagtgcacttcttgaaggaatatgaaaatgaacttgaaaaaaaaagttcatttccttattgagtggacaaagagagagagattagaccattaaggggaaccaaggtagatagttatgtttaaaggaaaatttcttctattttgctaaagtacaaccaggaaagaaaacaatcatctccctagtcagtccagatgcttttaccaaggtgctgaaaacataaacaaaaataatctgagaagagattatctgaaaatgagaaatctgattaaggcattttgatgttaaatatgacttttttttttttttaccaactactccaagtgagtttctccaataattaattactagcattaaagcaaaatcttcttgatgtgccagatataatctttccttccatcaaaaatagatggcaaaaaaactaacctatactttattatatatactacccttttattttcttggtaccaagcacagagtctaataaatctttagaataaacgtttggttcaatacatcaaagtatgtgtttgaaaggtttcatttgtctctgaatctttattgactctaattctgatgaaaacacaatacttaaatatacttcaatatttagtagactaatctctcataacttggaaatcaaattactttttctagaaaacttagagagtgtactcaaatactttctcaaaatacaggcatacctcagagatactgcaggttcagttccagacctccacaataaaccaatgttgcaataaatccagttagatattttttttggattctcaatgcatagaacagttatgtttaccctatactgtagactagtaagtgtgcaatggcagtaggtattcaaaaacaatggacataccttaattaaaagtactttactactaaaaaggttcatgttcatctgagctttcagtgtgtcataaccatttggctaatgaagggtcattcttcactgttaatggctgttgactgaccagggtcatggttgatgaagtttgggtggctttggcaatttattaaaataagacaacattgaagtttgccatgttgattgactcttattctcatgaaagatttctctgtagcatactatgttcattggtagcattttacccacagtagaacctttttcaaaattgaagttgaccctttccaaccctgccactgctttatcaaccaggtttatgtaatagtctaaattctttgttgttatttgagtaatgtgcagagcatctttaccagaaatagattctatccaataaaccattttctttgcttatccataagaggcagctactcaacctctaagttttatcatgagattgcatgaattcagtcccatcttcaggctccacttctaattcttgttctcttactattttcaccatatatagttacttcctccattgaagtattgaatccctagaagtcatccatgagagttggactcaacttcttccaaattcctgttaatactttgacctagtgtcaagaatcatggacattcttaatggcacttagaatggtgaattctttgcagaaggtcttcactctcctttgcccagatccatcaaagaaattaccatctatggcagctataaccttacaaagtgtatttcttaaataataatacttgaaagttgaaattactttttgatacttggactgcagaatggatgttgtgctatcaggcatgaaaacatcactaatctttttgtacatctccataagagctcttgggtgactaggtgcattgtcagtgagcagtaatatttgaaaagaatctttttttttatctgagtagtagatctcaacaataggcttaaaatattcagtaaaccattagacagatatgttgtcatacatgatttgttattccacttatagagcacaagcagaatagatttagtctaattcttaggggctctaggagtttttgaatggtaaatgagcattatctttaggttaccaactgaattaacccctaacaggagaggagcctatcatgtggagcttagaagccaggcattgctctctcctttctagctatcaaagtcctagagaacattttattccagtacaaggctgtttcatcaacattgaaaatctattgtttagtgcagccaacttcatcaatgagcttagctagatcttctggataacttgcagcctctacaccagcacttactggttcacccttcacttttatattatggagatggcttctttccttaaacctcatgagacaatgtctgctagcttcaaacttttcttctgcagcatcctcacctctctcagccttcagtgaattgaagtgagttagggctttgttctggataaggctttgacttaagaggatgttgtggttaatttgatcttctgtccagaccactaaaacgttcatatcagcgataaggctatttcactttcttaacattttgtgctcactggagtagcactttacgtttccttcaagaacttttcctttgtattcacaacttgactaactgacacaaaaggtctagcttttggcctgtctcagctttgacatgccttcctcactaagcttaatcatgtttagcttttgatttaaagtgcgtccagggtaagtcttcctttcacttgaatacctagaggccattgtaggactactacttggcctaatttcaatattgttgtgcgtgagggaatggggaggcccaatcaacggaagatggggaaatggcttgttggtggagcagtcagaacacatacaacatgtatcaactaggttcggtgtcttacatgagcacggtttgtgatgcccaaaaacaattttatcacaaacctttaatttgtaaaaaatgcaatatctgcaaagtgcaataaatctaagcgcgtacaatgaagtatggccgtattcatttttcatggctgctgtaacaaactaccacaaactgagtggcttaatatgtcaaaaatttattatctcccatttctggtggttagaagtttaaaatcaagggattggaaaggttgttttctaggtatagaaagattcaatttcattatcgaaacatttgattaagctaattaacatatccatcacctcaccaatttataatttttttgtgataacaatattaaaaatctattttagcaattttgaaatatatctgtgttcaccatgcagcttggttgaatctttctttaatgtacacattaatcaaaatgtcacattgtaccccataaatatatataattattatttgtcaattaaatataaataaatcggtttttttttttaaagacaatagtttgtttcttctagagggctctaaaacagtttgtctcattcctttctcctaccttcatgtggttttcttcagtccttggtgactcttggcttgtggatgcatgcctccagtttccgcatctgtcatcatatgggattcctcctgtatatctttgtcaagatttcccttttgttataagaacagcagtaattgaattagagaataccctaagctaatgatatggtttggctgtgtccctacccaaatctcatcttaaattatagttcatataatccccatgtatcgtgggaggtaatttaatcgtggggacagtcaggctcaggctgttctcgtgatagtgagttctcacgagatctaattgtttcatatggagctatcccccattttgcttggcacctccccttgctgccatcatgtgaagaaggatgtgtttgcttccccttccaccatgattgtaagtttcctgaggcctccccagctctgtggaactgtgagccaataaagccccttttctttataaattatgcagtctcaggtgtgtctttattagcagcatgggaatgaactaatacacctaatatgacctaattgaaactgggtttacatttgcaaagactctatttctaaataaggtcacattcataggtatataggattagtcggaacatatctttcggggagataaaattcaatccataatacttcttttagcttgctcagcaatattttgtactttcattattgtaatctggaacatattatattaaatatattcataagtattttatgctcttagttctgtatgtagtgttttaaatttttactttacattaatttgtcattagtttatggaaatgcaattgtttttttacagtgaacttgtaccctatagttcagataaatccttttactttttatagtagaggttgtagatatgtttgagattgtctacattgataaccactgaatagagacaaattacttctttatttttaatcatttatttctttttcttgcctcattaaattgtacaggatcttcagtataaagttggacagtaagcagatatctttgttttactttcattcctgaattccccattattttatttttctagagattccatttttctacttaattctgtatatgttcactcactataaaacaatttctttgaaattcttgagtataggtttttatacttattaaactatatcatctaatacctattgtctgattcctgaaaaacaatcatctcagttattttattgtttctagtttttagatttttggattgtggttgttgtgctttgtttgttttttagctggaagcccagtctgggacaaggtcctctgtcatagcatgcaatggatttatagttattaaactccaaaattaaaaaacagcaggtttaaagtccttgtcaattaaatacaacatctaaggtctgtttgtacttattttctttattatagttcacattttcctatttattggcaggtctaacagtttttaggtgttcagattgtttagtaaagtttttagttttttgaaggaacagactatgttgtcttgctttatagaatttttgttttgttctgatagaccactaaattaatgaagatccttgtttgtgtctggtttgatcattctttttactgttatgttaggtctatttgagttttgaactttgtccttgggcctagttttaactgtcaaaacaaggtatttttgaggcatcataatgaagcctgacattctcagtgaggtttttctactcagcttaacatggaattccaacttctgtaatcactgtaccatcttggttagttctgttctgttctcagtcccacagcggcaatctcatttagacttcccacaatctcacccacaagccagctcatggaaaccaccctaatttgatattcccagctaatgtttccctctaccccgtaccttctaaaacattccatcattttaattactttttctctaaaattccaagtgcactagccacctagaactccaatatttacctcctcaggttagaaagactgtcaatatgcttgggttttattttcttgcattaaggcagcaatgtgcttccaggtagaaagtcaggcaatcatagatcctcacgtttccactctcttaaatatgaaagtccctattgtcaattcctgaaaaacaatcatctcatttattttattttgtccagtttttagatttttgggttgttgttgttgtgcttcatttgtttgtttttttagctggaagcccagtctgggacaaggtcctctgtcatagcatacaatggaagtactttttcttataggcttcagaagaccaatggaatgattttcattttttaaccatacactgctgttttaatttttaacttaataaaagttatgaattgactaagcttatttatctccaaaaagaaatgtataaataggtagtcagaaacaccaaaaataaaatcatcaatttcatgagcatgttttatgaaaaatagtccaacattctggagatttcaacaagtaaatttatttactccttcattcatttaatcatctttacatatgaaatattgattaaatttgttattttctaggcattaaattgaatgttgaagattacagttgatatccaaaagtagtttacatgatggtaaatagaatatgacagacgaatatgtaacatacctttgatgtcacttttattattattataattattattaagctatgtaaaaggagctatgttaacatgggtgaataaatcattagctctattttggctccactgtgatgagattaagataagacccaaagaaataaatagtgagatttttcctaataaattaaattttaggacaagtttgaataacttgaagaattgttgatacagtagagcatggctgaaaaactgggtttgggctagctgtaggcctcgtcatgttgattattaatttaatatggttctgtggacatcagatatttatagcaaggaatctatttttatcagctacatgtttttggaatttaactgttttgacatacagatgatatattgaagaaattagtggctagtgtctgggaaaattatcagaaggttattgctctagtcagtcaagggatgaggagctgaattattggtgtagttgtgagatacagagaataaaatagatgggagaaatttgtttcatgagcaattatattttatgtaatgtattgaatgcctgttgaaaccttaggtagtagatgcagtaccctaaaagttgttgacaagaagcaaaattttcattcagtaaatgttaaacaccttctctccataaggcattttataatgctgggatctgaaattgtgctagtgtaataaatgtttgccctatcttgatttctatcttcttctagcttcccttaaacacaacaatgaaaaaaatgttggcaaattgtaaagtcagtgatggggactggaagggctgctcagggtcgaattggacccagagaagtaaaattaagcaaataaggtattttgctgacctaacctttccaaatttttttttttttggaaagtaaaattaaagggatttttttaaagtcttctagttgctatgtaaaattgtattatatatgagttagtcaaccttagacaaatgtgttaactatcgtttaaaaatttttggaaatgataaattatagttaacatcaagacattatagcctaacctctcaaatctgtgacttgttgctcattaatattgataactgctaaatatatctctcactttactttccaccaagtagaaaaaattggcatttttcagtaatgacctctcaatcttctcttttccctagatcttcttttttcatgaaattttccattttagttttgagttatgcttgcagatttttatctctaatgaattgtatgcctttgtcctctgcaaaagtattaagctagacatattagtatgcagttacagtcttctttgtttgctctctatttcaattagcccttttatttaaatttaaatttggagttttattactatgttttaactaattagcttttatgtacactgtgctgttctaccaatttcccctacattgtttcaggaaaaagtttcttactatattgcattgctgaatgtctcacagcttagtattttccaattattctttacacacttaactttttaaagatctataaaatattaaaaaaatataaaaactaactttcagttttcagtttatagaatcatttagtagggtagaaatgtttccctaatgtttttatgagatggactgaggtgtacataagactaattgagggattcctttgcaacacacaatcacaaatgcctctaattatgaatttttaaattataagagcacatgactcattgtacattcttttttaaagcctcataactagttttgcagtagtgctaagatccaccttatgatttgaacaccaggcaatgtctctctctctctctctctgtctctctctatctatctctttctctctttctctgcactttgcatacatcagcccctctcccggggctagtagcttttttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgctagtagctttttatgtggcagttttttgcagcagcaataggaaactagtacagacattagtactagaaagtggggtacttcctggcagctttttatgtggcagtttgttacagcagcaataggaagctagtacagatatcagtactagaaagtggggtacttctatagcacatacgaaaatatgtggaagtggctttaaaattaggtaatgggtagaggctgaaagaagtttaagaaacattatagaagtgcctggggagtcttgaacagaatgttagttagtttatgggcattcaaagggtttctagtgagggtgcagtaggaagtgaggagcacaggagaaaaacttattgtctcagagaatactttaattgttatatgtaggctgttggtagaaatatggatattaaaagggctgctgttgggagaccagaaacaaatgaaaaatatggtactagaatctggaagaaaggggatccttgttatataatagcaggaaacttagctgaattatattttctagttgtgtggaaaggaactgtatctgataaacttggatatttagccgaggagatttctgagcaatgtgttgaagatgtggctttgtttttttcttatgaaatgtgaaatgtaagaggaaagatataaattgagggcaaaattcttatgcaaaagtgagccagggctttcaaaacatgctactatgaggggattaactgtcaggaaagcatgctctgaaaaaaaagccaagtgtatggcttgacaacattttgctactgtctggaagagatcaaacaatcagactatttaatcacacaggggactatgaagagattaggcatgtgactaggcatgaaatccagaaaggtaactcagcagaagccataagtagtgatagaattgtctagaaaagatatgtacaggagtttcttgtctgataagatgaagctcctgacatatgaggaaagtaatagtggtacaaccacaagcaagaaatgttagcactttctagagcaagcttgtccaaactgcagcccacgggccccatgtggctcaggatggctttgaatgcggtccaacataaattcgtaaactttcttaaaacatgatgtttattttagttcatcagctgttcttttttatgtgtggcccaagacaattcttccaatgtggcccagggaagccaaataattggacacccctgctctagaagctggaaaagacaagaaacagttcctagtctagaatcttcagaaagaactagccttgcccagcatcttgacttcattacgttgaaacttattgtgtacttctgcctccaaaactgcaagacagagcatagtatgtgtacgtgtgtatatgtgtttgtgtatttaagttactcagtttgtcataatttgtttatagtagcaataggaaactgttacagagattggttccacttgaaattattaggtatgtacatagattaagggagaaatgagtagatctgtcataatggattataggtagattcttttgggaaaaatgtgttgcacacaattaccttcatataactgtattaggttgttttgccgggtaacagtaaaaaatgctcaatcctggcacattcatttattttgagtctaaagtatactgccaattttttaacttctaacttagtctattagtacttgtcccacataaaaagaatttactttatttttttatctttttttgtatttgataggggcaggtagctattgcagaggaaataatcattctgagaataactgagaggttaaaactttatttaaaaaaaaacctctgaatcaatatttggtgaggtgagaatgtccatttcatgctgctattttatccaaataaagttaaagcattgtagaaatgtatggctatatgttaggacttgagatactaaaataattaaggtgtatagagtttggcaacctctagatattattcgtgtattatttttagtttatgaggttacattcaacttgtatcaatctattctgttcatgtggtcactcattaaatagaaaaattgaatgccacgcacatttcactaagccctttgctttttctcatttaaactatttcgataacagagttatatgataagattattctataaatattgacttcttaacagagcatcttattaaaaagtatggcattatatatgcaagggtttttagcataatcaaacttctttacctcatcttataagtgaaggttacagttttctgctgtaagctggacaccaaagcatatgtgatcaaaaaccctacaaatattagtgactatggcatcataaaaataaaataactaacccaatatttattaaagtcaatttttataacttcaagcttcatcattaggtgctgtgatatttgcctaatttttattaccccccaaaatgttattagaacaaaaattaatagaaagccactgtaaagaggagcaatttgatattaatttgttttccatcacatcaaatagtatggaaagtttccaggcccttacagtaggaaattacaggtaggatgttgaggtctgacagcgttctgagtgacaggtttttctgtttctctagaatgaggaggctccaaaacaagaaatcataaactcacacatattctgacaaatttaactctctcattattgtgaatcagctagaaattttattttaatcatcatacttctggatgcatcattttgcaaccctcattgcttctgcaggtggattataggagaaagcctttgttatgtctgattaggctccttaaaatctccttgacctcggccaaattctttgaattatctgagatcactcttctggtctgcataatgcttattttcttacaggtttgtagttgcaaaacttgaagtatactaatgttgtgtagggttttcctgaattatggtattaataatcagaaacagattcaatattcttcaaatatttacaccatctcaggtaaaatggattttcctttgaaataaatcatggaagcaaaaacctccaaaacatttgtatttactttgcctgtgtcttaatctaatagtaaggcagatataaatagagaataataacatgctatgatattactgggtgtcatattcccaggagttagaaaaataacatagcaaggcaggtgacttctaataagtaccttttttttttcattaaaaacaacatgtgccctaaataaaaataacagtaaatggaaagtgccattggcatcatatgaaataatacacactttacaggcaagaaccctgtacagtatgtcttattatttctatttgactgatgaaggaattggagatgggtgaacccaactatatcactcagcatcactcagcttgtaagttgcaagtgtctcttatttcaatgcctgtgctcttatcaccatatgatgacactgccaaagaaatgtgttggcatgaaagtaaaatattgtgtactttggatgatggatggagcattttattaaagagacagacttattctgcattccctcagccttccttgtaataaacctttccattctgtaaaaaagttttcattgttttatgttttaaaatattgcttcttttctttttttaatactgaaatttagtaaaatattgccaccttgaatgatttacctactgaaaaatatgcaatgcacctaaaaagaccaattatgccatttttaggtttcacagagtcagaatttctaagaaacaacatctttgtttctgtgatactagtggatgattatacacatgaatctccagcaaattgtctagtttgtttaattacttatgtaaaattatcatttaggatattgtttattcatgttaaaaaactattcttacataattagaatttatattttaaatagaagagaggaactatgcttgatactgtgtgatgagcccacaagtttagtccctcactgtttgctgttttatggtcaactaacttaaaaattggtgtgattaaaacaaaacataaaaatttaaaaaaaaattgatatagcctacaaaagactttttctcagattcttattatgatttaaatagcagacttgcttttatggcatgacagaagccctggggctaagagataaaacatcttctctctgttacattaaatctgctatctgttctatctgttaaactaaaacctggcatttatagctttgaaatatatattacacattagagatgtcctaattttctgtgagctagtaaatctcattgttctacttgtatattttatggagcccatcaatattattgctttactgtgtgtgtgtgtgtgtgtgtgtacatatatatatacagtatgtatgtacatacagtgtgtatatatatagtatgtgtatatatacagtgtatgtgcatgtacatatagtgtatatgtgtatatatgtatacacaccgtgtatgtatatgtactgtatatatgtgtctacgtgtgtatgtgtgtgtggtatgtatgtgtatgtatgtgtatatatttatagactggtggagcatccctaatcccaaaattcaaaacccaaaatgcttcaaaatctgaaactatttgagcacaaacatgacataatgatagctttgctttctgatggatcaatgtacacaagctttgtttcatgcacaaaagtattaaaactattgtatgaaattaccctcaggctgtttttataggtgtatattaaatataaatgaatttcatgtttagacttgagtgccatccttaaggtatctcactatgtatatgcaaacactccaatatctgaaacaatcagaaatctgaaacacttctggtcctaagcactttgaataagggatgctcaatctgtacctgcagttaatcatcatatatacaaacacacacacacgcatacatatatacacacacatatatgattataacttcaattacttatatatatgtatatgtaattactgcaattatgtatacatatatgtgatgcagaaataagagtaatatatgcttttccggcaagtgactatttctttccatatgggcatagtatttttgtataaaataatacagtcataccttggagatattgtgggttcacctttagacgaccacaataaagcaaatattgcaataaagccagtcaaaggatttttttagttttcccagtgcatataaaagttacatttacactgtactgtagattattaagtatgaaatagcatcacgtttttaaaaatgtgtattacttaccttgatcaaaaatattttattgctagaagatgctaacattcatctatgccttcagcaagtcataatctttcttctggctgagagtcttgccttgatgttggtggctactgactgatcagagggatggttgctaacggttggggtggctttggcaatttcttaaaataagacaacaatgaagtttgccacattgattgactcttcaggaactatttctctgtagcatgcaatgctctttgatgacattttacacacagtagaggttttttgagaattggagttggtcctttctaactctgctgcaaccttattaagtctacatgatagtccaaattgcttgttgtcatcttcataatgtacatagcatcttcatgaggagtagattttatctcaagaaatcaatttctttgctcatccataagaagcaactactccttctccaagttctatcatgtgattgctgcaattcagttgcatcttcagactccacttttaattctttgtcttcctattttcactacatctgtagttacttcctcatgtaaaattacaaacccctctatgtcatccatgatggttgaaatcaatttcttttaaactcttgttaatgttgctatttgacctcctcccatgaatcactaatgttcttaatggcatctagaatggggaattctttgcagaaggttttccatttactttgcccagatcaaccagataaatcactacttatgacagctattgatttatgaaatatgtttctgaaatagcagtacttgaaagtcaaaattactccttgatccatgggttgtagaatggttgttgtgatagcaggcataaaaccaacattaatctccttgtacatctccatcagagttcttgggtcactaggtgcattgtcaatgagcagtaatatttttaaaggaattttttatttttttctgagcagcaggtttaatagtattattaaaatattcagtaagccatgctgtacaccagatttattgtttgatttatagactacatgaagagtagatttagcatgtattttaagggctgtaggattttcaaaacagtaagtaaacattggcttcaacttgaactcaccaggcccactagtgcctagcaagagacgcagactgtcctttgaagatttgaagccatacattgacttctcctctctaactatgacagtcttgaatggcatattttttcatcataagactgtttcatcaacactgaaatctgttgcttaatatagtcatcttcgtcagtgatattactagatcttctggataacctgctgcagtttctacaccaacacttactgcttcacattgcacttttatgttatggaaatggctttttctcttaaacctcatgaactaatctgctagttttaaacttttcttctgctgtgtcctcacctgtctaagcctttatattgctgaagagagttagggcctggctctggattaagctttagcctaaaggaatgctgtagctggcttcatcttctatctagagcactaaaactttctccatatcagcaataaggcttattcactttcttatcattcatgtgttcattggagtagcacttttaattttcttcaagactatttcctttgcattccaacttggctaactgtttgatgtgaggcctagcttttgacctgtcttggctttgacatgacttccttactaacttaatcatttctagctttggatttggtgagaaacatgtgactcttcctttcacttgaacacttagaggccattgtaggatttttaacccatttggcttaatttcaatattgttttgtcttcaggaatagggaggcccaaggagaggaagagatggaaacaaacagctggagagcagttagaacacaaacaactttattaattttgttttcatctcagaagggcatggttcgtgggaccacaagacaattaaaatagtaacatcaaagatcactaatcacagatcaacatacagatatgagaataatgaaaaagtttgaaatactgtgagaattattaaaacgtggcatagagaaaccaaatgagcatatgctattgaaacaaaggtgccaatagacttgcttgatgcaaggttgccacaaaccttcaatttgtgaaagaagcaacatctgcaaagtacaataaagggaagcacaatgaaatgagttatatgcttatacattaatataatctattatataattataaaacataatattatataataaatgtattaatagtggaactaaggaatatattaatgtataatatattaatgtgatgtattgagatattaataaaaaattgatataatattaatagtattttatatatacatatattgcccatatattttagaaaacatagtcatttactgataaaagcacatattactctgatttcaaaatgtaatttcataataaagtgggcaatagacttagttgattatttagttgcccactcttagttaataatgacctatacggccaaactgttacttgagtaaagaatggaccaataatttgatacatggtaaatatgatttttttccacataaaattataaaacatgtgtatacatttgtggcacctttaaaaataataaaaataataatttttatattctgacagtaaaatcacaagaatctcttcttagtaaacaaggataaattgttcagttgcaaaaaacataaaaagcaatagcttttatttcttcaggttttccttattataaatgtgcaaataaggttacatttggggagaaattttcctctgttttgggaaatttctttctgatcaaataatctacctaaaatagacaggtttccgcagatttttatgcagtttgctagatatttttttctatataaataatgtaatgtatctgctatgggagagggtttctgacaagtctacattattggtgtttttcttgtggacaaatgatttttctaaagcctgagtggataatggactggacttttagctataatagtccttatttcatctatgttgtttaacttcatctatattgttaatttcatgtgtattgttcaatcaatctattatgtgtaacaagtatacacttagctaggttcagattacatagtgtggtggagaagatcatgtgatggccaaatgcccttgcaaagaaagacctgctactctagcagctgggagtacttcagccccttctctggctgcctcagctacacagagctgccacagggcctgaattgtaacacagcttctcccttggcctctaataatcatgactgaggttctccttccttgaagagtcatccagcctgaaatccagaactctgagaggctcagaggagacaagaattccattgtggaatacatacatgttatacacacacacacacacacacacacacacacacattttaaaattattttttcctttttattcctcctgctgtgtgtgcatgtgtgtgtatacaaatatgtatatatgtggtttgtgcaagcttttttcttcttttatttaatatcatgtgagcattttctgagataaataagaaatctaggcaaattttgtgtttttaaaaataatcactttgcatagctgtgccaatatttatttaactaatttatattatttagcaatagctttctattcttcaggttttccttactataaatcaagcaacactaaatgtctataaatttttgtgtacaagagttactcttttatctctcctatgacaattccgattattacaaatttgaatttatgaaaagcaattcaatatattttatttatagatacagtggtttcattttaaaatataagtgggtccaataaaatgttaatgaataacaaaaatcagagcctaaataaaattcaatttattaaaataggtttttaaatttttgatgagtgttgaattaatcatgagtttttcatccaggtcttttattttgagaaaattacaaaattttataaaccggatctctcgtcttcaattatttgttccccattaaaaaaaattactgtgccctggaaactataaaatttttaaggcaaacttttttttcaaaacttttgagttaattctgccctattaaaaatttttataacttgtaattggattcactagtttttattaccatctataatacttaaacagtttataaccagatttaatgatgttaatctgctttccaggataatctgtaatgcctctgcttgcttgttatctaatatttattacatatatacataaatgtatatatatctaatatttattagatatacacataaaaatgtatatgtgtgtatatatatgtgtgtgtatatatttgtgtaaatatatatacgtatatacagacgcacacttttttgccccagccacctctagccagatggcatattattggttgtagttataatactatattttttgttgcacctaattagttactgatggaaaagtccatataacttaaacacctaagtccatattaaatacatgtggatcattaaggaaaactgcttccaacaaattcaaaaaatacaagtatacaaaggaatttctgtactcaaatatccctgtttcttttttaatatttgttgctcgttttcaaactggaacaatgtatggaaatgttttgccaaatgcgttatatgtttttgtttcatttaaagaaaacttacactatcaatattgaattatatcatccactagtaaaaccaactgcttatgtgttactttttaaaaattatttttctaaaacatcttacccacctcctagccaatattgtgtttaagctgggattcacaggccaagtattgggggaaggagtctctgtcactgatgagcaactaaagatcaatatgtccaagattacccaggatctccaacatctaacaggtttttagattttccttgggaaatgttttccatttttttctacttctccttgggaaataataccttcataaaattaggggaaaagatatcatcattaaatattatgttagctgcagggttttttttattattcaattctatttaattacaaaactgctgctcataacccatggaattgatttctaattcactcatcagtcatgacccgcagtctgaaaaatgccagtacaaatagaacccaaaagctaagatctcaccttttaaatgtttcacaaaagtatataaaaaaggagaaaatatatggaaaataaaaattgtttatactcgtatttttagtaaatgtttctttcttctttatgaattttgtagcaaaagaaaccagtcaattgttctctgactttggggaagaatatgcaggcattaggtcagaatttcagacatgcatgccctggttgtggaaataggagacccctgagcacatggcctgcctgggctttgggcttcctttcctggtggtatgccagcaggaaggaagctgctgtcactgaggtgtgtgtgttccttcactgcatcctgttctgggatcattcatgtgaataaatgcagtcttcttcaggcatgatgatgaagtctttcctcttgttctgttggtgtgcgctgcttgtgggacttgtgactttgtctgctaagtttgggccatagtctcatgtggctgaaacatcctctgtaggtcttgattattattttactgaactgccataaattacatggggaatcctggcatgtttggggttcatagaaatgaggggcaacacataaatacagggacaaagataacagtattctgccctgtattgtgagtttatatacgtacataaacgtatataaatgtttatataaacatatgctaatatacatacccatttatgaaactttgatttatgaagtagggtatgtggcaaaatatgccctgtatctaatgtgatggttttagagcccccacaaagtgtcaaaatcctaccatgggctttgtggattttctggcagctgagtttgcccagggatcagctagggaaagggagagatactcgacctccaggtgagcttcctcccgtccccctgctcttgcctggatagaacctaggactttgtctctccatgccacattttatctccctaacagaaacaacaaagtatccttttccttggttgtacccagatggattgcaggaaatccatcaatgctcatttgaggatagacagaataatcatccaaatgcaaggtatagtttcatgtgctactctggagtgggcaggaatgctacctttcttgttatctgtaacaagaaatatccttgggccatgtcctgaaatgacttataggaatgctgcaagcaaccaaatggagtaataaacaatttatcactagattgaaaatttacctagtttgctcttttattaataacaactagaaagtcataatgatgatacagatgacaataatctgaaccaagatttgaatagttacaaaataataaccatatattgagcttttgctctgtgctctgctaggggctttgtctcagtatgtctgttactgtaacactgagatgtacacatccttttgtatgattttcctttgacacgtacatcaacagcacaaggtaatagtagtcccattttctttggaataaaatgtagttttgcacatgagctggataagtaattttaaaaatattttaagaaacgttattttttagaaagcttttaattcacagaagaaataagtggaaagtacagagagttactgtataattcctgtccctgcatggcacaacctctcctgctttcaatatcctgcaccacagtgggacatttattatattagatgaacctaccttgacacatcattatcacccaaagtccgtagtttaggattcactgtcaatatggcagattcgttgggttttgacaaatgaataatgacatgttatctaccattaaagtatcataaacagtggttttgctgccctaaaaatcctctgtactctgcctatttattcgctcaccctaagccaactccaggcaaccaccgatctttttactgttttcatagttttgccgtttcctgaatgtcatatagttgaaattatatagtacgtaacctttttagattggcttctttcacttaataatatccatttaaagtgccttcgtatatttttatgggttgatagctcatttttaagccatgaataatattccattgtctggatgtaccacattttatttatcctttcacctaacagaagaacatcttggttgtttctaagttttggcaattatgaataaaactgctataagcatctgtgtgcagttttttgggtgggtacatttttagttcatttaggtaaataccaaaaagtgcaatgctggatcacatgataagagtatgtttagttttgtaagaaacagccaaactgtctttcaaagtggctgtgccacctgtattcccataagcaataaatgaaaatttttgttgttccaagtactcaccagcatttggtgtcagtgttttggattttcaccactttcgtaggtgtgcattgataatgcattgttttaatttgcaatttccaaatgacatacgatgttgagcatcttttcatatggttactatctatatatcttctttggtgaggagttcaggtcttttgcccatttttaaattggattgtttgttttcttactgtcaagttttaagaattctctgtatgttttggataacagctctttcccagatgtatcttttgaaaatattttcctccagtctgtggcttgttttctcattgtcttttacagagcagaagtttttccttttataaaattccaatcttgccagaagcggtggctcacgcctgtaatcccagcactttgtgaggccaaggcgggtggatcacctgaggtcaggagttcgagatcagcctgtccaacatggcaaaacaccgcctctactaaaaatacaaaatttagctgggcatggtggtgcatgcctgtaattccagctacctggggagctgaagcaggagaattgcttgaacccaggaggtggaggttgcagtgagccgagattgtgtcactacactccagcctgggcaatggagtgagactctgtctttaaaaaaaaaaaaaaaaaaaaaaggaaaaaaaaaaacccaacttagattttttttatttttcatggatcatggctttgctatatctaaaaagttattaccaaacttaaagtcatgtagactttcttctctgagctgcaagtttttggtagatggtatttatcaaattgaggaagtttccctttatttcaagtttgccagaaggttttattatgcatgaatattggagtttgtcaaatgctttttctgcatctattcctatgatcgtgtgattttcctattttagtttgttgatatggtgaatttcattgattggttttcagatgttgaaccttgaatctagacttgtatatctataatatctcacttttgtaaggcattattctccattatgttggatttgctaattttttgatgagaatatttacatatgtgtttataagagatactggtttgtaatttatgttttcttctaatgactttatctggttttagtattatgataatttttccttcatggtaagagttaaaaatttttctttctgcttctaatttctagaatatcttgcatataattcatgtaattttgtcctgaaatctttattagaattcatcagtgaaaccatataggcctaatttgttctggtaggttattaattattaattcaacttatatagtaaatataggcttatatatattatcagtttatccttaggtgagttttgatatttgtgtattttaaggaattaggtccatttcatctaagttatcaaatttgcaggcatagagttgtttatcatatatctttattatcctcttaatgaacatgaaatctgatgacccttacttcacttctgatactgtgaccttgtggttctttttttttccttttttttcttgtttagccttcctagaggtttatcaatcagtgctattttcaaaaaacaagatacttgttttattttttctattgttttaatgtttacaaatgtattgatttctcctttgttattatttcttttattctttgtgttttgggcttaattttcttttaccatattccacaaattttgctatgttgcactttcatttgtcatctagttcaaactattttaaaatttctcttgagatttctttgatccatgtgttattttaaagagttttctaaaagtttctgaatattcgaggattattcaggtatttttcatcattaatttctagtttaattcaactgtaagctgcaaaatactgtgtatgatctctattattttaaatttgcttaggtgtgttttatggcccagaatatggtccatcttggtgaatgacctaagtgaacttgaaaagctgttgttgaatggaatattctataaacgtaagttagataaagtgcattgatagtgctgttcagctcagctatatctttactaatttttcggctgcttaatatatcaagtactgacagagatatgttgaagtcccctgttataattttggatatgcctatttttctctacaggtctaccagcttttgccttatgtatgttgatctgttgaagtacctacatttttaggattgttgtgtcttctaggagaatagtcctttatcatcatatgatagtcttatttaatcttttataatgtctcttttttttgaattttgatttatgtgaaactattctagatatttttaaattagtgatagcatggtatatgtttatccgtcttcttcctttcaacttatctaagtatttgtgattaaagagaatttgttacttgtagaaaacatctagttgattattactttttaataatccattttgacagtatttgtcatttaattactgtattcagatggttaatatttattttaatgtttattttttacagttcagtgactttttttaatgtttcaatagctttaggggtacaattagttttttgtcacatggatgaattgtatagtggcgaagtctgggattttagtgcacccatccatctcctgagtagtgcatattgtacccagtttctcgtctttcacccatttcctaccctcctcctttttgagtctccaatgtccactataccaccctgtcttggtgtacccacagcttagctcccacttacaagtgagaatgtgtgattcttcgttttccattccttagttacttcactaagaataatagcctccagttctatccaagttcctgcaaatacattattgcattctctattatagctgagtattattccatggtgtgtatgtgtgtgtgtgtgtatatatatttctcatgggttgatgaacacttaggttggttccttatcttttcaactgtgaattgtgctgtgataaacatatacatgcagatgtctttctgatttaatgatttattttcctttggatagatatccagtagtgggattgcttgattgaatggtaaatcttttagttctttgagaaatctccatatttttttccatagaggttgtactaatttacatccatgccaacagtttataagcattgtcatttcaccacatctgtgccatctttttatttttttgacattttaacgatggccattctagctgaggtaagtggggatgtcattctggttttaatgtgcatatgcctgatgataataatgttgagcattttttcatgttttttggccatttgtatatcttctttcgaaaaaagtctattcatgtcatttgcccactttttaatgggatcatatgtttttatcttgcctatttgtttgagttacttgtagatcctagatattagttcatcaatggatgcatagttggcaaatattttcctcaatctgtaggttgtcagtttactctgatggttatttcttttgctgtgcaaaatccttttggtttaattaagtcccatttgttttatttttagttttgttgcatttgcttttgtgatctttgtcataaattctttgcctaggccaatgtccagaatagattttcctaggttttcctctagaaattttatagtttcagatcttatattgaagtctttaatcaatcttgagttaatttttgtatatggtgaggcataggaatccagtattattcttcaacatgtggctatccaattttcctagcaccatgtatgaatagggagtcgtttctctaatttttattaattgcatgctttgtcaaaaatcagttggttgtaagaatttggcgttatttctgggttctctattctgtttcattggtctatgtatctacttttataccaatacatgctattttaatgactatagctttatagtataacttgaggttgggtaatgtgttgcctccagaatctttttgcttaggattggtttggttattctagacttttctggttttgtatgaatttttcaatagttattttccaattctgtgaaaaatgttgttggttgtttgatagaaaattcattgaatctgtagattgctttgggcagtatgatcattttcatgatattgttcttccagtcaatgaaaatgaaatgtatttctatttgtttgtgtcatctctgatttctttcagcagtgttttgtagttctcattgtgatatatttcacttccttggttaagtgtattcctaagtatttttttttttgtagctcttggaaaggagattaagttctttatttcattctcagcttgaattgttgttgtatagcagtgctgttaacttgtgtacattgattttgtaacctgtgagtttactgaatttatttatcaaatctaggggtcttttggaggagtgtttagcattttctaggtatgagaacatatcatcagcaaacagagatagcttgacttcctcttttccaatttggatgccttttatttccttctcttgcctaattgctctgactagatgattaatatttaaattattagtatatttatattaatatctaccatgttttaataaatgttctacttgttgtatttgttcattggccttaccttcctcttccattgagttccttctttgattttgagcgtaatatgtttcattgtatctcctttgttaacattaaaagtatatttcttataaaaagaattagtggttaccttagcatttctaacatatacttataactaatttaaggccatcctgcaaataccactatactgtctcaggtgtaccacaggtatcttacatgatttcctgaatctttcgtcccatctcctctgtcattgctataattcatttcacttttgtaatagtaattttgttgttattattattactttaaacagctaacttttagaatgatcaagaataagaaaatcaaaatttttattttacatttatttattctccagcactcttgctttatggatatcagagtttctaatttatattatttttcctctctttgaagaaaacttcttttaagatttctcgtagagaaagacttcaatgataaattccccctagtttttgtttgtctgagttaagtctttatttctccatcacttttgagtcataattaatttaactagacatatattctaggttggtggatttcttttttcaacactttaagtattttatttcactctcttcttgcttgcatgatttgtgacaagaagcctactgtaacttctatccttattcttagatgtgtattagtttcctaggactgccatagcaaattactataatctgagtgacttcatatgatgtactttcctctttgtgcctatgcccaaatttccctctttacaaggacatcagtcatttgactaggtctcaccctaatccattatgacctcatcttaacctgattgattatctctgcaaagatcctagttccaaataaggtcacattaatgggtaccaggagttaaggcttgaatatactttttcgttggagacacatttaactaactcacaacagtaggtaagaaagatttttttttttttttcttctctggcattatatgagatgttctcattgtttttggttttggctgtttaaataatatgatacatatgatatggctagttatttttttttaaaaaacacttgcttggtgttttctgaacttcttacatctttttttgtatatgattgattttggaaagcccttggccattattacttcaaatatttcttgtgctttgttatctctttccctagtattttaatcatgtgtatgttatgcactttgaaattttccccaaattatttgatgttctagtctctctctgtttttctcttttcacttgaatttggaaagttttattggcctagtccactctcagtccccagaaattcaattaaactaccacttaaatatttataccgctttatgattaaagtgatttctgctctaggcaagaaaatctcggctctgattctttcaattaacctctcttgtcagatatcatggtggtcaatttgttctaaaaccttatttctttgatgggtttcagaaaggtcgtggattctcacttttgtaagttacttttttcttgttttaaggatgaaagcaataacttccaagctcttcacatactggagttgcaactgggagtctctgttgttgtttctaaaagtttattacttcactccttctgtttgagtactcattattttaacaaaataaaactatcatcttcctcatacaacattcaatattagtggaaacacctactttacatattcattaatcttgtttttcctcctgtttcctgcatttccaactatatttgtaactctgtatatattcattcatttacatcaaactcttcaggttattcaactttacaaattcaaagtgagcaatagaaatttacaagtgtatttgttctaaccattcctgaactttctgctaacataaaggaaagatttcctcattcatttctcttcccatacgaaagtattatatacaacccaaaccaacaacaaatagcatcataaacaaactgtcaaaccaattaaattagaaacatgacaagaatacttactagcataattaactaatattttgaggttctaacataatatgtaaatataataaaattattataaaagcattaaattgctacattataaaaataaaagtaaacagttacctctcaacagaaattgttattatataattatgcaattctataaaagttagcagacgatagaaaaattaatgtctggtagaaacaagatattcaaaaactagaaacatggtttccttctctgtctctatgtctttctttctctctctttctacctctactaaaaaaaccagttagtcataaagatggaaagcttttttttttggttacaataacaataaaagcactaagtataaaagataaacaagaaaatccaaaagacataaatgttaaaatatatacaaccttattacagtaaataataacttagagtaatataatatattcctacaaaggtaggttcaaaagtcatcataatattattaatctctaaattaatacataaattaatgcatttccagttaaaatccaaatatatatgtttaacaatgtaatataatttgaaaatgtgtatgtgaaaagaatgtaaattaaaaaagataaaatttaagaataatggacacctggtcttggaagatattaaaaacttaaaataggactgatataatcaaaagcttggctcagaaactagcaaatgccaggagaacaaaatagacaatccacaatttttctatgagaactcgtatggcatttcaacttgtaaaatactgttttatttagagattttggaaccattggttggctgcttatctcatagaatagaaagttggaaccctaaaattaataataaaaaattagaatataacttctttagtaaactggaaaacccaaagtctatgaagtaaatgatagacagacatattgtattatcaaactgcaaagtgtgtatgacagatgctgcaaaaaataaacagaaaattgagagacagatgaaatatttacaacttatgtgaaaccttatacatcaataaaaatttactgatttggtaacaatgtatcacaataaaatgggcaaattatataaaaagacatggggaaaaaagatatataaatgagaagatcttcaatttatattttagttagggaaatgccagttaaatctgtaatttaattatttgtaaagccattggattgtcagttgcatcactgctgagtcttagcaggatatgaaataatacattgtatgaatttctgttaggaagaaatattgatatttcctggaaagtgctgaagaaaaaaatacttttataattttgatgatgacacaacagaagaaaaaacagtgctaatttctaaactgctaatttctgaatcagtttatcttgtcacctatttgattttcttggtctcagaccaggcacctatttgattttcttggtctcagaccagggcatcttaccctgtcatctctttgattttcttggcctctatcagactaggatatccctaatctacaatttttgtttgtttgtttgtttgtttgtttttgagacagagtctcactctgttgcccaggctggagtgcaatggcatgatctcggctgactgcaacctctgcctcagcctcagcctcagcctcctgagtagctgggattacagtcacctgtcttggtgcctggctaatttttgtatttttagtagagacggggtttcaccacctaattctataatctttagtggaaagatggttaaaataagagtctccatttgaagaatcttaaattacagtcaataagagtaaaaatatggaaaaccatttctacaaaatataatataccatatgggtcttgaatgtttgcatcattacatactgagaattcattatataatactctgtctgttgaggaataacaatgttgtttgtttaatccggaattgcatgtttggaaattgttctcagttataatggtaacgtttgaaagggtgacagatttagctctagcagtgctgcaaagcccctttcttagtataaaccatcaaaaaacagtaacaaacactaccattttgctgcttatataccttgtcttaaagaaggaaagggtagaaataaaaagatttcagaatttatgccaaacatatgttagacaaagtactataccaggaagtaatataaaaaaaataaattgcaggcttcctcaaataagaagagtatcaaaactctcctaaattctggtatattttaaagttatttatttgtttactgaaatatatttgtacttacactttattatgcttgttttggaaaggtaaatttgctccaatgtattgatgcattagggatcaattcgagcataataaatatttcacatttgtttaagcatgattcatttcttgaagtaaaattaggagaaagcagaatattgcactcagctaaatcagcctgtataacaatcaacaaaatacacagtagcacacacttcaaacatataccagttctcttaatccaatgcattcacaatcctaaaaatatgttctgctattcttcacatttgtgaagttttctttttttatattaacacaaaaatactgccaggcacagtggttcatgcctgtaatcccagcactttgggaggccgaggcgggtggatcacctgaggtcaggagttcgagagcagcctggccaccatggtgaaacaccatgtctacaaaaatacaaaaattagccaggcgtggtggtgcgcacctataatcacagctacttgggaggctgaggcaggagaattgtttgaacccatgaggcggaggttgcagtgagccaagattgcaccactgcactctagcctgggcgacagagtgagactctgtctcaaaaaaagccaaaaaacagaaacaaaagtaaaagcactcatttattattcaaaacatgtgcaagagtcctggttcaaaaataccatgaagttggtgcaaagagaagtttaaagtgttgaagtgaagcttgaaataataaaattttttaaaaaagatagaaaaaccaaaacctgagagaacatgtgatgtctccaagcagtggacataaagtaacacatatggcagactatgaaagacaaaacaatgaaaagcaaagaaacgtcaatagctataacaataccaagtgctgcaaagtcaataagaagaaagcctaaagaaatggaaagattatcaaccatatggcttgaaactcaaacaaccaaagaatcagaaacaagctctttacaaccaaagagaaagcactaattatatatgaggattttaaatggtaagcaccaaattctcctagaatgcctctttttagtgctattagggtctaagagtagtagtttcaaatacgagttcaatttccaaacccttcagctactgagcaaaactgtgagaacagatgagaaagttgcacaagaattaccagtgatgatgcagaaattgattacaggaagactatatattggaatttttgtttttcagtttcaatggacaagtatcatatataagcatatacctccaaaactatatctcaaaagcagaaaaatatatcctaggatttaaggctttgaaagattgcttaactgtcatatttgaccagaggaccatgagtttacccatccacatctggtgttaaaactttccatcatattttggatagcccttcttccattgcctcacaataattcactaccattctgagaactacttccacaagcaagtatcaggtcttttcaagatcaagtgccatatttttgaactgttgatgtgtttcttaaccatttagcacatgtaaaactatgttactcctttgaatgtagttcctatcaatattatttaatatgtcattgatgacattttgagtgttttgttcctaatctattttattcatgagttccatactttttattgcacatatttgcataatgcagtgatatttaggagcacatatgctgtgttataattaaacgttctgtacaattgaatctcagttcctctctgaatattctttttctcctctctcatgctcacattttgtattctcttctcatcagcaatgaccctctatttgttgacattctaaattccaaagctgcaactgactcaaatctcttagctaataagtaaatatagtcactctggcaaacaacatatggctaaaacaggtagttcttcatatttatgtattcaagtttatgtattcaagtatattcactttaagttcatcaagaaaacattttgttaattggttgtagcaataagaaattgtagtgaattgttattctgggccttatattaaaatggaatatcaaaaaagtattgaattgtagcatatactattctaagaccaaaaaaaaaattggtatggtctttatatagtttataaatgtaatacaataggatatttatgaaaacaatattgaatggaacatgtttcaaaactgatatttctattgtaaaatgctcaccacaaatataagaattttaagtggcacttttttggtgtattgttgccaaatacttccggatattttattgaaggtgtattatgttggtttgcattattattaaagggaaacttcactatgttgtttgcataaggagtaaaaaaactacacaatgatgaatattattaagtaacatgtcaagtacatggcataggaaaaggcgttggcttaaaaattagacactttttctgtcaacactgagaaagttttaacattggattggaggatttggactcactataagactaaaacttcttaaaaatcagtaattcataaaaaataataaatatgttttaaatatataagagggcattccaatcaacttgtgtacacattttctaaacatgatggataaattggttttatggtctgtggaacacagcacaaaatgagcgagcaatgcaaataagagtcttatctaagtccctcctctgtacccagggagacagaaaatttaattaaatggcttgaataaaataaaatatagcagtcgcaatatattataaacaagtcagctaggaaaatgagaataaaagtaagaaaaaaagtcagaatgagggctttttgattataacaataaaacagcaatagaactaacataactaactccatttttgtttaaataaccttttcccattcttacacataggccaggataattttagaacactaaaataatatataaaagcagcagtcatgtagtttaaaaaactaattctgaaattaaaggaaaagtatgtaaacaagtatgttttgttaaagacttagaggagcactgtgacctgacaaaggacaaggaaggaagtttccaaccttcttggacactcgctggtgcccagatgtctgtggttgttagttacctcttgatctcaatctctttctcttccctggccttaacataaaaagggtctaaattttgtactgacttaaggtgatattctaggacaatagtccactatctagtccactatcttcttggtttgctgattctccaaatatacccgttttcctccctaccaacccttgtgtctcaagtctggcttttgagcagtgagctgccaaacctgggtttggttacataatgatatatatgacaagtcaagaaatccctacggttataagtgaatagatgctgggtaagtgataggcagtttcaattatccctgtctcctattatttacatgattctacaatcacctccttttgagtgtggactggacatagtcacctgctttgaagaaatagaatacagaaaaaatgatttttctatgattaagttacaataaaattgttacttccaatttgctagtattctagatatatggcttttaaagtaccttgcagtttagccagaaaaatagttatttggtttattttaactgttgagaactctatttaaaattaaatagggcttatttcatggactgtctgaagtgtgtgtatgtatgtgtgtttcataaatgctataatagttttgaaaatgttaggcatattttattttacttcagaaatcttgaaagcttgaagagaaattcatatatatttttgagtgggactttctattcttttctgttattgtgtatggaaaacatgcatataaactcattctgtgattagtttagtttaaatcaccatgctctgtttttagatactgaaagtatgtttccatggcagttgactgtggttagcagaaacagagaagtcagctatctataaactcccatgatgagatgccagaaaaagtcaaactctgggaatacagggtagtacaatttattgattgacataaacttctacagtaattcatctgttttcctgcctgaattttttcaagctgcagcacagtgattatttaattgagttaattaatttattttagagacatggtctgactcttgctcaggctgttctcaaactcctgggctcaacaaatcctccagcctttcaagtagctgaaactacagatgtgcgccaccacatccagcttatttctggtcgggcaatgctggaaagatccatgaatcttacattactaatctacctgtttgttgttccagtatgttaaatctatatttcaataactgttgacttttgccagccttatgtctactctaccatcagtagcaagacaattgtgtagatcagggttgtccatagtagttaaaaggtaagaatcgcttggcatatgtattaatatagtaattctaaggtctgtctgccagaaattctgattctaaaaattggtatggatacccagaatctgtacagtagatgacattttaagttagaaatatttaagcaacacttataaaaatgatcaggaagaagaaaagaataacagaagataccatttaaaaaatgcatacatcttttggccaaattccagaaatttagactaaaatgttttgaataaaaaagtgttaaaataattttattaaattttatgcttcttgaacttcaaattgaaagcagaagaatattttggaaacattattttattattttcatgatctctaaatggaaatctgaaacaaattgattggaaaggttgaaatcattgatttttcaataagctgcataagcaaaaataaaaataataaaacaaagagtaatcccaattacagaccaaaacatcatttttcttttgggtagagcctgagatagggcatgttaaccaaagggcatggaattgggaactaaatgtgggcagccaccccatgaagagccacctctgcaggcataactcaacttgtgcctcctccaggagaaattaggtggattttgatatatttttagagctgttcttctctaatgcagctatcaggtcaatcactgcatccccttagagacagactgaggaaaagttcaggaaggccatgaatgtgttaaggggcaatccctcctgggaaataacagaaatggggagaaaataaagtgtttctttaacatggaagttagtcagtaaccttgtttgcttaccaaagaattagctgtttgttttaggtgtcatttctcaggatttcttcagctcctacacttctctaattctgaaacactaattctgaaaattgagccagtcataacaatttaattacacacacaaagggagcataacctcaagttaacataaaattatatgattggactaacatgcagttgttaccgcaattatccagtctgacactgtgcattattgcatttcacattgtattaatatgtataaaagacagagggtcaataaatatttagcagatgaatcagagttggcatctcaagaatataagggtgatttagaaattatcttaaataatctagaagaagcgctgtgtgggttctgtagagaaaacaaaggagaggaaattgtttaccatccactcctcacttggcgtattcagggaatatctagtagctttttgatgaggcatagagacagaagagcatggggagctgcttaagaggagtcctaaaaatgtgtccaggacagcttgctggagtatttatgacaaacttaagaatgttctcctcattttgtgggccagtagtgttcaaaatctttttcatgacacttatttgtaaaagtttaagaatttaaccccaattatttacatttatatctctatctttaaaaatatagataacaagttataaacatgtgtgtatatatataatactgtatatgtaatactgtcaaattgtctaatgctgctaataaacatatttttcatctttaaacattaacaggcaaaaagatttttgattaaatatacaaacagatgccccttgacttatgatggggtcctggtcccaataaacccattgttagttgaaaatattgtaagtcaaaaatgcatccaatacaactaacctgctgaaagttgtagtttagcctagcctaccttaaacatgctcagagcagttagagagcctgcagttgggctcaatcatctaacacatctagcctatcttatattataataaagtgtcaaaaatcctatctaatttattgaatactatactgaggcatagtttctactgaatgtctatcacttttgtaccagtttaaagtaaaaaaatcgaagttaaaccaacataagttatggaccatctgtattaagtttgtcacccacccaaacatgggaaataatagtaaaggggtttttgaaaagacaaatccacaaatacaaaaagaataaaagaggagtaagcaacattttagagggtagagaacatatggaagagtggtaacttacttactcattgaatccatggaagacaaatcctaagctcccatggggaaagccaagaactaacttgagttttgcttcagtactcacaaaaggaccatgaactcatgccgccattaaatctgtaagtgtaaatgaagacactcagccattttaataaatggtcagagtacaggatagactacaagacctctccaccttacttagtgcagttggagcagcactcttcttctccatactcatagaagactgaagatttaatactggacaggttaaaattgaaagactctcatctggatatactagacaaattaagaaggatattatcctgaaaacagaggtgctgactaattccaaactgtactgagattccaaactcccttttgtctcttatcatctcatagattattggcaagcagtcctgatccccttatgcttacctgggaaatataatgacccctgaaagaaaatattaaatatttttatatcatggattatctaaggaaacagctctacctcagaatctattaagccaaaatttaaaaagttccttcagtcattctgaaattccaataagtgagggacttcaaggtagctgactagaggtatctagcatttgccttgttcacaaagaaccaaaatagggagatgatcacacttgaaatatagtgcctaagaaagaacaccagaattcaacagagaagtaacaggaagcaaggaaagagagaaaagtcaggtaggccaggcttggccaggagcactgggtagggtctgcaatgtgggggaagagcaactcagacatccccagcagtccacatccccaagtagactcctgtgattctagccacaggagagccccttgacagtcgcaggtcctgaaaccaacatagaaagctacctagagactacagaaaggcattactccagagagagctcatggtgaggcccatacactgccaaaacctaagcagctgtggcacagcaccattttgggagccaagacaccaccagattgcatcccaccctggggcctaataacatacattttcacatccctggagccccactgaaatccgctgtccccagccactgccattgctggctgctgcctctggaagcctaagcacaagtcactggcagcacccccgtcaccctcatcgaggtcaatatgcatttatatgtaccttgagaataagctaccatgcctgcagctgtcacctggggccaaaagacacactcctcagccacctggctacaagtgctgccattaaacaaccctcctctccctggcagcagggacacagtgccctcacatatgccataagggcagcaacccctcctcaccactgatgtcttccccacatgagacttcactggtacctggagatcaccccaccctgtttaccacagccagcacccacatgcaccgctggggcacctgagacctactcctcccttcctggcttgaatttccagcattcaagaatgtcatttgaaggcttgggaatcactccattccatccaccaccattggccactgagcactcctcctgggggcctgaaaacaagtccactcttcctgccactacaccagcgttagcactaaactgcacatgccaccagcaggcctggggacttacccacacagcagttgcagccattgccaacaccagtgcagatcacttgggagtcaaaggatcgtcctgccacagctgctgctatcacagatgccatgtcctctgcccagggccccgaagacctgcccacctgcatggaccaccactgtcactgatagcacctgaacaagtcacctgtaccaagtgccagagcctgctactctggggcccaaggacatacacactagcattcctgctaccactggggactgagattggcccacctgatgtcagtgtcctcagcaaaacttcaccacaacttccactacagccatacaatcccttagagatagtcaatattagggttgcacagtgaagtttggttttaggcatattagtccactaatttcatggcacatggatggcctctagaaaaatgaaagtatgtttgaaagagaacatttctagctgaaatggccaagatgacttaagggaagaggtgaattgctcagaaccttgagtggtggttcgtttgtgttcatggatggaggtgggggacagggagagcttaaagaaatctgcaatgcgagaaaggggccaagacagacaaatagaaacagctcccatctgcagctcccagcgagatgaacacagaaggtgggtgatttctgtatctccaactaaggtaccaagttcatctcattgggactgattaggcaggtggcgtgacccatggagggtgagcagaagcagggtggggtgtcactttacccaggagctgcatgaggtggggggacctccctcccccagccaagggaaacagtgagggtctgtgctacctgccagagataccgcgcttctcccatggatttgtgcaatctgcggatcaggagattgcattgtgagtctataccactagggccctgggtctcaagcacaaaactgggataaccaactaaccaacgacagccactcccgccagtggctgttcaggctggcactgagctgcaggagtttatacatactccagtggtacctggaactccagtgaggcaggagaacctcacaggagtggaaaggctaaagccagggagccaagcagtcttgatcagttggtcccactcccatggagccctgaaagctaagacccactggcttaagacccctactaccagcacagcagtctggagtctgcatgggaggactgagtttccaggggaggtgcgactgccattactgcagctgtagttggtggttttcccctgacagtgcaaaggagactgagaggtttgcagtgggtggaattctcccacagtgcagcaaagaggctgtggcaggctgcctttttaggttggacccagagccatccttcctcactgggcaggccatccctgcaggaattccagcagctctagtcaggggcttacagacagaaatctcatctccctgggacagagcactgcaggggagggtgcattgcgttctcaagttcagcagacttaatctttcctgtctactggctctgaagagactggctgatccagatgaggggaattcccccagcacagtgcactagctccactgagggaaagtcagactgcctccttaagcaggtcttggatcccatgcctcctgacttgactgggtgagacctcccaacaggggtcaccagacacctcatataggacagttccagctggcaccaggtcagtgcccctctgggatgaagcttctgaagggaggagcaggcagcaatctttgctgttctgcagcctccactggtgattcccaggcaaacagggtctgaagtgcccccagcaaactgcagcagcctgttagaacaaaaacaaacaaacaaacaaacagaaaataacaacaacaacaaagaccccacaaaaaccccactgaaaggtcatcagcctcgaagatccaaggtagataaatccacgaagatgagcaaagacacggaaaattgcaaaagccaaaatgtctcttctccaaatgattgcaacacttctccagcaagggcacagaatcaggctgaagctgagatggatgaactgacagaagtaggcttcagaaagtgggtaataatgaatttctctgagctaaaggattatgttctaactcaatgcgaagaagctaaaaaccatgataaaagattacaggagctgttaactagaataaccagtttagagaggaacaaaaatgacctgatggaactgaaaatcacagcacgagaacttcaagatgttaacacaagtatcaatagtcaaatcaatcaagcagaagagagaatatcagagcttgaagaatagctggctgaaataaggtaggcagacaagattagggagaaaagaataaaaaggagtgaacaaacctcaaagaactatgggactatgtaaaaacatcaaacctacaactaattggagtacctgaaaaagatggggagaattgaaccaagttcgaaaacacacttcaggatatcactcaggagaattttcccaacctagcaagacaggccaatattcaaattcaggaaatctagagaactccaataagatactccatgaaaagatctaccctaagacacataattgtcagattctccaaggttgacataaaggaaaaactgttaagggcatccagagagaaaggccaggtcacctacataggaaagtccatcagactaacagcagacctctcagtggaaaccctccaagacagaagagattggggaccaatagtcaacatttttaaagaaaataaattctaacacagaattttatatcctgccaaactaagctttataatagaaggagaaataaaatatttttcagacaaagaaatgctgagtgattttgtcactaccaggcctaccctgcaagagctcctaaagaaagcactaaacatggataggaaaatccattaccagccactacaaaaacacattgaagtacacagaccaatgacactatgaagcaactacattaataagtttgcaaaattaaccagccagcatcatgatgacaggatcaaattcgcacaacaatattaaccttaaatgtaaatggactaaatgccccagttaaaagacacagaatggcaagctggataaaaacataagacctattggtgtgctgtattcaagagacaaatctcatgtgcaaagatgcacatagacttaaaataaagggatggaggaaaatttaccaagcaaatggaaaacacaaaaaagcagaggttacaatcctagtttctcagaaaatagactttaagccaacaaacatcaaaaaaagataaagaagggcattatgtaatgtcaaagggttcaatttaacaagaatagctaactatcctgaatatatatgcacccaatacaggagcacccacattcataaaacaagttcttaaagacctactaagatacttagacccccccaacacacacaataatagtgggagatttaatacctcactgtcagtattagacagatcattgagacagaaaattaacagacattcaggacttgaactcagctctagaccgagtggaccttataggtatctacagaactctccacctcagaacaatggaatgtatgattttttctatgccacatggcacttactctaaaattgatcacataactggaagtaaaacactcctcagcaaatacagagaactgaaatcataatagtttctcagaccacagcacaatcaaattagaactgaagaataggaaacccactcaaaacaacacaactatatggaaactgaacaacctgcttcttaatgactcctggctaaataatgaatttaaggcagaaatcaggaagttctttgaaaccaatgagaacaaagagacaacataccagaatttctgggatacagctaaagcagtgttaagaggaaaatttatagcactaaatgcccacatcaaaaaactagaaaaatctcaaattgacactgtaacatcacaactaaaacaactagagaaccaagggcaaaaaaaccccagagctagcagaagacaagaaataaccaagctttggctgggcgcggtggctcacgcctgtaatcccagcactttggggccgaggcgggcggatcacaaggtcaggagatcgagaccatcttggctaacacggtgaaaccccgtctctactaaaaatacaaaaaattagccgggcgcggtggtgggcgcctgtagccccagctactcgggaggctgaggcaggagaatggcgtgaacctgggaggtggagcttgcagtgagccgagattgtgtgccattgcaatccggcctgggctaaagagcgggactctgtctcaaaaaaaaaaaaaaaaaaaaaaaaaaaagagaaataaccaagcttagagcaaactgaagtagatagagacacacacaaaaaacttcaaaaaatcagtgaatccaggagcttatttaaaaaataatgataataaaatggattgctagtgagactgataaagaagaaaagattcaaataaacacaatcagaaataataagggggataccaccactgaccccacagaaataaaatcatcagagaatactataaacacttctagattttctaacttatttgcatagaagaaattgataaattcctggagacacacaccctcccaagactgaaccaggaagaagttgaatccttgagtagacagacaagttctgaaactgaggcggtaattaataaatagcctaccaacaagaagaaaaaaaaaaaacccagtcccagttgggtttacagctgaattctaccagaaatacaaagaggagccggtaccatttcttctgaaaccattccaaacaattgaaaaggagggacttctccctaactcattgtatgaggtcagaattatcgtgataccaaaacctgggagagatacaccaaaaaagaaaacttctatcaaataccctgatgaacatggattcaaaaatcctcagtaaaatactggcaaacagaatccagcagcacatcaagaagcttatccaccacgatcaagtcagcttcatccctggaattcaaggccagttcaaaatacacaaatcaataaaggtaattaatcacataaacagaactaaagacaaaaacctcatgattatctcaatagacgcagaaaagtcctttgataaaattcaacagcccttcatattaaaaactctcaataaactaggtgttgaaagaacataccacataataataaaagccatttataataaacccacagccaatattatactgaatgggcaaaagctgaaaccattccccttgaaaactggcataagacaaggatgtcctctcttaacactcttattcaacatagtgttggaagttctggccagagcaattagccaggagaaagaaataaagggtactcaaataggaagagagaaagtcaaattgtctttatttgcaaatgacatgatcatatatctagaaaaacccatcaactgagtccagaagcttcttaaactgataagcatcttcagcaaagtctcagaatacaaaatcaatgtgcagaaatcagaagcgttcctatacaccaacaacagacaagcagagagccaaaccataaaaacactcccattcaaaattgccactaagagaataaactacctaggaatatggctaacaagggaagtaaaggacctcttcaaggggaaactactaaccactgctcaaggaaatcagagatgacacaagcagatggaaaaacattccatgctcatggataggaagaatcaatattgtaaaaatggccatactgcccaaaacaatttgtagattcaatgctattcccattaaactaccattgacattcttcacagaattaggaaaaactattttaaaattcacatggaaccaaaaagagctcacatagcaaagacaatactaagcaaaattaacaaagccagaggcatcacactacctgacttcagactatactacaagactaaagtaaccaaaactgcatagtactggtacaaaaacagacacatagaccaatgaaacagaacagaggcctcagaaataacaccacacatctacatccatctgatcttcaacaaacctgacaaaaacaagcaatggggaaaggacttcctgtttaataagtcgtgctgggagaactggctagccatatacagaaaattgaaactggaccccatccttacaccttatacaaaaatcaactcaagatgaattaaaaacttaagtgtaaaacccgaaactgtaagagccctagaagaaaatctaggcaataccattcaggacatgggcatggcaaagattttatgatgaaatcgccaatagcaattgcaacaaaagcaataattgaaaaatggtatataattaaactaagagcttcagcacagcaaatgaaactatcatcataacagacaacccacagaatgtgaaataatttgcaatctattcatctgtcaaaggtctaatacgctttgtcagaatccacaaggaacttaagcaaatttacaaggaaaaaacaaccccattaaaaagtgagcaaaggatatgaacagaaacatctcaataaaagacatacatgcagccaaaaaaaaaatacaaaaaaaagctcgacgtcactgatcattagagaaatgcaaattaaaaccacaatgagataccatctcatgccagtcagaatagcaattactaaaaggtcaagaaactacagatgctggtgaagtggtggagaaataagaacacttctacacttttggtgggagtgtaaattagttcaaccattgtggaagacactgtggcaatttctcaaagatttagaaccagaaataccattcaacccagcaatcccattactggatatatacccaaagaaatataaatctttctattataaagatacatgtacgtgtatgttcattgcaacactattcacaatagcaaagacatggaatcaacccaaatgcccatcagtgatagactgaataaagaaaatgtggtacatatacaccacagaatactgtgcagccatgaaaaggaatgagatcatgtcctttgcaggggcatggatgaagctgggagccattatcttcatcaaactaatgcaggaacagaaaaccaaacaccacattctcacttataagtgggagctgaacaatgagaacacatggacacagagaggagaacaacacttactggggcctgttggggtagggttggggggaggcaaggagagcattaggaaaaatagttaatgcatgctgggcttaatacctaggagatgggttgataggcacagcaaaccaccatgacacaccttggcctatgtaacaaactagcacatcttgcacatgtaccccagaacttaaaataaaaataaaaatacaaaagaaagaaatctgcaatgctaaacaacaaaaatggcaaatgcatgcaaatgtcagtgaatataaaattaaaacaaaacatttctgtttaatttaaacaaggtaaatagacaacagactattcacttattataacaactttagaaatgaggttggattgttcactgttatacttacataattccataactgtggtgcttctcaatcttttctcttgtttggaataaatactaggtggtgagccatgtgtttggtggaatttccaaataactaatcaaattcaacagcagacttctcctctcccttcatgattaattccacataattccacatagttttttttttttcttcccatgttccccaaggcttgacttctgtacccaacctaatcattttatttatttccagcttttcctcaggcaataaaaatctaggcaactgtaagagttaataacaagcataaaggttgtactacatcagtgtagttttacagtcttgaattttaaatgtacagaaaccaccagagtgctcaatggtaggcttctgctcatatagaaaagggatgtgttgaattgagccatatgttagcctcctcctttataacaatgcatgttgtaagagattacatgcatggactgctttatgaattttgctgaaaaatttatagcatgtgtcttctgaacataattagatcttgctatgtgataaaagcattctactgaatttattttatcttgtaactgaataaatttgctttgttaatttttcaacatctgctaaatttaagtatatttttgctataaattgtattagtatgtaactgactctgtagtaaaattaattcattttatatttcattttaactgattgagatatatttacaataccaggaagatcaacagaaagaacataggccttgaaaattctgatttgattacaagtattaggtactttatgttatcaaaatacatacaatgaaagggaaggtcctggggtgtcagtgatgtcttcaaacagaatgtagaaggacattatgtgttgtgtaagtaaaactattttattaactctcagtctccaaattttgaagatatggagaagaaagttgaaagacctaaaagaaaggcaatataaaatggaaatcatgtagatagacacatatacttttatgcccttcctctcatcagtatacatgtaatgtgtatttcatacattgctattgattttaaaacgcaaatatctttttattaaaaattatctttcccacatgaattttatgtacattatattaaaaaatatacaaaacacatatacaatatgtgtataaaacatgttatttttttcattgaagagttttcttatttgctaaaggtaactcactattttaaaccagttctactttactcttcttcagaacaggcagttttttgttttgagaatattatgctatgttttatgacaacatacctgtcaagtttgcatggttatcctaattagagaattagatgctaatctcaacataactatgatataggtaatgcatcatggaagtcttatgtgacggaaagctgacagttgcagaacagtactccttggccttcgtggatcatgacccataggtagactttaagtactttaagtgtttacaattttcttacatgttaaagcaaaagatcttatcaaaggcaatttatgtgtcaatattgatacgtacttattacatgtccaacacagcattcatgtgctaaatttattattttatataatttgctttatgtctaagataatattaaataataaaggtacttgttaatgtccttctaggatctcattgtaactgaattaatactaatccttttcttttaagatttaaaatcatatttgaacttccaacatctgcttagtatatagaaagcgagaaaagcaccactctctgtattaggctattcttacgctgctagagagaaatatctgagactggccattttaaaagaaaagaggtttaattggctcacagttctgcatgttgtacaggaagcatggtgctggcatctacttctggtgaggccttaaggagctgataatcatggtgaagtttatcaggaagccagcatgtcacacggtgagagcaatagcaacagaagaagggagagaggttccaggtatttaagcaaccaggtttcacaagaactgagagagaactcacttattaccaaggtgatggtgctaaaccattcgtgagagacccacatccatgatccaatcatcacccaccacaccccacctccaaaactgggactcccattttaacatgagatttggagggcacaagcatccaaaccatattattctatccctgcctccccaaatctcatgtccttctcacatttcaaaatacaatcatgcctttgcaataaccccaaaagtcttaatttgttccagcattaactccaaagtcccaagtctcaagtaccaagtccaaagtctcatttggagatgtgttccttccacctgtgagcccgtgagattaaatacaagttattttctgtcaagatacaatggtgatacaagctttgtatatatattcccattccaaataggagaaattgaccaaacgaaagggtctacaggctccactcaagtctaaaacttagtggagcagtcattaaatcttaaagctccaaaataatctcatttgactccatgtcctgcatccaaggtatactagagcaaggggtgggttcccaagtccttgggttgttctgtccctgtggctttgcagggtgcaggccctgtggctgctctcacaggttggagttgagtgcttgtggctttcccaggctcaggattaaagctcccagtagatctatcattttcaggtctggatgatggaggcctccttcccacagctccactaggcagtgccctggtgtggactttgtctggggggctccaatcccacatttcccctcagcactaccctagtagaggttttctgtgagggttctgcccctgtagcaggtgtctgcctgagcacccaggctttctcatacatgctttaaaatctaaagggaagatgccaagcctccttcactattgcattatatgcacccacagacttaaaaccacatggaagccaccagtgcttattgtggcctatgctctccaaagcagtgacccaagtagtatctgggtccaatcaagctggagctgtaggtagagcagccaggattctaggagcagtgtcctgggcttgcccagggcagcgggccatgggtctgtcaaagaaaccatttttttctcctaggtctctagtctgtaatgagatgccctgtgtgagagatttctgaaatgcctttgaaaccttttccccattgtcttagatagtagcacttggctcccttttagtcatgctaatctctctagcaaatggctgcctgggcagcttgcttgtatttctctccagaaagtgtcttttcctcttctatcacatgggcaggctgcaaatttttcaaattttgacactccacttctcttttaaatatgagtttcaactttaagccattcctttgctcccacatatgatcttaggctattagaagcagctatgctcacttattgaactctttgctacaggaatttctttcaccagataccttacgtcatcattcttcacttcaaactttcttaaagccctaggacatggatgcagtgcagccaagttttttgctagggaataacaagggtgacctttatgcaagttcctgataagtttctcatttccatctgagatctccttagtctgatattgctgcccatatctctatcagcatttttatctcaaacatttaacaagtctctgtgaagttccagactttctctcatcattctatcttcttctgagccatccaaactctaccaacctctgtccattaccgagttctaaatctgcttctacatatttagttatctttgtagcaatgccccactcttgggtacaaattttctgttttaggctgtttttacattgtgtgaagaaatatctgaggctggctaatttatacagaaaaaaaggtttaattggctcacagttctgctggttatacaagaagcatggtgccagcatctggtgaaagccagcctgaggaagctttcaaccatgtgagaaggcaaagaggaagcaggcacctcacacggtgagaacgggagcaagagaaaggaggttggggagaggtcccagacctttaaacaaccagatcctgtgcgaattgaatgagaactcacttatcaccaaagtaatggtgataaaccattcctgagggatctgcctccatgatccagttaccttccatcaggtcccacctccaacactgggaatcacattttaacatgagatttggaggggacaaatgtccaaaccatttcactcctattcttaaaataaaaacaacgaaaaactagactagctacacattcataattttcttgaacactccatagatttgagtttataggtcaaccaaataactaaaaatttaacaaaaacaagtttcttctggaaaaatgagattcaggcacttgcttacctgaggaagatgctattgcacactggtaagattagtctggataaattgtttaatggaatgctaaagcctgagtatgggatagcagagaatgtagaactcctggtgggtgcagtctgagagaagacttttctctcactcacaggattttttccatagaactcaatagcctcaccaaaaagattgttgagcatcctaaaatgtctcccttgtggtgctattctgggttaaaggagactcagcaactgcagtaaagatccaaaacaagcttcaaattccttcccccacacccctactcctcgtttgttgttgttgttgttgtttgtttttctacaggaaataaaaaagccttaagctgttggtgaagagcactatacagcatttttcttagagaaatggtgaaaatttattgtatctgagagagggagacagaaaaatcactccaacgtagaggaagtggcaaaaatgtgctgtgattagagtctcctccagttgagggaggagcgtggtcattagaaggctttaaccctgaaagccgggaaacacagtatttgcctagaatgaaagcttaatcagaaccacagtgaatgccttccccaagcctccaactaccaacaggttagcaagcatcaaataataaggaacagcagaatactgctggggaaggagcaagagcatagagagagatctgctttgaggcacagcatggagggaagacctaaaggtgaaggtaggaaggtcacattcaaggaatttgaaacaggtggttcaccagagggtaactataacaaccacaaatcccaaacccagctgattaaaaactggattgactcaatgctctgaactaaaggcaaagcaggagaaaagtaatgtccagttaaacaaacaaacaaacaaacaacttatttgcctcagaatcaatacagatttctaactttcaaaaaaaactatgtgccatataaaaatacaaaacccatactcttaagagaagcagaagtcaacagaaatttaaatcatccatcagaaagtattgagttgtttagacactataagaaccttggactttcttgtttctcattctacaccacatttattagatagtggaaattagaattaggaaagttaacagaggctaataggctagttaacagggagtaaaatgtttgattgtcataatctaaatcttgtgtcaagagaacattcaattataggcattagtttccatttagaagtatgtaacacatttctgagacattggcattttaaatgattatatacttaggtacttaaataggctatctaaaatacgtaattataaggatagctacctccctcattgatgatggattaattctttctgtccctttgattgccctttaaatctcatatgcaataaattgtagtaattatttgtgatggcaaactcacttttgccctggcatagtccattttaatttatctagttaattgtttaaaataatgtaataagcaccttcaaacatactaaccaaaacatagctcttttccatgagatttgctactgattagcttaatactaatcatccaaatggatgttttatgaggttgctgacttctatcagcataattgtaatggtttagaagaaatttttctttttcagactgataatgttttcttcttaaaaactgaaaacttcccaacatagtgacatgacttctttgcaattatttttaaactattgctattttttaactaaatggcaacaccatgataatgttagagattttaactttatacacatagagatttataaataaccacattggttactgctgtttaacatattatataacttgttgactggcataaagtcttcaaatgcaggagataaaaattgtaatgatcaaatgagacgttttcctagttaaggatttaaaaattatctaaattgtttcaattttttatattaatgaatttggtgatagatatgtttcacttagtgcttattttatcttttctactaaaacattcaatgctcatattttcctctaaaatgtaataacaaaactttcccttgggttatcatttcatcttattgttaaagaagctggaaagtgacactaaaataaaccaataaaagcaaaatagattgtaaataatatgttctttaaaacgtatttttatcatttcccaactccaacttttcatcctctttttttgttttttttttttaaattgtggctccagcagtagttcaatttcagaatcaatttcataatatatgttttaatataaactcagtcttagaaaccactgtatttaaaagtaacctagaataggttaggtgtatattggataatatttcagattcatttaacccttccctatccttccaaggttgactgaggctgtgtcagctacttctatgacataatggacagtgatacaatctattagacaagttagcctgtaaaataaggtgtgaaaaatatatcaacaacttatctggtgacattcagagataagtgttgttgcagtgtgtaacaaggaatatgaagtggataatattttgatgagcataaataaattttttaaagttttataagtgtttatcttggtataatttgatcactctattttctcggtcatgacaggtacttttcatgcttaaccagtacgttatagaggtatatagtaactatataagcaaacaaaaggggaggaactagtttggctttcacaagggagaatcagaagatatatcagagaagtgtgatcctcagtttggttataaaaggtgagtataatggcaatagattgagataaaaagaaacaaatgtgcaaaatcccagtagaacacaagaacatggtatatttggaaaacaacgagaatttcagtaaaggtttataatatatctctgctagacatgctgcatggccactccaaagacccttctactctgatagagtgtccctaaattatcagtagaattgagttgacagccactgcaggcactatctgtgaacgcacgtatctcccaaaggcatatatcacacaaacgggagtatcagctgcatctgatgccctcactggggataatttgagtgacctgtaggtgagaccaataagagaaagaacattattctggttgcagatccagaataatacagaaactgtagtgcacatccaaagcatggttaaattaaattgtcaactcaacctcctgctacctctcaactgtatgctaagaataattgtcaggccctgggatttaattttaccctccttgtgaacaagttagcctgttgttactgtttcatggatgctggcagtagacatgagactcctgggtgagaggtaaagagaatttcattactcatggcaggatgaacatcatgtttacattatttcttcttgttccactggttcaatggggctaatgcagagggcccagatggttgctgcacatgcagtgggttgcattacaggagaatagtgagcatcgataattgactaacctatagtaagcaataagcaagcacacactgttctagagggagacatgatctcatacctcatggttactcattgtaaacacaactctggcaaaggaaaagagctgtcagggccttgcatgtttggtgtacccactaagactgaggagtatgagacttcgtggaggactgttacccagcaaaaacatagatgagattgttgaagtaagttcacatctgaaaggttattccatataagactgtcctgctttcactcatgtgttcacttcgtcgtgttatcagtgccctacttttatttatgtattcacttctttatttatggggaaataaaatttcgctgtattttttttagcgttcctgtagaaatctttagcctcctgagacacaggaacattccattcttcacatacataagaatttgatctctagctatttgtctacttaatggtcctgatatgaaagtataataaaactaatatttcctcaagaggaccaaatggttatatcctgtaatagttccctagattaagcttcaggatgtcaaggagactggagcattatctccccagtactgatatttcagaagaaacaatgcctcagacacagggggctatctgcctcatagagatattttatttacatataccaaatgattggggtaaggattcaggcccattaggattcagggtctctaaggagacccttttagaaagggagggatacagtggcctctttcctctttattagcagagagcaaaaaaaaaatttactttgtctctcacccatggagtatctggatattcagatagaaaaaaaaaaaaacaaaactatcatctttcatcatgtcactgcaaggacaaaagaagggcagtcgaagcattcaatttttactgtgagatagtaagaaatctgtttctgacccaggacgtctcctaggagcatttaggatacaatttttaaaagatgaatattaaaaagaaacaattgggtagttgttacacaaatatctattacaaaacctattatgtgccaacctgggtttcaatgccaaagataaattagtgctaaaagaagcatggcacctaacacatggagtttacggtatagtaaaaagattatctatggaaaaataacatgaatatgtgcactattataaattcttatgctataaaaaatcaggttgttaggaagaagaacaaggaaaatccaatttagattggtattagacaagacctctcttagaaattacttcatagcacttaacatatattgataatgatgaagatagagattatatgtatctatcttcctatctattcatcttcattctttcctttcctttctcttctagctttgtcactaaggtattccagtacctagaataaagccttgtacataataggaagtcaagaaatacttgttgaataaatgaatgagtgaaaaattatttggacatttaaacttagccctaaagtgtggtgataagtcaggccataaatggagaaaaaccattccagattcaggaaaaagcatgttgaataatttcacagtaggagtaaacaataacttcctggccatattaaagatgttatatttatctcaagataatttttactttttaacaaagggatgacaatatccaaatttatatattttttaaaagtcatactgtctatggagcgaacaacagttgttctaagagaaagacaaagtagaaaattcactgaactactacttcaggccaggcgcagtggctcagcctgtaatcccagcactttgggaggccaaggtggatggatcatgaggtcaggagatggagaccatcctggccaacatggtgaaacaccgtctttactaaaaatacagaaaaattagccgggcatggtggcacgtgcctgtagtcccacctacttgggaggccgaggcaggagaatcacttgaacctgggaggcggaggttgcagtgagccgagattgcgtgccactgcactccagcctaggtgacagagtgagactccttcacaaaaaaaaaaaaaacataaataaaataaaagtacttcattaggctatggtggacaggtgaggaaggtgacagcagacataggaataagggctaagatttaatataggacttttactaataatcatagagatttgctgatgaggatggagagagaagctggtatggctgttgatcactaggtcacagcttgaagtacagagcacatgctagtgccatgtggaaagacggagaagtttgaaggagaaatataaatggaagatccaaaaattaggagttcagcttaggacaagtgaaattttagataaatggaaggtaaccagatggagagatcaagatatacagttctgaaagatcagcattatatatatagctatcttcaacatcagtatacctatgtgacatttaaaggtaaaggaatggatgagatgatctagaaagtgtttaaatgaaaagggcaagaggaagacagttagaggttggatgaggagtctgaaaggaaacagaggaatgcctagaaaggaaaaggcaaacatggtaagtaggtagtgactctagagcagaaaagtcctcacaaaggaaaaaacagaaacggggtgaatgattctgagaacactgtaagaagagtaaaaaaaatgtccattggattttaataatgtgaaaattattgtaacactagcagtagcagttttcatagaatttaggtatagaagccagataagaatccattgaaatctgaatgtgtggcattgttctgtgagctctgaaaggactagtcaaggatacatgcaggatgcaaattaaatccatggcaaagaagtgcaatgtaagtaacagcaaattaatcagtaacatattttgggaattattgactgtaatacatgattcattttgtagctgattttaaaaataccggagccaaatctccagacaataatgatttgcaaaatgacaatggaagcatttaaaggactgttaagcataaggtgctttcatgaaaaaatttggatcatgctacaaatatatacagttaaatatgtatattgaaattttaattacttaaaataaaacctatagaatccaaaccagcagatgaagtataaaaagagggagagatagagagagggagaaatgaaaagaaagtgccaggattcaaatgactcagaagttttcaaggctaaatgattgggaagataacatttacataaatggaaaaggatatacaagaatatgagacataagcaaaagatttaaaagcacagtttactaacttgtcaagggtaatgagtgccaatttgaattattaatagccccttaaaaggtgaaatcagtgagctgaaaaaatatattatgaatttttgtttctacttatgcaaaatttactagttccttaccactggaatgaaatgtgacccaaaaaaatggtatactaattaaaatgttgctcttaggaatgcactcccatcacaatgaaaagaaaaacctctatctgcaaggtaagagtacagaggtgatatttgctttcttagccttcaaaagagaggccaaagaatttaaacaaaaacaaaaaacagagaaagacttcacaacatttgaacaagaacagctgctcctttcctcaacctagtcataatagagcaaattataacctttgtgtaaacatttactttcagcgcaaactagacactaagcaggtgcaataggaacacaaagatctcatatgtcaaggaagagaatattgtcaacactttattactacatttagtaggatataataagagacaagtccttaatatcatcatcatggaattatgctttcattcattccttcaccaagcatgagttccaaatttgtttcaacttcattccatagttgagcttagttatttaaataatcataaccagttaactttaaattgcattatactttatattattttatactgaattctgtattttttacacaatcctaagaggtaagttggtgtggctatgatatcaactttgctgatgaaaaaattctgatttggagagatgaaatggctcccataggtttttaagtctttagaggcaattagaaaatggagcagttcttagattccctaacttaaagtttggtttttctttgtattaaagtacatttttagacaatatcatacaataaatgttagctgtaaagttggtttggttaaagcttatttgtaaaataaagaatttagagcataattacattagtgtattttaaattaagaatcccatactaagtggggtcaatttgatttaaatttgtacttacagagatttgcataataaaatattttagcaacaaacagtaaataagagctgagagagtggagccagcatatggacacaattattctgagaagccttgttggcactaaggctattaaatattataatcaggcagagttttgttggtaaaacctaaagatttcttttctactctctctgctttgtgtagtttggttcttaatttcatgaaaatgtagattagtttgtaaaataaagaagtgatggaatcagcaactgctgtcacaggacctggaccaagcaagttctaaagccttaggcatctgctgacatgcctctccttcacctagtcttcaaaggtttacagtagagaaggtggcctgggtcaactcttattctcacattccttccagtgtgtcaacctaatacagagatttgaaagtaaggcctaattttacaaaaactgtagagtagtgatttacaaacttcattgtagaatcgcaattaacatatgagctattagaaaatacagatgtgtagtcttcaccccttgaaagtttggttctctggccatagggtatgctttgggcatctgtagttatttaaaacccctccagatgatttggctgttaagatggaaataactattgtacttgtcaaataccagcttacgaggctggggactctcttgcagcttctaacttctgaattctcagctcactgctttagatacattttaatctcaaagaaaagagagcagcctgttttcttgaaaaaaggtcaggacatttattgggacatattttcatattagaggagggtactgttatttacagaggatacctcatgataacattgtctatttgctgcctgggacagagacaccaggttttgtgttctccttcttgtgagcattattaagtagctaaattagatagagccttctttataatctatatctctctttccacatttcaatctgtccagtagtaaaacaaaagggtcactggtacatatgctaatggttctgagtttctatgactaccttctttaatttttttatttgttttaattttttaattgactgataataattgtactgattcatggagtacataatgatgtttcagtacctgtaatatatagtgatcaaatcaggattttagcatatccatcatatgaatcatttattacttcttcatgtggggagcattcagtatccttctggctatttgaaagtatataatattttactgttaactatagtcatcttatagtggcatagaacactagaacttatttcttctacctcgctgtagttttgtacctgaggataggattcctacagtttagattttggttcggaggagactgttatccactgaagcttcaagcctagaccatgtaaccagtcttataagagccctaaattgggagttttggggctcatgaatcacctctaatatggctgtaattcagatactatttttcgaagtttcttgcactcagtatgcctggaagtatcttcagcctcttcaatttgcttctgagatttttgtctggccttattgtctatatcatgcagtgccttccattattaaaaaataaaaacactgtactttcaaggcactgacaatcatggattcattcccatctatcattttctctcagttattccattgttcccaggtcagagtcctgttgctcctcactctttggtggaattgagtagagaaacagttctcacttctctgaactatgtttattaaggccataatgtgtgcatagctcccaagatgcaagcttttctaagttgactgtagctcattctcccccaaatgcatgttgggagagaatatcaaggtcgggtcatatcaatatagtcatgactaaatgacctgttgatattgtattttattgaagttcccttgtaactctgggacaaatccactcccaggaagccgttctgtcccttatcaaactaaatgctctggtccaaacttctatatcttcagaaatgactgagattcttgtcataggagtctccataatcccatggggggaaagtatggttgtaaatggatctagcgaaatgtcacattttgtaacaaaatctcagtctgacttacttgagttccctaccatccttagtactgtataatttatacactaatatttgtatatatctatctctatgtatccatctatatatctatgaatctatctccatttatcacatatctatctctattagctacatatcatgtacttgtatctactccctccttatgaagatattaatttgttagttttgtgtaactctactgacctggagtaaactgagatatatgggagatttatgcttagcacaaattctgcgaaagatttatgttcaacatctccttttaaaatatatattttaaaacgagcttcccaaaatacttatttcaaacaccatgaaagaaaaaatggtatttaacccatttagagtctgacatacatttttcttatttaacacatttttatatagcttgaggtttcttatttgatttttaaattattgtgttaggaattattttcattgaaagattattaatgtaaattaagtcatagcaataacataaagattaattttatatattcacattcctcagtaaaaatatgataaaatttccatagagttgatttttttcaactttattcttgagtatgacccaataaatctgatttacagggcaattatgcaaaactgtttttattatcactttggataaaagtactatataaaataatctaataaaatggtgactaaggcacagcatgtcctccaaatgaaaacacaggagctctggtctgtcttattcttatactgagtcctgttcctagagtttctgtgagctctgaaaaaaatttctcttagaccccaatgacaatattcttactaagcatactccctcaccaaggaaatatctagtggctgccctgattttgaaatatattctgactagtgccccacatttgattccttggaatctaacttttggaaactatcagacatatggacaatagggaatagtgcagaattctctcctgtgattagtactgaatcattccagatgagctggaaaaatctttcatgtacctggacccatggaattcaagagctatctagctaaagaaagtgggaatgagatttgtttccattgtcaatgcaagcaactcaactaactatcctcaaattatattttagcctctggaaggtttggcaaatgcttggttagtctagaaaaagatatttgggaaggccacattactcagagttgtatgcatctgaaacctttgtgtgcgtattttaaaaataatttagaaaatatatgtactcaccattaagtcatcttaaaatgttgtatttcaattttaaatagctggaaagaataatttgaggcagaatattatgtcaatctttaaacaatttaagtggcataaaaatacatactgttatacatattatcatatatatatatacacacacgtgcaaaacgttttaacaataactgttagaatgaatggaatttcattctaatctattttaaactttaaagtcattcttgatcatcctctcttattcctttgcaataaataacctgtatataaataacctgtatataaacatagttttgtgtgaagcaagtttcaaagataatgactttcatgagaactgtctcatttaatattagaacaccaaatgtcagatttaaaaatagttatatgaagatttaaaaataattaataaacataaaagtataattttactggaaatataaatatgaggtggatggaaagttatggaaattttgatttattatatctgtggacagataatttcttatcgaatatcatatggataaatgtattttttctatttctgtcattattttaagctttgaaaagctaatgaacgtaaattagcaaataagaacagaatggagttctataccaaatctcacatagtaatcaatcataaaaacttatttttgactttctatgtgctattagtttaattgagtcctgtgtcaattttgttgaaaataagacattggtaacaatcttccttgcaaaatgatttcatactcagtcattgatttttccattttcttaacattaacaaccatatttatcattcttttggtatttgagagataaactatcagaaaggaaaatccataggatgccttaataacagacacattctcagccagacccatattagaaaagaatacatatggtaattgaaattttaaaatgaaagttttttaataatcttcatgaccatgtactcctaggaaagttttcatatattcccatgtgttcctacaaatcacatctaagactactagagtaaagtaaagaactggcctaaaggcaggagaatcacttgaacccgggaggtggagttgcagtgagccgcgatcatgctggcgcactccagcctgggtgagagagacagagactccatctcaaaaaaaaaaaaaaattaaaaattaaaaaataaaaaagaactggcctaaatgattatcttgatttcatttcaaaaatataaactaaattaaatgaggaagaaacacatctcctgacccataagtactgataacagattgtgcttcggtttcagctatttacgcttctcttaaaaacaaaaacaaaaagatgcttgtcttatgttccttagacccagaaagcacattgattcatgacaatgcacttccaaaaacccatttcaatttgttttttaatgtacacaggttgcagattaaacatactacataacttcccttgtgtatctaatcaagctcagtggtattacatatttgagtttcctttgtcaacaatagacagtgggaacaaagagtcaaagagttgaaaattaaaaagagagagagagagattgaaattattgttttctctcagccagtgtaattctgccctcacaatgatgatgatactattctatagtttcataagtttgtattcactttttagaaaaatgaatctgcatctaattatagaagagggaaattgggaaattgttattttatattcaacatacatatatatgacatgaagagtctagaaacaaataattaaaataaacatcataggaaatattaaatttgggctacttcctaaacatactcatcccttgaaggatagagcaaagacatctaactagtgctgctggtgccattttggctctaaaatctgtttctttatcaagaaaactcatctataaaagaaatctaaaagataaaataaaagatcatgcttcatactgaccatctattgcacagattattgtttaaagtgctaccagagcataagaaacttgtagataacttcaagttgaataggtttaacaaaacctatttaaagaaagaattgagcttagaagtatagggtatatgcaatggcccttctgagcacactttatctcacttaatagtgcagttaaatctataccattcccctagcaataatcagtgctgagtatttcagaaatcctaatctctaatgcataattcaagaaaataaacaggtgcttttggattgccttcagtgtaaaatctagatctagatttactgttttataaacttaatgtccccacttcactgatacataagagctacatttatttacctgcaattcaaggcctcagtgctttaacctttgtcttcctgctttatgatgttgtagtactccttttacagaaatacctatattaaatagagatggacaatctagattttaccccaacaaataagttcatttaggcactgattaatcacatgtaaagtgaggcatgttaaattttctcctccaacacagtaaaattaaatatatcaatttcttcactgtcagaataacgtaatagacatggaggaggactaagattgagtaaattcgttccagtgctgtctttttactgtgtgtgtaattttggatgagttgcttgtgtgttctcaggatctattaactacatttatcaacagggtaataatagcccctgttcccctataggctaatggcaactttcaaatcttttgaaaaagtcaaaagcctttgcatttggtcctgacccattattactctgtgaattaatcctaaaagtcagtactcaataatgtggctttttaatcatgagcaacagtggctgccctttctgtcactatcttcaaactcaccagttctctctgcttgttagcgagttagctacttacaaagctacttctaggcaattgtgtttgacacctggcctcttagagttatctgcttcctacaatactgtaagatgcttggggtctagaaaccacatggagcaaccaccattcaatttccatgcggggatgatatttttctttgcacattcctcaatgtcagtggttcttgcactcccaaagccagaatatccatcagcatgattgatcttgttttcaccctagaagagtccttgacatcaatggagctttttaaagtactgacactttaactaatctggattgtggcctaggcaccttaaagctctccaagagctataaagattaagaaccactaatctagaagaatctagaggattccttaagaaatttttaaaaatatttgcataaaattcctaattttcaagcatgggaaattactggaagatacctgttgacaacagcatcaggaagatacatttgggaaaggacagtctcttcaacaatagtgctggggaaacaggatatccataagcagaagaatgaaactaaacttttatctctcaccatataaaaaaattaaatcaaaatatattaaaaccttaaatgtaagacctgaaactatgaaactcctacaagaaaacattgggaaatgcttcaggacattgatctggaaaaagatttcttgaggaagctgtcaaaagcacaggcaaataaagtaaaaatggacacatggcatcacatcaagttaaaagcatctgcacaacaaaggtaacaatcaagaaagtgaagagacaagttacagaattggataaaatatttgcaaactattcaactgacaagtgattaataaccaggatatataagaaactcaaacaacacaatagcaaaataatattataataataataataataataaatgatccaagtaagaaatgggcaaaaatctgaatagacatttcttgaatacatacaaatggccaacagatatataaaaaaatgctcaatatcaataaccatcagagaaatgcaaatcaaaaccacataagttatcttaccctagttagaatggcttttatcaaaaagacagggaataataaatatttgtgaggatgtggagaaaggggaaagctaataagctgtcagtgggaatgtaagttagtacgtccactgcaaaagatagtgggcaagttcctcaaaaaactaaaaatagaactagcatgtgatccagcaatcccacagctggatatttatcccaaaacaaaaggacttcagtatattgaagaggtatctgcactcccatgtctactgcagtactatgcacattagccaagacacagattcaacgttaagtgtccattgatagatgaatggataaagacaatgtgttacatatagacagtgacatattattcagccatgaaaaaggatgatatcctgatatttgcaacaacgtggatagaactgcaggatattatgttaaggagaataagccaagcattgcaagataagtatctcatgttcatgttctcacttatatgtgggagctagagtattgatctcatggcagtagagagtagaatgattgttaccagaggctgggaaatgtagacggagaaagagagatacaggggaagaaaaagagattgactaatgggtacaaaaatatagatagatagaaggaataaagtccagtgtttggtagcacaatagcgttcccataatcaacaataatttattgtatatttcaatataactagaagattggatttggaatgttttcaacacaaagaaataataaatgttggaggtgaagaatatctccattttgctctttttttttttttttttttttttgaggcagagtcttgctctatcacccaggctggaaagtgtacagcagtagcacgatctttgctcactgcaacctccatctcctgggttcaagagattctcctgcctcagcctcctgagtagctgagattacaggtacatgccaccacgctcagctaatttttgtatttttattagagacagggtttcaccatgttggccaggctgcacattaacacctgacctccagtgatccacccacctcagcctctcaaaatgttgggattacaggtgtgagccacagtgcccagccacaattttcctcatttgattattacatattgtatgcttgtatgaaaatagcacataaaccctataaatatgtacaactattttgtatccataaaaaatatatataattatatatgataatatataatatatattattaaatgatatatagtatgatacataatataatatataatatagggtatgaagtgagagagacaaaagggaaataataatctattttatgtttaaacgctgcagcatattgaaggcgggaagaacaccaataacaataatgtttgtggtggttcttggtagccattaatgcccttaataatgaataagaatttaatgactaaaaaataagctgcacttttctggaatggttgactttcagtgaagaaaaaaattaactttgcttcaatttaaaaagttactttgcctctcatttaaacaaccctagtccctgcttgcctgctgataaattcttatcttaatgtctactccagctgattcttcttttcagctctagactctgatctccttgagaacagcagcatcacattcatcttttatttcccccttctttgcagtatccctggcatatagaaggcactcagtaaatattgatatgaactgagctgaaagcaccctatcttcaccttgatctcctggctttctaagctgggtaaaattagacataatcattatattcttgtaaaagcaaggactacagtgcctcagagctttaagcaacccactgtcattccacaaagaggtagcattttggatacaaaagaaattagcatgtattaatttaagatggcctaattcaagtagcaaatatatttgaaagcatagtaaagcaatagcatgaataactgttttgccacctgatatattgatagaaaaggagaaagctttacccctgaaataaaatgcttaatctcagtgtcagtgttttgtatattaaaaatcttaattgaaaaaattacatcatgaaactattagcaatcattgtaactgttagaccacaggagaatgtgcaagttgctgctaagtacgtggcaagtttttataataataatcagctaaactgcttaagtgagtgataccatttaaattaggaaattaaagcttgaattatttttctgaaaatttgctactgcttcttaaagaagctaaagtcttgttggatattggaattctctatagccactgattgtgtgctgtttacaatcaatctataatttgcttggctgcttccaataaaatattaatgcaatcaaacctaaaatgtttctgttcacaggcatcctcttatcatgggtcagactataaagctctattattaacataagccaagtatttgctgtttaactgcatacagataactttggaaatctcatcctaaggagttcaagatactttttttcctttggactaggacttcattttctaactagataattttcagctaagtatttattgttaatatatagttgacatagattgtcttaggcaatatgcaaattattaaagggtataggataaagttctgacatttatatatgactgcagagacaataatacacataaaaaggttgagaacataagacaacatgttcttaaaacaatgctacatgctgtcatttctgaggaagggggtttctcattgagggtagtatcagaagaggattagagacagggcatcaagatgagtgacaatcgaatgtaaacatccctcctaccaagtggctcttatcctgtcctttactcaaaagtagatagccattgtaaaaacactttaataagaaggaaatctcatgtatgttgaaataactatgtatcaaattagagaatttggtgtacttgagctgaagtcattaagactggaaagtaaacagataaaaaggtaaaggatagagccttccagctgcagaaaataaaggaaaaagaaaaacaaaaacaagaaacctttgagaatggttttcctggaataaacaagtaggggtagggtgaaatacaactgatgaacagactctggcacagataaatttacattattttaatcagagaagagattttatctcaaaaataaatctcacgaagttctagattgtgatggaagagctttgatactccgacatatttgacattatactagttctaggatttctttatcctggatatgactacagtgatcctaaaactcctcaagaagtttcatatttagtagaaagacatcccaaaactcacttcatactaggtcccaccatatataatcactaaatggggttacaggtttcaactttccatgaagctaatgggtcacatcagataaacagtttcttgtttcattaaatcaaatagtctgattttgatgcaaaagctaatgtcttaccatgcatccttctggcttacgtctcaagtcaaatcactatacatacactaccataactgaatacaacaagctgtgttcattgattattgagtgaggaggagctgtatcatttaaaaaacaaattgtatgggtctccctgagaagaaatataaagagctagctttaggtttctcaacagaagcactattgacactttgttattttttgtttttgtttttgagactgagtcttgctctgtcacccaggctggagtgcagtggcacaatgtgggctcactgcaacttccatctcctgggttcaagctattctcctgcctcagcctcttgagtaactggcattacaggtgccagccaccacacctggctaatttttaaaaaatatttttagtagatatgaggtttcacatgttgccaggctggtcttgaactcctgacctcaagtgatccacacacctcggccttccaaagtgctgggattacaggtgtgaaccactgctcccggccactattgacactttggactgagtaattcttggttgcgtctctgtgtggtggtgggtgggggtgtcatatacattgtaggatgctgagcagtgtctctggccactactcactagatacctgttaccctgctcctctaagagtatgacaatcaaactctctctagatgtttgcaaattattccccggtgggctaaatcacctgtggttgaaaattactgggtaagagaaaaggagaaaaaagaaaaaacaccaatttaggcaatatgagttcaagtcttaagttgacttagaaagcagattgtatactcttttttacaaatgatcttatgttatttgtctcagaagggagggtgtaattctcaaaggggtccaggatgagatgaataatactgtagtgagtatttggatgtgcatgctagaagcttgaataactttttttttaacgacccacttttatgggtccctattgccccttaaaatatagaagaaaccagcattgggtcatgtgttaataatttctgtctttaccaccatatgcattattatcagctgataatctctggatttttatgaagcttctggcatttactctgagcagagcagaaacagttcattttacttttgttgaagaatgagtttttgtgccatgtgacaagaaaggagttatgcaacatcatttcagactctgcagaccagacatctgaagatgtgagatgaataagaataagtgcaattacataagatcggactagaagacacttcagagccatgacaggagatctcccaatcttggcaagggaaacaggtcccagagacctccagtgtctacttttaatagtcaggttgcccttccctttgatttgcatatggattattcaggcatccctgtggtattactatatgttcagtagaaaatgttagtaatagcatatattctttgttggcataccagcaggaaaactagggataccctatgatccaaaagtcctcaggccaaagtactcagtcctgcttcttgtgctttttgggcttatgcagtattactgatcacaagccagtattagagttacatttggattggtggctttaataacctggatttcttccattcatatgtaaccaagtccttttgataagctaaggcaatatgatataaaagttaatataatatgcaaaatcgacatgaatttcttcactgtttgaaatgatgtcatgataaatctcaatattataaaaggatttctggatatgtctagtttaaatgaagtcttttgataaaaggtaaaatggcttagtttagaatatcatgtgaatatctaatttaatccctgcctacttgcctatgcaatacatttgcatatcaccataggcactgtgaaaatggttagaactgtttgatccacaatcattcccttcttgctaatgtatctatcatgctcaacctccctcctagtttcctaaattcagtcagccatcctggccagcttacaaataagaaacatgattgacagctgtcttctctcaaacttctacggctattctctttaccttcccccttttaaaaatgtgcttcctcaatctaaattccattcagtctagggattcctttcttcttcattgacaaactccccctctatcttctgtctcttccttaattgacctggcatgtcacattaacagacatggttttctcccttgaagatgtgtcccattgggactctggtggaaggaatcccattcacttatttgaagcaatacaggactttagttacccatctgcatttctgattttggtatcaattcatttatatcatgctttccacattcttgctttaatcactcctaaacttcaatgaatcaatctctctgtaataacaatcgtatggaaaggaaaatgaaaacttctgtttttattacaaatttaatagcaataataaagctaatttgtttggagattgcataaatagacatacattgtaaagaaaagagattttaaagaacagatatcaaaacctcaagattgtagacaggagaagagtgagaatggtagacctatatagcatgtatgtcaaataggaaatatgttatttaaatacttattttaatttttttaacttttaatttttgtgagtacagagtaagtgtatatatacttatagagtacatgagatgttttgataaacccatgcaatgtgaaataataacaacatggagactgagtatctatcaatcacctcaagcatttattctttgtgttacaattcagtgatactcttttagttatttttcaaggtacaattaagttattattgactatagtcaccctgttgtgctatcaagtggtaagtcttattcattttatctaactatgtttttgtacccattaaccatccccacctccctaccagccccccactacccttcccagcctctggtaaccatccttctacttgctatgttcatgagttcaatagttttgatttttagattccataaataagtgagaaaatacagtgtttgtctttctatgcctggcttatttcacttaacataatgatccccagttccttccatgctgttataaatgacagaatctcattctttttttatggctgaatagtatactcccttgtgtatatgtaccacattttctttatccactcatttgctgatggacacgtaggttgcttccaaatcttagctactgtgaacagtgctaccacaaatatgaaatatatggtattcaactgttacatattttttatttagttatatttgtatctataaaattcagatccaaatattcctgtctgtaattaagaaagagaactgtgagtagtcagggccaaagaagaaactgtattaagaacagaaaggcttttgcagatggctaagcataattaccaggtagaaaaagggtccaacaaggcgttctagtatgaagggttagcaacatgcagcaagagcagcatgtacagaacagatgcagtttctcctcttctgagagataaagcctctggatgaccatgctagcaatgatgcactgccaaccagtcatatggaggaaaacagtaaagagatgacattccttgaacaatctttgatgaattacatgaaaactgagaaagtgccaagagaaaagtaggaagtgcgaagtaagaaaaaataaaaaaaaaaaaaaataaagacctcttaaattgtctgctaacaattggagacttgtggctattatttacttcaaatcccaggtcagggagtaaatcaagctgtttaacagaagacatgaagaaaccggtaacatacagttataaaagtagaagatattaatagccatcatcaaagctaaaggactgtcataaagatgagaggtgagatcaatcagtacccatctttcagtccattcaagggactttcctgctctgagtgacgtaatttggaggccctgaatatctcaaatacacacaaaataaatgtattaaagaatactcagacacaccggtacagctcaacccataaaccacacatctgttcttctgactgagtcaggcctctaggaagttccttaccacatctcttgctctatatcttcaaaacaaagaacaactgtttttggaagttctgaaggtttggattgtgctactaactttttttagggcactattttgaactataaggagcttttcagctttggaaacacttggatgaaggaagaaaaaaaaaattaacttgtgaatccttctttccaatagcaaggaagcgatacattcttgagtaatgaagcatgttttgccagtcacaccatgcatttgtttcctccacgcttctcttattgttccagtttaggatctaagagataataatcacaataaaaaatttgatttattttatacaataagatgcagttttaaaaaaggtaaaacaagaggtgatcttcaaatggagggtgaattgtggtcttagacaaaaactaaaagtgaatttatattttccacattattgagtataaactaatttacctttaatatcagtgaaagcttagcaaaaaaatgctaacagatctgaatgatttcactattaaaatgattacagtatttttaaaattttagagaaatttgtttcctaaatagatacaacatgtggaaaaaaagatagatacaacatgtggaaaaaaagatagatacaacatgtggaaaaaagggaatacaaatattattccaataaaaataagataattagaacaagaaaatcaacacaatttctatgactatgaaagataagattcatgaacatataagctcaacacttatttctatagggaataacactggcaattatagatcaaagtatataaagaaaacaaatttggcaacatatgctatttccatttttttaatactatgttaccattgaaacatttgaaagaagaatggaaacaataatctatgaaactagatattgttttaagtgatggtgaaaactgcaatctgagatagcaatttataaaatgaaattacagtattttgtaatattttctgtgatgacactttaatatttgtcacctcatcacaaaatttgaacaatactatttcaattctttggtttacaccttaatctaactgccaatttaagaattttatggacgattgtaatggctattgtctcagtgggctaaaattttctatattgaaactacaaaagtaaaataactagagctataataactcagagctgttgtaggctgagagtggtgacagggattatctacaaagaggcatgagggaatttctggatgatgaaaatatctaacaactgcattgctttggtgactgcatgactataaacatttgtcaaattcatcaactgtacacttaagaagggtgaacatcattatatggaaattatacctcaaaaagttgacttttaaaaacaataaaacatttgttctttaaatgctggcaatatatcattattccaacaaattatttcaaaataatttgtttttaaaagttgtctaatttggcattactctcaacagaagaaaatgtgttattctgattataacaacatagttgttaatgttgataaaaatgtaagttaagattgcataaacataatttgtgactcatgtcagtcttaatgtattagtcatccaaatgccactgactcagaaaataatcagacatgcataataaaattatatttatttacaatttatattttaccaactttccttctctggaaattgtagcttaatacatacatttcaatatttccactacacagaatatttttagccactttaatgaggtatagttgacagagaaaaggctgtagatagatatacatatacatagatagatatacaatgtatacaacttgatgtgtttgaagataagtatacacccaggaaatcatcaccacaatttatgctatagacttatttatcacttctaaaagttttttcctgccatttttagttattattataataattacatttttctttctgtggtaggagcacttaacctaagattaaccctttttagaaaatatttaagtgtgtgatacagttttgttaactgtatgctctacagtgtacagtagatctccagaacttatcttgcataactgaaactgtgtacccttgaaaatcccccccattaccccttccccaattccttggcaaccaccattctactttctgcttctatgtatttgaatacttgggataccacatacaagcaagatgattcagtatttatccagaacagaaaaatagaagattttttgtattagttatgttagcttgattttaacttttagacaaagggtatgttgccatctcttctcttgacacaggtcccacaaatgttagaggtgtatctgagactctctgaatctatgaacctctgcatttatctattttaacttatagggaggttccaacataaaaaagaataagctagccattagtgctgcccccaaccagagtgaacagactttttaaaaggctgtgcatgctatgaaactagaggattcaaatccgagttcaacagttgtgacagaaggataacctggatgagattccctgcattcttaaaataactctggtaagtgatggtaagcattaagggtaatataatttttaaataccaaactgccttttaattacattaatatttactatacattgaatactagattctgtgttaagcatttcttaggtaattcatttaagctttacagattttgagatggataccatgtgtttcattttgcagacaatgaagcccaacctgagagaaattaaatacttttatcaggattagcctcccaggatatggcagagtttggatttcaatcctggtctatgagtcttcagcaaccatggtattattccttacacaactgcctttaatttatgtctcatttttaaaagaatgttttctctggaagaagttgtaacagctgctttcattgtcctaccatatcccctcagcactcaccctttctgtaaacaccagcccactttccagcacaccttcccacatctagccagaatctggacccatgtgttcaaataacagggtttccttagaaaattgatctgctgattaatggaaaattgtaaagggttctaaaaagtgtaggaaaatattaccttacagtcaaggtaattaacactggatagattgataaaactagtttttaataaaattttaacattaaagatgcaccaacacaaacatgaaatttgattttctcttttgaaaaataattttatgtaatatcgagagacaattaaacatttttattagccttttgagtaaactacaataaaagacagggtggggagagagagaagacagattcacttgacctcatgctgtctttattgggtctttattagaaagctgattctctcctctcttagtgagtatgagattttgcatttttaaaatattcgagtaatcattctggctaaatgaatgactgatagtgacctgaagttctgttttgtgatatccagtgtttcaaacctttgatatttgacaagtcttccaagatcaaattctaaattaaaaaaaaggtaaaatttaggtcccctaaagtgcaaaaaagacatattcagcttatttaatatattaaaatcatataggaaacactgtctgatataaaatggtgtttaactttctctggattatgttcatataaatattagtatgtgttacaaaattatatgtttcctgtaattgtgatatgtctctatatatgttgctagtagtaattataattattgtgtaaaattgatggtataccacagaaataaccaagattcctagtgaattttggctttaactatggctgtcctgagaattttgtcacccacagacaactgttgtcttgttttgagcctcttcaaaaggtggttataatcagctgtaggactttgacaggtgctcttgaattcaggtcttttatagctttggagattgtgacattagaatagaggaaaacctttcagaactctcatggaaagctggaatgttcatgtatatcaagcagaacagcagtaaacctcatggactgaactaatagaagactaaattattccttttatgacttttgtttaaaatgttactgattctttgttttgtttttcaaagtcaagaacacttttattttaagctatttacagcttttaacaattgagtatactcctataaatgaaatttgaggcatatttctctctgatttctccaaatttgaaaactagttgtgagcattcttaacttatggcaatatagttatttgcataagtgcaattagaatctgttttcttttgcaacaggacacaattgaagaaactggttatttttacccaggctttgactggaatgacatgctttcaaatataagcagcctgctataaggaaccagacttgacttatggaaccaagaaactcaaaatcgtaccaattataatctcacaatacagtgaaataaaaatagaaatcaatatcaagaagcactctcaaaactatacaatatgtggaaattaaacaacttgctcctgaatgacttttgcgtaaacaacaaaattaaggcagaagtaaaaaaaaactatttgaaataaatgtaaatagagacacaacataccaaattctctaggatgcaacaaaagagtgtcaagaggaaagtttatagtgctgaatgcctacctcttaaatgtaaaaagatatcaaattaacaatctaacatcacacccagaggaactaggaaaataagaacaaaactaaccagaaagctagcagaagaaaataaataactaaaatcagatcaaaagtgaacacaattaagacctaaaaatacatacaaagaatcaatgaaaccaaattgaaacactgaagagaccaatatcaagttccaaacctgaatcagtattaaaaagcctaccaaccaaaaagagccccagacaagaaggatttacaaccaaattctaccacatgattaaaaagaactggtatcaattctaatgaaactatgccaaaatattgaggaggagggacctctctctaatttattatatgaagccagcattaccttgataccaaaatctggaaaagaaacaaggaaaaaagaaaactacagatgaacatagatacaaaaatcctcaacacaacactaccatcctcaacacaacactaccaaatcaaattcaacagcacatcaaaaatttaatttatcatgatcaagtaggcttgattcctgtgatgcagggtttgctcaatatatgtaaatcaataaatgtgattgcccacatatacagaattaaaaacaaaaaacacaggatcatctcaatagatgcagaaaaggctttcaataaaatcgaactttccttcataataaaagcccttgaaggaacatacctcaaaacaataagggcagtctgtgaaaaacccatagccaacatcatactaaacagggaaaaactggtagcattccctttgagaactgaaacagaacagggatgtccactctcaccactcctattcaacataacactgggaatgttagccagagcaatcaggtaagtgaaggaaataaaaggcatctgaataagaaaagacaaattcaaattacctgtcttcaccagtaatatgattctctacctagaaaaccctaaagactctgccgaaagtttcctggtcctcataaatgactttcgtaaagtttcagtatacaaaaatcaatgtataaaaatcagtagcatttttatacatgaacagcatccaggttgaatttaagaacacaatctcacaatagccacagaaataaaataaaaaataaaataaaatacctaggaatacgtccaaccaagaaggtgaaagatctgttcaagaaggactacaaaacactgctgagagaaatcagagatgacaaaaacaaatgaagaaacacttcaggttgatggattgaaataatctgtattgttaaaatggtcatactacccaaaacaatctacagattcaatgcatttcctatcaaactaccaatgtcatttttctcagaactggaaaaaaactattctaaagtttgtatggaatccaaagagcaaaaataccaagcaaaaagaacatagctggaagcatagcattacctgacttcaaagtatgctataagactacaataaccaaaacagcatggtactggtataaaaacagatacatagaccaatgaaacagaataaagaacccagaaataaagccacaaacctacagccatctttgacaaatttcacaaaactgagcaatgggaaaaggactccctattgaaaaaatggtgctggacaagctggctagccaaatgctgaagaataaaactgaactcctacccttcaccatacataaaaataaactcaagagggaataaagatttaaatataagaccatgaactataaaaattgtagaagaaaacctaggaaacaccattctggacatcaccttttcaaaggaatttgtgaccaagtcctcaagagaaattgtaacaaaaagaaaaattaaggaatcaggaaaaatagctagtgtatgctgggcataatacctaggtgatggattgatagatgcagcaaaccaccatggcacatgtttacctatgtaacaaacctgcacatcctgcacatgtaccctggaacttaaaatagaaataaaaaaagtgagtcctaattaaactaaatagctttggcacagcaaaagaaactatcaacagagtaaacagacaacttacaagataggagaaaatattctcaaactatatattcaacaaaggtctaatatcccgactctataaggagcttacgcaattcaacagtcgaaaaacaaccccattaaaaagtggccaaaagaaatggacatttctcaaaataagacatacaaagggccaagaaacatataaaaaaagtttatatcaataaccataagaaaaatgcaaataaaattacaacaaggtaatatctcacatcagtcaaaattgctattactaaaaagtcaaaaaacaacagatgatggggaagatgaggagaaaaggaacatatatacagtgttggtgggaatgtaaattaattcagccactgtggaaagtggtttggagatttctcaaataactaaaaacagaactaccatttgacccagcaaacctgttattggatatatatacaaaagaaaatgaatcattttaccaaaaggacacatgtactcatcacagcagtattcacaatagcaaagacatggactcaacctaggtgcccatcaatagtggattggataaggaaaatgtggtatatatacaccgtggaacaccatgcagctgtaaaaaagaattaaatcatggtttttgcagccacatggatgcatctggaagttattatcctaagctaataatgcaagaacagaaaaaaccaaataccacacattctcacttataaatgggagctaaacattaggtactcataaggatggtaacagtagtcactggggcctactaaaggtgggagagatggagggtccaagggttgaaaagctaacttttgggtactatcctcactacctggatgataggatcattcatacagcaaacctcaacatcatacaatagactcaggtaataaacctgcacatgtactccctgaatctaaaataaaagtttaaaaaaaaaagcgcctccccacccaccaaataccaaacaagtgtcagttagtctatagcttagcgattctaacatgctgataggaagacatacatccacaaaaatggaggagtagcaaagaaaataaaccaaaagaagaggaaaagaacaacaccaaactaatattcaataagactatctcaagagttatgtgccacatattatatccatgtaccttgggaatctggtactggtgcttgagtataagctttagtgtaatgtggtaattaccttgggcttccaattttttttattaatgaagaagttagaataattaaaaagaaggaaaatatctctctaccaaatacacttggtgaaaaaataactatcaaaattacaggctataacaccgtaccatcaaaatcctccagaacagacttgaaaagcgaaatcagaacgttaccttggtatagtttctgaatagtacagtgtgccaatattgtggggataaagaggtaatagtttagatatatacagaagtttaatattaattgttttcatagatgttcattgtcatgaatattcatgttgaaataactttggaaaatacagagaataaaatcagtcagagtattatttattccacctcacataattcaatggtacacagttagtagggattataaatgcatatactttactttttctgttggtgtaaataattcagtcacctttcctcatagtgagtgctttgtatacttcctgggttttggctccagagcagataaactttagcagaaagctatgcttctcagaaaaaataaatgtatttatctaatactcctttctatcagctttttcatttggagtttataggttatctgaaatacctccaaggatattgttattgtacctttcaatttgctactagcagttgtcactgtatgactattactatgattgaattaaggtgataactactctttttgttaaaaaaaaaaaactgatcttaattggtgttaatctatttcttcttttccttgtctgtaatattgaatatttatcccataaaaatctatttgtctcctctgaatacacacacacacacagacacacacacactcttctgctccatctgccagagtgatagagaggaaataacaaattcatcaagataatggaagaaagtctagaatgtctacaaggcaatatttttctaagcattaaacataccaaaaggctgaaaggtttatatccacagaaatttattgtgattctatatatgaaaaaacaaataccagcattgtatcttgaaggtggttgaatgctttctttgaattttgtgaaataactgcctgagtggtagcagagaggtgaagattaataatttgagatagcatctgaaaaagaatgtctggaataatcaaaaagaaaataaagtacaggtacccaggaagggcactaactagactgagttgaattttttttttttatatctgatacagtagagcaatacaaaaatcactctcacagttagtagtactcctgtcactaccactactaactgtggttaatgtaaacagtagaacataaaattatagcactaaggatgattctgcttatcataattaccataattaaatactgaagcacttctgtatactttgtgcatcacataatttatcatttaatccacatgacaaacctattaggcggttttcttatctgcttttaaatcttgagaaacccgaggtgactgaagattcctagcctctcatcacttgtaagatgaaaagtgtttatttgcctctttgtagttgaaaatgtaatgaatcaattgaagaaggagaaagttgatgctttccatataaatctgagacccaaagagcagctgatagaaattaggaaggacaagagtaattaagtacctaaaatatatttacaaatttaatatccacagtaaccctttgaggtaggtactattattatcctcattttaaaaatgagagaggtaaggcagtaaattaataaacctgtaaattgagcaagaatagggagacttaaaaacacattagatgaacaatttaaatcttccagacacagatatttaacccagcaaactggcttctggaaattacaagtgagagatcaggtacatgtacaattctggaaagaatccgtattggatttttctcagaattgcaaaaatgacttgtggaaaggcacttctaatttccaggctaagtcctttgacttcagctagctcaatgtggaggtgctatgtgctaccctgtgaacaccactgtgaaattctctgaccttgattatgatggtgaatggcagacacaaaaagtcacacatgatcaaagagatgttactttgcctaagatgaaccttttttctttctggttatttttctcaggacccatttctcagggtgcgatgtttgtgacatctacagggatgaggaaattcagaatattattttacatcattttctgctgtttagaggaagatgtcagagcaatagtctgttatcaaaattaaaatgactggtctattatgcttggcctatatatgttcatatgctatagagctatattaaaacaacatataacattttcatatcctcaaatatctctctttagtttcccagtttcaccactttgcaatgttaacaagaaaaaaaggtagttttatcctagaaaataatgacagagagaattttaaataaaaggaagtaatcatgtcaaaaactgaacaaatgaatggaaacaaaaaatgacaagtgtccattaaacttcaatatgatgtcattggtgatttagaagaatgtaaaatcaacaaatacaaagaccaaacagagaacaacagataacgatgtaaagagaggtagcaaatatatatatattatataatatatattatagatataatatatattatagatattataaatatatattatagatattagatattatagatataatatatataatatatattatagatattatagatatagatataatagatattatagatattatagatataatatatattatagatattatagatataatatatattatagatattatagatataatatatattatagatattatagatataatatatattatagatataatatatattatagatattatagatatagatattatagatattatatatattatagatataatatatattatagatattatagatatagatattatagatataatatatattatagatattatagatataatatatattatagatattatagatataatatatattatagatataagatatattatagatattacagatataatagatatattatagatattacagatataatagatatattatagatattacagatatagtagatatattatagatattacagatatagtagatatattatagatattatagatatagtagatatattatagatattatagatatagtagatatagatattatagatatagtagatatattatagatattatagatatagtagatatattatagatattatagatatagtagatatattatagatgttatagatatagtagatatattatagatattatagatatagtagatatattatagatattatagatataatagatatattatagatatagatataatatattatagatattatagatataatatattatagatattatagatattataaatatattatagatattatagatataatatattatagatattatagatataatatattatagatattatagatatattatagatattatagatataatagatatattatagatattatagatataatagatatattatggatattatagatataatagatatattatggatattatagatataatagatatattatggatattatagatataatagatatattatggatattatagatataatagatatattatggatattatagatataatagatatattatggatattatagatataatagatatattatggatattatagatataatagatatattatggatattatagatataatagatatattatggatataatagatatattatggatattatagatataatagatatattatagatatagatataatagatacagatatttaatctataatatatatattatagatattatatatattataatatataatttctataatatatatattatagatattatatatattataatatataatttctataatatatctattatatctataatatacctatgtatctatataatataatatataatatatatatatatgtcaggcctctgagcccaggccaggccatcgcatcccctgtgaattgcacgtatacatccagatggcctaaagtaactgaagatccacaaaagaagtaaaaacagccttaactggtgacattccaccattgtgatttgttcctgccccaccctaactgatcaatgtactttgtaatctcccctacccttaagaaggtactttgtagtctcctccaccctcaagaagattctttgtaattctccccacccttgagaatgtactttgtgagatctacccctgcccaccagagaacaaccccctttgactgtaattttccatcaccttcccaaatcctataaaatggccccaccccatctccctttgctgactctcttttcagactcagcccacctgcacccaggtgaaataaacagctttattgctcacacaaagcctgtttggtggtctcttcacagggacgtgcatgaaatttggtgccgtgactcggatcgggggacctcccttgggagatcaatcccctgtcctcctgctctttgctccatgagaaagatccacctacgacctcaggtcctcagactgaccagcccaagaaacatctcaccaatttcaaatccggtaagcggcctctttttagtctcttctccaacctccctcactatccctcaacctctatattataatatataatttctataatatatctattatatctataatatacctatgtatctatataatataatatataatatatatatatatgtcaggcctctgagcccaggccaggccatcgcatcccctgtgaattgcacgtatacatccagatggcctaaagtaactgaagatccacaaaagaagtaaaaacagccttaactggtgacattccaccattgtgatttgttcctgccccaccctaactgatcaatgtactttgtaatctcccctacccttaagaaggtactttgtagtctcctccaccctcaagaagattctttgtaattctccccacccttgagaatgtactttgtgagatctacccctgcccaccagagaacaaccccctttgactgtaattttccatcaccttcccaaatcctataaaatggccccaccccatctccctttgctgactctcttttcagactcagcccacctgcacccaggtgaaataaacagctttattgctcacacaaagcctgtttggtggtctcttcacagggacgtgcatgaaatttggtgccgtgactcggatcgggggacctcccttgggagatcaatcccctgtcctcctgctctttgctccatgagaaagatccacctacgacctcaggtcctcagactgaccagcccaagaaacatctcaccaatttcaaatccggtaagcggcctctttttagtctcttctccaacctccctcactatccctcaacctctttctcctttcaatcttggcactacacttcaatctctcccttctcttaatttcaattcctttcattttctggtagagacaaaagagacatgttttatccgtggacccaaaactccggcgctggtcacggactgggaaggcagccttcccttggtgtttaatcattgcagggacgcctctctgattatacacccacgtttcaagggtgtcagaccatacagggatgcctgccttggtccatcacccttagcggcaagtcccgctttcctggggcaggggcaagtacccctcaaccccttctccttcacccttagtggcaagtcccgctttcctggggcaggggcaagtaccccttaaccccttctccttcacccttagcggcaagtcctgctttgctagggggcaagaaccccccactcccttattcccacaccctgacctcttatttccgtgccccaaccccttctctgcttttctggaggtcaagaacccccaaccccttctccgtgtctctactcttttctctgggcttgcctccttcactgtgggtaagcttccaccttccattcctccttctcccttagcctgtgttctcaaaaacttaaaacctcttcaactcacacctgacctaaaacctaaatgccttattttcttctacaatgctccttgaccccaatacaaactcaacagtagttccaaatagcccgaacacggcactttcaatttttccatcctacaagatataaataattcttgtcataaaatgggcaaatagtctgaggtgcctgacgtccaggcattcttttatacatcagtcccttcctagtctctgtgcccagtgcaactcgtcccaaatcttccttctttccctaccgcctgtcccctcagtcccaaccccaagcgtagctgagtctttctaatcttccttttctacagacccatctgacctctcccctccttgccagcccaagctaggtcccaattcttcctcagcctccactcctccaccctgtaatctttttattgcctcccctcctcacacctggtctggcttacagttttgttctgtgactagtcctccccctcctgcccagcaatttattcttaaaaaggtggctggagctaaaggcatagtcaaggttaatgctcctttttctttatcccaaatcagatagcgtttaggctttttcatcaaatataaaaacccagcccaattcatggctcgtttggcagcaaccctgagaagctttacagccctagaccctaaaaggtcaaaaggccatcttattctcaatatacattttattacccaatctgctcccgacattaaataaaactccaaaaattaaattctggccctcaaaccccacaacaggatttaattaaccttgccttcaaggtgtacaataatagaaaaaagttgcaattccttgcctccactgtgagacaaaccccagccacatctccaacacacaagaacttccaaatgcctgaaccgcagtggccaggcgttcctccagaacctcctcccccaggagcttgctacaaatgccagaaatctgaccaccaggccaaggaatgcctgcagcccaggattcctcctaagccgtgtcccatctgtgtgggaccccactggaaattggactgttcaactcacctggcagccactcccagagcccctggaactctggcccaaggctctctgactgactccttctcagtttagcggctgaagactgatgctgcccgattgcctccgaagccccgtagaccatcacggacgccgagctttgggtaactctcacagtggaaggtaagtccatccccttcttaatcaatatggaggctacccactccacattaccttcttttcaagggcctgtttcccttgcctccataactgttgtgggtattgacagccaggcttctaaacctcttaaaactccccaactctggtccaacttagacaatactcttttaagcactccttttagttatccccacctgcccagttcccttattaggccgagacactttaactaaattatctgcttccctgactattcctggactatagccacatctcattgctgcccttcttcccaatccaaagcctcctttgcgtcctccccttatatctcccaaccttaacccacaagtataagatacctctactccctccttggcgaccgatcatgcatcccttaccatctcattaaaacctaatcacccttaccccgctcaatgtcaagatcccatcccacagcacgctttaaaaggattaaagcctgttatcactcgcctgctacagcatgggcttctaaaacctataaactctccttaccattcccccattttacctgtcctaaaaacagacaaggcttacaagttagttcagaatctgtgccttatcaaccaaattgttttgcctatccaccccgtggtgccaaacccatatactctcctatcctcaatacctccctctactacccattattctgttctggatctcaaacatgctttccttactattcctttgcactcttcatcccagcctctctttgctttcgcttagactgaccctgacacccattaggctcagcaaatcacctgggctgtactgccgcaaggcttcacagacagtccccattacttcagtcaagcccaaatttcatcctcatctgttacctatctcagcataattctcataaaaacacacgtgctttccctgctgatcgtgtccaattaatctcccaaacctcaatcccttacaaaacaacaactcctttccttcctaggcatggttagtgtggtcagaattcttacacaagcgccaggaccgcaccctgtagcctttctgtccaaacttgaccttactgttttagcctagcactcatgtctgcgtgcagcggctgccactgctttaatacttttagaggccctcaaaatcaaaaactatgctcaactcactctctacatttctcataacttccaaaatctattttcttcctcaaacctgacgcatatactttctgctccccggctccttcagctgtactcactctttaagtcccacaattaccattgttcctggcccggacttcaatctggcctcccacattattcctgataccacacctgacccccatgactgtatctctctgatctacctgatattcatcccatttcccatatttccttctttactgttcctcaccctgatcacgcttgatttattgatggcagttccaccaggcctaatcgccacataccagcaaagacaggctatgctatagtacaagccactagcccgcctctcagaacctctcatttcctttccatcgtggaaatctgtcctcaaggaaataacttctctgtgttccatctgctattctactactcctcagggattattcaggccccctccctttcctacacaccaagctcgaggatttgcccccacccaggacgggcaaattagctttactcaacatgcccgagtcaggaaactaaaatacctcttagtccgaatagacactttcactgaataagtaaaggcctttcctacagggtctaagaaggccaccacagtcatttctttccttctgtcagacataattcctcagtttagccttcccacctctatacagtctgataacagaccagcctttattagtcaaatcagccaagcagtttttcaggctcttagtaggtttcagtgaaacctttatatcccttaccgtcctccgtcttcaagaaaagtagaacggactaaaggtcttttaaaaacacacctcaccaagctcagccaccaacttaaaaaggactggacaatacttttaccacttttgcttctcagaattcaggcctgtcctcagaatgctacaaggtacagcccatttaagctcctgtatagatgttcctttttattaggccccagtctcattggacaccagaccaacttagactgtgccccaaaaaaacttgtcatccctactatcttttgtctagtcatactcctattcaccattctcaactactcatacatgccctgctcttgtttacactgccggtttacactgtttctccaagccatcacagctgatatctcctggtgctagccccaaaatgccactctaagctcttgaagtaaataaataatctttgctggcaggactatggtgaatctccttaggcactctctaatcagatgtcctaggtcctcccaattcttagaccttttatacctgtttttctccttctcttattccatttagtttctctattcatctaaaaccgtatccaggccatcaccaatcattctatacgacaaatgtttcttcttacatccccacaatatcacctcttaccacaagacctcccttcagcttaatctctcacactctaggttcccacgccgcccctaatcccgcttgaagcagccctgagaaacatcgcccattctctctccatactagcccccaaaaattttcgctgccccaacacttcaacactattattttgttttatttgtcttattaatataagaaggcaggaatgtcaggcctctgagcccaggccaggccatcgcatcccctgtgaattgcacgtatacatccagatggcctaaagtaactgaagatccacaaaagaagtaaaaacagccttaactgatgacattccaccattgtgatttgttcctgccccaccctaactgatcaatgtactttgtaatctcccccacccttaagaaggttctttgtaattctccccacccttgagaatgtactttgtgagatccacccctgcccaccagagaacaaccccctttgactgtaattttccattaccttcccaaatcctataaaatggccccacccctatctcccttcgctgactctcttttcggacttagcccacctgcacccaggtgaaataaacagcttttattgctcacacaaagcctgtttggtggtctcttcacatggacgcgcatgaaaaaatatatatatatatataattttttttttttttttttgagatagagtattgctctgtcccccaggctggagtgcagtggcacagtctctgctcactgcaacctccgcctcctgggttcaagcaattcccatgcttcagcctcctgaatagctaggattacaggagtccaccaccacgcctggctaattattttttcattttttgtagagacagggtttcatcatgattgccaggctggtctcaaactgacctcaattgatctgccctcctcagcttcccaaagtgctaggatcacatgcgtgagtcactgaacccagcttaagtctatattcttctttaaaataattctgaaggggtaagaggtgaaagagatcactagctaaaaatagcaaaaaagtgaatatagtttagtttcttcttgctttttttgttttccttttaatgttgggaaagttttgcacatggaagcaagagaagctgcagtgcaaagagactgactgctaaagacagcctggaggagggcaatgggtgtcatccacagccgagggtcataaattttgaatgacaagaggggcattatttccaaggaaactaaaataaagccgagaaaagatggctgaatggaagtatatggggatgtttgtgagaatgagagggtttaaatgacttaacatctaatggactcaatagtcattgggaaataagagccaaggacattttctgagagtgagaagaaggtgaggggcaaggctgaagggagtggcaaaggtataaattgcttgaagggaaggacttctgaaaaaaaaaaaaaaggagtatttaactaaggctggagataatgaacatgtaatgacttcaggacaaacaatttatttttttctccaggacttagtaacctggctataaaagaggaaatgaacagttgagtttataggagatcgttgtttcttttttgaatgcagtgggcaagtacttttaggttacctgtgctaaatgtcggtaaggacaatgaatgagaaagataaattcaagtacctgtagctttggtgtctagtgagtggtttaggggcagaagctgtgtttgagtaacattctagtttctctgaaatcacaccttgcacttttatacctaacaaggcagaattaccaagtggttacctgcgtgggcactgcagtcagaatgcacagtttcaagctctgtctctgacgcttaccagctgtggaaagcatgatcagttgctcaaattttcagtttccttacccttaaaataaaaataaaagtaattgtgcaaacctcacagggattcattaaattaatacctaaaatattgcctgcttgatcacattaagcattccataattattgttcctaattagattttatgacaatctctttctcaaattcaatagtttccaaaaaataaaagcagaaaattaaaaatatggagaatgaagactttaaacaattatttgatttttctattagtattataaatagtacatggagtacttcttttctcaattccattaataataacatgagaataaagttcggggttaattttttaaaagcagttagtttgctccactagtgacagaacctattattgccactgactccatttctttacacgtgggcaaaatcttaattcatctctcttgatcactgctcttccaatagctgaaagtagttttgtcaccagctcattagattatttgaaatttctaattgaaatataatattttaatgtcaaaaggcctgcatgtactaggtagaacagggtagtgagatttgaagggaatgctttttcttctctaattagaggcaatgaagtgcttaattaaggatgtctggttcattcttatgcacctactcataggacaagtgaatacacaatcaactcataactctccagtgttctctattgtttcatttgaccactggtcttataaaagggaatggttccaaagtgagttaaagaactgaactcacaccgagagtatattcagcagctgtgctttgaataattggcccagcaacctcagcatcacctgttagaaatagaaaatctcaggtctcattttatacctattgaaacaattctgcatttcaaaaagatacctgagtgattcacatgcatagtaaaatttgagaggcatggccaatgacgacattcatattctctgggaaagtgaaggctgcattaggtctcagcattctgtcttccgcctttttccattcctttagtctctgactaactagaaggactgttaaaacacatctggaaattttgagagtcaggaagttctccgcctctataggcactgtccagagggtattttttgttagttcctccacatctcctcttttttttccagaactgagtataaaaggccctgtgtgttcatatacccaacacttcactttgtttctgctcataatatgatagatttttggttggagaaataggatgctcatgctgtgtgtaccagtgcagctcatcgattttagcaaccacagcttttgcaaacaaaatcataaaatatgagtgaacatacagtttgaagaccagggataaatttccctatgacaagaacactttttaagcccacaaatttgtcctgagtgatatgtgcgttattaatcaagacagttgtcaagttgtctggttaagtggatctaagagaaaaaggaatgagacaacagcctacatatttgtttaaagttatgaattaagtatttcttgttccatgtgtttcactaatttgtctattcttgacatttagaaaagaagaggaaataatacatttggttttggaacaggatttgagatgagaattgagttcagagctgtgctaatcatctgaaaccttcttcaatgataaatcaactttttattttgaacctatttgatcaaactaaaatctcacaattgaacatgaataaaattttttcttcctgaaatctatataacatacatcgagtaacttctagatgatattttccccttgagaaacaggttctttaaacatagcaaatggtgggtttcccgttactatatcgtatcaatttctagaaccaaatcatattctccatgttactgtgcagattaattggacaccttttaaaggatgactttttttgtgcctggatatatcttctgtggattaatttccatctgaaaactcacttcaatgttcaagataaaggattaagttgagaaaaatagtcaaagtagattacataataacactgcatgatcatgaataatttgtagtagttcatctgagactgcaacattgttatcctatcaattcaaactttaaatacttgataatcagactttgggaatctaacaaatatttgagacttgagattgaatgtctacattataagggcaaatctaaatgctatgttccatggtaaatttgagcagtgcttttcaaccctgggaggaaatccagtgtccaagctcaccccagctcagctgaatcagaatcatttggtggtggggtgggggtggcctatgcatcaatactgaaaacaaataaactcaactctgattctaattgcagtcaaggttaagatatacttccctctactggaggacacttatcgtcttagtatttcatgtacataaaatgcaacccaaactgcagatttctaacaaggaaattacacctatgtattacacataatgcctcagtataaatttcaagtaataagtcatcttacaacactgtaatcacaaaatctctagttaagtgaaatactggtttcatatatgaaaaatgcatcctgatgaaatatatgaacacatgtcttctggtaaagatcactgatctcattgtttctcactcttattggggcaattgagatttcattgccttttaaatgttatacaagggaaaatatagtcttgtaaacattcttctaaaaaaatagactatagttttaagcttgggtggctccatccacaaaataaatattatagctgaagttcaagatttaaaaagaattgttatgttttgtttatcataatagccgttaactaaaatatcattatttgtttcatcttacaatgctcagggggttaaaatggttcaccaaatttcatattaaagaattgttggggccgggcgcggtggctcacgcctgtaatcccagcactttgggaggccgaggcgggcggatcacgaggtcaggagatcgagaccatcctggctaacacggtgaaaacccgtctctactaaaaatacaaaaaattagccgggcgtggtagcaggcgcctgtagtcccagctactcgggaggctgaggcaggagaatggcgtgaacccgggaggcggagcttgcagtgagccgagatcgctccactgcactccagcctgggcaacagagcgagactccgtctcaaaaaaaaaaaaaaaaaaaagaattgtcggatgacattttcgatagctgagctattatctctgtttatgacattttctttttcttttttttcctttgaagatggagtctcgctctgtcacccgggctggagtgcgatggcataatcttggttcacggcaacctccatctcccaagttcaagcaattctccttcctcagcctcccaagtagctggggctacaggtgcatgccacgatgccaggctaatttttgtatttttaatagagatggggtttccccacattggccaggttggtctcgaaatcctgacctcaggtgatctgcccaccttggcctcccagagtgctgcgattataggcatgagtcaccatgcccagcctgtttttgatcttttcgatagctgacctattatcactgtttatggaaattagcttagtgacttatcctaagttcttgaggaggcactagagaaaatatgtactttgtctataagtttagcagattattttaggaactctagcttctctgcaaagtaggttttatctgacatacaaggcaaaggaaatattaggaagtacacatacatgctaatatatagagagccaaaataaataaagcaacacattatttatatttaagaactttgctttgaagacttagaaaggcaaacaaagaaaaaaaaatcccactcaaaaagaagttttaagactgttgactgtatattctacttaaattaagtcacatataatagtttcactgattttaaatgagttaaaggtgttatctaaagtaaggtaggaaatatagtgattactattctttttaaatgggtcactataaaatctaatagtgctagtataatttaaaatctatagaaaaagcagacattttttaaaaatgagaatggaggtggctaaagtatatactgataaaaaggaaaatatagatacagatccaaagttatatatatatatacatatatatataaatacatatatatataaaataaacattgtgtttttaattcctcttccagtaatcatgtgtgtttgcagccattcctcatttattcacaatgaaaaattcagggaagatggggtggctgataaccctagggaagaagaaagaggctatgagatgttgggaagtctctactggataggtagtaaaaatgggaggctttaagaactgaggctgtaggttcagaagataatagaaatggagagaaggaaaacaggcagtaagacattgatgttttgacccctaatctatgggttgatgtcttggagggggtcaaggagtgtactggatagtttgagaggaaccatttctatgtataatgctgatgtggtgacaaacatctaagttgacaccgcggcctgggatggcagctccttagagccctccagctctcgtaaggaatccagaagttcccacatgccctgtggagagctagggggagctggctgatggtgctgactggccagccagcagagagtgtcacagtggctcaagagaagggatcctgcagctctgctatactaggtagcacattcaggtttaggatgaaaaaagtgtctggcaattctccagagaaaccaaagcaaaagagaactaggatggagcctgactggctgatggattattaacagttaccaggtgcagagaaccagcagatgctgggagctgtagcagtgattaaggcaaaaaataccactgctgcagaggacagtgaggatcctataagctcctccataaaccaaagtccctctgtataaagagaagggaaacagccataaaacaacattgaaaatcaacaagctgagctattcagaaacagtctattgaaacacagaagttaccacatgactacttgctaagtttaaagtttaattttcaatgctccagagggtagatggtgaggggcagggttgagaacagtgagggtagtaacagcagttacagataataaaaatgcacatgttagtgtgtctggcgagtgacttccctacatatattttttcataagcaagtttttcttttaaaattttatgaagttaattataggtatcttttcacatttcagcttctgataaagtcttggtcataagaaaacagtgaggtaactgaattttgcttcaatttattttttcttcctaatcaccttgcaagtgggctttataatttcagagctagtaatagtgatgacatatttgtgctttattgctatggcaacagtgcttctcctgagacaagggccatgtatttttggttctctgttctaaaatcacatgtttaccaacagatacagctttgtgattgtggctttcaatttgattgccccgagcaatgtgttgtggatactactgtattgcccaggtcttcccatcaggattgaggctgttttcacccagttttaaggagtgctgttgtcaaaaaaaccttcaacagtcaaccctttggaattgccttcagctgaaaaaaagcctccttgtacaaggtcatattgccgtagcagtcacagcttaaatccagtgactggtaaattctggggtttaaaccaccccaaatcaagacaactctgaagatctacccacgcttcagagctcaccagggttcctccatttaagcctaattccttttcctcttcccagtgttaattctaagagcactacctactaaacctcctgtatgctaatttcattttagagtctgcttcatcaataacctgacctgcaacagttgcttctagtagtagcctgagaaatcagatggattggaacatttgccagccagctgacaatgaaggccaaaccactggtggtagacagaacttggataggttctgtaacaagattttggtgcaattgtcaaaatgtttatcagcaataaactggagagataaaccaggagaagcaatgtatcatgtgcttaagaaatacaggataaatagtattgataaggataactattctaggggtaattgatgctctggagaaaaaaaaggaaagtctgggggttattatctattaaaaaggtaactgaatgtcagagagacttcttggaagcacttaacagtcttttatttcctacatactaaggacagagaaagctgaggactaggaagagagccaaatgggaatagcacagttctaataaaggtttaacatttaagctagacaaatcttatatgtcaaattcaaagtcctgattgggaaaaaatgggaccttgacataagggatggggtcatatgggtgcatgcccttgaaaatattgaatctccaaattccattgaactctttggagctgtagaagtggcacatttctctctgttaaaggctagggtcccacttgtcttaaagaaggcctctctcctgcaagacatcatgtgccttcctcaaaatctggacctcgctttcctcttaagtaaaaagtcaataagcagagatgtcacaccataatctggtcatggaagtgacaagcttgtgaagggaggtagggagcaatatcccaaagagctgcaggaccaagacagctggtcccacagaggaaccgtgaaaacaaaattcagggagaagatgaaattatatatggaagagtttatctatacagaagaactgttgttttaaaaacattctggcaaaacactttgggaaagactccaaaagacaatgctaggatgtttcttagcaacttggagaaaatgtggcccactataagtagaataggagtgtcaatattgctatggcagatggtagtaaaagaggggaaatagtttggaaaaatgggcatgccagagtggacatttcatgtaagcctgggcaaactgctagatgactatgctctcagcagggccaggaaaatacttcatttaacaaagtaatgaggaatatggtagtgaaaagcctaccagcattagaacctacagcctaactgtggagtacaatttatgagaggaaacatgttagggaaatggtctccttaataagagtggggatgataacatttcaaaataatggactctaggtggtggcttttaacagtttaaaacaagacagtttcaattagtgttgaattagtgttgaaagttgaaatattgcctagaggagcatggcaggcagagagctgcagatatggctgatagaacacacttttcttagagtcaagatagatgtgcattcaatgatagcattgcccaatatttacaacaactccaggaaggctggtcaggagattaaaggcagtcctcttaacaaaatgtcacaatctcttgtccaatttccagatgcgagtcagtgttccaacccttgaacccaatgaatgaagaacaagcttggttcccaagagaaagtaccctggtagcattccagcaattacacactgtaatgattacttcttttcccaaagagcactataaccatttgcttaaataactgcacactgggaaaagaatacccaaacctaatattctgaggattgttgcatgtaagtactgagttgccaatgatatccatgaacacaaattatctcaccttcatggtttgcatgtgaggctaggaatatatgaaggccaggtaataaatgggatcctggtgcaagttcagcttgagtgtgtctactggttccatgactcatcaaaaggaagagccccgaacccctccaccaccaacactgacacaatagtgacaatatcatattccaggtaaaactgcagagattgatactatcttataaatagaaaggagacagaggtggcgtctttatcatatctcctttcagttaccaagtctggccctataaaaccaaagagatcctcgaaaataccgtagattaccacaaactcagccaagcagtatccccacatcaagctgttgtagaagaggtggttatcttggctagagaagattaatgtcacttcatgtatatggtatttagccactaatctcccaaaatgttcttttccatccctaccagaaaagaatatcagaaacagttaatattcatttggaatagataacagtattcatttttcagtcttgcatcaaagctttgctaactctcctactgtctgttataatacggtctgaagaaacctcgactatgt

SEQ ID NO: 386 - DNA, 22417 bp, Homo sapiens
ctccaatttgagaagttaccctacgttaagccaacagcagcctggctccttcatcctgtgcagtatgggacagagctgggtccttgttgtcatcagccagacaagcacacattaaagcccaccttagccattggcattacagctttaaaagcagctccatcctaccatgctgtcactctactcaatcacgtgatcttaacgaccagctctacatatcctctctccatgcccccaccaccatcccccaccaacaaatccggtaatctatctctgtcaatagtcctgcagtgaattccgaataagtttttctcttccctggcctgccgtttacgtagtaccctggatgaatctatacttactccatagtaagtagtaccttggatgaatctatacttgcatccaatggaaatgagagtgatggtgcagagttatccgaagtaactccagctatgttgtggatcttctaatcatgggctcatctaagccttcccagatatcactctagtttttacaatctttgtttatgacaattagggctgtaacattggctgtagacatttgttgcatcaaggaactcagcttccactgaagttctgaagttaatcagtttctgatcttgttctgcaactctctgcaagaagaaaaatcaccaggaaatagtgcatcctgaaaggagtcaaagtttccttatccagctggagcagtgtgatctcggaccagagtcaattccttgcccaacagacttcacattgagccatgagaagcagcctacttacccttacctggacacttctccaaaacctgtgaaatggcctctgtcactgcctcaaagcctcatccttggtgggcaactcacctggatcctgagaccaaaatatagagcttaatgaactgctcctctgctgtaaacctactatcttttcacactaagatgtagatattctcgccttgctctacccagtggtgagcaaggatgttaatctagttcttacttcccctgagagcctcttgcaacttcactgttaatagaaatcactcttttatgcttgcaaagcatatccttatcctttggtataaggaatttatacaaagatgcacaggactggtggggtaacaagaaaagccatttccctaactgcctgcttaatctggatccaagtgctgctaagacaaagaagtacaacaaatttaataggaaaccagaacaaaaccctaaaacgaacgctcaaggttgtttgggttacaacctcagcttgagagatctgctctggcatttatacttcctaaaatagagaatttgagtgaatgaggtggccaccatccaaatgaagtgcctcaactgggaagagattcatgccaacctgctagggcatggtgtttagcctttcttatatttagtcaattcatgggctcatcatttggggtgaggtcatcaggatggtgccactcaattcacttggcaagagccacagcaactgatgtaggaagaagcctgttggagtttcttttactaaagggcacctgggggccaaggatacatggagtcttcatgaattaatgaatgaagcccctcaactggctcagtataattattctcaggggacatctttatattctcttacagttaaagtcctggtggggctagcttttcaaaataatgactccaattttgaggcagttcagagaatttagtggattgatttttcaatatctctgtctgttactgattaatttgttgagagtgaatgtaggcatcagctctaatttccttgaacagcttttataagtgacttacatgtataaagggcatcctccaaaaccattttaatttttaaagatgccaaacaatttgataattaagttctataaatgtggactagtatttcccaaactgtgccctctaggaaatgcttctaggagatgttaataggtacacaacaaaaataagtgaatgaaagaaaaattttcaatccattgtcagaaaactttggaaagaatttgtttactataggggactcttcttggagatttactctccaattagtatatttaaagacctgagaagttccattgtaaagaaatttgcttttaattaaccaagcatttcccaaatttaccttaacacagacaatttttaaatttttccttatgcttccccagatcctaattttaggacatattgatctatgtaaattttaagtcaaatgtataattttgaaacatgtgtagaacttaaatggaacaggatagggaataagacttactttaaatcaagtcctcaggaaaaacaattcgagataaaaaacttgtgtggggaagtttactgggtggtgttctcaggttcaattcctgcaaggaagtaaagacatagcactgggccgagggagaatttgaactgtgttctagccacaacaaagttctcattctgtcataggggatcaccgaagccggaatgggcttttacatttgtcctgccttgaggcagcggggctgggcattcataaccctccttaccaggttgcttccaggaagaggtcatgatcctggggtggatcaagaactgctatcttgggttgagggtaattcttgaagaaggattcagccagagtccccatgtcttagagaggccatcaacaattcggagatttagtgcctcatccctaaagagggcactggaggggctccatggcagcctctactttgtgccacttggatccatttgctttgtagattaagttctgagaacatttcctccaggatctcggttggtcatttctcttggagaaacttacaagaaaaaggaaatggaggaactacagcctcaccacatgcagctcatatagaggttgcaaatgacattcatcagctcctcctcaagtaccattccagatccccttgtccacgggtggtaactttgttggtccatgtggctggcctgatgtagtgaccagactttgatctctgaggggcctgagcttcatagccacgactgctgcacttccattcattaccaaaattgctcccattgggtaacggcagctctatctcctccttataatagagccgggaggctggctcctctccttgcttactgttggcacaaggagtcaaacgtgaccactgacagccatagctaacatttaatgggagccctcctgggtttcctggtggaagcatttttttttggtctgaaaaccagaacctctaaacccataaagttgggagttatagaaatgggaaacacaaatttcacaagtgtgtcagtagtactgatgggaagtggggcaactcctaatcgtctcccttggtttctggatttacctattgagaacacagaaccatgaaaaggcagttgatttagagcagtagctttcaaacttttggtctcaggacccctttacactgttaaaattattttaaacagaagcccaaagctcattgagggtgataactaccaatacttactgaattagaaattaaaactgaggaaactttaaaatacttcaactcatttgaagatagggtggaacacactgcatgttaacagatataacaccttcatataattattatgaagttagttttgacctcatggaaccctggaatctctcctaaagtgtcagattgtcccagaataggaaggagcatagtgaaggacacttggcaggtgaattttacttgccttggtttgtaatacctgattcttaaaagaagctatgaaatgtgttgacgttgtagtgaagtctggtctactttagtggaagtgcttccttgatttactcattaattcctttgccaacaaaatgaaatgttattcctcactttctgtgtaatctgcctaatagcaaagcttctttatgttagctttgttacatccttgattattcaagaaaaaagtatcaagttataaaagaacttacatattctttacaatcatgttactatctacatttaaaaaaatgctattttgattaaatagataactaaatatcattttcaggcacccacaatcatatgttaatcaaatgtccaaatctcctctgacaactttttgatttttgccttctcaaaatcaaatccaaatatagaaacatataagtaaaaaaagaatatttcaagatatcttttacatcaaaatccattttgagattcccagagggtccctggaaaattgcaaagatttgttttttcactttataagaagagaggtactagagataattagcgtttttgatatgttactattataaagtttcatgggaaaagttgtcaaatcagaagagacattcagttaaatttgggtatttaaaatattttattaatgtaatgatttcagaaattatatgattttggaaagtccctggagatttgtcagtgacctcgcattctatgttttaacttctgagggaacgttgacctaaactctgtggattttttccatattcaccagaatctttgtgttgctttgcctgatgatactagacaacaactgtatgttattagtcataatttccattattatttaaaatatgaacttcatcacagacttaattctttaatttgactttaatatattctatgccactgattttctttttttctttttttttgagacagtctcactctgtcgcccaggctggagtgcagtggggtgatcttggctcactgcaagctccgcctcccaggttcaagcgattctcctaactcagcctccctagtagctgggattacagcctggtgccaccacggccggctaatttttgtatttttaatagagacagggtttcaccatgttggccaggctggtctcaaactcctgacctcaagtgatctgcccacctcagcctcccaaagtgctgggattacaagcgtgagccactgcacccggcctgattttcaattggggatgcacctcaaacttacttacggagttatataaaaatacagatgtctaggaccgatgccagatttactgaatctctttttattcttgatattttcttagtatatgtttgctgtaatcttagtatattattatattatgtctcggttattatatctcaaggcttttcctctctaaaattatgttctcctattttacaaatcagatgtaacattcactgactcctctgaaaataggcctaatcattcttcttagagacatattgtctgaaagtttatctcagaatggctttatcatcttgttaggtgtgccacagaagcactcaaatgtctctgtgggttacattattcttattattaactctcattagacctttacgttggaaaattattttaataaattaaccacagacattttccattttctctatcatttaagatacatttgttttttgttgttgttgtttttgtttctgtttgttgtttttactatttactctgatgcttgcctgaagattctgctatcagctacaggtctgggtttgtgtctccgacaaagaaccacctcaaagccccacagaaaaggactgtaccgtatacttcaaactattgacacctcaaagaacagagcttgggttcaggcttctgatgcattctgagacactctcagaccataccagtgggctgggtcaggatttacagaactattttcatttcaagagcatacgggctcatgagattgctaactcaagatccggtggaacagaaatacttatatcggactgaataaactgatgaggaaaatcttattgcatttattggtagagaatactattgatgtttaaatgttctcttttccatatttaaaagcaaacaagcactttctttttcttcttaaactctctgtaatccgtaatgatttagtagactctgctctttctttttgtttttgttttgctttgttttttgagacgtagtctcactttgttgcccatctggggtgcagtggtgggctcttggctcactgcaacctctgcctcccgggttcaagcaattctgcctcagcctcccgagcagctgggactacaggcacctgccaccatgctcggctaatttttgtatttttagtagagacggggtttcactctgttggtcaggctggtctcgaactcctgacctcaagcaatccacccgcctcggcctcccaaagtgctgggattacaagcgtgagccacagcacctgacctgactctgctcttttatactgaaatgtaacattttaaaatgatatctgattctccccgattcctctgaaatcagaaattcttaagtgtcctcacttttcacatcaatatgcttgtttgtatatgttcagtaaaaatctgtcttttaaaaaaatcagaatataattaggaaaatcaaatatacaagcaaggcctttcctgcaatgtcacatttgtgaataatctcatttaatggaacttaatggggccaatacttataaggtcttcccccaaaaaatggcctggtgcctcattcacagagtcccagccttacaggagtaaaggcttgactgaggctgaaagcttcacggcaggacggctcacttctgcctgttggccagagaccacagggcctcttcatgggcagcctgggtgtcctcatgacgtggcagctggaatcgcctacatccactcatcaaggaagagaaggcaaggaggaagttgccatcctttttatgagctagtctaaaagtcacactgtcacttctgccttattctatttgttagaaatgaatcactaaggccgggcacttggtagctcatgcctataatcctagcactttggaaggccgaggcaggtggatcacctgaggtcaggagtttgagaccagcctggccaacatggggaaaccccgtctctactaaaagtgcaaaaattagccgggcatggtggtgggtgcctgtaatcccagctactcgggaggctgaggcaggagaatcgcttaaacccaggaggcggaggttgcagtgagccgagatcacaccactgcactccagtctgggcaaaagagaaagattctgtctcaaaaacaaacgaacaaacaaaagtgagtcactaagtccagtgcacactcaaatgggcataggagagaattaagctctacgtcttgaaggaaggcatatcaaagaatttgtgaagacatttttaaacccaccacaaccaccttccaaagctctagccctttccatcattctaggctccatcctcacccttgggtaattttatgatttactggatgaagcagccttataaacaaatagcaataaaatgaagcagattataattgtgtactatcgtagaggtacaaaaagcgctggaaaggacgttaaatccaactggaataatccaggggaacttcatgaaggaagtggcatttgacatgaaaaaatgagaggatttcgagggtctaagattagaagcaagaaggagcaactggccaggtgatagggcaaggtggatgttggtacagaggcaggagaaagcgtatgtcggggctggggagctgaggacaatatagtggcactgagaacactgaaaataaaactgtggaagtttaaagaggagaacagtgtgggaagcctcatatgtcaggaccaggacatgagaaatccaggaaaggtttctgaataggagactggcatgattagacccatgctttagaaagaacagcctggtgatcctgtgaagactgagtcagagggggacaggcatttaatgtattacattatcttaataaactaaccacaggcatttggcagtagcgaggcccagtgggaagccgtcctagttggttcagcaagtgccctttgactccatgggacagctcagaggcgcgccattgtggctgcacgttggagtcacctgggtgtttccaaaacacaccgacactcagtctccccaccaggtttctgatttcaccgtgcagggtgggtttaggcaccccggctgattctcatttgcagcccagtttgaaaagagcatgaccgagaaagggaagtcaggctgatgtcttctcagctccaggcaaatttgaggactactactcactcactcttgcctcattttctgaatttctcttctaccttcttccttgggtccttgtccttcacttctgggtatttttatgatttttaggttttccatggtagcaccgctattttgcctgactattctaaccccgaaagtgtttcaagatctcattaaaatggaaggaatctgatcagactaattcgcagtaagatataaatgatcgatgacccaaaaccccacctaagggtatttgattttaaattttttttctaaccttaaaaaaagaataatttcacacttatggaaaagttacaaaagagattttctagatactctgttttaaaacatatcagtgttattctgtctcttcacacatacacactcatatgtatacacgcatatttatttttcggaaccactcagaactaagttgcaagcatatccccaaatacttctgtgtgcatctctgctatggtttgaatgtgcctcccgccccccaattcatgtgttgaaatttagttgtcattgtgatggtattaagaggttaggaaatccaattaaaattcctatgttgattggacgtggagtctaggtaattaggattagataaagtcatcagggcagggcccccgtgatgggactggtagctttataaagagaggaagacacacttgtgctgacacttgcatgcacttgcctccatgccatgtgatgccctgcacacttccggactctgcagacagtcaccaccagcaagaaggccctcaccacatgtggcccctacaccttggaattcccaacctccaggactatgagaaatacatttcttttctttgtgaattacccagtctctggcattcagtgatagcaactgaaaatggactgagacaagctactaagaacaagagcactctcttgcatagcctcaatacgcttggccaaaatcagtaccttaatgtttacacaacacacttctctaatctacagcctccactcaacttttgctgattatcccaatattttttatagaaatacaacaacaagaagactgggctcggtggttcacacctgtaatcccagcactttgggaggccgaggcaggtggatcacctgaggtcaggagtttgagaccagcctagccaacatggtaaaacccctgtctctactagaaatacaaaaattagccgggcgtggtggtgcatgcctgtagtcccagctacttgggaagctgaggcaggagaatcacttgaacctgggaggtggaggtggcagtgagccaagttcgcaccactgcactccagcctgggtgacagagcaagactccgtctctctcaaaagaaaataaagaaagaaagaaataacaacaacaatgccatctttcctttaccccctttcctttctggtttgggatgcaatacacaaccacacactgcattcatttgttacgtctcctgtcttggtcctgagactgggcacttcacatgtgtttggcaggaatgccacggaagcagtgccgtgtcctcggtccatcctatcaggtggcacacagtgcccacttgacccaagcagtgctgttagcttctgttaccaggtgaagatggtttctgccaggtttctcataaagttagtaagaattttgtcagtaattattaagaattgtataaggatacactgtgaggccatataaatattctgaccctcattaaactttcactcatttgttccagcatccattgatgatttttagctgaatccatgattactacaatggtggccaaatggtgattttctaactttatcattttcttctacacctattagatggatttctactataaaagagagctttcccttctcctcagttttacttatttatatgaacatagactcatgacttgctattctattcaatagggtgcaataaattggtagcattatttattttgatgcccaaattgatgcaggtttgaccaaaaacaatcccttcaagctggctcagaattttgactttgaaaagaggccaattttttattcaaatgtgtctccacatagtaggagtaaggtcttgggagtaaacagagtggaaattttcggcagcacgcctggtgatgatgagcaaagtggcctttaccgtgtcagcgctccctcaactgttccagcctctcgaagcttcttcctccttccctgtcctaaaatggaattaagtgctggatcttggaggcaccttagagatgatcaggtccctggttcccagacactgattggcaagggctgtgtgactgcaacccctggagaggtagtttctcagaataggtgcccccaccgtcacgccaaacatttcgggttcaaaagcccgacctggtgggatgagccctttatctgtgtatgaagccacccagatgactcctgtgcttagccaaaacccaccctactcccataaatacacgcaccccgctttcttttgcaggtgagaaaccagtgactcagagaggggaatccgcatgctctaggtcatgctgtgaatgtcagaactgggaagtttcttgctccgttaacactggctttttgcctgcattgtgctatctcattacagttctttgaaagctctgaagtttttggctcctaacaattgttctcacagcagtaagaatgaggaatttacctgtaggatggacgatgcttaagtcaggtgtttgtaaaccaggggctgtctctgctcatttacttgatacttacatgcagtatgttggtttactttacgctgatccccagagtttcatcatttaaactgaaaagaataataatacttatttatatggccgctatgagcattaattttagagatactgtaagcctggcactttcgctaactaaatatgcatttaccactcccccaccccaaagacacacacacacacacacacacacacacacacacacatacacactcccctaatttcacttaaggaagcactttctgttaccatttctctctctcttacctactgacccctcactgacaataacagcagtatgcccttttgccattgagaaagacagctgtaagataaacagatgccattgcattatacatacatgtccccctgagaccattctgcactgtagccaccacctcgtcccctgggctatagaaatctgactattaaacaaaactaacctttaaacatgtaaactgtatccacccgataacaattcagccatacttccttacaaatctagaccggacccaatatgttaaaggctttctggcactacagtgaaggaagggaacatctttcaaacatgtttataaatactaataacagtacagggtgctcaagatctcaagcaatccactgctgactttttcattaggtggtcatttgttgaacttcagctcccttccaataccttccattcattctcttcatcaaggacatctgcagtgcacggcagcatcagggggcaggcctcctgagcccccagcaggattccatttctccaccttccactgccatccgacttgctgatgcccaggcccccagaggaggaagggctatcctgttgttatgagaacaaatgaagctaagaagtggtttgaggtgggaacagccaggccctacagacagagagagtggttaataaatctgtattgtactgaattaaatagagcatcttaagctacctactggggatggaacaatgcagagactcctgtgttttttagtagcattagcaaaagagcttagcatcgctgctaattaaaatcacatccacgtttggcttcggaatgcataaggcatcacaataactcagcactgaaggggcttatagtggttttaaaataaatccacacattctttgcagtgtgctcccttcaatgcagcctcattcctctcctcttgaatgtaggctattctgagtgactcacttatcaatagaatgtagtgaaaacggtggaatatgactttcaaagatatgctgttgaagacactgcgcttctgtcttgctctctctttcggatcacgtgctcttcagggagccagctgccatgtcatgcagacactcaagcagccctatggagaagccacatggagaggggctgaggcctgtttcccacagccatgtgagtgggccattccggaagcagatcatccagccctcgccaagctgacagacgactgcatccccagccaacatctagactggagcctcacgagagaccaacccggagaccccacccagctaagccactccagaatccctgaccccaaacattgtgacatgataaaaatgtgttgtttaagcttttaagttgtgtggtattctgttatgtagcaatagatagttaataccgggctcttaatcttttccatagcaaccgtgacaaaaggtagtgcaggctcagcttgcacctcccattgacagagagcttgcttcttcacagggcagccccttctgttgcttggccagtctgttaccagtcctgctcacaccgagctggttttggcctctctgtaatttccatccctggttcaagatgtgccttgtgaagcaaaggtgaagcttctcctcttttatgtgactgcccttcagacagctgcaattcgtgattatgccggcctcctgtgtgctcttgtgctggctaaagagagaagaaggggaggcagcaccttttgaggggcccgggagaagagacatagtctgtctataggaaaacaaaacaaaacaaaacaaaacaacaaaacaaaaaactgctttatgctctcttttgtactctcacaacatttttggtcaccaaaatgtgtggggttttcccccacatcaagcaattctctaattctctgtagatttaattgtaattgaattacaatttaattcaattctgacagtagctagagttagtgcagaccccacaggttaagatcccagtcccacaagaccaattctcacttcagacatcaatcgcgagtagtaggtccccaggttacccgcaacttctctctgacctggctacacggaaggttctcgcagctgcctcattgggtttaatcgtttgctagaatggctcacagaactcagggaaacactctacttacatgtttggaagatgttcttgcctgtttcactgtagtgccacaaagcctttacaattttggatggattctagatgtgtgaagcagtgtggctgaattgttgttgggtggaaatcccacttattacaaagtatacaactcgggaacagccaaatggaagagatgcaaagagcaaggtatggggaaggggtcagcttccatgccttctctgggtgtggaccctcccagaacctccacgtgctcaacaacctggaagctctcagaaaccagtccagtccttttggggttttatggaggcttattgtttacatctttagctattagttattaactcaaacttctgccccctttcccctccctggaggttggttgctgaggcggtgggcgggggagggtgtagtgggactgaaagttccaactctctaaccacatggtgagttcccctggtaaccagtcctcaccccaaggctgtccaggagcctccagcccttggtcatctcactcgcatgcagaatgacacttatcacttgtcacaaggggtttatgagctatgtgccagaaaacggggaggggtgggaagaggaaaaatatattttttttattaaatcccaatgtcatagcctggaattaggccacagtcctgcatgcaccaatccaagaggggctggattctgggagattttgagaaatggatggcaccagtcctgagccactagataacaatcgtagcagtaacagtaataattagtgctgacatagcacttaaacaggctgccagatcctcttccatgtgttttgtatgtgctaagtcatttaatccccacaaaagctcagaattattgcccctattcacagaggaggaaactatagtgcaaataggttataacttgcccaaggaaacatagccagtaagcagcagagcaggatttaaagggaggcagcccagcttcagaatactcctcactgcaactcagtagtgccttcccttctggatctagctcatcttagagctgcattgaaagctgttatagaaacaaaaactgctaccatttactgagcatctgctatgtctcagtccctgggctgagtgctttgtacacactagaaaaattaaggctcacggtcaatggaaccaatcatttaacatttatttatcaagcacagacactgtgctgatcccagtggggacacagtggtgactcaggcttgggtcctgaccttaaaaatttttcagtcctgaagcgataaattaggtacaaaaatagctaagtttgaggcatagagcaagagttgcccttttgtagaggaatagagagcaatgttatggtctaaatgatcatgttctctcaaaattcatgttaaaatcctagctcccaaggtgatgggattaggaggttagatcttttggggaggtaattaggtcatgagactggagagctcctgaatgggattagtgcccttagaaagaggcccaagggagcccatttgcccagttcaccatgtgagaatgcagcaaaaaaaggtgccatctatgaacgagaaagtgggtctcaccagactctaaatttgctggtgccttgatctttgatgttccagcctccagaactgtgaaaaataaatgtgaaactgtgaaaaatctatggtatttcatgatagtggcctaaaaagacaaagacaagcatgacacacggagagagctggggctataggggtgttacctgagtaggctttatctgaaccggttcttgaaggaggttatggttggggaaggtagaggtgggagaagggcactctaggaaaggaaacaggacaggagttaagatgagaaaaatgaggcttcactctaaccaaagacagaatgatgagctagaaagatggaaacaccatactggggtggtttttgtttaatcctgtgtattacatgtgattttataggaacccatggtcttgagactgctgtgggtttgtgatttcagcaaatctatcccaggctggaaaagcagaggccctgtgaggacttcatctggagcaaatgaaaactgtcagaccctcagagcccccaggacactcatttatcatggtgagaaatattgatattaataagcccttctgcttgatacaatttcttgtcatcaccctcttctctcacccccggctgccaccaccaccagtttccatttggagaatcaaactggcagcagagagtcacacttcttgcagatctgttggacacacacacataaatacggcaatcattttatgtctaatgaatgggaagtgaggggtagaggtcctgactgtacagtgggagatttgcaagctgttttgctgggatttcctctcacctgtgggaaagagggaaagacatgaccctaccagcttcctgcatgtgatgtgcctgcatgcactggaggcacagtcatgactctgatccccaggtcgggggaagccctttccaaagggtggggcatgcttttgggaacttgtgctttctgagatctcaaggaagaggcaaattctgatttcatgagggctgaaagttgtacaatttggggacctttttaaagaaaaagaatatcaaattatgaatacaaagtgaggcttacaaaattttttttacagtggaggtctcgctctgtcacccagagtggactgcaatggtatgatcatagcttactgcaaccttgagttcctggacccaagcaatcctcccgcctcagcctcccaagtagctgggactaacaggtgcacgtcaccacacctagctcaaagtgagatttgaaagtcaccatttatttagaatgattaaagaaatcacaacaaattttaaatcttaaaaatgctgataagtaccatgaatatcacaaaattcagaaaaatgttttattaactgcctgacatatgactaaaatatatttttctgcttttctgggtcacacactctctagatcacttcttcaaatggcaacagttttgtaatagttctgcagagagaagacaattcagtctgacgtctagcatgtttggttcaaattattaatattttctcattgattttttcaaaagtttcttttagcttcacaactcattattaaacatgccatttaaatgtttaggattgttgtaaatttggggaaaacttaacagaatatctttcctgtatgactgcaagccttctgcagctatctccttaaacactctttgacttgagaatgactcattgattcattgaccagttagtcatccccgttctcattgtggagatacatgaggagttgtgtgttatcctcagaagagccagtttcatattgagacagtaggaaatgtaaatctttctccagtgtgttcatatgattcacttctcttcattaactggactattaaatgatctgggagtctattcactattattctattggaaagttatctcttccttttactgaattactgcttttgatgcgattaaacagtattttattgtaattctatccttgatgtctgaataatttctatgtatctcatttcttttcttttttgctccattaactttttctctgaaatttctctgagtttctgaataaatacacttaaagatgacaaaagattatacccatcgtaaatgccaaaattgggagtctgtactcttatttcttttcttgaaatgttccaaaaatgtcattccaaattgaattcaaatggcttgttgagctttataaacttgtaagtaaacaccttgctacttatttgtctttgaatttctcttctgaatcttcaaaaatacatttttaaaatttatttttattttattttattttttattttttgagatggagtctcgctctgccacccaggctggagtgcagtggtgtggcttcagctcactccaacctctgcctcctgggttcaagtgattctcctgcttcagcctttcgagtagctgggactacaggtacgtgccaccacacctggctaatcacaccggctaatttttgtatttttagtacagacggggtttcactatgttggccaggctggtcttgaactcctgacctcatgatcgacccaccttggcctcccaaagtgctgggattacaggcgtgagccaccgcgcccggcctacgttttctcaaagattgttgtatctatgtgtcagggcttgaacagatttataatggtagaccaaatgttacctgcaaatattacctgggtgccataagacacattcatgttaaaatgaaatttgggtcctacacgttttgaacagaagtattcctggaagccattcctataccagacagccagcggagcacgttggctcacacctataatcccagcactttgggaggccaaagtgggcagatcacctgagttcaggagttcgagatcagcctggccaacatagtaaaaccccatctctactaaaaatacaaaacttagctgggcgcagtggcttacgcctgtaatcccagctagtagggaggctgagacaggagaatcacttcaacccaggagtcagaggttgcagtgagctgagattgtgccactgcactccagcctgggcaagagaatgagactccatctcagaataacaataacaacaacaacaaaccaaaacctataccagacagccaataacaattcctttatacgtgaaagtgacagtgatttccaaacacataattatatcccaatggatgtaaattaatatgtgccaattcaacctccccttaaccaatatacccaaaatgtccatggacactacaacactacctggcatcagcaagactatgatggagaagttgcaatggaaagaaacagtggtcttaaccaattgcaataagtggtgtttacttttagagaagtgctcaaaaaatgatgggagcaccatgaaaaagctcccagtggccaaatctgggatcgtttgagcaatgatggtaatgaattgtattcattcacttctgtttagtgatataaataaaataattgattaaataaagaaatgggggagaaggaacagttcttccttatagaagatttcaattaatacacatggaaaggtggaaatggaaaaatcatcatctggcaaataccatggtagtaatttttattggcaacaatcaccaatgaatacgaaaatcagtgggtaaagtaggatgataaagggcatatttgtaccagtatcaatgcacctcttcatctgatacttattaattactgggggaaacctcaaacttcacagaagagaaacctgaagatactgtctctaccaagtggtcagagttaacatctctagtaatgacacatgtcaacatcatgtgccacctgatgtaatgcctgaaaaagatgtatcacagtcatataagtaaaatatttagggatccagaggttttggacatgcagcaacatcccccagagataaacgacaagttactgcatctcacctcttaccattaagaaagaagccccatgcctgggaggcctcttcaagttctagaggcagtacttagtgatattgctctgaccaatttaccaggtaacatggaaggctgtcagctctgagtcacagcaggtgtaagatgaaatgccatactgcttgggccaaatgattgaggagaccctattgatattagttatctgtggtggaagaattcaccacgtggagcttatggcaagctccaacaagagaatcataatgtagaccccagagtcccggagcaaggccatgccatctgcagaggagaccttaacactgtttgaaaagagctcctggcacgccacttccctaatagagacagagcatctgacaagtgacatgtggccaaagctacccagcacgagctaagtagcatctaacctaccaagccataaagttggcaagctgggaacagtacatctgggattaggtgtgagcagggccagagggtgaatgtaagctatgctaatagatggcccagaccccagggcatccatcactgttgtaccaatgtctctcccttagacaaaacttgtggccatgtggagtatgccttacagccaagctgatggagggggaaaaaaaaggactgagaccggttcaaggaagtataagcttggtttgggggtgctagccaaaaatgaactgctagacaccattcctctagtctatcttgtaagtggtgaagaaaccaaccagaattccagaagagctgttcccaggtggattggacttatacaaagccagtagatttgatcagtgcaagatatggactgtagaggatgtgctggtgtattactgtagtcccattcagggtggtcccaaaaaacaatggtaaagaggaatcctctcattagactgagcacaaggtcattcactttctgtgggaagagaagtggcctgaagtaggaatatataactcagggctatgaaaaatgactaggctggttggccaggggcctgaaaagggaaagaatgtaagactggggactggggacaaagcatgtagatggacctatgggagcgggcatagggagtcaagacctttgcaatgcatgttagtgcccactagggagcacctaccatggaagaagcacttcactctgtgaagatagggtcccttcctttaggatgtggttaacaccctaaatcacagacttttatctgagttggtgtccccagtaggtagaatacatgggcccaggaaccaaggagtaagattgggaaaggtcctgcataccagcattcctagtgtcacacttggcaattaatgcttgtcattgctgcaacatcaggctctgtgggtccagaggtcctggttcccagagggaaacgcttgcaccaggggccatggtaagtgtcccattagaatttaagtcttggctgctgcctaggcactttgggctcctcgtgccaaaagatgagaaggcaaggcccccatgctagctggggtgattgaccctgactgtcaggggagtagggctgctgttccacagtgaaggcagggtggaataaggctgacactctggtgatctgttaggggcttttcttggtgctctcctgcctacttttggtggtaaattggtgagtgtagctgccatggcttgagaacagcaaaatgaccagaaacttggggatgatggtttgggtcatcctaccaggttaggcaccttgactagcaaaggcaacagtaagaagagtataaaatgagtgaccttgaggccaactgcagtcactcagggaatatatcatctctctagtctttttctcgtaagtggtgaagaaaccaaccagaattccagaagagctgttcccaggtggattggacttatacaaagccagtagatttgatcagtgcaagatacagactgtagaggatgtgctggtgtatcacccagatctctccttttagggccaaagcccccgtttccttggctgccatgaatgttggctgctgactgttcacatctgagccttctaggaactacccctcactgaagggagcttctggcccaaaaggctgaggacccttgcctcaatttgggacaattcagaaggcccatctcagctccagagcaccctggtagaattggctgaggcctctgttgcttctgcattgcagctcaactcttctctctgctcattccggctccctcactcccttacaggtgttgttcccaagagcaggcaaacaaatttcccacacacaaacacctgtcgcagaatctgtttcatggggagcttgaccccaggagtccagaattttcttcatgctcttgacatgagttaggagtgtttgcctctacatgcaatggttcaactactgtagacaagggaggatgatataaagcagagctcctactaaccctgcatgagcatataggggagcaagacatcaaccttagcggtttaagtcacctgagatctgatggttgtttgttaccacagtacagtctaactctcctgactgatacagaatcaacacaatgattctgcctttaaaaatatatagattctggtctccattcagaagtggccaatcttaatgcataaagcaaatgtaggtctgcacttatggctgacaaactagagtcaagctagaaagagtcaaatagagtcaaagaggctaagtgtcatcattggggcctttttaaaaaatttaattttaattttattttgagacagtctcgctgtgttgcccaggctggagtgcagtggcatgatctcggctcactgcagccttcgcttcctgggttcaagcgattcaactgcctcagcctcccgagtagctgggattacagtcatgtgtcaccatgcccagataaaattggggcttttcttgagcctgactgagagttgcaggatggaactcaaagttgcttgggtgcttgttggacaagtctagaacatggggatgaattgccagacagcaggtcctggttagaattggttgggtaatttacatatgttttcaggtcactgccgagacctttttgcaggcaatccagatgggtctggactcaagtgagaagtgagtcatcaatgcctgtatcaatgagaaaaataaagattagtaattcagtgttgggttccatgtgtttttttagtgggaggcatgaatccaagacaaagtccttggcaccacacagtacattctttgacaacagctattgttaaggacctttccgaggagttttaagcagtgattgttgctgatgaaagttgaccaggcagggagccttacattatggtcctatctgtgcgggtgggtggatgaaatgtcttgagcctgtgaatgatttctgacacccttgttagtgtcctgcaatataacacaatgttatctggcttaggaatgtgctactggccttagctgctgaggaagaaaccagagtctcatctgctaatatttcataagagttaagttttgggaatttgtttgttgtctaatcagagccatgggcagtacatctgtcctcttcaatccattttctgcacaaaccttggccagcttattatttttaatcccattttgatattttattacctctgttgactgcagacaatgtgggcattgacaacactaaatattctgtaggctttacaactttaagaaccaatctagcaaatacatgttcaaatacatgtccctgtgattgtagagtattttaaacctagtaatgagattttctggaggtcttttgctggtcacccttgtgtcagccttggaacatagatatgtttctacccattttgaagagacatataaattactaaaacgtgtccataccaatagcattttctttaactgtatagatttagcttgaatattaattttaagtagcccccaagg

SEQ ID NO: 387 - DNA, 127512 bp, Homo sapiens
gctataataaaaatgcctctctgagaagcttttatgcctaggataaccttgagctttttgtgttttgttttagcccagaggagaaagtctaataatacctctctccacaaaacaaaatattcaccagttctattcttgtttaaggctgttatcatctcaaataagtatttccataggaaaaataaaaagtcatggcaaagttacatgaattttggagcacaaatataatgcagaatcaaaagaaaacaggtaagactgtttccattcaattgtactgcctttggggtaaagattttatctaagtcagatataagggataagtgttatgcaacagagagccaggagtggaacccccaaataatgccatttagcatcattagaataggatcaggatctttttttctcccaggaagttaaaggtatttctgctgcataatcatgttagcctgaagactgctttatatctacatagggtgatcatccaagaacatgagtttgaaatcagaagctgtgatgtactttttactgaaaaaggtaccacccattcatctaactaatggcgaggtttcagagaaagcactataatggacagaaaactgattccacatgaagtgtatattataacagcacaaatgttaggacagttatctgataggatctgggagtgaaacagcaggactgcaaaggtgctggggaggaaaggaaataaacatctgtagggagaaatatttcaatctgtatttaaaagatattggctgggcgtggtggctcatgcctgtaatcccagcactttgggaggccgagttgggcacatcgctagagcccaggggttcaaaaccaccctgggcaatatggtgaaaccctgtctctacaaaaactacaaaaaaaccggctgggcatggtggagctcacctgtagtcccagctactcaggatggggaggattgctttagtccaggaggtcaaatctgcagtgagctaagatcacactactgtactccagcctgggcaacagaacaagaccctgtctcaaaaaaaaaaaaaaaaaaaaaaaagaaaaagaaaaagaaaaaaagtagtgctgctgattagggaatctagtttctgatgtaacttatgtagatcagagatctcttgagaatttgtgtagcttttgttttcaacgcccatcatccttaaggaagatcatttactgaaattccagacctttatagttgagaagaaaagctgagactcaaaaggaaatttaccatctactatctcactgctttaactttctttctaaacgatagaactcaataaatgtcagctgtttttacttgtcaggtttatgtggtaagcactttacattttggatgacattttatctttacagtcttacaatgcaggtagtgatatttgttttacacatggtaacagcggttcaaaaagctgaagtaggccaggtgaggtagctcatgcctgtaatctcaacactttgggagacttaggcaggcggatcacttgaggccaggagttggagaccagcctggccaacatggtgaaatcctatctctattataaatacaaaaacaggccgggagcggtggctcacgcctgtaatcccagcacttcgggaggccaagacgggcggatcacgaggtcaggagatggagaccatcctggctaacacggtgaaatcccgtctctactaaaaatacaaaacattagccgggtgtggtgccgggcgcctgtagtcccagctagttgggaggctgaggcaggagaatggcgtgaacccgggaggcggagcttgcagtgagccgagatcgcgccactgcactccagcctgggcgacagagcgagactccgtccctcctccccaaaaaaacaaaaaaactaaaacaaaacaaaaaaaatacaaaaaaaaaaaaaaaatcgctgggtgtggtggcacatgcctttcatctcagctgcttgggaggctgaggcatgaatgagaatcgcttgaacccgggaggtggaggttgcagtgagccgagatcgcaccactgcactccagcctgggcgacagagcaagactttgtctcaaaaaaggaaaaaaaaaaaaagtgaagtaatctgatcatggccacaaagcaagccaggttgtgcacaccaagcaggtgattgaaaaattcattcttaataaaaaattctgtctcctgagaggatagagatctgcaatgtgaccactgaggagggacacttagtctaacctggggggttctagaagggcttcccttaggagatgagggcttaaaaggatctgaaaggtgaataagaattagaaataggagaaaggtaggataaatgtcatcagagagaataatatgagtaaaagcacgtaggcctgccacagcgttgctacaagcagtttagcattatcagagtgtagcgtgagtcagagattgatggaaattaaagattgagggaggggtaaagagagagccatagcaggagggcctcggtatgctatgaagcttagattttaccctaagaaatgaaagtaattagaataatatagtaaaaacaacaagtgtacaaggaaaaaccaacaatctgtagggcttagaaaaaaaaacaggattttagtcttctagataccttttgggaaaggaaaaagatggactgttcattaatcttttttttttaatttttttttttttgagacggagtctcgctctgtcgcccaggctagagtgccgtggcgcgatcttggctcactgcaaactccgcctcccgggttcacaccattctcctgcctcagcctcccgagtagctgggactacaggtgcccgccaccacgcccggctaattttgtgtatttttagtggagacggggtttcaccatgttagccaggatggtcttgatctcctgacctcgtgatccgcccacgtcggcctcccaaagtgctgggattacaggtgttgagccaccgcgcccggcccctcatttttcttaaaaatatttttgcaataaaatgatcattgcctggaaccaagaaaatgaaaaacattttagaacaggcagctgtcctcagtaatgtttctgactgcaggaaaattgttaggcaagccatggagtatttgaaactgaatggtagctgttattatatgtagctcctagattaagcactttagttaagtatctcatttaatcgtcataacaaccctatgcagtaggtaattacttctcagtttcagtaggtaaataaaaccaatgacttgtctaaagaaatatagtttaaaacaaagtaggataaagaattgctgagttcccagtgttagtaaaataagtcctgaaaactggtaagccaaccataaagattgaggagagttgattatctctgtggacagatacaaaaacgaaatataccaaagtctgaaaaatcctacctttctttctttcttttaaattttttttttttttttgagatggagtctcactcttgtcacccaggctggagtgcactggcgtggtctcggctcactgcaacctccgcctcctgggttcaagcgattctcctgcctcagcctcctgaatagctgggactacaggtgcatgccaccacacccggctaattttggtgtttttagtagagacagggcttcactatgttggccaggctcgtctcaaactcctgacctcatgatccgcctgcctcggtctcccaaagtgctgggattacaggcatgagcaaccgtgcccggcctttttctttttcttccttccttccttttttttttttttttttttttttgagacacagtttccttctgttctccaggctgtagttagtgcagtggtgtgatcttggctcactgcaagctccacctcctgggttcaagcaattctcatgcctcagcctccttagtagctgggattacaggtgcgtgccaccacacccggataatttttgtttgtttgtttgtttatttattatttattttgagacagagtcttgctctgttgcccaggcgggagtgcaatggcgcaatctccgcttactgcaacctccgcctcccaggttcaagctattctcctgcctcagcctcctgagtagctgggattacaggcacacgatacgacgcctggctaatttgtttgtttgtttgtttgtttattttcttttgagacggagtctcgctctgtcgcccaggctgcagtgcagtggcgtgatctcggctcactgcaagctccacctcctgggttcaccccattctcctacctcagcctctcgagtagctgggactacgggcacctgccaccgcctggctaattttttgtatttttagcagagacggggtttcaccgtgttagccagggtggtctccatctcctgacctcgtgatccgcctgtctcagcctcccaaagtgctgggattacaggcgtgagccaccgcgcccggccgacgcctggctaatttttatatttttagtagagatggggtttcaccatgttggccaggctgttttcaaacgcccgcctcagcctcccaaagtgctgggattacaggcgtaagccactgcgccaggccaacttttgtatttttaatagaggtgggttttgtcatgttggccaggatggtcttcaacactttagctcaagtgatccgcctcctcagcctcccaaaatgctgggattacatgcatgagccaccacgcccgacctcactcctttcttattaattggttggtggtcttttttaaaaagataaactaatatttcataaagaaaacaatttaccctgcacattaccattaaacttgaaatcctcctagacaatactgtgggaagttcatgtgggcttctgagtaaactttccaagatctaaaacccgtaaggaaaccatacgtgtaacttagcaaagataaaagactgacagtgtccaaacaagtaagaatcaaccaggttagactatgattacaaacaaccctaaaatttcagtggtttgttataagaaaatttctgttcacactaaatgaccactgagggttgcctggtgggtactcagtttggtatccagggtaaatcagcatccctatccagcacggtagcagatggaaaaggggcatgtcaaaatcatacaccaaaatcttaaagcttccacctggaagagacaaacatagtttatgctcgcatttcattggccagaacaaatcatgtggccacatctgacccagggtaggcagggaattgcattctaccatgtagccagagagtaagaaaaatttgctgaatagtactaatgactactacggtgataacttcagaaaagcagaggtgaaaggaacctaagaaagaaaattctggagctaggaacagcattaggcgcctataattatgtgaacagttgatgacctattcataatggtggctaagaggatatttaatatatcatttcacacatatgaaaaaatgttgtggctgggtgtggtggctcacgcctgtaatcacaccgctttgggaggccgaggcgggtggatcacctgaggtcaggagtttgagaccagcctgaccaacatggtgaaaccgcatctctaataaaaatacaaaaattagctgggtgtggtggtgcacacctgtaatcccagctactcaggaggctgaggcaggagaatcacttgaacccaggaggcggaggttgcagtgagccgagatggcaccactgcactccagcctgggcgacagagcaagactccgtctcaaaaaaaaaaaaaaaggaaagaaagaaagaaagaaaaatgttgcattaagtagttggccaatcaatgctataagaagtttgcagaaagacactgtgggatctctcactggtcatatagtatgggaaatgtttattatactccttcactctcactggggattcaatcaaaagctatgttacttctaactaatttttcaaaagtgtgattctaacagtatttcctgttgcattgctgattgctagcattagacttacggagcttctttctgtttaatgactctctgtgcaaaactttcacgtatgacatatgatcctacttattgctacttaacgtttccttcagtaagctatctaattttaaactattacatagaaaatgaactagataactcaagacatttctcattaattaaataacttcttttttagagaaaatcggatcttgtaacttcattctccaaatagaacagagtcctccctttagaaagaacatatataagaggtttcttagttgtgtttccccagaaactgacccaaagggtaggatttgagggcaagtattgtaatctatttgggatgagatcctagaaagcattggcagggaagagagtgaaggaaataagtagagaaaccaggagggaaggaagaaaggaaggaaggatggcaggcaggtaacactgttccctaaaggggaggttactgctgtgtgtatctgaaactcaaagttgggcacctttgggagactagagtacaatttaccgtagtcctaagctcagtggggaagctggagtatttttatatcaacacctttttttttttttttttgagatggagtgtcactccgttgcccagtctggagtgcactggcactatttaggctcactgcaacctccgcctcatgggttcaagcaattctcctgtctcagcctctcgagtagctgggtttacaggcacatactaccacgccccactaatttttgtattttctagtagagacaaggtttcaccatgttggccaggctggtctcgaactcctgccctcaaatgatccacccacctcagcctcccaaagtgttgggattacaggtgtgagccaccatgcctggcctcaacacctatctttgattggttgagggctgctctgagaggaattaactgcctggctcctctgccctgcccctctgcactggcaaagtggggtctggcagccacaggaagcccttgaatggggaagcagagagggaagagtaagatgccattggcctgccagtaggaagcccatgacatactggtggagccccagccctgttagtacagaaaagatacctggctgatatgctctgctatatccatctttgagcctagatgatgttaattaactctttaaaaatatattaaagctgtggtggcatctgagaaaagatggtatgcttttaaaaggtaggagtgaacagctcatacattgtcccaggagtgggctttattacagagatgggggagctctgacctgttgaagaccaagattccaggaagaaatgtttgttcacaagcaggttgggaaagggagatacttcaaacagctctgagagcaatatttcataaagacaggcagcaggaagaaagccttcttaaggccatattgacttttgcacctagcaaatgacccttactcttcattcccataaaaaagagagaaacaaacagtaaacattttcaaaggatcggtaatgttttaatagctctgattagtaagcggagtattgggtgttatttcgaagtcaaaaattctatcttggttgatttaccctataacctggagcattttcgagaggcaacagaatggaattgtctcaaagtactgacttttcattattttccacgcagatccctgaggataacagaaggaaaggttttgtctgggggagggtaggcttctcccaaaaagagaattctggaagtcaacataattaaacaaagaggaaaatgtgccagacaggagtgggtgggggctgttttctctttgtggttggttgtggtgcgttcaagattcctcgcctaagatgaggttcctgagcttccagtaggcgactgactgcccaagagacccagggctccgcaaggagacggcgcaggtgtcggggctccccgcaggtgaggaggccgacgttccaggaggtccgcccgggcggtccctgagtcctgcctcgcggctgctcgctgggatccgagggcggaacgggacgcgcaggaacccggcccgacgggcgcggctcacacccgtgctcttcctgcgctctcggcctcactttgcggccagagccgcggccctgcgcgtggccggcggccgcttctttatctccgaccccactgcccagtactgtacgcgtccagactaaagaaacatcattcgcttaaggggctgggaaaagcgcgtgctccgctcgccctggcaccgcgggtcgcccagctcgcagactgggacgggcggtgcaagaggtggtgctccctgtccaggaggggacgcggaagagggcatctctggtcccgggatgcgattgtcccggtttctccttctggcccactcgccgcgcgcacgaactctaggggaagttggttgtaaagtttccgagagcggcgtgggctggtgcgagtgaagcgcggggcgggggaggcgaggacagaagctctcctcgcggcgtctttgttctgctctggaggagagaccttggcaaggagtcgccgggcgggtgcagggacctaccgccaccacattccggacccagcgggagccctcctcttaatgcccctccccccgcaagccaacccaggacatagcccccaggtccccaaggttccgtctacctcatccttctacccccaaacttcaccaacccgaaaggattccaagtctgggatggggagaaaggaaagagggtggaggcaaaggtgcgcgacgggctggataccaactggagggtgggtgttcgcattgaaatgtttttttcttttgccctagaaattgcttccccatgcgggcccctactctctcccatttcccccacctccctgctttctttttcttcaattctagtggatctagaaggaaaacgagtgctgctctgagtcactcagcgagctaatgctatggcccgaagttgggatcagggtcgaggggtgggggaccatgtggatggggtcccaattctggaggttgagaatgactggaagggacctggggaagggtcgggagctgttcctggtccgagacacctgatttgtcccggacaaggcagtgggggaggggaaggaaagaggggatgctcggctgggacgtgtcgcggcagggggtggaggatgaggaggcggcctgggaccccgagtcagatctttggggtgagcacgaggacgtggtgtagggaagaggacgagtgagcagcgcctggctgtagggtcagagggcgcctggtcatcctgagagccttgccttcgcagtttgagattaggggaagttcggggcctgagaaggtgggcgcgatgctggagctgggaattcttcctcggagcccctggaccgagttgcgctgcgcctgcagcaacaggtagccccgagggatgggcggaggccccggccgaacccggagctggcctttgtcctgccaattagagggctctccagagggacagcgtgggtgggggtaggtggggaagggcgggagaggagtttcctaacacttggagcccctttgagttgttctgtgtattgggtggaggagggtgaatccgagaggagggaggagggtgaatccgagaggaggaaggaggatgaagagcctagcctgcgccccacctctgattgtgtaagcgcctttatctagggttgaccccctaccctttgcattttgtctcttgggatgacgaaaaatggacagaaactcgacgcccaagtgaatgtttcacattgattggcagggaaagtgcaaacaaagaggtgcatctccgggaaacaatgattttggagatcccctgcccaccaccccagacttgtgcgcggtgcggagggggccagggctggcatctcccggggaaagtttcgagcctggcagtgggaggagaccgtctgggcagagttgtgatgaactggggaccgagcagccccagctcgcctcggaggttcccgagccgggcgggagatgcggggagagggagggggcggggagggaggggagggagagaggaagaaggggtgagagggagaaacctgccgccgctcgccgcctctttgtctgctccgggacttggaacaaaagggggaactctgatgaactctctttcctcccctctcccccggacgccggggtatctccctctcgcaactttgccgccccgactttctctgctgtcaggccgggaaaaagtgtccgaacgcctcgtggactgcagcgggggaaatgtcccttaaaagtgcgacgaagtggggaagaaggtgagtggggactgttgtcttgtttacctctctcccctcaactcgccccgctccccgcccttcggagggcagaggagtagcccagtggcaaagtttggctggtaaattgtacctcctttccccgttcccttctcttttgttctttaaagaactcgcgcaattgtttcatttgtttatttttaataggcaaaagccaagtaggcatttatcttatgtgcttctttatatgaggggctggggggatggggaggagggtttcaaaagggtggggtgagggggtattgcttcgcgttcttccagctgcactcatgtagggatgaatatgcagaaattgagagggtcaagtccagcctcgcccccaccctagccctgaccctggtcatgcaaaagaaagcgatatggatatgggggtcgtttgtataacttagctgtctgcagagcgctctgtagataccacgcacaatataaaaacgctgcaacaatggaaggaagaaaggtttgggttggaggggattggtcccttgtgttagcggtcaaggagaggtttacaacaaacagctaagagttcagaaagttttcttcggggctgagatggggtggaggaagccacaggttacagactgtcagagatgcagggatggaggggatggggcctggaccactagttagagccatcccgtccgcccctttcagtttcacgatccacccggaataacccaggcaatccttggtatccgtcctcacctctctcactttccatcaccccccgcccccaaccccacttcagtgtgtttgaatagaaagcagaacgtgagccccagaagctcctctgacccagccttccgccccgccttttgtgttttaaccttttgtttctatctgccacgcccgtccaaaagagggatggctgtttctgctgctgcggggtgaagaggcagcgcagtccactccgtttttataggctaaggaagacgccctaactttgtttcctaagtagcttaacttaggaatgtttctaggttgggtcatgcgcgaatgaggggaacactcaacacccagtaaacgttgccactttaggtacaatttctcccagcgcttttccactttatacaggagttgtttatcccatactgtcatttggtttgtagaaaaagcattttgggggccgggcgcggtggctcactgtaatcccagcactttgggaggccgagacatgtggatcgcttgaggtcaggagttcgagaccagcctggccaacatggcgaaaccccgtctctactaacaatacaaaaattagctgggcgtagcggtgcgtgcctgtagtcccagctacttgggaggctgaggcaggagaatcgcttgaacacaggaggctgaggttgcagtgagctgagatcgtgccattacactacagcctgggtgacagagccagactttgtctcaaaaaaaaaaaaaaaaaaaggaaaagcattttggagactgaagttgggggtttattgaaagtgggcaaatgtatgccttatctgaggtgatatctaaatattaggaatatgcagaataggctttttgaattctacatgcagaataacctaaaggttattatcttcaggtatgttttgtgagatcatttctgatgccaggatagtttattaccttctccactttcttctctcatatattcccaagtgctagaggctttcctcacttccttggacttacttttgacaagacaaatgaaacatcaaagcgcatgcactgtcaataacttgaggaaacgcccaaacattgtcttttaacttcttcaacttttgattctgtatagtagtagttactattgaagtagttactattgtacctagaaatgattcaactgctagaactatgtagttttgagttttcatatcaaagactgaaatatattattgcaacaattactttcttttacaaagtgaggaggcagaatgacctggaagctaactttaattaatttcaattgtataggtgtaattactattatcagcatctagaaagcatcatgaatttgctggagtacttcctagcactgacctccttcattctgcgttgttcttactggatctttccatcagccaacaatatggaagtaccaatacaaggtcaaatcattcctggattcatctggagttgcttaaaagttaaatcattggaatttttgatgataccttttctatatggattacaatttgatcgctgggaattctccaccttaaagaaggtatgttgctttttagatactctacgaggacttcatttttggtctggggcttatacccagagatttgactagttattttgagcggctgtgttatcagagtgatttatgactttggacttccttgttttaaactgttttctgtagatcctttcttatttaggatgatgatttgggtatttgtgatggaattttattaattttaccatctgttcttcaacattagcacacataatgaatgcagattatatggtcactaaggaaattttgtaatgatgatgcatccagcagggaaatatcctactttatttgtgattgatttgcttcttaaatattgcagtagatatttctaagttctgtgttagcagaacttatgttgtttgcattactattatttttcttcattttgacacttcattttggtaaacaaaatccaaaaatggcccaaaataaatgtctaatgactgggagtctatataaaatacagtaagttctctcagagtgaaaaccttgagtttgtaataacagagcccgtacatttgtttaacctttatggcatacatcaagtttttatagtggtcataagagtcttctattccttcttttaagtcttacaattagtttttgttcacctctgtgagaaagtagttaaaaattcacataactactgttggtaatataaaaagttaattttgatatatttacaatccttgtttaagtgattgtttgccatggaaagtaagaactttctttctgtggtctggtcaaataaattaactgggaattggaaacatttttatcttgttatgaggaaaaaaggaacattacaacttgcttctttctagctgtataaacataaacaagctacttaaccttcctgggcttctgtttgttaccaataaaatgaaggttaagttaaataacttaaaacatttttgaaatcttttaacattaagattctatgatttgttacttgcttctataaataagatacatcctctcttgtaaagtttgtttttacatcattgaacaatagagttaacagcatcatcaagttttttttttttttttttttttttgtgtgacggagtcttgcccttgttgcccaggctggagtgctgtggcgcgatcttggctcactgcaacctctgcctcccagattcaagcaattctcccacctcagcctcctgagtagctgggattataggtgcctgccaccatgcctggctaatttttgtacttttagtagagaccgggtttccccatgttggccaggctggtctcaactcctgacctcaggtgatctgcctgcctcgtcctcccaaagtgctaggattacaggtgtgagccaccgtgccccgccttggcatgataaacttaatgtgatttaattacaattattttgtttgaatgcttagctcaggtagcattagttcaggaaatatgctttaaattttctgtaaagtatactctcaactaagtgttctgtatggaaatttcagatttccttaaatgttctcaataaaagtttgtctgctggaattttttttttggaggtggaaagtacagtattatttctcgacaaacgttttacctacaaatatctgaagtcaatatgtttgaatttgttataatggccactcagagttgatatcagagatttagaaagagactttggagtaaaacagacctgagttcgaatcacagcctaggcaattactatgatacctcctccacgttactggattttcatggctccgaatttcctcatttgcaatgtgtatatcctaacacttatctcatatggttgttgtaatatttttttatgtaggaaaaaacagagggctaggcatctgtaaacataataaaaagtactgttacttgctttcacaatgacttaatgatgttttgttacttcaaactttctttgttgtctcccttacaagtttcaggccccattaaccaaatattcactgaaatattcaaagtcaatttggacagaagtttgtatccgtttaaatgtttttctgtaaaactatatttaattcaaatcttatatccagttgattgcagattaatttacttcaacgagcatttattaaatcgtactatgcatgagtatatttctgaaggtcatggccttaccttggagtatgtggcctttccattttcttactgaaatatctgtaggttgagataatagtgactttctataattgacttactgaaattctctattttcaatgctatcaatgatttagatatggtttaaaaactcgtgtttattcacttttcagctaaaatataaagtgatggctcagtggtttcttgatgaggaaatcaagaactgtagcacattttctattactaattttatagaatgatctttagttaaataaaaaacttacagttaatataaatagcacttagaagaatagcatttcattttgaaacgaagtctcaagtcatggattttcattttctaggtctgtaatatagcaatatgcattgccttctgagtgattatttagttcaaggaagagtatattcattttatctttaggaagtttcagataggaatgttaaggtattatttctcatttgtaatttactagcagatatttgcctagatatgataatgttaggaataaaaatatggaattaatcaatattaaaataggaaaatatctttttttaatatgtttccaaaactttgttgaaagcattcattttaattagcagattatatatcaatatagcaactactaatataatactttgtaattacagagtttaaaataatacattcatttaaaaatgtctatatgttgttaatgtttgaagtgataaccaaatatacttaaaaactttactatagatatcaaattttatagtcttggttatttaaaactgcccgttgacttggatcagtttgaattactgaacgtagaacaacccaccatggtgttcacaataaacttacacagaaagaaaacctaaatatttagctatgccttctaaaaataatgaatataatgcatgctaaacatctcataagtaaatcaaaagcatttatttaactttgtttcttttttttttttttttgagacggagttttgctttgttgcccaggctggagtgcagtggcgcgatctcggctcactgcaacctccgcctcccgggttcaagcgattctcctgcctcagcctcccaagtagctgggcttacaagcatgcgccaccaggcccagctaatttttttatttttagtagagaccaggtttctccatgttggtcaggctggtctcaaaccccctacctcaggtgatccacccgcctcggcctcccaaactgctgggattacaggcgtgagccactgtgcccggctttaactttggcctttatattaagtaaaggaagtgattacctgcatatttagttgtattctgagtaccatttctactcatttatttgctataagtttcttttggtacttatttgtgttcccaaatttactttgatttcttctttgtggctcaaatttgctgattttttttttttttttttttttttttgagatggatcctcgctctgtcacccaggctggagtgcagcggtgcaatctcagctcactgcaacctctgcctcccaggctcaagcgattctcctgcctcagcctcccgagtaggagtagctaggactacaggcgcccgccaccaggcccggctaatttttttttgtatttttagtagagatagggtttcaccatattggccagctggtctcgaactcctgaccttgtgatcaacccaccttggcctcccaatgtgctgggattacaggcatgagccactgtgcccagccaaatttgctgatttttagatttcgtgcatgtctaagaactttgattatagttcttcccattattgttaaagatacaggtatttagaagtacgttttttgtgaatctagaaagcctacttggttcattttttctcattcattcttttacataatacttatttagtactttctgtgtgcatgtgccaggcattgttttaaccatcaaggacacagaaatgaactaaagtccctgcatgcttagagctttcactagtgacagtaaaatatatgttaaaagggagcaactattaatactatcgtgaagaataaagcagaaaggaggaatagagagtagaaggggagagagttgcaaacttcatttggatggtgggggatgacctcatggagaaggtgacatgtgaggatggatttgaaggaagtgaaggaatgggctacatgatgctggggagaaaagcatgcaggcagaggaaatgacaagtgtctgatgtttcagagaaagcaaggagggtgcagaggctggagtggagtgagccatggggacagtggtaggagaggaaagaggaatatggcgggtaggtgccaaggagcttcaaaggccatggtaaaggcttaggattttataccgagggaggtgggatgttactgaaaggttttaaaggatgaaagctctgctgtaacaggataactctggctgttgggttgagaccaggtgaaaggggtgggcaggggcagaaacagggacaccatttaggaagctgtttcagttatcccaatgagaggtgatattgacttggtaacagggtaaaagtaacatggaggtagtgaaaaggagttgaagtctgaatatattttggtattaaagtttttctggtgggttggatgggaagtacgagacagagaggagtggagtatgagtccgagatttttgtcctgagctcccagaaggaccaaatagctaataactgagatgagaatcaggcttggggcataggataccagtagctcagttcagatgcattaaaattaagatgctttttttttttttttgagatggagtctctcggtctgtagcccaggctggagtgcagaggcgccatctcggctcactgcaagctccgcctcccgggttccagtgattctcctttctcagcctcccgtgtagcttggattacaggcacccgctaccaagcccggctcatttttctttattattagagacggggtttcaccatgttgaacaggctggtcttgaacttctgacctcaggcaatccgcctgccttggcctcccaaagtgttgggattacaggcgtgagccaccacgcctggccaaaattaagatactttttaagcatttaggcatttgataaacaagtctggttttcagagaagtgtagagacacagatttgttagttgtaagaaattaaatgctatttaaagccaggagactggttgggattacccgggagtgagtatagaaagacaagaggtctagatactgagctttaaggccttccagatttagaagtgggcaggaagtagtaataatgaaaagggagtgccgctggggtgaaagcccagggaaggaagtgtttccaggaggaaggcaagacaatctgtgtcaagtgttgctgaaggatgaagatgagaactgagaataaatctgtgggtttaggcattttggaggtcagcgctcactgggagtcttcactagagcagttttaacagaatggagagatcacatctttttcctaaatcgtgtggtccattaaatacctttaaaaaattccatctatttggctgggcgcggtggctcacgcctgtaatcccagcactttgggaggccaaggcgggtggatcacaagttcaggagattgtgaccatcctggctaacacggtgaaaccctgtctctactaaaaatacaaaaaaaaaaaaattagccgggcgtggcggcttgcgcctgtagtcccagctgtttggaaggctgaggcaggagaatggcgtgaacctgggaggcggagcttgcagtgagccgagatcgcaccactgtactccagcctgggcgacagagcgagactccgtctcaaaaaaaaaaacaaaactcatctattcaaactaaaatttgtcagtacttcataattgataaaaatgctttcacatatattatcttagttaagcctcattagtagtctaagagagatgggataatatctgtgtttaccttaaagaagaagaaatcgagagtcagaagtaacgtgacttatccagagtcgcacacatataagatagaactgcgttttaacttgaaaccctttgcttttcacagtaggggagatggcaataatgaaatcaattccaatattgtttgctagaggtgataatggtggtacatacaaagtatagagttaaagcagaggagggagtgattgtttatttggtcagggaagactttcttgagttgggatttaaaagatacgtagcattttgagagacaaagaaaggaacatcttaggcttggaaactgatatgcagaaacatggagggatgaaacaagatggagtctggaatgtgtttgggatgttccaggcatttcattcctactgaccctgcaggggagtaggtgggagctaggctgagtgacaagtgctagttcatattaaaattgaaagagggttttctttctttttcttttctttttttttttttgagacgaagtctcactctgttgcccaagctggagtgcagtggcgtgatctcagctcactgcaacctccacctccctggttcaagcgattctcttgcctcagcctcctaagtagctgggattacaagtgctcaccaccatgcccagctaatttttgtatttttagtagagacaaagtttcactatgttggccaggctggtcttgaactcctgaccttgtgatccacccacctcggcctcccaaagtgctgggattataggcttgagccaccgtgcccggccagttgttttttttttttttttttttttttttttttgagacggagtctcactctgtcgcccaggctggagtgcaatggtgtgatctcggctcactgcaacctcagcctcctgggttcaaacaattctgcctcagcctcccgaatagctgggactacagatgcccgccaccacgcccggctaatttttttttttttgtatttttattagagatggggtttcactgtgttagccaggatggtctccatctcctgacctcatgatccgcctgtctcggcctcccaaagtgctgggattacaggcgtgagccaccacactcagctggtctcgatctcttgaccttgtgatccgcccgccttggcctcccaaagtcctgggattataggcatgagccaccacacctggccacacctggctaatttttgtatttttagtaaagacaaggttttgccatgttggccaggctggtctcgaacccctgacctcaggtgttctgcccgcttgggcctctccaagtgctaggattacaggcctgagccaccacgcccagcctaaaatggagttttaacagcacaacttctacgtgtcattttaatgtacctcacagcccaaaagttgtaaacctaattagaaatgtttgaacatacgtacattaccacaaatgcattttttttttttgagacagagtctcacccaggctgtaatgcagtggcacgaatctcggctcactgcaacctccatttcctgggctcaagagattctcctgcctcagcctcctgagtaagctgggattacaggtgtgtgtcaccacgcccagctagttttttttttcttttgtgtttttagtagagatggggtttcaccatgttggccaggctaatctcgaactcctgacctcaggtaatcagcccgccttggcctcccaaagtgctgggattacgggagtgagccaccgctcccagccacaaatacatattttcaaaactcgatttttcctccaaaattaaatgtgtgtctggatcatataccactgaatagggtgacaccatgtctagtttatatcaatcaggatgtatttgtcctcacgtaagaaaatagtcaactaacagtggcttaaaaagtaaggatttttctttttcttttctctctttctttttcttttttttccttctttccttccttccttccttccttccttccttccctccttccttcctcccttcccttccttccttccttccttcctcccttccctcccttcccttccttcccttccttcccttcccttcctttcccttcccttccttccttccttccctctttctttgtttcgttcatttcaccttgaaggaattcagagtatagctgttccaggactggctaattcagcagatcagtaacatcatggttcctggtcagctggtaacctggacctaggaaagaaacggtgaatatttgtctttttttttgagatggagtctcactctctctctcgcccaggctggagtgcggtggcgtgatcttggctcactgaagcctctgcctcctgggttcaagtaattctctgcctcagcctcctgaatagctgggattacaagtgcccgccaccacacccagctaatttttgtatttttagtagagacagggtttcaccatcttggccaggctgatcttgaactcctgacctcatggtccacccgcctcggcctctcaaagtgctgggattacaggcgtgagccaccttgcccggccgaatatttgtctgaatacaaacacacgcgcacacatgcacacgtttaagtatactatttgatgatttttggagtggggagacttatagaattgtactactttcaccatttccagaactttatttttattttatttatttatttatttttgagactgagtctcgctctgtcacccaggctggagtgcagtggcgtgatcttggcttactgcaagctccacctcccaggtccacgccattcttctgcctcagcctcccgagtagctgggactacaggtgcctgccaccatgcctggctaattttttgtatttttagtagagacggggtttcaccgtgttagccagaatggtcttgatctcctgacctcgtgatccacccgccttggcctcccaaagtgctgggattacaggcgtgagccactgcgcccggccccatttccagaactttctatcattccctaaagatcccttgtgtccactgtggtcaatttctattcccatccaccagtcacaggtaactactagtttctatctctatatatgtctacattttcagaacagtttatggaggtggaatcttacaattagtgtggcctttttgcctggcttcttttgctcaccataaagtttatgagatcagtctgtgtcatagcatgtatcagtagtttgatccttttcattggtgtgtagtggtgcatcgtgtggacataccatgttttgtctgtctagtcaccaggtgatggatatgttagttgtttccgtttttgcagctaccacgaataatactgctatgagcatatgtgcataactctttgtattggctgggcatggtggctcatgcctgtaatcctagcactttgggaggctgagactggtggattgcttgagcccaggagttcaagaccagcctgggcaacgtggtgaaacctcatctctaccaaaaatacaataaattaggtgggtgtggttgcacatgcccgtagtcccagctatccaggaagctgcagtgggagggtcaccagagcccgggaggtcgaggctgcagtgagctgtgatgatgccactgccctccagcctgggcaacagaacgagactctgtctcaaaaaaaaaaaaagtctttgtatagacacccgtttttatttctcttgggtgtagatacccaggagttgaattgtggattgtatggtaatttatattcaactatttttttcctttcttttttttttttttttttttgggacggagtttcgctcttgttgcccaggctggagtgcaatggtgtcatctcagctcactgcaacctctgtctcccgggttcaagccattcccctgcctcagccttctgagtagctggggattacaggcatccgccaccacgcccagctaattttttgtatttttagtagagacaagattgcactattttggccaggctggtcttgaactcctgacctcaggtaatccacccacctcggccccccaaagtgctgggattataggcatgagccactgcacccggctatattcaactttttaagacactgccaaactgttttccaaagtgacaataccatgttacaggttggaggtttccgtcagcaatatatgagggtttcagtgtctccaaatcctggccttttatgagtcagaggaaaaactttcgcagaagtctacaagaggacttcccagggtaactacagtagcccatgacaaacactagtcactgataagcagacacatctgagaggcttagactggtcaactaacaccccaggcccgggaaggggctcataatgcttatcagtgcccagtgtcagaacacagttgaagggggatggctattggatacgaacccagcaaaggcattcatatgtccatgcgtcagggtaagcttggattattgatttaaacatacagattggagccagatgctgtgtgtatgtcacaatcatgattttattttatttatttatttatttagacagagtctcactctgtcacccaggctggagtgcaatggcttgatcttgactcacagcaacctctgcctccctggttcaagcgattctcctgcctcagcctcccgagtagctgggattacaggcacccgccatcatgaccggctaatttttgtatttttagtagagacggggtttcaccatgttgaccaggctggtcttgaactcctgacctcaggtgatcctctctcctcaacctcccaaagtactgggattacaggcgtgagccaccgcgcccagccacaatcatgattttagaagttacaaactctaatggaaacaatccactctgttggaatttaggttattaaggtattctatgactaacatagtaggagtttctgaggccaggcatggtggctcatgtgtgtaatcccagcattttgcgaagctgaggtgggaggatcacttgaggccaggagttccagagcagcctgggcaacatagtggtaccccatctctacaaaataaataaataaaaattaaaagagtttctgaaaagtaacctgtccaaacgaagagcaaaacaagcacagctttggtaagtgactccatgggcagttgctaagccccagcattccttttctatgaggcaacatgtaacttttccagcatcccagcaacagtttttcataatcttggttaagtgtaagttaacagccaccaaatccttggcttaggatgtagaaaggtatttagacaaggttaagtattgggcaacttggcagcaacttgagaaaaattatttgagcttggatggaataaaaaaagactgtattttcatagtcttaccttattcttatgtaaatgtcttttattgtgaggtatgcatgcgtaaggataggtaaatctaccatgtagggggatattgatactctgttgtaccctctgttggaaaatccagaacatgcgggtcaacatgtttatgatcagtagagtgatatggtctcaagcaattcatgcttagaagtccctgaatatctgaagccaaaatttttataattggaatgcatgcatagataattttgataatttatgcatagcttcagatcattgtgggggaaataatgtttgaaatggatttctgtgacacttgtcttaaattaatgggatgactttccattttttcttcaaatttgagttggtaccattacagactgtgatagaattttgaaactgtggttttaatcctagtattttggattacgtagtgtcttttttttttttttttttttttgtcttgagacaaagtcactgtggcccaggctggaatgcagtggtgtgattacggttcactgcagcctctacctccccggctcaggtattatccaatctcagcctcccagaatagctggggctacaggcatacaccaccatgctcagctaatttttgtattttttgtacagacgcaatttcaccatgttacccaggctggtctggcactccttggctcaagcaatagcagtctgcctgctgcagctctccaagtgctgggattacaggtatgagctaccaagccaggccatgactttttttttttaacccaaacaactccagtagttctctcattgtagactatttcattttagaaataaggaaaaccaagagaaatttaaaggtttttttttttttttttttgagacagagtttcactcttgtcacccaggctggagtgcagtggcacaatctcggctcaccgcaacctcctcctcctgggttccagcgattctcctgcctcagcctcctgagtagctgggattacaggtgcccactaccatggctggctaatttttgtaattttagtagagatagggtttcgccatgttggccaggctagtcttgaactcctgacctcagatgatccacccaccttggcctcccaaagtgctgggattacagtgtgtgccaccatatctggccaaggttcttaattattggtgttagtgaatatgaagtatacatcttaaaatttatagttcagtattctatttttctcagagaagtggtagagaagcattacagaagtacttgtgcagcagtatcttatgcatcatcttatttgattctcactggaattccatataatagctgttagtaacattctcattttataggcgaagaaactggggttcagcaaaatgtccagttcaagttatcaaactagtaaattgcacaatgcagctcttttgactttgcactagatattagggatcagtaatgtaaaccaggaagagagaatgtttccttgagagctcccactcaccctgataatttttctagtttcaccttgagacttactcttattctgcaaatactgtgactgtatcttgagacccaaacatttaatgaggcttaaaaagaggatggtctactttgctggtggttttttttttttttttttttttttttttttttgagacagagtctggctctgtcgcccaggctggagtgcagtggcacaatctcagcccactgcaacctccaccacccaggttcaagcgattctcttgcctcagcctcccaagtagctgggactacaggtgcctgccaccacgcccagctaattttttgtatttttagtagagatggggtttcaccgtgttagccaggatggtcttgatctcctgacctcgtgatctgcccgcctcggcctcccaaagtgctgggattacaggggtgagccaccgcacccggccctctgctggtgtttttagatttcagagggagagattgtgttgcaagcagcagttgagaagccggcatgacggtgaaatccgtctgtgttcaagagttttacttgtcagattttaatggatggcgtcattatctctaaggaactcccaaaagatgatacatagcaatactcatagagtccctattctgcagcaaaagaaaaatgattttcagatcatcctttcatctcctctcttcttcaagtcagatatccaagaaagtttgggcagactcacaattcctaaattgaaaaccctgaatccctgaattgaagatttccctgtggctttcaccttgctttgtctctgcatttaggcctctccctttctataggtatgagagaaaagaaactctatgcaatgacatgctctttattcatagctctagctcttattctgctctgtctactttggactgtgatgaccctctagggactctacttgctcttttctttgttcttgttgtttttctagagacacagtcttgctctgtcacccagactgcactctgtcatgacttcagtggtgcaatcacaactcactgcagccttggactcctggattcaagcgatcttcccacctcagtctcctgagtagctgggactgcaggtgcatgccaccatgcctggctaattattttttattttttgtagagacaaggtcttgctgtttcactcaggctggtctggaactcctgagctcaagcaatcctcccgtcttggcctcccaaagtgttgggattataggcgtgagccaccacacccagcctcttcttgttattattattatttttttaagacggagtctcactctgtcgcccaggctggagtgcggtggcgcaatctcagctcactgcaagctccgcctcccatgttcgcgccattctcctgcctcagccatccgagtaactgggactacaggcgcctcccaccgtgcccggctaatttttttgtatttttagtagagacagggtttcaccgtgttagccaggatggacttgatctcctgacctcgtgatctgcccacctcggcctcccaaagtgctgggattacaggcgtgagccactgcgcccagcgtcttcttgttatttttgacgggcctatgccaggccagaggtaggcctaagtgacctggttcatgccttccttcccacatcccaggattgggtcctactagctttctggatctcaccactctaatagagggaacaagaccctcttttctaaaagcctagagcggggtgcagtggctcatgcctgtaattctagcactttgggaggccaaggcggggggatcacctgaggtcaggagttcaagaccagcctggccaacatggtgaaaccccgtttctaccaaaaatacaaaaattagccgggcgtggtggtgcacacctgtaatcccagctacttgggaggctaaggcaggaaaattacttgaatccaggagacggaggttgcagtgagctgagatcatgccgttgcgctccagcctgggcaacaaaagcgaaaatccatcccccccaaattaaatagataaataaattaaaacataaaataaaaaataattttaaaacaagtctagagcagagctgggccaaactgcatgtgcttttcttctttgccttgggtttgaactcagcctgccttcctgtgatgtgggtttctttcattgggagatttcttgagcccctgattttcagtactggcctggaaggacgaagagaactcaagctttctttaatattccacaccagaagtttcatagcctatgcaaggcctggacctacacctgcacaacaactttttggtgtaaagagtgaatcccggatattacagtgggtgagctgagctattagaatgtgtaatgggaggacaggcacggtggctcactcctgtaatcccagcactttgggaggccgaggcaggcagatcacgaggtcaggagttcgagatcagcctgaccaacatgatgaaaccctgtctctactaaaaatacacaaattagccgggtgtggtgatgcgcacctgtaatcccaagctactcaggaggctgaggcaggagaatcgcttgaaccacggaggcggaggttgcagtgagccgagatcgcgctactgcactccagcctgggcgacagagtgagacgctgtctcataaaaaaaaaaaaaaaaaaaaaaagaatgtgtaatggggaccctttcacattgctttcattggaaggtaaatacaatttaaaggaaagaagtctaaaaactcagaacacccaaaggtgggcagttatttgaactcaggctttgtttggtgacccccatgagtcctgacctcattatctttagccctcaccacaaattgatattctagaaagctatctcttcctgcctgccccgcctcctagaaatacatcacactgcgttagcacagtcaggatgctagtccctgatggctgatcattgtagtgcccattggaggttggcatgattagttatgtgacaaccctgctgaaatgccacctactatatttggtctcagcgattaaacgaaaagagatggtaaggcaacaaaaattatcagcatatattttcagcttctttgagttttgcagattagtatagttcaaaggatagacaaattcacttgttttcattttgtctttaagataaataaattttggtactttcttaataagtgttcagcatttatcccagtgtgggaattttggtgaaagttcatggaatgtttttcttcaaaaatttccatcaggaggtctgactcctcagccaaattcaaaattctcactttactgtaatgatggagctgctatacctaaatatattgcataggtttctagacaaatggctgtaagataaataagcaaagaagaggaagaagtatcatgatatcctaatgccaagttctcgctctgcggtatgacctctggagttcctagagtttgtgtgatctgaggcttcagaagccaggaatgggagtttggctaacccgcatttttagatctcctttggaacatgggagtcaatccaggtgcctggaaaatgggctcgaacatccgaggtccccagcagatgacagcttcatcttattttctgcctcctttctctgcatcaacttaggttactatttacctattgattctgactttatgcaaattttatgacgtggtccacagattcaaatagtctgtcttttcacatcccagccttcagtgttcctcggcctcaactctgcctgctcttaccctgatactgcttctcgtctttggttcttgccttctttagaccttgattctcatggctggccaatttcagtggatcttggccagcctcagtggtctcaggttctgcctcctgttcttacagaataatcttggatcctaacacgttgctaaacatccaaaggcagccagtagatttccaaaaccggaactctccgtttgctatcacctctgcccttctccagggtattgcattgattcaaatgctataaatcaggggtccctaaccccaggccatggaccggtaccttcacttgcttacccaccactcacttcctgttctgtggcctgttaggaatcgggccacacagcagagggtgagcagcaagcaggcaagccagccaagcttcatctgtgtttacagccgctccccatcactcacattactgtctgagctccatcttctgtcagatcggcagtggcattagattctcataggagcatgaacctggtgagctgcacatgagagggacctaggttgcatgctctttatgagaatctaatgcttgatgatctgtcactgtctctcatcaccccaaatgggaccatctagttgtaggaaaacaagctcagggctcccactgattctacattatggtgagttgcataattatttcactatgtattacaacgtaatagtagaaataaagaacacaataaatgtaatgcacttggatcatcctcaaacgatccccccacctcccactgttcgtggaaaaatggtcttccacaaaaccggtccatgctgccaaaaaggttggggactgctgctataaatgacatcctgaaagtatgggagtagaccctctcaattatctaaaaagtattaagctattctgagtaccctttttttttttttttttttttgagatggactctcgctctgttggccaggctggagacaaaaaaaaaaaaagaaaaagaaaaaaaaaaagaaaaaaaaattagcccggcatagtggcatgcacctgtagtcccagctattcaggaggcggaggcaggagcatcacttgaacccgggaggatgaggttgcagtgagccgagatggcaccactgcactccagcccgggtgacagagtgaaactctgtctcaaaaaaaaaaaaaaaaaaagaagaagaagaaaagagccttctgtgtgtgcatgagtttggggaactctgcagactgtatgcataccccttttggaggttcaccaggccctctaggccaggctgtgagatgtctggtggttaaagtttaacttaaaaaaaaaaaaactcattgaatatggactcatttattatatttgttttggtttttaaagattcacaggacactcattgacaaaactcaacagaactaatcttttgacaagtgtatatttcatgtatccgaagacacagtaactgtgatttaatgtgcaatccactacaaaataatatttgagttttaacagtgggcttttgtccaaggaggaaatgtgaggaattttaggcactgtgacgtgtcctgtagagtgataatttggggcagcagaaacctttctatgtctctttggtcttataaagtcattgctcactacagccgtgaaaagactggccccaagccaaacaacaacaacaaaaaaatagcaacaaaaacccctgccggccgggtgtggtggctcacgcctgtaatcccagcactttaggaggctgaggcaagcagatcatgaggtcacgagattgagaccatcctggccaacatggtgaaatcccgtctccactaaaaatacaaaaaaattagccgggcgtggtggcccgcgcctgtagtcctagctgctcaggtggctgaggcaggagaattgcttgtacctgggaggcggaggttgcagtgaggtgagattgcaccactgcactccagcccggtgacagagtgagactccgcctcaaaacaaaaaacaaaaccctgccaagatcataatgaggtggaacagaaatggaacggagcttcagtgaaataaagatgatataagcaggaggccattcaaagcagctgcaatgataaatactatagggcttacagaagcccttcagaggctcacacaatcgtttgagaacatctgggagacagtaagcctcatcaggtcccaggaggaccattcccatttaggcagcatggatcgtattccctgaacgcaggcggaaggagttttgataccatatagtttagtacctatttatcctgtgctgctttgcttggttttcagtttcatggctgggatcccccactccccatagaagctcgggaactgtgagctggataaaggcctcctcccaaaagaccaggttctaatatctggaacttttgaacgttgccataaaggaacatggtctttgcagatgtgattaaattaagaatcttgatgtagagaggttatcctgggtgacctgggatatccaatcacaagtatccttataagagacaggcaggagatcatcttcacagagcacatgtaagacagaggcacagattggagtgatgtggccacaagccaaggaatgccagagaatgccagcagccaccacaagctagaagaggcaaggaacagattccacaaacagattctacccctgagccttcaaggggaacgtggccctgcagagagcatgagggagtaagtttatgttgttttaagccacagagtttgtgataatttgtcctagcagccctaagaaattaatacaggctgtaaattttctgagaggtggggtgatgtgttccctgttcctgtcttctgcacagtatgcatgtttctgcacagaacaggcactcaaatacccgagtgcttgaactgacttgacttcttcactggttcagaaattcagagcctaaagatttggatataaaattttattggaagaacagtgagaccagtaagatctgagcattcatttgcaaaagaagaaattaatgcccctgaggttagtcccttagagtttattgcctcttgaagctgagatttataccacgttttaatgtagcaattttttttttgccttgctggaatattaataataccatgaagaaaacttcatctaggccgggcgtggtggctcacacctgtaatcccagcactttgggaggccgaggcgggcagatcacgaggtcaggagatcgagaccatcctggctaacacggtgaaaccccgtctctactaaaaatacaaaaaattagccaggcgtggtggcgggcgcctgtagtcccagctacttgggaggctgaggcaggagaatggcgtgaacccgggaagcggagcttgcagtgagccgagatagcaccactgcactccaacctgggcgacagagcgagactccgtctcaaaaaaaaaaaaaaaaagaaagaaaacttcatctagcagggaccagaaaagcaagtcattcaaggcggtggcttggtgtcttaattagatactaccttggtgcttgctttctcttcgtttgcactgacggtatctaaatgacagtgttctgggatttctggatcagacacaaaatgtcttctgctcaaatcttccatgaaatgtaattttgaaaccatgagcttggttcttactcaagcagaactcttagcgtatttactgggacttcagctgaattggaatggaattgtgagatcacattcctttggaaatataaacagtttgtttttacgtataaggaagccacataaaagtatctagaattttagctcagtagactggttggtgatttggtgatgaacattattcttttcaatattatggccattttatttatttttttaacaggcattttgtttttctttggtagggaaataagttctcttctagaccatctttcatctaggaagctcagttcattgtaaagccaagtaggagtaacaataaactgctagaacattttaccaatattgttaaactaatggcaaaggaaagggaagctacatgcaagattgtggttagtgtgttgataattttgtgtttgttgtgatctggagcataggtaagggtttctttacagatttactgtgaatttttttttttttttttacggagcagagagtttaataggcaagaaaaaagggggaagaaagaaagaagaagctcccctgtacagagacggggcagggggctccaaagccgagagagggaaccccgtgaaatttattttttaaagcacttatattattacctgatgccacatagaaatgttaatatgctagtagacttcgcaagatttagtcactttcattgtttttagtaagaaactgtagcagacatttacgatagtatggctaaagtaaaatcagttaatctccaccttggctttgcaggagagtgagggttagatttgaaagagacttttccctcattgaattgaacttgtatttgaccttatattctgatgaaggttgaaattgacattaggcagttttgctttaagtcaacccacctcacatgttgaaataatgaggtctttgccttgatgttaactccatccccttcactctctgccatatttaaaatgtgctccaatgccatttagtttttactattaatagttatacagccttattaccgaagtattaagtggtatgattgggtcatcatctaaaagattccttacaaaattctctaaagacaggcccatgtgccagacattgtattattttgcctggaacatagcagttgctcaataaataattatttgttgcctgaatgaattcatgatttaatcactgaaatcaacaagttttgatgtcagtgaagccttaaccagcaatttggatgtcctgggctgtcatatcaatctagtaactcatcttctggtgcgcagaaaagtgttcatcaacagtttattcggtgctgtccaagagaaatagaatgtgggccacaaatgtgagccacagatgtcattttaagttttctagtagctacgtttaaaacaaaaagaaacaggtgaaattatttttagtaaaatattttaactcaatatattgaaaatataatttcaacataaaatgaaaataaatgtattttatatatgtactatgcatatttcatatttaacaatatatctcaatttggcccagcctcatttcaaatgctcaaaatccacatatggctgccagtggctaccatattgggcagcctacatttacaccatctggaggctccaattctaagtaattatttttgctaactagatggaaaactcagattttataagctattgagtgtgatatgtgttatcctatcagtgtgcaactaaaacaaaaattacacaattaaaaaaattgttctttagagattgtgtaaaaagtgtaatgccccctaaattttaggggccatggcaaaacttccattgttctaagattcagattttctcttgtgttattgtggggcaagttacttatcctttcttgagcctcagctccctcttctgtaaaatggggttactgtttgtctcaggatgtagagataacatttgcaaaggttcttttttgttttgttttgttttttgtgacagagtcttgctctgtcgcccaggctggagtgcagtagcgtgacctcagctcactgcaaccttcatctcctgggttcaagtgattctcctgcctcagcctcccgagtagctggcattacaggcatgcaccaccacacccagctaacttttgtatttttagtagagacggggtttcaccatgttggccagactgggctcgaactcctgacctcaagtgatccgcctgcctcggcctcccaaagtgctaggattaccggcatgagccaccgtgcccagcccacaaaggtcttaactcagaaacattagctactcattgttagccgtaattagttcttatttagtattttcttctgcatgcaaaacttcagagaaaaaaatgggttctttcctatagatgctcgtcttcttttcctaatagttgttccacaggcaactcctcattatggcaagaatttcctgtgattctttgatgaaaatgagataattgaattttgtttaaattagttcaacatgggcgactccaggtagttcctgcacagggggcccatgaaggatgccaagaaaactgaagaagggttaacttgggttaacttgtgaggtattgaactgaatttggagactctgttaatgcatttctattaaacttatatcaacattacgccaagatcagtaatctagcagggaaaggtgatcatggtagagaaatgcttttagatatagctagacttcattctgcttaaggcctatccaactcttttccgatgtaataaactttgagaatatgaaattagtgacaggaaaatgtttttagccattgtttatcttgctttggttaagtgagacaaataatgagaaatcactggagctaaaatttcttatagtatgttatttaccaaagctcacctaggcagggtcaaatacttgtttttttgtttttagatgatgttaatatgtttggagtataggatttccgccagcagttcctaagaatttttgcataacttaaagactttttttttttttggcaaatagttgttgattttaattctaagtaagataatcttcatgataaagagtggtgagcaaaggcttgtcctcggagacctactgtcgcttggctattactttcacctctttcattgcttgtggaaaaacccttatccagggaagaattaataacttcaacaatactatcaaaggagggcctaaaattaaaaaaaaaaaagaaacaaaaaagttgtgaaacaacaacaacaacaatacttggcaaactcctgacagacttagggagaatattatgatattgaggctgctgttgactaaggctctcctattgttaatataaaaaaatcttttgtctagtagtattaaaccttgacccccacacagcggaactttggaaaagaattgttaactcctttgctgaaaacagagttctagaatgttttagcaaaagcaacatatcttttactaaatattatattttccaataaaatgaataaagagaatgctttttttttgcttttcatatttacataaattgaaaaaattcccccaaaatacgaaaaactggcccttgcattttttacgttgctcaatgtgggtaactgtttagtggaagtagacattcacttaaatggggaaaatggagaatggacaattcattaaatggaggaaaataaagccttattttttaaatgttgctgataaaatatttgggtacttaatgatgctgaatcaagaccactctgaatacaagtggtttcccttttctctgaatgcctggttgtacaaatcataggttttgcttgtttttgggtaggggaaggttggcaagcctaatgtggtttctttgagagcaatctgtctgaggggtcccctttgctgtgggggtgagggcatttgacttctctaatcttttcttggtcatagctcctcttaatggcaatgtttttaaactcttctttgagagagaatatattccgagtctgattttgcagtgcactttctcctgtgtagaatgctcatgagaagggaaccatctctgcagaacttctagaacaagtttttcttcctgtggtattgaaaaggatggattggatgggtgcatattttcccttctatggaaacaagaactctgtagggttcctgtgaatcaggaagccgttacaaagctacaagtatgacggccagtttttaaaaaatgaagtacgtatagtttatttaggggaaaaagaaggaaaagaaaagagctggaaatagtaatatttgctttcaaaatagaaatatgagcctgaaaatagaaatatttgcttttctgtatttacatacacatctggtttttcatttattttgtgtgtaaagaaacctaataggtgtgactcgcttcttcatcttgtgattgtgcttttttttttgagacggagtcttgctctgtcaccaggctggagtacagtggcatgatcatgactcactgcaacctccacctcccgggttcaagtgattgtcctgcctcagtctccggagtagctgggactacaggtgcgcgccacaaagcccagctaatttttgtatttttagtagagacagggttttatcatgttggccaggatgatcttgatctcctgacctcgtaatccacctgcctcggcctcccaaagtgctgggattacaggcgtgagccaccgtgcccagccgattgcgctttttaaaccttggtttcagctttgatgtgacagtgcttgggaatagaataattttcctccttgggcttgagctctgttaatcatttggtaaagatctttcattgtcaaaaaagccaagaggcaggcctagttaatatttgcaaaccgaggaaatatttattacatgaaatattgttccactgatgggttagtggaaaattctgggataagatcatttctttcatgactaatgaagaactgtatcttaattacttttctagagggtttttttttggttttctgatcatggatttgagattcaatttttatactaaatgatgacgatggttaatatcaacttttttttagcttagagatacctggtttatttaataagttaacagggtttcattctcaataatagtgtgactatagaccgctgggcagcagactttattgaaccaataaaactttatttgcttgctcttaaaagctccgttggaaagacctgggggtaggctggacacagttatttaacacagaatttctaatacctttctttgtaatgaaaaagggccaatttacttactggctgtgagctgtaaaagcatttccattgatgttaatgtgggcttgactccctcagagttggttcattccagaaatggttcttggatcttgagagtggggagggtggttcttcccagcaaagctgagtgacttgcccaagggcttgtgatagagccttgtagacagtgcccttacttgcctttgtgatttgaatgatcatccaagggaaagtagaatcagttttaaggaatatttcaaattagcaaaattggaatatccccggaaggctgggttctacgttttatcatgaagaattggtcagacaccaacatttttgagtgccagagacttgcaataggatgtcttacaaatgttatgtgtattttgataggctaaggtttttgtagccaccactgcatgcagtgtaaacactccatgaattattaggttttcctatgttaccagaaaagggtcccattctagaccccaagagggggttgttggatctctcacaagaaagaatttgaggtgaatccatagagtaaagtgaaagcaagtttattaagaaagtaaaggaaccgggccggtggctcacacctgtaatcccaacactttgggaggctgaggctggcaaatcacctgaggtcaggagttcaagaccagcctggccaacatggtgaaactccgtctctactaaaaatacaaaattagctgggcatggtggctcacgcctgtaatcctagcactttgggaggccgaggcaggcggatcacctgaggtcaggagttcgagaccagcctggcaaacatgatgaaatcccgtgtctactaaaaataagaaaaattagccaagtgtggtggcgcacgcctgtaatcccagctattcaggaggctgaggcaggagaatcacttgaacccagggggcagaggttgcagtgagccaagatcttgtcactgccctccagcctgggcaacaagagtgaaactctgtctcaaaaaaaaaaaagaaaaaaaaaggtaaaggaatacagctgggtgtggtggttcatttctgtaatcccagcactttgggaggccgaagtgggcagatcacttgaggtcaggagttcgagaccagcctggccaacatggtgaaaccccgtccctactaaaaatacaaaaatcagccgggcgtggtggcacatgcctgtaatcccacctacttgggaggctgaggcacgagaattgcttgaagccaagaggcagaggttgcaatgagctgagaccatgtcactgcactccaacctggatgacagagcagactctgtctcaaaaaaacaaaaaaaaaaccaagcaaaggaataacgaatggctactctataggcagagcagccccgagggctgctggttgcccatttttattgttacttcttgattatatgctaaatgaggggtagattatccatgagttttccagggaaggggtaggcaatttctggaactgagggtccctctttttttttgttttttttgagatggagtctcgccctgctgcccaggctggagtgcagtggcaccatctcagctcactgcaacctctgactcccgggttcaagcaattctcctgcctcaggcttctgagtagctgagattacaggcgtgcgccaccatgcctggctaattttttgtattttgtatttttaaaaattaaaaattatttttacattttttgtatttttagtagagatagggattcaccatgctggccaggctggtctcgaactcctgacctcgtgatccacccacctcgacctcccaaagtgttgggattatgggcgtgagccaccgcgccaagcctttttttttttttttttttgagatggagtctcgctcttttcgcccacactagagtgcggtggcacaatctcggctcactgcaacctccgcctcctgggttcaagtgattctcctgcctcagcctcccgagtagctggaattacaggcacccgctgccatgcctgactaaatttttttgtacttttagtagagataaggtttcaccatgttggccaggctgttttcgaactcctggcctcaagtgatctgcccacctcagccttagaaagtcctgggattataggtgtgaaccactgtgcccgtcctgtctataaacattttaaaatgctgcaacacagactcctcatttgtcactataatactgagtactgagtgtgtggacctgtaagggtctctttttctctttttagttacagggcttgacgtttctaggactaaccaaggaagatgcagttggttgtgaatcacttcttcccatgctgaaatggcaagtttatgacactaaagatgcagtccaacagagtagtcactgtgctcagcatcagtatttttttttgcctccatcatcttgctgaaacagcattggtgtaataaaaatgaacctctacacctctttaaagtgctttggatttggacaaatttatgttttatcaaaggttaatcctgacaaattatagtcaatgatttctggaaggtctgctacaggtgcagttgaattaattgtatactgtgcatagccggatgtatactttaggaaagatttactgcattttttgtggcaaaagtagaactagaaaactggggatgcccagtaaaaccacagtgggaccaggagcttgaccctactgtgcagataaatgatgttcatgaaaggttaagttagagctctaatgttcctcattgcagcactctactgctacctctgcctaaaagacaaaatgaaaaggggaaaagtcacaaaggcagggaaaaaacaggtaacactagagttgtgacttttacccgctttttcattttctgtttttggtgggaaggtgaaacctctattcatttatctgctggaaagaagtcttctttgtgttttcaagacaggcgcttctacccattgtttctagaagcaggagaaactttatttctctagttcggggatcgcccagatgcaaaagaggacgaaatgagaagtgagccttgagagaggaatataaatcagtgttacaaacaaacaaacaagagtattgagcacatagctgctcaagatggcttgacaaatgaataaattatgtaggtgcagccctgtgttaaataaaggagtttatactctgagacacacacatgacagacacaacagcaaatcttgaacatgtgcatagaagtttctgaactttccacagagaatggtttattagtgtgctagggctgccataagaaagaatcacagactgggtggcttaaacaacagaaatttattttctcaggctgggtgtggtggctcacacctgtaatcctagcacattgggaggccaaggcccagcagatcacttgaggtcaggagttcgaagccagcctggccaacatggtgaaaccccgtctctactaaaaatacacaaaataagcctggcatggtggtgggtgcctgtaatcccagctacttgggaagctgatgcaggagaatctcttgaactcgggaggcggaggttgcagtgagccgagatcatgccactgcactctagcctgggcaacagagcgaaactccatctcaaaacagttctggagacaggaagtccgagatgaagatgtcagtagggccatgaggcaaggatctctctcaggcctctctctctctggcttgtaaatgtctattttcctctctatgtgtctgtgtccaaatttcctcttcttttaaagatccctgtcatattgggttagtgcccaccctgaaggcctcattttaacttaattacctctttacagtctctccaaatacagtttcattctaaggtactgggagttaagacttcaacatatggacttggggcgatgtgattcagcccataaaaaatggttacacttaccctttgatactaacactcatacctttttctcatttccctcaactatttttgtaagtatctaagaagccagaattttcaatgttttgatatttctcttatagttttctgttaatttgcaaatttggcgacatcacttcttgttttctggtagtctttattggtctgatattgaacagaacagtgagtagaaataggaaaaagaaaccttctgaagtaggaagtgcggggtcaattcttataaagagcatcatcaccatcaaacatttactgaatatctgccctgtcaaccctttcagatggttctgaggtcaacggagtgtctgctgagtaaataactcttgggtgaaaaagaaagcataagaatatcatctcttgggtatatatttttttcataaacttttttttttcggtggtgtctcactctgtcagctaggctggagtacagcggcacgatcttggctcactgcaactgctgcctcctgggttcaagcgattctcctgcctcagctccccaagtagctgggattatagacctgcgccaccatgcccagctaatttttgtatttttagtagagatggggtttcaccgtgttggccaggctgatctcgaattcctgacctcaggtgatctgcccgccttggcctcccaaagtgctgggattacaggtgtgagccaccgagtctggcctttataaacttttaattatgtataatatacataaagataagtacactagtcttaagtgtaccattcaatgaattaccataaagtcaaccttttaggttaagaagttggtagctccccttctgccctctcccaagggtaactcctatcaagacttttatcattatagatagaagtttgatactattttccatttatgtaaatgaagttgttcgcagtgttcctcattgtatttggcctctttgctcaacattttcagccatgctcaacagattcagccatgttgccgagtatagcaatagtttctttattctcgttgctgtacagtactcaattgtttgaagaggccacattgtattcgttctactgttggtggacatttggattatgcctagtttttgactgttaggaatagtgctgctgtgaacattcttttttttaatttaaaaatatttaattgacaaatacaattgcatatatttaaggggttcagtgtgatctgttgatatatggacacattatgtaatgattatgaacattcttatacatatcttttgttgaacatatgtatgcatttctattatggagtggggctgttgggtcgcaggtcatatgttcaactttagtagatacttacagtatttcaaaagcacctgtagcaatttacacatttttttttcttttttttggagatggagtcttgttgtgtcacccaggctggagtgcagtggcgcaatctcggcttactgcaagctccgcctccctggttcacgccattctcctgcctcagcctcccgagtagctgagactacaggcgcccgccaccatgccaggctaattttttttttttgtatttttagtagagacggggtttcaccctgttagccaggatggtctcgatctcctgacctcgtgatctgcccgcctcgccctcccaaactgctgggattacaggtgtgagccactgttcccggccgcaatttacacttttatcagtagtgtatgagagttctgattgtgaacagttttgctaatacttgatagcatcaatgtttaaatttagccattctcttaggcaagtagtggaatctcattgtgattgcattttaaatttctctgaggacaaatgaatttgagtatcttatttcttttgatcactcaagtgccctcattcatgaagcagtttaaagtaatcacgggctgtgggcggtggctcacacctgaaatcctagcactttgggagtccaaggccgtcggatcacttaagccctgggaggtcaaggctgcagtgagctgtgatggcgccactgcactccagcctgggtgacagagcaagatcctgtttaaaaaaaaaaaatatatatatatatatatatataaattatatatatatataatttatatatatataaatatatatatataaattatatatataaatatatataaatatatatataaatatatataatatgtatatatataataataataaaataaagtaatcacggccaccaatccatcactggtgtcctcaaaaactcttccaagtcttaagcaaataaataatgaattgatctttctgcagcttaaggctaaggtgaagagttggtttgttttggatattttaagtttatgcttattaagagaatcctcactctcagaagtgttccagtttagatgattaatttatagtcaccctatttatatccatcatctcttctgcattatttaaagcttttctatctgaaatcactcattcatttgttctatcattgctgaggtcttactctatgccaggtagtgggataagtactggggatgtaaagatgtatacgatatccctccccctaaaaatcttaagtgttgtggaagaaacagagtctagaactattttttttttttttgagacggagttccgctcttgttgcccaggctggagtgcagtggtgcgatcttggctcaccacaagctccgtctcctgggttcaagcagttctcctgcctcagcctcctgggtagctgggattacaggcatgcaccaccacgcctggctaattttgtatttttagtagagatggggtttctccatgttggtcaggctggtcttgaactcccgacctcgggtgatccacccgtctcagcctcccaaagtgctgggatcataggcatgagtcaccaagcacggtctttttttttttttttttttttttttgatggagtcttgctctgtcccccaggctggagtgcagtggcccgatctcggcttcccgggttcatgccattctcctgcctcagcctcccgagtagctgggactacgggtgcccaccaccacgcccggctaattttttgtatttttagtagagacggggtttcaccgtgttagccaggatggtctcaatctcctgacctcatgatctgcccgcctcggccttccaaagtgctgggattacaggcgtgagccactgcacccaacctctggaactatttttacctgatctaatcatagccatataatcataactctgagttctagcagagctgaatttctgcattaagaacatctatgctaataaaatgatttgttacacccaatagcttatgttgatgatttatgatatgttgtgaacacaatcgtttaaaacatatattttttggcactctatttgtctcaagtccttaatgtgtgagaattcaatcttcagtaggttcataaaactcatgttttgggcaggagccttaatcccttgaatcacggtaagggaaacttgtgttgagttgaactgaatgtcttataaaaatccttctggtttctatgtcctcattcatttggatccagctgtgttaaaatggccatctgatactgtcttttacccggaagagaatactgctttaatttaaatgtgccctgttgtcacatctgcccaggtgttcaggtattactctttggtaccctgtatgatggaacaataagcactgttttggaattgtctgtttacttgtctatcttctagattagattgttaccaactcaaaatccctagcacctgacatgatgcccaacagaagctagatgttctggtcagtaaatgccttttgaatgaacgagaataagcaaatgttggcccgggcacggtggctcacgcctgtaatctcagcactttgggaggccgaggcaggtggatcacctgaggtcaggagttcaagaccagcctggccaacctggtgaaaccccgtctctactaaaaaatacaaaaattagccaggtgtgcagggcgcagtggctcacccctgtaatcccagcactttgggagggcagatcacgaggtcaggagatcgagaccatcctggctaacacggtgaagccctgtctctactaaaaacacaaaaaattagccgggcgtggtagcgggcgcctgtagtcccagctactctggaggctgaggcaggagaatggcgtgaacccgggaggcggagcttgcagtgagtcaagatcgcgccacggcactccagcctgggtgacagagtgaaactttgtctcaaaaaaaaaaaaaaaattagccaggtgtggtgcctcatgcctgtaatcccagctgcttgggaggctgaggcaagagaatggcgtgaacccgggaggcagaggttgcagtgagtggagatcgcatcgttgcactccagcctgggtgacagagtgagactccatctcaaaaaaaaaaaaaaaataagcaaatgttagaatacaaacacacaccactcataattacgaagaaatgataatgcacctggcatagagctaggttctggctccaggtcattgtggcccagaacagacatgccaactgctccaataggctttcatttggggagtgaggaacagacaataatgaaggcttcacacaaagtagtgttcagttacaagttgagataagtgctttgaagcaaagggacatatggcaaataagactgacctagactttgggagttgaaaaggcttcccagagaaagtggcatttaagataaaacctgcaggatgaagaggaattaatgataggcagtaggtagggaagacaggaaagcatctcaggctgagggaacagttgtgcaaatggtctgtggtgggcaggaacatggtggggatcaaagaggttttcagaagacaaacctgggagacaggtcagggtcagactattcatggcttaggagatctcattgaagatgccctgctttgtcttaggagcaatggtttcccttttaaaagttgtatgggaaggtacaggagtgctaggatcagatttgcactttataaggattaccctatgctaggaactagcctgatattttgcaaacgtaaataaagagaaagaatcaaatatttattcttggttgccacataacttgtacctcaaaataaccaaatagtatatgaagataaatttctctatagatgtgttccaggtaatacatgaaaaggagtgataggataccatcattccgcaatccatagtgaattatatgtttaggcaataattatcgatagatgttaactttacaaaagagacaagcagacaagattcctggaaataaataataccaccgtttgatagacttgtcaaaaaaaaaaatcaaacctgaatctgcccaagcttctagacctgactagcatatttttaggaaatgtgggaccaagggaatgtgctacccatagcatggagacgaattcaatacagtccaaatcctgggaaattctacaggatgaaccacttggattatttcaacaaagaaattataagagggacagaagagagatggaggggaacctatagattaaaagagatttacataaatgtgtggaccttatttggattctgatttggacatactaactgtaaaacaaaacaaaacatttatgagacacttggggtaatttgaacactggctggatatttgatgatattaagggattacgtattattcttaagtgtgataatgttattttgattatgtttaaacaacaacaaatagctttcctatcttttagagatactcactgaaatatttatgaatagaatgatgtgatgtctgggattttcttccaagttggtgaatgttgaagctgagggatgggtcaatgggagttcactttctcttcttttctgcttttgtttatgattgacatcttccattataaagagttttgaaaagttatgggaaaaaggaaaaaagagatcacctttggtttgacttttcccctcacccctcaaatcctcagtatgtttcagttgaaatttatcagctggtcacactttaatgtattactatattaaagaattttaattttaatatctttatatattaacatgttttaatgcttattagactgattgctttttaaaacattttaatacgtgttaattgtggaaaatttggatatgtaagaaaagcccaatgaagacaattaatagcaccgataatcccactactttggagagagctatagttaatatttttgagtgttcgatctcatcaggaatatatacatattaaaacataattttaattattaagcaacaaattttctgcttctattttttagcagctcattgtgaccattttcccaaggcattaggggttctgttataaacaaattttagtggctgtttagtgttaacatccatagacatctatggcaaaatttacttaattctctctcgttaaacactaaattaaaaaaaaaagtctgttgtggaaatgatgctctaataaatagacttataaatatatcttttatacattctgattatttcctttgcgtacattcctatagttaaattgctgggtcagtgagcatgtgtttttgtagcaatttttattttttttaaattttttttgagacggagtcttgctctgtcgcccaggctggagtgcagtggtgcgatctcggctcattgcaagctctgcctcccacgttcacgccattctcctgcctcagcctcccgagtagctgggagtacaggcacccgccaccacgcccggctaatttttttgtatttttagtagagacggggtttcaccgtgttagccaggatggtctcaatctcctgaccttgtgatctgcccgcctcggcctcccaaagtgctgggattacaggtgtgagccaccgcgcccagccttttgtagcaattttataagcctttgaaatgttgacactgatttgcactcctgtaagctatatatgagcatgcttatttattctgtgctctatcaactctgaatattatgaataaaattttttggccagtttgttgatgaaaaatagtgttaaatagttttagttggcatttttctgattatgactgcctttgaacattttttcctgtttattactcactagtttttcagttaccagacatatcctttgtacatttttatatttgtacattctttttatgcttaattgtacatagtctttatataatagggattgtatcactttgttagtcatgttgcaagaatttaccctgcatgttttaaaattcagtgtgtggaattaaaaaatttctaatatacgctgggcgttgtggcttgcgcctgtaatcccaccactttgagaggccaaggtgggcggatcacttgaggtcaggagttcaagaccagcctggccaacatggtgaaaccccatctctactaaaaatacaaaaattagctgggcatgatggcggatgcctgtaatcccagctacttgggaggctgaggcaggagaatcgcttgaacctgggaggcagagattgcagtgagccaagctcgtgccactgtactccagcctgggtgacagcatgagactctgtcacacacacacacacacacacaccaattttaatatatagatttttcaaatttttatatagtgagtgattaattttgttcatgcattctctctttggtattacaaagtccttttccatttggaaattattgtgtttgcctattttaaaaaaattgtttcatttattttacattggactctttaattcacataggtcttatattgccatattgcttagagtagagagctaacattatttttctagcagtgaccaattattcaagaagttgaacacttctttgttctctgagtcaaattgctagttcccctcatatattcagatattttatatgtaggctttctgtactctttcaatgaatgccctgcttcctaatcgtgcgcaagtagtggtattttaagccctgcaaattcatggattgttttaatatatagtatcagtacttaaaaaaaaaaaaaactttgattccattaaaaaaaatcttggatatttttcccctttccatcttccaaatagcttttttagtcttgttaatctcattcttgttaaggttcaacaagaattttcttataattttgaaggagatgacattagacccatttgggagatttgatatttttacataattattctcatccagtaacaaataatgtgccaccctttagtggtgttctttcatgttcttcagataaagttttgtatagaccctgtgtcagtcttgttaattactagatattttatatatggtgatgtttttgtgaatgggatcacaaaaatgcagcatttttattgagatataatttatgtaccatgttttgtgcttaatttcaaagctaatgtaactactaggcacagagcatacatactaccttaataccatttatggttttctatttcttcttttcaagggtgattctgaccacctattgatgcgttttttttttcaagacaggaagcaggattatctaatgtggagatctctgaattaggcacacagaaacataagttctaacttcgtcctgctttgtcatagctgggtgtttgatcttaggcaaatcacttaacctctctggacttttggactttgtttttctctaaagttctttctagctccgtatttctttttcttttttgttttttttgagatggagttttgctcttgttgcccaggctggagtgcagtggctcgatctctcctcactgtaacctccaccttccggtttcaagtgattcttcttcctcggcctcccaagtagctgggattacaggtgcgcaccaccacacccagctactttttgtatttttagtagagatggggtttcactgtgttggccaagcttgctcgaactcctgaccttgtgatccgcccacctcagcctcccaaagtgctgggattacaggcgtaagccactgttcctggcctagctctatatttctaagtatataatggccctcaaaatatttgagccttagagtttgtattctagaaagagggaaatcagaatttacatggtatcatagccaggcacagtggctcacatttgtaatcctagtactttgggaggactgcttgagctcaggagtttaagaccagcctaggcaacatagtgagatcctgcctctacaaaaaatttaaaaattagccagatgtggtggcatgcacctgtggtcccagttacttgggagattgaggcaggaggatagccagagcctgggaggtcgaggctgcagtgagctatgatcgtgccactgtgccccagcctgggtgatagagtgagattctgtctcaaatataaataaataaatgaataaatggtagcatagcaaatgaaatatcatagcagtgaaattttgaaatatattttgtgttttatcctctgttagctggtatagactcagtttggcattttaattgttcagaatattgactttgtttcctgagtctatcaagcatgattcagaataaagcatgacttcactctgtaaggatgtgtcacccctctattttagatgtcattttaacacttctgaggggaagaacacgtttttattttaaggtttatttttataacaaatgacccaactgtagtatttttgaacctggtggcattttaatattagctgtttccttcctattgatgcaagaaaagcattcacttaaatctgaagtgaaatctgcagtgtaatttgaaacctgaaatgcttattgattatggtaaagaatggaaaattaatgactttgggaatctatgccacagtcaaattgagcagagaatgttctcctggtagggtgctttggatgctaacttctattagctgctgctcatttctaccactaaatatctaacaacactgttctcagaagtaactgaacttgcagaaatagctcatgaagtcattttctatttaaatagtctgcactttttagaataaatactctttaactaggatgatattaacgtatgtcttcgacagcaactgcattgagaagacagcctttgcaaaacactcttgtcccccatccaagtatgggtcttttatgacagattgttgtgtatctgaggaagctattgtgtcaacaatgagcatcataatgagtctaaaaatctgactcaatggaacaaatgcattttaatggcatgcattttactttaaaaggatgtaccaaaatagagcaagagtctgaaagcagggcattattttataatgaaagactaatatatgggtagttcaaactaaaggaagagtgtgactgggaatgaaaattgacttagggtggataagatcactcccatcagcaaaccacaaatgctgggggagagttagctgaagtggtacaggagcgaaaattaaagtggttaccaacacccaggaatgtcctttactgagatgctgacctaagtgggcagatggcttcctatggcactcttcacaggctggcattgcaatatcacatttactcactttaccaaaatgccatgaagttaatgctggaataacctgtttcttttcatgtttaaattctacttattaagtgtggtgtaatattgaggggaaaggagtaagtttagagactgagataaatttctaacatgtttagaatagcgcttaagggccgggcgcggtgactcacacctgtaatcccagcactttgggaggccaaggcgggaggatcacgagttcaggagatcgagaccgtcctggctaatacggtgaaatcccgtctctactaaaaatacaaaaaaaaaattagctgggcgcaatggcaggcgcctgtagtcccagctactcgggaggctggggcaggagaatggtgtgaacccgggaggcagagcttgcagtgagccgagatcacaccaccgcactccagcctgggcaacagagcgggactgtgtctcaaaaaaaaaaaaaaaaaaaaaaaaagaatagtgcttaagtgtgtatctttggaattagggtcccaactttgcaatattgaggtggaagttatgtaataatattttgtttggtattgacatcaccatacttctgtaattgatttttaaagactgtgcattatttgtttttttgttgttgttgtttttttttttttttttttgtgagacggagtctctctctgtcgcctaggctggagtgcagtggtgtgatcttggctcattgaagtctctgcctcccaggttcaagcgagtctcctgcctcagcctactaagtagctgggattataggcactcaccaccacacccagctaatttttgcatttttggtagacggagtttcaccatgttggccaggctggtctccaactcctgacttcgggtgatccacccgccttgtctgggattacaggtctgagctaccatgcctggcctatttgtattttttgaaagagaacttgcaatttgtggaaatataccatagtacattttctgcatttatattattctgtttattatattggaaactctgcacatgtgcacttacatactaaaaaaattaggcatgaggccgggtgtggtggctcacgcctgtaatcccagctctttgggaggccgaggagggtggatcacaaggtcaggagttcgagaccatcctggctaacacggtgaaaccccatctctactaaaaatacaaaaaattagccgggcatggtggcatgtgcctgtaatcccagctacttgggaagctgaggcaggagaacctcttgaacctgggaggtggaggttgcagtgagccgagatcacgccattgcactccagcctgggcgacagagcgagactccatctcaaaaaaaaaaaaaaaaaaagtgatgtcaacctgggtttttaaaaaaattactgtctgtgatgatccatatgttttttgtattacatctgctgactaaaaagagcaacaactctattctatcagaggcctcttaggccaaacccgtttggccagatggaatagagaaaactgtaagaagaatgtgagtattccattgtcgcataagacattttattttctgggcaggatttcctgttgaccccaattcaccatttatgtctcttaccatctcctctttcctgctttttctgcctgcaatgttgtttcagatttcttttgcaaattgccaacttcatgcatgcatggtgcagttcttttttccttccctcagatgcctccttttggctattggcagccttgcatagggcaaggatgccttttcagaaatactgtgtgattcacaacttcttggggtggaagtctgtgaagagataaataactgtaagaatgagaataagtactactaattgaacatggctgtggtgggtaggtggatttgtatgcatagtggcctcctgaggaaggtgccttaccctgacatgcaatcctaggtgccctttggcatgaagcatccgtgtggtttacaagtttaacgcagaacaggagctccaaggatctgaagggcggtaaagctaaatgcacatttcctagtcttctaggctgaggagagtatgatcttctttgagaaagtcatagggtgggtaaaatgctactttgcaagaggtacatgctcttagagcactgttgtatgctatcagtccaaccatgttataaactatttaggaaaatggactgtatcctatctacctctgcattatctgtgaaacagtgccttccgttgaagcacagatagctgtggctgaatgaattgagcagacattcaaatgcttgttggatgtgagggaaaaattaaggaaacattccctctccattccaagttcccaaacttttcattcgtctgtgttctgttattttctcccactgaaaaaaagcctggaagggacagatgatacaaagaagacattcttgtccattggcatgtgagaaagaagggcagaggttaaagagggaacagggagtcaagctttggggctaaagaggcgtcctcaggctagtaaggtggatggggagcttgtggggagggaccatcagtgtgggggctgccctgggaggtcatgtctagttccacgtaaagccccagaagtgaccttctgggtctttacccatggaattccagactatactgcagtgagaagaaagacgtcttttgttctttggctaactgtgcattccagactctaatttggaaaggccagatctgtgagtgataacagggtccatttaaggaaaaggcatctttgttgaaaatggaatagggcaagggtgaaaaggtggggcgaggcagatgtcagttttgtgtattgcagtattccattatctaaaacagtgcaggcagatagtaagtgcttaatacctagttgttgaatgaatgcttgatgacgatctttgaggtattatttgctataggagtttcagtacaggagtattttaaggagatttcagagtgcccttggaagctgctggtaaagaggaactctctagcaaggtgaccaggttagacacagaaaaaaatgcttctggtcatggtcaccccttcccaggctaaaagtactcattggcaccaggaacccttccctatattttaaaaaatattatagcccataattttgcacactaaatttggctttgttgacattggcatcaggtaactcaatctcttttcctttattttattttattttattttatttttttttgagacagagtctcactctgtcgcccaggctggagtgcaatggtgcgatctcggctcactgcaacctcctcctaccaggttcaaacaattctcctgcctcaacctcctgagtagctggggttacaggcatgtgccaccatgcctggctaattttgtatttttagtagagacggggtttcaccatgttggtcagcgtggtctcaatctcctgaccttgtgatccgcctgccttggcactctcaaattgctgggattataggtgtgagccactgcacccggcttgaagctgggaggcagaggctgcagtgagctgagatcaatctctttttctaaggcattgcacacctacacatgtgtaacccaggagggtggcacgggaaatatttccaacctggagacatcgtagagagaggaagtgctccttcaggaggacaaatggaaacatctgctgcagcttcttagcactctcctggcttaccttttcagttgctcaaccctaaataaatttgctcaaccatagacatcagggcacactacgggaacattatgggcatggcatttggcaagcatttattcacagttcacaaatatggattgaaccccgactgtgtgttagatagtctcctggatttgtgggctgtgggtatgaataaggcagccaccctccctccttagggcacaaacagaattaacttattcttctccaggagaagtaagctcatgataagaaaccaaatttatgaattacttatttttttgctaggctccgtgcaaagacactttgcataccttaattcacttaatactcaggaaaaccctgtgagaaaaattttagagctgtggaaactctcagcctttgaggatttggataacctgcccaaggccactttgaatctaataaatgctccttggtccaatcgaagttgcttctcactattacacaccctacactcctataagatgctaatggaattgatcctgccatgctctaggtgaggggaagagctgaaatagcagagtttaaaaatctctacaccaaagtccatctctgctactgtttcccactgcttccttgaatggttgggtacatacttgtctgggccacattgctttctctttatgtggggcttgtttggaaagatctttgttttcttgagtccctggttaccatcagtcatttttcatagaaatacaaatgaattagcctgatgtaaaggaaggattcttattttattctcggaagaaaaccttggaacttaaattcaaattttctttaaatcattaaaaatgaatgagatcgttttcatacctcctaaaatatattgtttttctttttaagaatttaaagttgatcttatctcaccttattgcatttctctaaagtaggttctggcacgaatagctataagtgcaataaattgaatgttttgaccaactaataaaatggcaaaaatcactagcagaaaacatataccaagagagtattttctgtcttcactactctacagatacctctttctaaaaaaatttattttacagtggtaagaacactttacatgaaatctatctttaacaaatttttaagtggacaatatggtattgttgactatatgtacagtgtcgtctagcagatccctagaacttacttatcttgttgaactgaaactttatacctactgattagtaactcctcattctcccttcctcccagtcctaccattctagtctttgattctatgaatttgaatatttttggatacctcatataagtgcatttatgcaatatttgtctttgcgtaactgggtatttcattgatgttggctcatattgcagaatttccttctttttaaaggctgaataatcctgtatgtgtgtgtgtacaccacattttaaaaatctattgatcttttgatacacatttaagttgtttccatatcttagctattgtgaataattttgcagtgaaaatgggagttctggtatctctttgagaccttgatttcaattcttctggataaatacccaaaagtaaagctgggtatggtggcttatgcctgtgattacagcactttgggaggccaagacaggagtatggcttgagaccagggattttagaccaatctaggtaatgtagtaagaccctccctctacccgcccccccagaaataaaaattagctgagagtggtgatgtgtacctgtagtcctagctactccggaggctaaggcaggaggatcactggagcccaggaaatcaagggatggtgccgctgccctccagctagagtgacagagcaagaacctatcttaaaaagcacaaaaaacaagcagcaaaaaatacccaaaagtggcattactgaatcatatggtagttgtatttttaattttttcaggaacttactgttttctatagtggctgtaccattttgcgttcccaccaacagcgggttccaatttctctacatcctcgccaacacttgtgttttgtatttttgataatagccatcctcacatgtataaggtgatatctcattgtgattttgatttgtgtttccttgatgattagtgatgtcaaactaaaaagcttctgtcctgtaaaggaaacaatcaacagtgttaaaaggcaacccatggaatttggagaaaatatttgcaaaccatatgtctgataagatgtgaatcccaaaaacatataaagaacccttacaatgaaatagcaaaaagactaataacctgattaaaaaatgggctaaggacttgtataggtatgtctctagagaagacatacaggctgggtgtggtagctcacacctgtaatcccagcacattgggaggctgaggcaggcggatcacgaggtcaggagttcaaagaaaagcctggccaatatggtgaaaccccatttctactaaaaatacaaaaattagccaggtgtggtggtgcacacctgttgtcccagctactgggaggctgaggcaggagaatcacttgaacctgggaggcggaggttgcagtgagccgagatcacaccactgcacttccagcctgggtgacagagcgagactctgtctcagaaaaaaaaaaaaagaaaaaaatctttattcctattctttaggtgcaaagtcacagatacagtggtgcttcattcaaactcaagttacacctgagtgccttcctcttgagggcgtgacatgccacacttaatatacctctccaaaaacatatggcttgatttaggtattgttaaaatagctccactgtatactttgtttcactggaattaaaaaggaaattgtcttgctcacacaaaagtgcaagacaaacagttgagtgtctgtgtattattgtcaaatagaatggatgtaggatgtaagttttagctgcgacgcactctagaatgcggaattccccttgcaattgaaaggatatggagcgtcctttcgaggactgcctcacatattaaatatatatcttgttttgtctggggactgctactcaggactctgccatctgtagtgggtggcaaccaaatctcagtcttgaagaattcatctgttaattttctttcttcctctgacttgatgataccattgtggttacttctcctccctctccaatcaataacatctcattttccattattacatcttaagtatattgcaattgttgcaagctgttacattttcattttggaaatgtgatggttggaaaaaatcacccatctgatgataaagaaaaaggagtaggagtcaagtcctccaaatactgactgtcttttggatgacttagttcttaaatggaagagcaactctacctgcatacatttcgcagtgttagctcacccagccatacccttttatagatgaagaccctggagcttggggatgaagtcacctgcccatgtggggtgaatgtagctcccagagcccggagtcctcattccactccacctacttcttttaagctttacatttgaaagaatatcaggattttagaagcagtgtcttatttctctttgaatataaggaaagatgtgtttgacaattaaaatcacccagaattttcttttcttttcttttttttttttttgagacagacttttgcttttgttgcccaggctggggtgcaatggtacgatcttggctcactgcaacctctgcctcccgggttcaagcgattctcctgcctcagcctcctgggtagctgggattacaggcatgcaccaacatgcccggctaattttgtatatttagtagagacggggtttctccatgttggtcaggctggtctctaactcccgatctcaggtgttccgcctgcctcggcccctcaaaatgctggaattatagacgtgagacactgcgcctggcctgaaatcacccagaattctgcactgcttttctttacccaaatgttggagtggcaggcctcacacaatgtctggagttgggtgacaaattagttttaacaaatggaagaaatctcccgaaaggtaatttcctgcaagtctctttgtgttagtgtttttaatgctttggttgttctttaatggaaaacactttttttgtgtgtgtggggtagggtgagggatggttctagctttttaccaatgcatttcaaatttagaaaaaatagaatagttcatgtgtgaaaagttgtgtgggaacctttcttggaaagaaatttaaatgtttaggaaatgtgttctaaattgcaagaagagtgtggtttaagactgcatggcctggtgggattgtgcaatgttgggaccagggtacagctcaatctagtctgggattacccatgggtgagcctgccatggggctaccctctccataacggcatgggctcaggggtgttggtgggaggatggggatgggtgtgctgaacttccccttcctcccatccccactggcttgtgccctgcggccagtggcaggcagtggtggttctggctggtgaacacattggaggaagagcagaaattcagtactcgggacacattttttttagggaagcgtgtctttgcaatttgagttataaatgcaaaatgagaggccaggtgtggtggctcatgcctgtaaagccaacactttgggaggctgaggcaggcagatcacctgaggtcgggagttcgagaccagcctgaccaacatggagaaaccccgtctctactaaaaatacaaaattagctggatgtggtggtacatgcctgtaattgcagctactcggtaggctgaggcaggagaattgcttgaactcgggaggtggagtttgcggtgagcggagatcacgccattgcactccagcctgggcaataagagcaaaactccgtctaaaaaaaaaaaaggcaaaatgaggggccgggtgcgatagctcacacctgtaatcccacacttggggaggctgaggtgggcggatcatttgaggtcaggagtttgagaccagcctgaccaacatggtgaaaccccatctctactaaaaaattgggccaggcacggtggctcacgcctgtaatcccagcactatgggaagtggaggcgggtggatcaggagatcaggagttcaagaccagcctctggccaagatggtgaaaccctgtctctactaaaaatacaaatattagctgggcgtggtggcaggcgcctgtaatcccagctactcgggaggctgaggcagagaattgcttgaacccaggaggcggagcttgcagtgagctgagattgcaccactgcactccagcctgggcgacagagcgagaatctgtctcaaaaaaaaaaaaaaaaaaaaaaaaaagctgggtgtggtgggggggtggcacctgtaatcccagctactaggggaggctgaggcaggagaatcacttgaacccaggtggtggaggttgcagtgagctgagattgtgccactgcactccagcctgggcaacagactgacacttcatctcataaaaaaaaaaaaagattggaaatgagggttatttccctttgcaaggcacaatactatactcttttcacaacaaaatgacgaggaaaagagtcaaactctataaaatatttaaagaggtttattctgagccacgtatgagtgaccgtggccccaggcacaatctcaggaggccttgaaaacatgtacccaaggtggttgagttacagtttggttttgttttagggagacataagatatcaatcaccacatgtggagtatacattggttctgtctggaaaggcagcataactcaacgtggggacttacaggtcataggtgaattcaaatattttctgattagcagttggttgaaagagttaagtaattatctaaagacctgaaggagtgtttgggttaagataaggggtggtggagaccaaggttcttattatgaagtctcataggtggctgccatcagagacaatagatggcaagtgtttcctattcagaccttgaaagatgctagacttagttaatctcttcaccgttgagagggtctggaaaggggaaggacccagtaatgttagtagaggttctttacagatgcagtttctctctctctctctctctcacacacacacacacacacacacacacactcacacacacacacacacacccacgcgcacacacacacacacacaccggctttgtaggagcatttcaaaatatggcaaggaaacattttttggttataaaatattttgatttccttccatatctgtcatgtgattttatgccagagtcaggttggaaagtaagccaagttatatagggttaagtaaaacccatgggatgagattttatggtttgtagggtgtgactccccaggtcctttagataagaatttgggcaagagaggaaaaaggtcagagtttagtttgcaaaagaaaaatcctcaggtgaaggttatgccccaaaggaatagattgaactgattgtagtaatggggccaattttgtaggcatccattactttttttctctctcttctttccctgcctccagctcctttaagtctattctcttttcttgagtcatgatttggctccgtttcccaggctagagtgtagtggtgcaaccaagacacactgcagcctcgaattcctgggtgcaagcgatcctccccattcagcctcctatgtagctgagactacagttgtgcactaccacacctggcttcttcacgtctgttctattaacctatgaaggcaaaaattgatttttgccttcataatatttctgtgtgtttgtgtacattttaatataaatgatatcagatgcacctgtataagttttcatatggctgatgtaacaaagtagcacaaatttggtggcttaacagaaatgtattccttccagttctggagggaagaagtccaaaatcagtgtcactgggatgaaaaggtgtcagcagaactgtattcccaacaagggctctattgaaggattggttccttgtgtcttccagcttctggtggctgccaacattccttggcttgtggctgctgcactccaatcttcaaggccagtgtctgttcatctctctctgctccaccttcacattgccttctcctgtgtgcgttcatgtcaaatctccctcccctctctcataatgacacttgcgactatgttaaggtaccatccaggtgacccatgataatttccccatccaaagatccttaatttaatcacatctgcaaagatcttttatccaaataaggtagtatttatagaccccagggattaggacctgatgcctttggagcctctattcagtctcttataatacctattatgcaacttgcttttcttgaagtccacaatctctcttagagattttttttttccatattggctaacatagaccttcttcactcgatgtcattgctgtagagtgtacccaggatgggtatttcatattttgtttttagtttattaaattgatgagcaatgttttgtttttattttttccattacagacatgtggcaatgattggggaaggggctaaagtgatacacactgattgatagtatttgttacatctcatgggtacgggatgagtccttcagaataatttcctggccgggcgcggtggctcacgcctgtaatcccagcactttgggaggctgaggcaggtggatcacctgaggtcaggagtttgagaccagtctggccaacatggcaaaaccccatctctactgaaaatacaaaaattagccaggcgaggtggcagatgcctgtaatcccagcctcaggcggctgaggcatgagaatcgcttgaacccgggaggcggagtttgcagtgagccgagattgcgccattgcactccagcctggtgacagagtgagactccatctcaaaaaaaaaaaaaaaaaaaaaaaaaatcctggctacttccagagttttcttgttgtaataactaaacccctctcctggtccttcctggtcatcctgatggctggtgttgaaacgtaggtgaaatactcaccagctgtctggccttaggcattaacctctctctcagtgcctcgggtgctgggcgcttagtctgtaaaacaggtatcatcatagcatctacctcctgggttctcaggggttttggaggagttaatatatctaaagcattcaaaacccgccaggcacacagtgggtactttactagtgttagtttttgttgttattgttaacagctcctttccccacccacgcccaaggaaaaactctcaaatagctggcatgagtatggtcatccacctcagtagcctgcctgtctgtgagggcctcctccctcagtgagcggcttggtcctactcccctgggctcctttctgctccctttcctcccactgttgagtctctcttccctgggattaatccaccaaccatttcgccctcttctgtgttttagcttcatccctacccacttttcttctccctctgttgcttccttccattcctttttttttctggagacagagtctggcgctatcttggctcactgcaacctccgcctcctgggttcaagcgattctcctgcctcagcctcccaagtagctgggactacagacgtacatcaccacaccctgctgatttttgtatttttagtagagacggggtttcaccatggtggccaggctggtctcgaactcctgacctcaggtgatccttccgcctcggcctcccaaagtgcttggattaaaggtgtgagccactacgcccagcctcctctctctttcttccacctttttgttttaccttattcctcccgccactccccctcccccttttattattaaagcagcttaaacaatgggacaaaggtcacattctattgtatttctagagggatgacacctagctagattgtgtgactagaaagactgaaaatttccaacagaaggaatagcaagcaggctgagaggaccggaaaggtacctaaccctaaagcttgtgtaaagtagagtgataaaaactcacagaaactaagttgcctagcacagttcagtagtgaaggcagtctttatggcaggagggtaaatagaggtatttaagataaaagtctaaaacacttagattttgcttaatgatgtcaaagaaatgttcttaattttatggaaaaactgttttttaaatcctagaaaattctacctaattcttttggtgtgtacatgtgtatgtgggtgtgtacagacacaccttcatattttaaaataaatttactgtgaacttcctagctttattttatattttattttattttatttttgagatggagttttgctcttgttgcccaggctggagtgcaatggctcaatcttggctaagtgcaacctccgcctcccaggttcaagtgattctcctgcctcagcctcctgagtagctgggactacaggcatccgccaccatgcccagctaatttttaaaatatttttagtagagacagggtttcaccatgttggccaggctggtctcgaactcctgacctcaggtgatccgcccgcctcggcttcccaaagtgctgggactacaggggtgagccaccgcgtgcagcttattgtttttattttttaagacagagtcttattctgctgcccaggctggagtgcagtggcatgatctcggctcactgccacctccgcctccagggttcaaatcattcttgtgcctcagcctccctagtagctgggactaatttttgtatttttagtggagacgggggtttcaccatgttgaccaggctggtctcgaactcctgacctcaagtgattgacagcctcggtatctcaaagttgaacctgctaactttcaacagtgtatattgttaatttaggggatgttttaattccaggtacttaaatgttcttgtgagacacaatgtatcatttccgaataagcccttttcttttttctgattcacttttctccaaatttcccaaatttgctaataatagaggtgagttaaactggactctagcattctgatgtgtttgttcaagatctggttcgcagcttttgtagtcaactggttttgtgtgacaaagttctgtatgcttataaaagttttaaaatcatttcataattggtgatgttgtagaaaaaaaccaggttcttgtcacacaaccaggagaagtttggcacgcagacactttgaagggtgagggggaatggaatggtgaaaaggcaaaaaaaaacaaaactgctcagcagagcgagaggggttccagttaacaggccctcatctcacagattgaatctcaggtccccacccaggaacaggagaggcctgtctccttccccctgcaaacggcctgaacttcctgcggctccaccctatcctcccagtgcacaggcaggtgggcgattacgggggtggtggggagggctcctccttatcttcgcaggtgggagattccggggcggggcggggagggctcctcctcatattggcgggtgggagattggggggggtggggggaagggctcctccttatcttcctcctgcatctatcagtgaagacgctgaggtttgcaattgtataatatccaggtttgcaattgtatactgcagttgtataattgtataatatccagagttgaaaataaaaaaaacaaacaaaaaaagctacagtagcattcccttttttttttttttttttaactttgagatggagtttcactcttgttgcccaggctggagtgcaatggcacgatctcggctcactgcaacctctgcctcctgggtttaagtgattctcctgcctcagcctcccaagtagctgggattacaggagcctgccacaatgcccggctaattttttgtatttttagtagagatggggtttcaacatgttggccaggtgggtcttgaactgctgacctcaggtgatccacgcgcctcggcctcccaaagtgctgggattgcaggcgtgagacaccacacctggcatcattcccttttaaaatgtcagctaggtaataatcttttcttttcgaatcaagtgggggtttcactaagaagggtagagtattatttctatgtgaggccaggaggctattgttgggtccaagaacaaatgcttagagataagcttgttggcctctcacggtgttgtgagagggttcagagtagacagacatgtgtcttcccccttttctgtcaccttcctttctgcctacaatgcccgtttttgatatccagctggtgagagtggataaataatttgtatcatagtgtcagcctcctcagaaacccataaagatttctttaaggatttggatccgatatctttctgaattaggccctaaattattatgaatgtgaacctaggttatatgtcttgcctgtggtatgtgtgctgcgatactttgaagcagaatgatttgtggatcattttaccagtcctttctcttttttggtcaaatgcagatggcatggaggaaatggaaagttctaggcatttttgcaaccactactatataactcttatggaccggataaatttagtagacaaagtaagtggttagtttcttggacctcggttttctggtctgtaaaatcaagagatgcatcaaagtttctttctagctttaaattctgtaattctttctttgagaattgtgtagcatgtataatgtttatgggaagtaaagtttaagtcactaaaaagaggcagaaatcaggttatcactcacagggctgttttttcagcctagtctctgccaatcctaaccttgttaaaactacaatgtggcaagagatgatgtcccattattatttctttcactcgagaatgcttcagctatatagatctatcaaagcagttgttacactggtgagtttccccatatccatcagaagaagaaaatccatcacacttttgactactttttcctctccaagaaaatgatctttaagagaatgacatgtaatatagactttactattcttgaggcattggagaaactgcatctgaaataaaatcaatacatgatgcagtggtgtatgtacatttcaaatattgaatggcaaaacattttatcaaagactttgggactaaatacccgtcgcagacttacataaagtaggatagaatacagtagaaatacgagtgtacctcctgtgtatataatacctagtcgtggttcagttactccatatatctcaactacactaacagaaagaggtagactcattagaggttaagaaaggtagacattagggctggtatgtttagaaatttgttgttcttttttttttttttttttttttagagttccatcccataatctcagtttaagttataatgatggttaccaggcaacttagaggaacaaaagcacagtcttagccttcatatttctagctgaggaaagtagacaaataaaacagaattctgtctcagttatgcactgagtgtgtgacgtgtaaccttaatctcttttttttttttttttttttgaggtggagttttgctcctgtcccccaggctggaatgcagtggcttgagctcagctcactgcaacctccgcctcctgggttcaagcaattctcctgcctcagcctcccaagtagctgggattacaggcacctgccaccacgcctggctaatttttgtatttttagtagagacggggtttcaccatgttggccaggctggtcttgaacttctgacctcaagtgatctgcctgctttggccttccaaagtgctgggattacaggcttgagccaccgtgcctggccccaaatctcttaaccttcctggatttggtccttgaaaccagtaattttaaattactggctaaattaattaaaattactggttaaattaattaaaacaaatggccaataaagccaaacagacactgagtcttttgttggtgtaaattcctttacacatttcataatgtcttctatgatattggtttacttttgggaattgaaacctttacagaaaactatcagtttcactaagattttaccatgaaattatatattagatcatcttcatttatttaataaagtgttaaacacaaagttatttctaattttatttgggttttctatgttttaaaaattaagactgcgtattctttccccgacaaaatccagctctgggattcattaatgtattcgaatattttttggttttctatttacttttcaatatgatcttttttcatttaatatgatctatcattttatgatattccaatggcctcttttgggtataaggtggaatcacattcacaggtcagcctgagatccaccggctgatagccctgccctggggccagcagacccttggcctcctttgtagttctttttcttcttccttttggggaaggatgttagaacggactggctttgatgtctgtcaggctgtttgctgctcatggtctcagggtttacagccaccatcactctgttggcttcaaaaggggctactctggccaggcacggtggctcacacctgtaatctcagcactttgggaggctgaggtgggtggatcacaaggtcaagagatcgagaccaacctgaccaacatggtgaaacctcgtctctactaaaaatacaaaaaaattagctgggcctggtggcgcacgcctgtagtcccagctactcgggaaactgaggcaggagaatcgcttgaacctgggaggtggaggttgcggtgagccaagattgtgccactgcactccggcctggtgacagagcgagactccatctcaaaaaacaaaaaacaaaaacaaaatacacacacacgcgcgcgcgcgcacacacacacacacacacacacacaaacaaaggggctactgtcccgtttatcactgtagtccaagtttggacacagacccttctcatagttcctcaacgatttctaagataaagctataattttggtgttttttgagacgcagtctagctctgtcacccaggctgaggggcagtggagtgatcatagctcactgtagcctcttcctcctgggctcaagccaccctcctgcctcagcctccctagtagctgcaactacaggtgcactccatcatgccaggctatttttttttctttcatttttttgcaaagactgggtttccctatgttgcccagggtaagttatagcatttaacatagctttattaaaggtatagggtaacaggagagaattatagcatacagagtaacttgtgaccagatgtgagatgattattttcggaatttataggcccaggccatctgcatggctttaattttggattgatctgctcccaggctctgcctgctttccatggaggtgaaagtcagtattccccaccatgtctagactcctgagaatccagactaaagtctcacttgtctcggagaaaaaaagtagagtttctccttcagtctaaggccttttttttcctttcaggatctaccgcttttcaggatgactaatggaaagaatactcatttccttcaaagataatttcacagtttaggagtgttattagcttaattcatagccctagcgagacccctatgtaataccatggtccgtaagtttttagctttgagtacacattctcaaagtacacaggctttgagtgattcatgaaacccgtgaagctgtgtgcagatttctggccacatgcctttttctcgggagcagatccatcgccctcatcagattattaaagtggtctagcatctccccagaagattaagaaccacttaagtaggtccagcaaccggacattggttcaagtgtggattagtcacgtagagcatcaggggtttcttccaggtagggcttcacttagagtccctcctccatcagcaaatatagatgggttttcacatcttctctccatacatttatctctgcttctgatccacaaataagggctgaaatgcaggtatctccagagtggtttgtaggaaccatatggtccaaatccattcttggacaagaagcatttctccagagttaacagagtctgcagagatgtaattttgcctaggctttacagctgtggtcttgtaacaatctttatttcataagctctttgcataattaaactgcctattcggccagtcttcctaggatgaagaaattgtctctacaaagtaagtagtattcagtttctacaaagagatagtcttttgccaaaggatatccacctcactgtggtttgaaatgtactattaggattttagagatcttaaagccaagatttagctaggtctaaattttttttattttttattttacttatttaagtatttattttgagatggagtatcgctctatcgcccagactcactgcaacctccacctcttgggttcaagcgattcttctgcctcagcctcccgagtagctgggattacaggcgcacaccaccacacccggctaattgttttctagtagagacagagtttcaccatgttggccaggctgatctcgagctcctgacctcaggtgatccacccgcctctgcctcccagagtgctgggattacaggcgtgagccacctcacccaaccctaagtctaaattctaataatcacctatactcctttctctcagcagcctttgccagatggaaacttctctgaggtacctgccccaggacttggagtctaggggagggatgatggcaatgaaaggtttcttttctcctgtcacatcttgctccagacgtcatcttgtctcctgttacacttggatctcaggcatctatcctggcttgatgttggagtcccccaggtgcctcatagtcccctggacactggcagggtcacctttcttttctgaaattgcagggcagcttgatgtacattgtaatgaacccaatttatgatgcctggcaatgcatttactaagtgccatttatctttttgtgtgtggaacgcattcagtcttctaagcaatgcctggatgttcattcatgtctggacttcaggttaggcatgagggtgaggtaaagtcatttgcaacagggttgcagctttcgaaattggggacgtgactgggcgcggtggctcacgcctgtaatcccaacactttgggaggctgaggtgggaggatcacctgaggtcaggagttcgagaccagcctggtcagtgtggtgaaaccctgtctctactaaaaatacaaaaaaattagctgggtgtggtggtgggcgcctgtaatcccagatactcgagaagccgaggcaggagaatcgcttgaacccgggaggcggaggttgcagtgagctgagatcgggccactgcactccagtctgggtgacagagtgagactcctgtctcgatctcttgaccttgtgatctgcgtgcctcggcctcccaagtgttgggattacaggcgtaagccactgtgctcggcgagacgctttctcaaaaaaaaaaaaaaaaaaaaaagaacaacaaaaaaaaccaaaaggccaggtgccatggctcacgcctgtaatcccagcactttgggaggccgaggcgggaggatcacgaggtcaggagatcgagaccatcctggctaacagggtgaaaccccgtctctactaaaaaaaaatagaaaaaaattagccgggcgtagtggctggcgcctgtagtcccagctacttgggaggctgaggcaggagaatggcgtgaacccggggggcggagcttgcagtgagccgaaatcgcgccactgcactccagcctgggtgacagagagagactccatctcaaaaaaaaaaaagaaagaaagaaagaaaaaaaaaaactggggaccaaggcaaatagtcttgaggcctactaacataaaagaataatcagagtcttgtgtagtgatgcctgcctttactcccagctactagggaggctgaggtgggagaattgcttgagcccaggagtttgaggctacagcgtgaatataatcgccactgccctccggcctgggcaatactaatgagaccttgtctttaaaaaaaatgttcaagaagggcttttgactgggtctctttttctgcctctgctgtccatgtctcagcataatgttttagtttgaaatgggattgctcttttttttttttgccttcatcaactgtttttctatctcgtgtggttttccttgttagaggtggatgctggggctttgaaaccagtctgctgagtggtttctaatattactgttaggcatgggaaaaggaaatctgagggatgtgaatttggatcactgacctggcaggttgtcagttttctcagggtgacgtagtttcttgcttaggtgccatcagcgaaggttaagaaagtcctctcacttccatccctcatgaaggaactcaggaggtgattacaaaacagtgttgctgaatctcaccgcaattagtgcaagggtagaacatgtctccaggttatgatcatggctccttcctctctttgctctccatgatcagatttccccctctattgctttgttttgatgggtattttacaggaacccgggagagaacagtctcaggatatgtactatggtaccatttcacctccaatttagaatattttaataagtgatgattttacagatttgcaacttgtgatcatttattcattgatagagaatgctagccaattaaaaacagcaactttcctagtgtcttagagtttgaaatttcacgtgaaggaaatataaaattaggaagtatctaataaatagttgaaggtcttttagtttgacatcaacttttaagtgtatcaattattttattgtagaggatttgctcatccttttgtgtactattaatattaaatatcccactttggactagatgaaaataattattttacaacattattaataccttagtttaaaacatagagtatgtaaagaaatgtgtgatgataaaccattttgtaatttatttatttatttaatttttgaggcagagtttcgctcttgttgcctaggctggagtgcaatggcacgatctaggctcaccgcaacctctgcctccagggttcaagcgattctcctgcctcagcctcctgagtacctgggattacgggcatgcgccaccacgcctggctaatttttgtatttttaatagaaacggggtttctccatgttggtcaggctggtctcgaactcctgacctcaggtgatccatccacctcggcctcccaaagttctgggattacaggcatgagccaccgtgctgggccccgttttgtaatttagaccttcactaagttatactgtcttccctcacccgattgccctgaactagtaccattgtaatctctgttccaaccgtagagacagtttgcagaattttcagggctgagccgcagttctggcccaggttcctgtggatgctgaggtttccgctgacttccaagatagcacggaggtgggggcgttgtgtcctatgctgcgttcaaaagctgagcttccgttgccttagcatttcgctaatggcagctgtgctgtgtgtctttattgcaggtgctttttcctgatatttgtttgagctgttggtgttcagccttggtcatttagattcttcttatctccctgttatcatggtgtttagtttagtgtgtgtttttttgttttgtttttgttttttgtttttgttttttttgagatggagtctcactctgtcatccaggctggagtgcaacctcagctcactgcaacctctgccttttggcttcaagtgattcttctgcctcagcctcctaagtagctgggtctacaggtgtgcaccactatacccggctaactttagtatttttagtagagatggggtttcgccatgttggccaggctggtcttgaacttctgacctcaagtgattcacccacttcagcctcccaaagtgctgggattacaggtgtgagccaccacgcccacccctcttttttttctttttcaaatattctttcttttcctcatagctgcactttgtaatgcatagggttaataaattgttattagatctccctggccaagcttagaatagagcaaagagtcactgagagctagatgtgtagacaggggccttgaaagttttggtgatttgctcaaggtaacccagcgggtgggtggtaacagagctgagactgctgggagctccttttcagtgatgcttaaccatgtctcccttctgctgcctgtagctgtttctgtgtctggacttgtaatcataggtggattcatatgacacctctctaactgcaccaagaacaggaatgtccaccctccttgaaggatatgagttctaatgtggattcttggtcttctttgggggctcttcttatgtttaatgcacttgttgcagcatatactgagagtctgtgaaatgttttcagatgtaaactattgaatcatttcaagtatttgtattcattagtactcatagcacaaatgccattcctgtcccttaaagtgtgcaaagcatgggtgtttgagggcttggcaaccaacgtgtgggcacctctattttgaaatcggttttgtttgcaattaacaaaggttaacaaaaaagtccttttgggaagtttggccgaggtcctagaatttgtacatacctttgcaatgtgctcatactctgtggcacatctaggatcctcagccccttgttcttcgctttttcagttgaccaagttaaatattaaaggaagaggatttctttcttgctaccaggggattttatcatggtaaaaggcttttaaataattttttaaagttgtgataaaatacacataacataaaatttgccattcgaaccatttttaagcatacggttcagtggtgttaagtatattcacatcattgtgcaaccatcaccaccatccatctccagaacccttttcatcttgcaagactgcaactgggcgtggcaaaatattttgtatgtacaaataaatctttaaagctgaaacaggccaggcacggtggctcacgcctgtaatcccagctctttgggagactgaggcaggtggatcacgaggtcaggagttcgagagcagcctggccaatatggtgaaaccccgtctctactaaaaatacagaaattagctgggcgtggtggcatgcgcctgtagtcccagctgctccgcagcctgaggcaggagaatcgcttgaacttgggaggcggaggttgcagtgagccgagatcacatcactgcactccagcctgggctacagagtgagactccatcaaaaaaaaaaaaaggctgaaacaataaagttcttatggtagaaggtgcagtagtgacatatctctaattcaatttatattttctgtttctttaacatttcaacatcttcaagtaacatttatatagtgttttcttatattctcattgaagattcaaaactcatgtgggataggcattaatattcccattttataaatgaggaatttgaagtagtaacagaaaaaaggtaatgaacaaatcaggactccagcttagtgctgtgggctctaaatccttttctgtctccattctactgtgcttcaaaaggctgtgactaatgttttctttatctatctatctacctagctagctggctggctggctatttagctagcgatctctttattttgtggggatggagcaggcattgagggaggctttctggagttttgttttaaattctgggtcttgccctgacaacagacagttgtgttcataaccttgggcatctcatcggatcagggattatggtgctttgcctaaacacttagtagatgcagcagctgtctattcaaatactactttaaaaaatgcctggaattgtatttaaattgcttcaatttttcactaattaaattgtagattgtttctcctggggattttgcactaggccgagtttcctcaattgttggtgttggacaatgacaaaataaatcttttgcattgtagcttagtaaaaaatcctgctgaatgggctaaataagtccacagtcatcccataagagacttattttttaaaaaaacaattttttttttttttggtaagaccaggcatggacagatattgggcttttgtttgtttttatttctgtactttgattctggtgcttaaaatacctggaggggtcacagacacaacggaggcccatgtcttctattgaatgtgtcagcttccttggtctgcatgggttttaccaagaactgtacaatggaattcaaatattttaaaaccacatgtgtgtttctcacatggctgctacagtttaaatcttttgtcagcctgttcaaggggttagatgtagcaaccagtttgccctaggactttctctagagtccttataaatggtcatcttgctatagcatttacaaagcatttctctatgtgctgttttcattcacagagaggaggagaaaacaaaattgggaaaaggaaagaacttagaagggctcagtgtccctgcagagcaggagcttgtaacaatatgcccttgatatttttaaacaaaaatgcttgcttgctcttaaaatgcaaattgtttccattcccctaaaaaaaatgcacaatttcatgctaatgttcacctctctatccacagataattaagactttgctctcagaataaataagtacctaacacttacgagcactggctttggggcagccagtgtctatgctaaacctttcacatgcacgaacctatttaatactcacaacgtagtgaggaaggtggtattctccccattttacagacaggaaaaagaagttcagggagggggttaagagacctgctcagatgtctcactgataataagtggcagatctgggattgggtcctttctgtgatataagtgctcagggtttttaaaaagcaacagggttttttttaagggttgttgctgatattaacaattttcagatatgagaaccaatgtggaagcaactcagcatatggatgttatagccaatctcagataaaatgtaagaggcaagttctgctcaacaatgtgctaacatcggcagagctgaagtggggagctggagaggtaccaaaatattggataggaaaccgaatgctttttcaaatcaagtacctctgagtgaccctagacagttggtgagaaagagtttgtcaccaacataaataattggaaagaagtgttagatgcgtttgaagcaacccagagattcccttgtgaagctgttgagaagagactagagtgtgaagaaaagaagcttgcttggtgtccaagataaaataagggatggatcttagcactacagatggaaactacagcagcaaataacagaaccagaagagatacttttctatctggatttatgcagaaaggatgtcaggtaactactgatgaaagcaaataaatccccagtggctatagtatcagataaaaatgcaggacacatttaaaatgggctctccacatacaaattcctcttttgagacaacctgtaccatataaaattttattttattttattttatttattttttgagacagagtttcactcttgtggcccaggctggagtgcagtggcgctatctcggctcaccacaacctctgcctcccgggttcaagtgattctcctgcctcagcctcccgagtagctgggattacaggcatgcgccaccatggccggctaattttgtatttttagtagagacgaggtttctccatgttggtcaggctggtctcaaactcctgacctcaggtgatccgccccccttggcctcccaaagtgttggcattacaggcgtgagccaccgcgcccagctaccatataaattacattgtaggtaaaggtctgtggtagccttatatatttaattcatttaaaacaaacccaagtacgtctttccacagactctcacaccacattattattcagcatacattctccttattaatttttggaattaagtatagttattatgttcttaaaattgtttcctggctggccgcggtggctcacgcctgtaatctcagcactttgggaggccgaggcgggtggatcacttgaggtcaggagtttgagatcagcctgttcaacacggtgaaaccttgtctctactaaaaatacaaaaattagctgggcgtagtggtgggtgcctttaatcccagctacttgggaggctgaggcaggagaatcacttgaaccagggaggcggaggtttcaatgagctgagatcacgccactgcactccagcctgggcgacagagtaagactctgtctcaaaaaaaaaaattgtttcccaatgttagttttagaagattatatagcagatgccatgctgaggtagttcaggaaccgtttgtaaggtagtgatgaaattcggagctggagggtgacttacaggtcagtgagaataaaatgttgctgcttatttctgaatgtcaagttacaatgacctactttttttttctcatcttcttcatgatccaagttttccaggcataaaatatttggaggtgtttttttctctttctttgctacttctcctatggtcattgtgtttcttgcactggtctggcaaggtagaccttttaatcatattttaagttaaaagatgtggtaaaagattttgaaacatttaacaggttttattggacaaatagaaattgtgtcacatttgtgtacaaaaatgtttcactaaaattaggatttcatttaggtctatgtgtttctgtggggatgtgtgtgtgtgtgtctgtctcatagcctcttctgaaaatttcttgaaagcaatagaatgttaccccaaaaggaaaaaaaaaacccatatattcacttgcacattagatttttttcatacaatttcaaatggtggattcatccttgaactcctgcttatgaatcctttgttctgaaatatcacaggccattttggatatacttggctttgggtagtgattatttgtgtagtctccagagaaaggtggatgtttgaagttgtatgacttagcaggaaatttctagatttcaagtgtaagagaaaataaatcttttgcaaaccacgggccataccttgtataagggagagagacaacttgagtttgagggtattatggagattttggattggagggaaatggggctagcgaaatattagaaagcataattaatggctttagtggttttttaaaaacttggaacatacaataacaaatgcaatgaagacaaacggtggtaaatatttacagttacactagaccttaaaggcagggatcatgtcctagtggtgtgtgatttgggagctcatacctgggagtcagtaattggctgtgagagtggaagaggccagtcctcattagagaccttctgggaggagatgagttctgggccagagcttcatcttgaagcttgttagatttttttttttttgagatggcatctcgctgtcaccaggctggagtgcagtggtgtgatctcggctcactgcaacctctgcctcccagattcaagcaattctctgcctcagccacctgagtagctgggattacaggcgcccaccaccacgcccggctaatttttgtatttttagtagagatggggtttcaccatcttggccaggctggtcttaaactcctgacctcatgatccacctgcctcggcctcccagagtgctgggattacaggcgtgatccaccgcgcccggccgaagcttgttagatttaaactttcccctgcaaggcacgtcagtggtaaaccacctaacgtggtggggaaagcccggaagagttgagaagcctctctaccctcctttctccttcgaggtagaggcatcttaactccctagctcctgcattgttactaagagacctgcagctaaacaaatggtgcaaatcttggcctaaaaggagccaaaattgtcaccttagactgcatttaccatcctgctagcaatatgtagtgaaagaccacctgccttcatcctcttgtaaatcccagtaatactctgtttctaccactcacatgacatccattaagtaattgctttcgttcctttactagactgaaagggaccttcatttaaggtcagagatcttttctaacacaatttggtagtccttgcctaccatggaaagccacacatatattgctggtgcttaacaaatgcttgctgagcaaatgtttaaaaggccaggtagggcgtgccactgaaaatctctaaaaattctctttggattgtctgtaatactgatcaggttggaacaacaattcaaagttatgctgtcagaggctgaacgatttccttgtcattaggacaatcaattttgtaatttacccttagtctacacagcaagtaaattgtagtacttgcatttttggtttcaatgatgtatatatagaaccatgatgaatggaattatagtcaagttctggtaattttaatgtatcgtctcagttgtgggtagggataaggtagggtcattcattaaataaccattcattgattaacatgtgtgaggtgtgattttatgatttttatgaggaaataaacaaaaaaaaatgtgtttttttgcttgtaagtagttctcaacttgttaggggagatagatgcatgagaagtagttacaatctctaatgtgttaagtaagagagaggtaaggaagggagggacaaaggaggaactgattgatttggcttgggtgcagggagaggggccttaagtatgagttgagagtccaggagttcaagaccagcctcggaaatacagtgagaccccattctctacaaactaactaaataaataaatataaaaaattttaagaattagctggacatggtggcgtgtgcctgtagttccaactacttgggaggttgaggcagaaggattgcctgatcctgggaggtccaggttacagtgagcactgcactccagcctaggcaacagagtaagacattgcctcaaaaaaaaaaaaaagaaaataaaagaaaaaaaagtatcagtagagagtggtaggcaatgagtgccaatgagactggagtggtgacattccaagcatagaaaagagactgtgcagagcacagaggaagatgtggagatccctgagtagtgtgcctggagtatgagatacaagggccaggggacaactggagatgaggatggacaagggctgggtggagactctgtgggggctcttaaccttctgtagattagttttttttttttgtaggtaccggtgtttttgagagtgaaagcaggtcctgactactggtttgttttatagtaaatatctcaatccagatctcaggtctagctgaggcaggagccttgggcaaatagtaaacagggactggaattggtcacaggagctgtgtcatcacccttgctcttcaaattataaaggaagcctaaacacacaaactccagtgtgggccgggctgactgccagatgtgcacaggatcattgtacaaagtggcaagattctcttggatattggtttatctatttgcttagaatgaagagaaataagggtgaacttgaagtttttcttgttatcgtattttgacttgcaaatctgagtaaaactgatggtgcaatctcctttctatgtggggctgacctcagaagagtagtggcttgtagtgtaaataaaataggagcaacagcaaacaattaaaatactgaatccaggtcacctagcactcggtggggtaaggactactcagacccagcacttgtataacccgtataactggatttacatgttctggccccctattcaatgtctgacaagcagttttaataaaaaaaaaaaaaactttacatttttatatacctagtagcattgttaatcctgtttgtttctcaattcagtaacaaacaggataaataacaaatatttatcaaataccttctatgtgctaggttaaattttaggaaagcttaaaatcaccttctccaaggtgattttcccagctcatttccaaaaaaacacttgccacagagacttcagagtctttgagtgaaaactttgtcattaattgattaattttattcattcaatagagatttattctggacacttacaaagtaccaggcatgatgttaggcactggcactgggagtttggtgctgaacactgcaggccctatccttgtcttcgtggagtttccatgctagggggatattgacaaataataatagcattgcagtgtagcatgataaatcatttgaacgagtaaatataaggtgctttgggagagtgagcaggggttgcctaacccagacttagaggaaaggcttctgggagaatgtcatatgtaagcagagacttgatgaagagcaagagtgggtcaaaggatggaaaagggggaggatgggttaggattggggtgggaggcatcacaggcattcacaaggtcatgtgccagagcccactgtgtgcgtgtggtggtccagggtgggaggtgttgggagggaataaaagcaatttagcttggctatagtgtggagtgtgaggtggaagtagagaaatggggctggagcattgcacagatcctgaacatactttgagctccgtaaaggtgtttggaatttatcctaatgccaataggagactgactttcctagaacgatctctgtagctggtgtgtgaaggatggatggggtgaggcaaactggaagacaggtagaccagttaggaagtttccacagtaatccggtggggagataatagtagccctaattaggggagtggctgtaggaatgcggaaagtggctggagtccagagctctttaggaggtggatttcagattggacttggtgactgaatggaggtgggggtcttggggaactggtaagaaggggacgctgttccttgtgcaaacacaatgcttgtctctgggggtgggtattattttcagtgtaattaaaaaaaatattaaaactgatctaagaaacctttaaattgtctgctagctcagccaggatacagatgctttggagggaggaaagaaatacgttcagaagggtgaatgcactccaattttgatttttctctctctcctttcaaatttcaaggctggttgcatatgcctcattagctcacgggagactgtgatcctataatcttttttcatattcagaaaactagagatgttaaacttccttggagaaggtgatttttgcagcctttgaataaaagcacttccagttctacctttagttgaaaatcaatggtgtctaatgtgtatgagaagtcaccccagtctcttgtgtccaggccaccagcacttatatgttatgcctatcactttgagtcaaataatctctagtggtccccaactgctaaaaatccccattctcttggatcttcaatttttttcttttaagttgagaaaaaaaatctctcctagaaatgtacatttgatttcttgctgaattaataagtttttctccttcttaatgtgtcctccaggtcattaacggaaaaatgtagtctatgatgcagcagagctctgccctttttattttaatacattttaaatatatcacaattgtctgcactctgataaaagaatgtagagctggaattttaatttgattatcatccccaatcttcccaggctttcgcaggcaagtactttgtttgaacagctgtactccggtaaatctcagtaacaaatgaatcaggaatgattttgtgtagcaagtcacatgaagggaacttccttagaaagacaggtcattaagagaatgaagaaagaaaaactagcaaacatttgagaaatttagcaactgtttttttttaaataaagcaatttgttctaataattatttcctaatcatcttaaaatacgctgtcattaacggcagagaaagctctttatttccttttgaattttaatactgggtagaaatataatttacaatgaaagtcagcaggaaaggaaaaatactaaaaacgaggaggcataaaaaatggaaatagatccctgtagtcaattttctatcatctataattttctatcatctatatgtgtgttacccatatgctggggtggagtggggaggggagagggaggcgctgtgaaatacatctgcctccgatcacaaaaagatcaaattaacatgtgaaaagatattccaaggagctgtgggagagaaaggcttttggctttcaccatcttacctactggatgggtttgaaagcataaaataaagctaaactaaattcagggaaacattgattcacccaagtgaataaacaacttactgcatttgctaatctaattaatcaaactctgcttctccttttccaaaggagattcacaggcagtaaaataaattaaatcaacattttttttttcccacttactaaaaataagctttctttccctgggtaaatcggtcatttaaattcccaaggctgcactcccgtagtcctctggcaggaagcaattgtatgggtataaaatcatttctgtgcagattgcagagcttgggctctgagcatcatgtctgagttctgccacctaaactgatgaataagatcagttttaactgaagttatctttagaaacaaatggcctatggatgatgttgattagcagataaaaaagcctgttacatggatgttttatgaaacttaaaactatattgatggcaggaaacaatgattttggaggaaatcctggaaaattaaggatatttaaagtttgaaaacaattgtaattgtgaaagtttagacacggaagtcataaaaaaatttcagttcagtagtttgcagatctgttacttaatctttttagttaactttagatcagtagaataagatttagttttagactgtatgtatatacatacggcaattttatacatacatacatttacgtaaatacaatatacaaggaaaagtgaaggacagagtaaacggagaagaaaatgaattaaaagattataaagtgttgaatgacaggctttatgtaagtaaggcaaaaatgtaacacaggaatatcctagataacaagttaagtatgagctaagactgtatcgctaggtttttcattttttaaaggcgttataccaggatgtggatttaggaggcctgcagtttagaattgagaaagagctcactgtttatattaagttctactcacacttactgcatttccttgtctttgtcatgaatgggcacccttccaaggaagaacctaaatggaaaagtgcttccagctgagttcttaatgctaccaccttcgtcatctgtctggtgccctcaccttgaggatcaaaggatccccaaggattgcctttccccgcatttccttctcggatggacttatttccgttctttttagttttgttcaccctaggatattatgctcaaaactaatttacatgctcagctaatcttaattaaaatgtaaaggcagatcagggcacgatcaaattaagttctgaatatacttggatagttgggcatcagtttaatggattaaacagttcttggaattgcttctctttcttgacagtaagtcttagttttgctgtcatttcttaatagtcccttttacttctactttcaagctgtgactgaacattctcttttaacttacagactcttttgctatctggaaacccatgtccacctctgacttccactcaaaattgctttcctcacagtctgactgcgagagttgtgaaaaattgggatgtgcttctgaggtgggctgtggaatgccatgtaagttgctacttttttttttctgaatgcagtgggtattcatgcgcagtagggatgttggcatatctctgatgtttccttctaaggctggtgaatctgggttgttgctgttggggtttgtaatgtagtccatgtctattagtgaagacacagagggcaaaataagcagtttctttcttctttctttctttcttttttttttttttttgagatggagtttcactcttgttgcccacccaggctagagtgcaatggtgcaatctcggctcaccgagatctcctcagcctcccacgttcaagcgattctcctgcctcctgcctcagcctcccgagtagctggaattacaggcgcacagcaccacacccggctgatttttgtatttttagtagagacgaggtttcaccatgttggccaggctggtctcaaactcctgaccgcaggtgatccgctgcctgcctcagcttcccaaagtggtggaattacaggcgtgagccactgagcccggccaaatatatatatttattatttttattttttgagacggagtctcactctgtagcccaggctgaagtgcagtggcgcgatctcctttcactgcaacctccgcctcccaagttcaagcaattcacctgcctcagcctctggagtagctgggattacaggcgtgtgccaccacgccaggctaattttttgtatttttagtagagatggggttttaccctgttagctgggatggtcacgatcacctgacctcgtgatccgcccgcctctgtctcccaaagtgctgggattacaggcatgagccactgtgcctggccaggggccaaatatttttataataaatccaccatctctatactgttctgtggtgaaatatgctgaagattaaatgaaacctttcaaacttggttatcatggatttggctgcatagttggccaaactagattggttcctttttttttttgagacagagcctcgccctgtcgcccaggatggagtgcagtgacacgatcacggctcactgcaacctccacctcccgggttcaagcgattcttctgcctcagcctcccgagtagctggaaccacaggcgcgggccaccacacccagctactttttgtagtttttagtagagatggggtttcaccatgttggccaggctgatcttgaactcctcgtgatccacccgccccggcctccctcctggcattataggcgtgagccaccgcgcccagcaactagattggtttctaagcattcactttgtgatttgtttcattatctttaacattcaaattggggaatgacttaactagatgcaggcaaagacaatatcttgcttactatctttaaggtactgccacctagatactagagatacaaagatgagtaagacaaagtatgtgttgttctgaaaatggtggtttatctgttaccatttataatgctgcagtatacttgtttatgtcttctagattgtgagtttgtttgaggtcaaaaccatggcagccaaaaattccacatagaaatttccactaaatagtttagaactgaaaagataaaccatcccaaagtactttgcatttggtcaaattttttaatttttttaatttttttttgagacaaggcctcaccctgtcacccaggctggactgcagtggcacggtcatggctcattgcaacctctgcctcctgggctcaagcgatcctccagcctcagcctctgagtagctaacaccacagacgtgtatcaccatgcctggctaattttttagtttttattttttgtagagacagggtctctctatgttgcccaggctggtcttgaactcccaggatcaatggatcctcctgccttggcctcccaaaatgctgggattacaggtatgagccaccatgcccagtgacatttcctaatagctattattgtcatcacaattactccttactaataatacctaatatatagatcttgcacatctcttggcttatgtgagccttaaaattccatgaggtatggagggcagcagatacttctgtatcttattgatttgggcaacctgcccagataatgcatgtaatttttctaagattatggatttagtaagttttgcttaagtgctcagacacaggtttcctcagtccagatccattgtgctgtttgataagcttttacggctgggctattacttgaatacttgaagaacatgggaatgtttctgtgtgtataagaaaggatataaaattagccaggtgtggtggtgtgtgcctgtagtcccagctactagggaggctgaggtgggagcgttgcttgagcccaggaggtagaggttgcaatgagctgagatcccaccactgcactccagcctgagcaatacagtgagaccctatctcaaaaaaaaaaaaaaaaaaagcatgtaggggaaacattatcaacattatcactatttttacgtgtttggaaccgtacctggtagttggggtattggtctttcttactctgaaacttctcagggtaaaatttcaaatgtgtgttgcttatgtctacttttattttggcttaatagagaaattttcttttctgacatgcaggcctagaggtgaaacatgtgtgaccatgcccttgtacaccggcctctgctcacctgtttgcctcatttcattaagttctcccccatgccattcactatgctcaagaccagtggttcatcttttccaccacagggcctttgcactgcctggccctctgcctacaataccattcccctttccccacctcaacacctcaaccttggcttggttgagtcttatgcatccctttggacttaggctaaaggttgcttggccagagaagacttcccaaagagaatgaatattgtgcgacaacctcagtaaatgtttgaatcagggtccctaattgtaagcgacagaaacggactctggttaagcagaaatggaatttattgagaggatattgagaagcttgtggtcgccttgggaaggctgaagaactaggcacatagctaaacgtttcggaaacagtttccaaaaccatggcaaagaactggcctaaagaggaaaccgtcaccacctgtgctgcccccttgagccctgaatgctgtggtttctttctttctttcttttttttttttttttttttaagttggagtcttgctctgtcacctaggctggagtacagtggcgctatctcggctcactgcaacctctgcctcccaggttcaagtgattctcctgcctcagcctccggagtagttgggattacaggtgcccaccactacgcccagctaattttttgtattttttttttttttttttttgagacggagtctcgctctgtcgcccaggctggagtgcagtggcatggatctcggctcactgcaagctcctcctcccaggttcacaccattctcctgcctcagcctcccgagtagctgggactacaggtgcctgccaccacgcccggctaattttttgtatttttagtagagatggggtttcaccgtgttagctaggatggtctcaatctcctgacctcgtgatccgcccgcctcggcctcccaaagtgctgggattacaggtgtgaccaccgcgcctggccaattttttgtgtttttagtggaggcagggtttcaccatgttggccaggctagtcttgaactcctgacctcaagtgatctgccctcctcagcctcccaaagtgctagcattacgggcatgaggcatcgcacccgaccggttgctgtggtttctaatgctgccaggaaatctgcctgctctgagaaggcagccttgcaaccatcactggccccctaagctggataccatgattgccatccttacctgtaataaaaccatgtcaaatccataccggtatgtcgcttcctcctgcaagttgcccgcatgtgaatccaagttgttcaagggtgaatctgattggtggtactgaagtcaccctagctgcaaaggagactggagaacgaagttttctgagttctttaattggaaagtgggacttattagctgaaaattatccagctacatcaagggtgttcaaaaggtgctaaccagggggaaaacatgacaaatatcttctacactgagacgcagggttttaatccacctatggaccaaccatacttacctcacagggttgttataaggattaaggtaatttacatgaaactgcttattaataaactgtacagagagcataagtataaaataatattatttctctagtgtaacatatctttgactgaagcataaaatcaagtccttaataagttgacaaatctccagctcactttatatgtttttaaaatggtaaggatattcttctcccccaaaagccattttaaatattcaagataaattgaaaaaagaaaaaaagtacctcttctatgaacgtgctgccctcataaatttctatcatcttcacgtttattttgtaatggaaatatacaaacaatgccaagcatagaaattgtagtttaaaacatgtgagtgggttttcagctacttttgatttgtttctgattttaaggctttgttctaatctactttttatactctggtttcaacatgaatacagccctcttgtttgaaaacagacaatgggcttattcaaccctcaaggccctctacatttggtgtttctgccacggcccttggtggctttaccacatatattattatcttgtaaaaaatgtagacgtaacagctgagttgttagcagaagtcatagtagttgtgtaaaagggtgttagtgtaaatgattgtggcagttgcattaacgctaatgcagtgggaattattcacgtattcactgaatgtaatcctggccttccgtggtggtaaagttcctctatagaagaggagaggtcgacatcaatgtaatttcagaggagaaacagccatgtgtagagctattttcctatttgacagaaatgttttccagtataacatcagaattttgagttatgctacttaactttcctttcttgtaaatattgaattaaaataagatattgctagaaaaagtaaaacatgacccagcattgcaatgctgaaaattggattataattctcagattgttagatttctgccatcttataatttattcaagaatatagagaattctaacgtaagtgtcttcatgcaccttcttacttaagtgatacttcatgttaccctgaactgtcctgaatttccaaaaatctcatgttgggttaagaggaatttcctttcaagatactctgtctcctcttcaacatcttctcaacccttttctccccacccacacatactcactcatttacacttaacctaaagaggacactgattttaggacactggaaatctggaatccttacactgtgttttagtaaaggtatgagcctggaactcctgaaggccttaaaaaatagcactgtagtaaatagagcttagttggggtaaacagagcaccccggaaagtagtatattttggtgattcaaaatttatttcacttctctgatctgtgtaagtatttatgtgatctgtaaatacttcccagccataaaaattctaatttcatctctcaagatacatagtgggcacttgtgcaactgtattcagggagctgtctgttggttggagagggagatgaagtagattgaggtgcaaatggcatatttaatgccgaagctgttgctttaattggtgatgttgaaagtcacttgaaaccacccccctagtcctcaagggagttctcaggttacgtgtgggtgtactgtgaatgccttttattttattgactcactaaattcttagattactctttaccatttgatattgacagaccataaaattcttatggaacctgctcagtagtgacttataaagaattatcttgttaataaactcagcatcatttggaattcaagtttaattaaaatggaaaagtaaatgatgatgtaaagatttttcctcatttaaacttgtatccttttattgcctctctgtcttttctctaaattcaaagatagattttatttgacacccatttttgcaaggtgcatttttacagaatctgttgtaggacttcttctcattagcttttaaattattattatttttaaattagagaaggagttgtgagatagagtctgagagaggtaaaaatgaaaaatctatgttatccagggattttagtttttgggatgctgtttaaagataatgattgtttatggactctttaaagatgttttctcataagagttgccaagtaacagattagttatctgagggtggtttgaaagaccttttgaaattgcctgggtgacaatactaccttatggtacttataaagctcctttgaagttggccttttatattagaaaaccagaaaatatttttcttttattaaacagaaaacaatacatggttcagaggttagtattttttttttttagaaaaaattacattggttatttttgtgattgactccaattttttttttaaatctttcagcctttgtgggctactggatttttctaaattaaggttcttagtataatacgtttggctgctcttgtaaactatagttacgaggtacatactgttatacctcgaaatttgaggccctcttcttttttctcttctgtttcagacactgtggtacaaaacctgcagcccccaagcttggttaagagaattttggattgaaataaatattgtagggcatgcggcattcctgcacaacccttgttatacacagtcacactgaaagaacaggttaaatggaaggggctgtcaggggtcagggctagaaactcacagaggcagatattgcagtttggataagcaggagtttatgagagtcctcttcagtccaagcttatctgagctcacaaaggagatttacggtctgttgctctgcaaaagctatttgggcaggcacttttcttcccaactagcttttaagtgctcctggggccctcaagcctattcacttaggcctctcagattatgaatacataaaccttaatgattttggagtcccaaaggaagacatattaactggtacatcatcaaaacatgatgctgctaatagaatggacaaatacatcgtagggcatcacaaattcacccgttttctagtagtgactataataataagtttttgcaacccgtaaagaacatttattctgttctagcattgataggatgactgatattgattataaatttatattcaaatagtggaaccagttgtttgatagacataacctctgagaccagcagtaatgattttagtttttaatggtttgacaaaatatacaaggcatttgatgaatacacaagttggttatttcaagcatcttggagcttcagtcttcccatattcaatagtgatgtagaccatgcagtctgttccccctttacaggtataatttgtctttcaaaataaaaattgtgattgtgattgttactaacacattgtgtctcttaatattctttaaatacttcaatcttttcaagcaacgtttggcataacctgaattccactcaaaatccctcaggagagaatagaaactgtcatatgaaattggttataataggatttaacctatagagttctgattctttcttcccttcaatttttatcaagtatttaattgcccactggatgatttattttagaattggcctacttttttttttttttttttttttggcttcagtgcctgtgggcaaatgtaaatttgcagctgaattagcaaaccagggatctctgtgtaacttaataaccacaacagggaatcaagtaactgatttccctctttttctagattggccatgtgtgtaaggtggtagaactagaattaggagataagggggggttatgaggaaatgattaatttcaaattgttttattaatacaaaaagaatgtacatttattgcggaaaatacagaaaagtaaaaagaagaaaagaaaatccattattcttccactcagagaagttatgtgaatgttttgatatcttttatttcaatcttttacttttttgaaatattttatgcataaaaagtgtacatacatttctgaaatagacagcaataaaaggctgacccatgcgtctgccatccagcatagaacagtctcaattctgttttatctttcaattattcctcctcacccgtacctcagatacaacttttcccttttcaattaaagttaatttctccaaaataaaatgtaattttgataatttcaaacacgtttagtctcttagcatattttacataagtcagcatcctgacatttttgttttccattttcttgtgttccttcatgatttcgccatatatgtgtccctaactaataattgctttattttgcatgttttaaagcttcaaatacatgaaactgtactgtgtttcttctatcgcctttttaaaaattaacgttatatgttttgtgatgtgcgcaactttatacatttattttcattgctgtatagtactactgtgtatgaatgtacctcagtttatccatttcctgtcagtgtacttgtgggttttgttttgtagcagattctgtcagttcctcacccacgtcttttagctgtttcgtgatgcactcatcaacctccagatgcattatctgcatctgtgtctaagcgctctcctctccatcccaactacagaaagccttgcacatcacagaaagccaggagtgcccctgggggcaggtctcaaccaatgactctggggagttggggtgtaaataccgcagctcccttggataattgcagttcccctagtttctctatgagacgatgccccagtgactcacacagtagttggtttaatggtacaccgtttattggctgccttttcttccctgtcttactcccccatacccctaccagttttttttgtttatttttttcttctaaataaacttaatttttgtcttagggtctgcttctgagaggagctaaactaagtcaagtagtttgcagtttgggtcattgcaaataatactgctgtggacattcttgtatcctggtacacagagcaactggtacacagtttttctgggatatattcccaaggagaataactggattacagggcatgcatatattccacttcctgagttggtgcaggcttgtttttcaaggtggttgggacaaacattcatgagtaatgagtaaaatattcctatcattcaacaccattgcaaacttacctttggtattgtgtttagcatagtttcttttaatttgtatttctggatacttaatgagattgtacatctttacatatattattggccatttctatgcaaatgaatatttgcatttgtcacttcttctatggtctgtattttttttttttttttttgagatgaggtctcactatgttgcccaggatggtctgttcttgggctcaagtgatcctcctgccttagccttcttagtagctgggaccacaggcatgtgccattgtgtctggctgtaatttgcttttttgtaggagctctttataaattctaggtagtagcattttatgtgtcttttagacattctctccaagtttgtggcttgtcagctccctttctttatgagtcatttttaatgaacaaacatgaagtcaaagcacttagtttttttttttttgagacggagtccctctctgtcacctaggctggagtgcaatggtgcgatctcggctcactgcaacctccgcctcctgggttcaagtgattctcctgcctcagcctcctgagtagctgggattataggtgcctgccactatgcccagctaatttttgtatttttagtagagatggggtttcaccatgttagtcagggtggtcttgaactcctgacctcaggtgatccacccgcctctgcctcccaaagtgttgggattacaggcgtgagccaccacgcccggcacagcacttagtctttcacaattaaatgtgatgctacttgtaagttttttagcagtccttttaactgtaatgtttggatcatttgcatttaatgcaattatccagatggttgggtttgaaatccattattttattatttcctttctttttgagaagtgctgggattacaggtgtgagccaccatgcttagcctattttattatttcttttctcttttctttctcccacacactcctcctcctcctgttgcatttaatacttcatacacagaagcagaactccagtacatttacatgttagcagtgttttgtcctgtggacaaggagaggattccttcctatattggaattgccagctgtgtagtagataactggaataaagtgtttctgatggaatgtgtttggatatcactcatgtaggaaaagcataggagcgtgcgtttgtaattctgaacacattcagtgggtggctttgtttgctaataaggtggttcttgaaatgccacagaagtggacaaatatgttagaaagtctgaaatacttgaacatgatacctacctttgaggactaagtgagacaagtgatgagtcgaggcgatatcaaggcgataggggaacatctgtggtagctcactgggcctatgatcgcattcttctcaggtcagaagtcccatgcgagagacccaaagccacagctcgcttcattcctctgacgaaggcaagcttgctgctcagctctcctacgttaatctgccaataagttctgcaaaactcacttggttttttaaaaaactaattgaactcacacgaaagctttatcagtcaacccttaagtcttgctgccttaaacagatcagtgtaaaaggagtttttgtaatgtttatagaatgaggttgtgtgaggtcactgaaatggtgtttgtttttcttgcagctatttcagtggcagttatacaaagcttgatatgctttgtttgggaatgtgtgatactgtaagcatgccatttttggtctgtgctaactgaagcaacattttaccctgtgtgtagatagtgtggtgtataatcattcctgtgattttaataacagaattataatatgtgagacctcaaatgggtgttagacatcatccaacttcctcaccacagaaaaatatataggcaggaagaaattttaaaaactcgtttcatcatgccagctaggaaattttggtagattatgtaaaatagagattcacccacaaaatgtaatagtaaagtttcaagaatgagaatggcagacgaagttttaggagaatgtctgttgctcaagtgaggcattcagtagaaagtagtggaaaattggttgggggtcatacatctaagcttaggagcattatatgcaatcttacaatattctcaaggccaaatctcatgcatatctttatgcagcccctgtcagagactgcgtttaagaaagaagatactttaaaaaaatggttaaaatggttttttttttttttttttggagacagaatctcgaagtcttggagtctcactctgttgcccaggctggagtacagtggcgtaatcttggatcactgcaacctctgcctcccgggttcaagtgattcttctacctcagcctcctaagtagctgggattacaggtgtgttccactacgtctagctaattcttgtatttttagtattgacagggtttcactatgtttgtcaggctagtcgtgaactcctgaccttgtgatccgccaggcctcccaaagtgctgggattacagacatgagccaccacacccggccaaaatggtaaatttttatgttatgtatattttgctacaattaaacaaaagcaaatgcaaataaagacaaaggaggctgtggattttcaccattttttttcttgttttttgtgtaaaggggaaggcagttaccaacccctgtggacaggaatcgcttttgaaggtagggctgaggtgatcatcaaccaagttgtaaagatcaaaactgaccagcctgccggagactacctaaccctgttcctgtttctgccgtatcaagtgaggactttctgttccctctggcgatgctactctgtgtgactcatgattccacgtaggcttgaaggaatggtctttattcagtgcctgttaggtgtgaagcaaggtattagaaattgtatatacattatcacattgatgtatcacaatcatctgctggaggtggtattatccctaatttttagacaaaaaaagtgagattctgagagggaaagtgtagtctccaagctcacacgtgtagcagttcagagaattcaaacccagatctctgtttttgaactccttgaccttgtctttataatgtcattgcctcaaattttgtatccacccaagctaaatggaaggaagaatttagtaccttagacttggtatattgtttttcaggggaaataagtataagaaataggatttcgtttggcatggagtatttcattcatatatgagatttttagtgggaacccacttggtgctagacgttgtttgtaggcattggtgagccatatctctgtgcaagacaggcgtagtccttgctctcagggaataataaattatgccatagctgtgtaaacccacttcgtctgcatgcagaaatttatttgaaactgaattaaggacaacaatcaagcttttaactatttctctgttactttcatcaccatcagctgtggtccggtttagcggaagcaaaatagacaaattcagtaaaatgtctttctgtggagaactcccaaaatgaatacgctgagccgggcacggtggctcatgcctgtattcccagcactttgggaggccgaagccggctgatcacgaggtcagcagttcgagaccagcctggccaacatggtgaaaccccatctctactaaaaatacaaaaattagccaggtgtggtggcacgcacctgtaatcccagctactcggaaggctggggcaggagaatctcttgaacccgggaggcagaggttgcagtgaactgagatcgtgccactgaactccagcctgggcgacagggtgagactccgtctcaaaaaataaataaataaaaataaaaataaatacactgagtctcatgatctgagagagttaatgttctgtaaagttgctgtgaacactgaattagcaaatactgaaccattgctcctagggaaaatacagggttaggttcctgagagcctctggctgcaagattttcatcaatgaacacatatgcttattttatgtgttttatttagcatgtattttatttaatatgttttatttgtattttaaaatatatttacatttagatttgatacatatatttaatatatgtgtaatttaatgtatattattggttcattaacattaaactcatggctaatagtgctacaactcatgcctaagtgaagcttagcaaacacgtgccttttctctgcaaggtacatcacagacttcttgcgcttagtaacactagatattaatagcatttcagccctccatctggggggcattgcaaacagtgaaatcaccaacaaaaagcataaaaatgcaaagaacatggcattaaaaatgacacttgtttacatgattgaagctgaaacaagaaggcagcgtgtcaccttgttcagcgtcagctgggaatgtgtgttgggcaacttagaactttcactgctctgtgcatgtttgagaaagcaggaaagcaccatgcatattgattttggggttacacgtaaatttctgcaagttaggtgaatttgcaaatacagaatctgtaaacagtaaggtttgactctattaatgtcaataataaaacataatgagaaaaatatgagatattgcaatacacagaattcaaatagggcaatgggaaggtgcctggggcgggtgctacagattgggaggtcagctgaggtgtctctgaagaggtttcatctaaactgagatctggattacaaggaggagcctgtcctgtgaagatcagggggaagggcatttgaggtgggagtgagtacaggcagggcaaaggctccaagacagaatgagtttggtgtgaggaaacccaaagagaccactgtggctgccagaaatggagagctttggaggcaagtacaggcctggtcactagggccttgtcggctggagtgggggtaaggatttgtgctcagtgagtgattcttgctatatttctccgtaaatgttgcggcatttttttcattttccctgccacacttcctaagtggaggtgttgctttttacttctttgctcttttttggtgtcctagacacagtagcccctatatgtgctgagtgacaccaagctttcggcttctggtgctgtaacctttccttccttctgtgaccattgtgaatgaggatggagtatgaatgggtgatatcatgagagagagtctgcattgtattgtattggtgtggtgggggtgctgaggggtagggaagcaggaagaggcaatgtgtacaggaataaaagttacttaaatgctccaggtctgagttttcttagttgatgattagctatgtctatcaggaaacaaagggtcgtcacccaggctggagtgcaatggcgcaatctcggctcactgcaacctccgcctcccaggtgattctcctgcgtcagcctcccgagtagctgggattacaggcgcatgccaccgcacccggctaatttttttgtatttttagtagagacagggtttcaccctgttgaccaggctggtctcgaactcctgacctcaggtgatccactcacctcggcctcccaaagtgccggaattacaggcatgagccactgtgcccgtcctggtccttgataattcttttctttttttttttttttgagacggagtctcactctgttgcccaggctggagtgcagtggcacagtcttggctcactgcaagctccgcctcccgggttcacgctattatcctgcctcagcctcctgcgtagctgggactacaggcgcccgccaccatgcccggctaatttttttgtttttttgtttttttttttttagtagagatagggtttcaccttgttagccaagatggtctcgatctcctgacctcgtgatccgcccacctcggcctcccaaagtgctgggattacaggcgtgagccaccgcgcccggcaattctattttttttttttttttttttttttaagacggagtctcattctgtcgcccaggctggagtgtagtggcgcaatctcggctcacggcaagctcctcccgggttcacgccattccactgcctcagtctcccaggtagctgggactacaggcgcccaccaccacgcccggctaatttttttgtattttttttttaggagagacggggtttcaccgtgttagccaggatggtctcaatctcctgacctcgtgatccgcccacctcggcctcccaaagtgctgggattacaggcgtgagccaccatgcctggtcctatattccttttcattcctgtcgaggtaagcttttagtaaatggatttcattccaccctttccttctggtaagaagcaaggactgaggatgatagaacttgtaaatgtttgaatttcatagtacacggtttatgtgttggatttgtcaggtgtccttcagcgttatttggtgaaggtgggcaaattaaatttgcctttttcaatatcctctgaatttttaatgagctgctatatgtcttgtcactttttctgcccatagctattgttttcagcataactgtgttctgtaattcttttttctctgcaatagtaatttatttattttacttttcaagatggcttccatttgtgttatgcaagttttagattttgtacaatatagagtgtataagacaccttttttttttttttaaactgaagagctatggaatctagtatacccagtgatatagctatgacacatttatctaagaaggaatatgttaccacaaagacagtttctttcttttggagaaattttcaaatgcatcagtgctttaaaaaaatcaccattttggtatccatatgtgagggtgagtgattttttcagagagaaaaaatgtgttccaaatagatatcagttgatttctttaatcgtaagttttatattaatgcgtcttttttttttttttttttttttttttttgagacggccaggccagagtgcaatgccgcgatcttggctcactgcaacctccgcctcccgtgttaaagagattctcctgtctcagcctcctgagtagctggggttacaggcatgcgccaccacgcccggctaattttgtatttttagtagagacagggtttctccatgttggtcatgctggtctcgaactcccaacctcaggtgatccgcttgcctcggcctctgaaagtgccgggattactggtgtgagccactgcacccggcctatgagcctttttaaaaataaacaagctgactgtttttaccaaacgctatgaaaatacaattataagctattctgtcaattaggaattagaggttcttagaccatagctctgagagcacactaagtcctcatgctaaaatttattttaaacataattaagaacagaggtggttttaaaccacttccctgctaacttttttttttttagacagggtcttattactctgttgcccaggctggatgcaatggtgcgctcatagctcactgcagcctcaaattccctggttcaagcaatcttcctgcctccgtctcctgagtagctgggactacaggcacacacccccatacccagctaatttttttgatatctagtaaagacaggatcttgctatgttgcctaggctggtcttgagctcctggggtcaaaggatccttctgtctcggcctcgcaaagagctgggattacaggtatgagccaccacgcccggtacttctagtttttgacatcatcaactatggttgagttatgcagaatcagataatagactaatttagcaaataatctttttaaaaattacttttagagaactctaaaaatgtaggtactttaaaatattttactctagtcaaaattttctcttttggcacaaacactataatttccaaaatcaaggttttggaaaaccttgattgttttgtaccttggttttcaactccagaagaaaaagtctagtccctgctaaaacaagaatcagcaagttgatgagctgggtgtctttgtaaacaactccacactttcaggattaagaaaacaagtctcatatgctgggcatagcttgggatcgtggactagataggaaactgtggctttagccttgccacactgccacacactacctgctgaacacaacacaacaatttagattgagaaaatgtgaatacacctccagtgactggaaatacatctcaatatacaagtaactttataagcacatgcgaagtttattatctttatgtgcatgaaagcttctgttatcagtttatcaaatattacatctttgacaaaaatgcgtatacatttgtcactatgatagtaaggcatgcaaactgcactagtacggagttgttttggttttgcttttttagaaaactctgatgttcaggtgggggtgatttgcgaccttatagcaaatgcacaaagaaaaatcacatgtagcttttaggagtttcagtttggggatctaaaggagcctacttaaaaggaggttgcgtggagctaaattaatccttatttttatattatacacacatattcatgataggaacatgtctatctcagtgacaacatctcttgccacactcatatttatatcatatctttatccttcctgctgtatgtcccagaatgcaattgttgacctcactttttttattaaattttttaaaatttaatttttactttttttttcctctgtgactctagccaaggaaaatcaagctaattaacatgtacattactgagaggtgacagcgtgctggcggccctcacagccctcgctagctctcggcgcctcctctgcctgggctcccactttggcggcacttgaggagcccttcagcccgccgctgcactgtgggagccctttcctggcctggctgaggccagagccggccctctcagctcgcggggaggtgtggagggagaggcgcgggcaggaactggagctgcgtgcggtgcttgcgggccagcgcgagttccaggtgggtgtgggctcggcgggccctgcacttggagcgcctgaccggccctggggccccgggcaatgagggacttagcacccgggccagcggctgtggagggtgtgctgggtcccccagcagtgccagcccaccagcgctgtgcttgatttctcaccgggccttagctgcctccccgtggggcagggctcgggacatgcagcccgctatgactgagcctatccccccactccccgtgggctcctgtgccgcccgagcctccccgacgaacgctgctcccggctccacggcgcccagtcccatcgaccacccaagggctgaggagtgcgggcccacggcactgggactggcaggcagctccacctgtggcccggtgcgggatccactgggtgaagccagctgggctcctgactggtgaggacttggagaacctttatgtctagctaggggattgtaaatataccaatcggcactccgcatctagctcaaagtttgtaaacacaccaatcagcaccctgtgtctagctcagggtttgtgaatgcaccaatccacactctatatctagctactctggtggggacttggagaacctttgtgtccattctctgtatctagctaatctagtggggtcgtggagaacctttgtgtctagctcagggattgtaaacgcaccaatcagcaccctgtgaaaacagaccactcggctctctgtaaaatggaccaatcagcaggatgtgggtggggccagataagagaataaaagcaggctgcccgagccagtagtggcaatcttctcgggtcccgttccacaatgtggaggctttgttctttagctccacaatgtggaagctttgttctttagctctttgcaataaatcttgctactgctcactcttttggtctacactgcttttatgggctgtaacacttactgcaaaggtcggcagcttcactcctgagccagtgagaacacgaacccaccgggaggaacgaacaactccagatgcgccgccttaagaactgtaacacttaccgtgaaggtccacagtttcactcctgagccagtgagaccacgaaccccaccaggaggaagaaattccgaacacacccgaacgtcagaaggagcaaactccggacatgctgcctttaagaactgtgaagcttaccgcgagggtccgcggcttcgttcttgaagtcagtgagaccaagaacccaccaattccggacatattacctcacatagttaactttttggggagtgaaaacatttatttaaaaagatttggccgagctcggtggctcacgcctgtaatcccagcacttttggaggcagaggtgggtggatcacgaggttaggagatggagaccatcctggctgacatggtgaaacctcgtctctactaaaaatacaaaaaattagccgggcttggtggggggcgacggtagtcccagctactgtggaggctgaggcaggagaatggcgtgaacccgggaggcggagcttgcagtgagccgaaatagcgccattgcactccagcctgggccagatctcattttcaaatggtatggtgtgccctcatttattttttttcattcattcattcattcattcattcattcattcatgatgttttggctgaatgcctggtatgtgtggtaaggagagaaaggaaaaaagcaagtcataattgcttcattcagaaactatggaacccggattcgaatggggagacaactcttggatacttgtagagttaagaataaaagtttaggattcagggccagaataataacagtaacagttaattcgacaggaatttctcaaaaggggtactcagggtgaggaggcactttcagggagtaaggtataacttaggttcatcctggaatgatgggtaggaatcaatagctagaagcgaggtagcattaaaactgaattctggcagaatgctgcagtttcgtataagaaaagacttgttttaaataaaatacttcacagaaggtaggcagacattagaagtaagattctttttcttcttttttttttcaagatagagtcccactctgtcacccaggctggagtgcagtggcatgatctgggctcactgcaacctccgcctcccagattcaagcaattctcgtgcttcagtctcccacctgcttggactgcaggtgccaccacgactggctttttttttttttttaagttggagtctcactctgttgaccaggctggagtgcaatggcaggatctcggctcactaaactctgcctcccggggtggttcaagagattctcatgcctcagtctcccaagtagctgggactataggtgcatgccaccatgcctggctgatttttgtatttttagtggagacggggttttgccacgttggccaggctggtctcgaactcctgacctcagatgatctgcccacttcggcctcccaaactgctgggattcgggcatgagccatcttgcccggcctaatttttgtagttttagtagagacagtgtttccccatgttggccaggctggtcttgaactcctgagctcaagtgatccgcccaccttagcttcccaaagtgctgggattacagttgtgagccactgcacctggcccaaggtttttttttttgaagtaaaattattttatatatatatgtgtgtgtgtgtgtgtttaattagagaaagaagtaaagaaggaatgatcaatgatgttggtatagtgtaaaatgatccagcataatttattcactaaatattggcaaaagattatatattagcttttcagatgggtggttattgttctgataatgatgaataagtgtctaaaaattgttgcctagtaagagcaaaaataggaataacaggaatttttttttttttttttttgagacggaggctcactctgtcgcccaggctggagtgcagtggcaccatcttggctcgcagcagcctccaccttcctggtttaaatgattctcctgcctcagcctccagagtagctgggattacaggtgcccaccatcacgccggctaatttttgtacatttagtggagatggggttttaccatgttggccaggctggtcttgtactcctgacctcaggtgatctgcctacctcagcctcccaaagtgttgggattacaggcattagccacctcgcacaacaataatatgcatttttaagatcctgtaaatattttatttgttctagccaacacctttattgaaaagaaacactttttctactttagtgacaatttgtcatgttagacatgcaaatctgatagatgacaggagaaataaaggttgtccatttcccttgtaaccccgccccagagattttctttttctcttcaaaattactttagggacccgcaatagaaatgacgtaagaggccaggtgtggtggctcatgcctgtaatcccagcctgggtaacgtggtgaaaccccgtctgtccaaaaaaaaaaaaaattttgttgggtgtggtggtacacacctgtggtcccagctgtttgggagttctcaaacagctgagaggattgcttgatcccaggaggcagaggttacagtgagctgagatgatgccactgcactccagcctgggcaacagagccagatcctgtcccttcccctaaaaaaagaaagaaatgacgtaaaactgtgaattttggatttctagggggccaggaccatttaaaattcctagaaagaagtatgactaaattcttgttggttcttttgtgagtatgctagtgaataagttcttctcatgagttttgaaaattagttcgtatgggaaagttgcccaagaattatagtgtcacagggccagaaaaggggaaaaaaagaaaaaagaaacatctatttttgtcattttaatcagtagagtaagtcaaaaatggggaagattcttttgtcagttgtcaagaaggggactgtcacacctgctaagcaggttaagcttgtttttgaaagcttgcaatgcaatttgcagtaatttttttctcctgctactgaccagatccaaaactttacgttgttcacaccagaaccagttattcaatttatgaagcagttgattaaaacatttactactcattcatcattcattcattcatcccataagagttatatgcctatttaccagtaaggcatcatagttgtctatgtatgggtggctataccttcagggaggaaaaggtatagcgaatatggtagtgaataaatatccctgggtgtagggttcaattgtgaaagtaaagcattacataaacaaatgcaaccattattaattagttaccttctgttagctagcttggattttatttggcagataatggggtttgtatgatttgtgccatgtcacttctctgtgacatcactggcaacagacagttgtgtgtcttttcattcctcccttcttacattcataaacacatgtatttgtttactttaacaaaatgggatcatagtatactgtgctttagagtattctgtcacttgccttttccccctccacatgtccatacgctataatcatccttccaagccaaaacatctcaatctttgttgttgttatgaatggcagcattcatatttgatgaaaccagaattgatatgtcatcatatcttcaaggagtttccttttatttaaattaattattaataactttattagagacaagctcttgctctgttgctcaggctggagtgcagtggcacgatcataactcactgtaactttgaactcctgggctcaagtgattctcccgtctcagcctcccaaagtgttgggattacaggtgagagccaccaagcctggccaatttctaaaaaaaaaaatttgtagagatcaattctcgctatgttgcccaagctgagagtttctgttttaaaaatgcagcaaaactgatcagttctcataattgaattgaagctagataaggcatttagtattcgatttatttatttaaagaattccaccatcctttaaggggtcttgtgtgtacaaatttgatatgacatgtaacatttttctttctttttttctcttttgttttgtgtttgttttttgagatggagtctcgctctgtctccaggctggagtgcagtggcaccatctcagctcactgcaacctctgcctcccaggttcgagcgatcttcctgcctcggtctcccaagtagctgggactactggcatgcgcgaccacgcccagctaattttttgtatttttagtagagacggggtttcaccatgttagccaggatggtctcaatctcttgaccgcgtgatctgcctgcctcggcctcccaaagtgctgggattacaggcttgagccaccgcatccagccaacatttttcaaatagaaaatctgaagctaaaatcacccctaaaggacaaataacaggactacaaacagcgataagacaaggaattctatgggcaacacttaagtctactgcagcttgggctggatattctccttaaggaggaacctgtctttgattgttccattgcccttcaactctgagcctattcaatcattgcagagcttttgctcagtagccactctctgtattcacagaggggccacctgcctccctacccggcatctcggagcaccttgcgtgtgcttgggtgtcctggagagctgaggaagcctgctcactagggcatcttctgctcttgctgttttattgtgagcagaagggagccattcttctgtaaggttgggtgtacgatgtggtcctgttttcagggaatattcagtccttgccttcttctgccatttgatagaagactttggtgttttggtctgccgtaatatatttatactaatttgtaggccaggcatggtggctcatgcctgtaatcccagcactttcggaggcggaggcgggtgaatcacctgaggtcaggagtttgagaccagcctggccaacatgatgaaaccccgtctgtactaaaaatacaaaaaattagccaggcgtggtggtgcacgtctgtaatcccagctgcttgggagtctgaggcaggagaatcacctgaaactaggaggtggaggttgcagtgagccaagatcgtgccactgcactccagcctgggcaacagagcaagactctgtctcataaaaacaaacaaacaaatatatatacacacacacacatatatgtttatactaaattttaaaaattcaacctatgtggatcaaaaatttcaaatttgtctgttcaagtctatgtaaacatcattatgtaaaagtaatctgaaaatagtttttcatgcaacaagaataatgtatattttcagtctcaaagttgaaatgaatgagaaatgtcaaaacaaaatgaattgattgggaaatcaaatctaagcactgacaaatatgaaaagtgtattatctaattagtagtttatgaaagtgaggcacttttataatcaaagaaataaaaccttccagagagatacagaattactctgacctgaattattttaatgggaaagagttgtttttgtttaaaaatttcaggtgaagtttgataattttatcttaagtccacttggcttcattttgttgggcagcattggacaggacagtgcagccttatacagatgactctcagttctttaaaaaaaaattaaaatgggtccatgagaaaataaaaatttaatgtatcttaagtagaggatcttgagaaagctaaaaactgcttacctaaactgagacattaccacggatttgtagctaagtcatttagaatagactttatttgtaaatgtaaaatgatactggcaccaagatatggttgtgaaataggaagtctccagaaaataatgaaaaattataaaccgtgcccatagacaatagtcagcaaaaacagattgtggaaagacaggaagacagagcttatcctagtcatggtactgagtggagaaaatctcagaattgtgtgcactcaaaaactgtgcagccctgttgaaaacatttcttgtaatattatcttataatagttacatctacctgcacactgtctcaaaataactttagtgtcacaataattttggttgagctcaacaacgttcttttatctttctaagccatattcatttctcagggatgattacagaattggttaatttgaaagagttgtagcataaatattgtgactcatgaaatgtttttagtacttgttttagactttcatttcctttggtcatgctcttgtgggagatttaagcagtaatagcattttcatttttctttcctgcattccttacccatgagaaggtaatctttaatacactgtttttacttagtaagttctggtgttttaaagaaatgggttttttattcaatcataatttattgaacacctactaagtgcccagcacagaatcagatgttaatctaacataattttccttttttcaaatggtcttatttgattttttaaaaaatggatattaatgtacactagaatggagatttttgtttaccagttatttgttgctatataaatgtgggttaaattagtttttcttccttataccaccaacctttcagacttttaaaggaattactgtagaattaaaattaatagattcctcagtactggccaaactcatggatttgtggcacttcagaataatattggcttttaatgaacagaatagatttgcatggaaatgccagtttcagggatagaattagagttgggatttattttttccctgaagatctgcttcgaaaatttgccccaggtgatctctgtccttgtcctagggtcactccagaattaccacttttttctgcttgcgattcataaaggtaagaaggacaaacttagtctgttttgtagtggaattgttatttttttttaaccttatcttttattttccatgtaaaattgcttttccctctttaactacctcgcatagacagggcaggtagagtgaatgtcagatgaattaaggtagcactgaactccttatttagcctgtcaatagctgcatgattgtttttgcatgaaatcccaagttcgtattagctgctcaactttcaaactttaatggggaagtcagtctttattcttcagtagtgtatgatccgtgaattaagtttgtattatgccttctgtcccaaaatttcctctctcttagcttctccctagccccagagatcagtttctctgcatgtgtcaaacttccttttctctcctcatatttcattcttccaggatctgtaatgtgtccaagttctcatagctcacttaaaaatggatggagtccagagggatcagtgccgacttttcattaatctattagagcttcacatttactggcttgcgccaagagatgtgggagaggaggaaaatgagtaagatctcacctcctggaaaggagggtgccactgctttttcagtggtagagttgctcccttaaagcagactctctcccagctgaattctgagctgagtgttacagagataagtcagcttgaatctggaggagtgagagagtttggctagggccctgtgacagctttgtggtcaggaaagaatatgtaaattcactgaattcccaggcatttcagccctagaggagaaggattaggggaatccaagagtcctgaccttactgtgagactgaattataactagagccctttttaactaacacagcttgagtttcatatttgaaataacgcttaaatcaaaatagtctccactcttcccatatactgatgggaaatttattaaatgttaaagtctaatctgaaatcaaatatagctttaaataaaactatgcaacatcatttagtagtgtttataacttgagtgatgactgtctgggctcaataacccagataggagaaggaattccatggccctccttcccaatccagacctgtctggaagcatttatttgtactaagttttccagtctgaaagtctgtgtcattgtttagactctgtgtgaataaacagacagagcaataaacttcctcttcaggtgaggtttatatcttttaaactagactgtggcctctaagccatggctttcctgtagagaggctgcataattcagttctgcagatgttttggtgaggctttaccatgtgcccaacctgcactgtgttcttttaggcataatgataattgcaaagaaacatggctcctaatgaagttgtagtcatttttgggaaaagtgagtctgacacacattaattaagatacctacttcagaaaatcttaaaatatgtatcatcgagggctgggcgcggtggctcacgcctataatcccagcactttgggaggccgagacgggcagatcaggaggtcaggagatcgagaccatcctggctaacacggtgaaacccagtctctactaaaaatacaaaaaaaaattagccaggcgtggtggtgggtgcctgtagtcccagctactcaggaggctgaagcaggagaatggcgtgaacccgggaggcggagcttgcagtgagccaggatcacaccactgcactacagcctgggcgacagagcgagactctgtctcaaaaaaaaaaaaaaattatatatatatatatatatatatatatatatatacacacacacacacacacacacacacacaatcaaatgtcatcagttcaagcagatatgcgctttgtagtcaggaagaggaaaaatgagtgttggctttagttttggggggaagtttgctgaaataaattggatttaagatgatctgtgcagaatgtgttcacttttgggtgccagattttaataaagttatcatggagcttcctatttgggtatcaggcatgacttaacatctaaacatcaatccctacaaccgtaggctagggctcagacctagagtcctcaatctggtccggcctgcctaaaacccttgtttatttccccaatatgctgtacaaatggtattatttactctgggtgcatgacatgaataatagttaagtagcactgaattagaggtatttctttggaaggcaaagggtctagaaaccaggtctcttgaggaatagttgaagggccttggcatatgagcttagagccgaaaagattaaggacaaacaaaatagttattttcaaacattgcaaagacattttgttacagaacaagtttatttgttctacatcaatttaagatgcagcatggggcctgttgggtagatgtacaagtgagcacacaagaatccagctcaaataagaggtttctcacgattaaaatgctcgacagagcactgtttttcagagcagtgccttcttcatttctaaaagtgttaaagagaaattggatgtccttgcagccggctatgtggctagggtggctgggatgcactaagtacgtgtttagggatcccaggcaagtagaaattatggaggctttttagaaaaagacaactatagcatgaacagacacaccaggggaacaatgagaacaggaaatgttcgtgtgccaggaatgtgtggaggaaatgacacgagcatgagattggtgatcaagaactttaaatattctgataggcagtggggaaccgtcttgcttccagtcctggggaaggatatcacaaaaccaatgtctgaggaagctttgctttctgtcttgtgccagaggaatgttaggagagagggaaagagatatattccatgcagggagatcactttgggagctttccccaattatactctttcttaactgtgctatgggtgggtggagaggggagtaatggaaacagagacggaacataatcagaatttaatggaagagctaatatgggtttccttgaaaattgtcctgaaatagaactctccaaattattaattgaaagtgatgtggtcagtttgttagatcagcagaccacaatcagatatctgcatcttggtgcaccactcaagctgaccagtgacctgagacaagtcattaaaattccttatattctaattccctagcagtattatcccagcatgagagaatgtttgcaaaacattctgagtcttggatgaaaggtaccttattataataatattatactataattattcttgttattggggttattgttctcaacattgatgcaatttaatacttcctaccttagggatatttttgtcttacagcagaattgtgaaagtggctttcctgggagatattctttgaaagactgggaaatctttcaaatatttgttttaataatagctcattgaggaaatgtgaaaactatgtaatattaaggattatcactcctattttcttctcaatctaatatctaggatatgttgaaaatacttttgtttcatctccttacagggagctagaatggtttagattggtgctttcctggggtactgattttttttttcctgtggaattctctgaacagggctttcctcaaaagaatacattaagactgtcagaatgattcttttcagcagattaagccttgcagatgccctttgttgaaggaaaaaatgcattattctgaaagtccttctgatcttcaggaaaactgaaaatatcaaatattctcctaccatttgaacttccctacaagaaaaccccagatatttttattttctggtctacaataattcagagcttattgtattttaagatgaggatatagacatgttttgaagaaaaattaactttttacatattcatttactgaaaggaagacacccttccccccaccctggaaagacagaaatcatagtgcttcgtttttatttttttgtttcctatttcttgcacctggacattttcctggatgaagtgatgtgtacggcataattatcctgggacataattgcttcatgtgtgtcagcaagacatggttcagatatttattgagctctggttgtctgtgtcctaaataagaccgtgctatttcagggttgcaaaaacaactccaatgcattggaaaaagcagaaaggaggacattcctcaaaaagagttggtttcatggtttagaaatccatttattgcttgcaccgacagactgtgcttgagtgtgcgaaggctcactttgatttataggggcttataaaatgctctgctctttgtacccaaagccacagacctgctgtgaatagggcacgggccctgagtttttctggtggtcaaatttataaaaccaaacaataatctctttgggaagctcctcaaaggcgagcctgagtctgttaacttcagtctgtacaatgtctagcatagggccacatgttgacgagccctcataaatgtccttgttgctgttgatgaatgaaggattgaaactgggaatagcatgtagggcacaggcgtttgttttccatgacagataggaagagagcttgtacatggggaggggatagatgggggggtcaaggacatattttgggggatgctactgtattctttaagaaaaaggaaaaatggctcaaattatctttcagtagtgtcatggccctctgctaggaaactggtttatgatttgaaggtgtctgagacgttcactctgattacagtgcaaagggtcatttgcactctatgatgcaatgatggcggaattctgtctcaactttgctgtcggccactctgactagtgttttttgtttgtttgtttgtttgtttgtttgttttttgagagggagtctcgctgtcaccaagctgcagtgcgatggcaccatctcgctcagtgcaacctctgactccctggttcaagcgattctcctgcctcagcctgccgagtagctgggattacaggcaagtgccaccacgctcagctaatttttttttttttttttttgagatggagtctcgctctgtcgcccaggctggagtgcagtggtgcgatctcggctcactgcaagctccgcctcccaggttcacgccattctcctgcctcagcctcccgagtagctgggactacaggctcccgccaccatgcctggctgattttttttgtgtgtgtgtttttagtagagacggggtttcagtgtgttagccaggatggtctcgatctcctgacgtcgtgatccacctgtctcggcctcccaaagtgctgggattaccggcgtaagccgccgcacccggccatttttttgtatttttagtagagatggggtttcaacatgttggccaggatagtcttgatcttctgacttcatgatccacccgcctctgccttccaaagtgctgggattacaggcatgcaccaccacacccagcttactctgactaatcttttatttcagtcccttccccttccctttctccctcattccccacttcctttcctcccacttttcctttcttccttcctcaactacttgtttaaaacctgtttctcttctaggctataaagatcccgtttccttcccatagctgaagaccatttagggaaggtggaagtacatgcctataatcccaactacttaggagacagaggcagaaggatcacttgagcccgggaattttagtccagcctgggcaccatagcaagcctccatctcaaaaaaagaaagcgttttcatatatgagtaaagctgaggcttgcttatgtccagagggggaaaggttacacattttcaaatatacctgttgcattttcttacacagaaagtgggatagcaaataaatagaacatcttgtctgtaggatgaatgtaaccttaagaagtattgcagtgtgttattattgcttaaaatgtatttatttaagacctctttgttgagaaaatttctcagtttgggtgaaaagatagagaatggaaccagtatgcagtagttatattgttgagggagtcttgaagtggcaaagaaaatgaagtatttctttcaaatagtattttgcaaccgaactgaaattccactctgcacaaatgtgcctgcgaaaagttacagtaatttaggattgaaaaacctgtatgttgctaaattcatagttaacctaattttagtttttgcagaaaagacgatttatagtatgaagaaatgataatacttttttaggagttttctttttttcttttctttcttttttttttttttttaaagagacagggtcagccaggtgcggtggctcatgcctgtaatcccagcactttggaaggctgaggtgggcagatccccatctctacaaaaaatataaaaattagccatgtgtggtcgcacatgcctgtaatcccagctacttgggaggctgaggcatgagaatcccttaaacctgggaggcggtggttgcaatgatctgagatcatgacactgcactccagcccaggcaatagagtaagactgtctcaaaaaaaaaaaaaaaaaaaaaaaaaaaaaagatggggtctcaccatgttgcctaggctggtcttgaactccaggcctttagcaatcctcccaccttggcctctcaaagtgctggaattataggcatgagccactgtacctggactaaaaaagatttttcatgcgaaaattatgtgatttttggttacctttgttgtaaaaacattttttcctttttatttgcttcctagagctctattcagtgagaaggttttattctgtgtattaatcagcacacacttcccatgcacatcttctcctaaagtgaaggcctccaacctgaatttcatccctgtctccaatctaatctttatcagggtgattttgacttcgtcctaccctctggatggcagtggggccacaggtggtaactgtcactctttgaagcttcctcatgtccataggcctcggtcccgggtccatttgttctcagcagcgggttgtgccctttgcatctgagcttgttcagtgtccatagtccatggtgtccctcctcaggtctggctttgctttgtggttcacatggctcacaatccggcttgcccaggatactgccactgtacccctgctgctccaccatagttattcagaacaccactttccttctctagtttcgttcctgagttatttcaggtattagtgcagagaggggccaggttcagcttgggtgttactttattttttaatttttaattttttaaaaatttatcattattttttagacagagtctcgctctgtcaccaggctggagtgcgatgacgcgatcttggctcactgcaacctccacctcccgggttcaagcaattctcctgcctcagcctcctgagtagctgaaattacaggcgcctgccaccacacccgggtaatttttagtagagacgaggtttcaccatgttggccaggctggtctcaaactcctgacctcatgatccacccgcctcgacctcccaaagtgctgggattacaggagtgagcccgcgcctggctgcccagctaattttttttgtatttttagtagagacggggttttgccatgttggccaggctggtctcgaactcctgacctcaggtgatacacccacctcagcctcccaaagtgctaggattacaggcgtgagccaccgtgcctggccttgagtgttactttaaatctaatattgttgtattggggtagaggtagagaaaccattgcctgtagtaacttagtaacaatgggtctatattagtagggttctgatctgggaagaggatatcaattatttacttaatagataatcatttaccacctattttgtgtcagatacagttccaggtcctgggaattatagaagtcaagaaaacagagtcagggccctaaagaagcatgcattttggcaagagacagtggcaataataataataaaaaaagatataatttaatgtcgggtaacaataaatgctgtaaagaaagcatagcatggagatagagaagttgctgcaagagctgttttagagggggcggccagggacaacttctgaagaagggacacttgaaccatcgtcacagtcatctagatagatcacagtcatctagatagatcttgtgcaacgggaaggcctcttcgtattccctctaagctcatagaggatcgtgaaaagtctgtggaatcttactggggataggacagtaatttacacagtgctatggcgatttgttttgtatgtattatcttcagctgctgggaacttgctttccatagtccatctctagccatctccagtcccaacaatcctacagcctacatttgctgtttggtatattacccagatcacgttttcagtcactttatttttttatgtatttatttattttttgagatggggtttttctcttgttgcccaggttggagtgcaatggcgcggtcttggttcactgcaacctctgcctttgaggttcaagcgactctcctgcctcagcctcccaagtagctgggattacaggtgcccgccaccatgcccggttaatttttgtatttttagtagagatggggtttcaccatattgggcaggctggtctcgaactcatgacctcaggtgatctccctgcccctgcctctcaaaatgctgggattacaggtgtgagccaccatgcccagccgtttcagtcactttaaaagttctaagaggtatggagagagaggggcattttagaacatggagccgcacagctatagaatgtgtcctggcgctgttccctgtccgtcatgtggctctgtaggaagaagacattctgggaaattctatgctccaggtcctagcttggagcctccctccctctgtgaggtttgcaacatttcctgaaccttagagagtaaagggaaatgtgctcctatatccagaacttccaaatgtaagtgtttgccaagtgctttgcaatctgcctttccataatttctctcattatctctgtgatgggatttatcatgctgtactgcactttactgagtaaatgtagggacagatggaggtggcagactggaggagaagagcaagagatgacattgagctgggagctcttcacaggaatggtccgtctgtgggcttcctggggggtgaggaggggggacaaatatgtgattggcacatggtattgccattcagtaacacctgtggcatgaataagctacctagggtgaaggtgagctgctgtttcgaagttttgaatacaattatattttaaattaatgaagagatcctggcactgaggaggttgaaatccttttgcatggtggattttctggatctgaattttataaggaatttttttttaaatagcattgaaagatttttagtagatgaagacaacatgcgtagtaaggtggccattatatggtgagtcagttcactatgccctaggatttgaattgctgttaagttttggatgttgtaactgactgctggttggtctgttcctatttttgctgctgttgttcatccatccaaccatgcatctgtgcatccatctgtccattcattcatccattcatccatttatccatccatccacccacccacccatccatccatccacccacccacccacccacccatccatccatccatccatccatccatccatccatccatccacctctccacccatcaatctgtccactcatttctattacttactagtagtgtgattattttcttcatctcacttggactcagttttcttcatctacagaatggtgagttttgtctaggttattgaaagggtcctgttaattctagaatcctaagattcttaccatttgattacagtttgtgcaagacaattggaaagaatacaaacatgaattaaacatgggttctgccctccaaaagcacattgtctggtaggcgtgctgacatagaaacatggcacaaatgtgagtagagaatgaccaagtaccaaacacagctgcggttaatgtgtgcgatgggaatttcaagaaattcaagaaatttggctgcagatgttaaggaaggcttcagaaggaaggtggcatttatgtttgagtagagcaaactgacatgtattaacatcatcagttgattagcatcctcatttcatttaatgttcacagtagtgtatggtcttcactttactatccccatttagcagatgaagaaactgaggcagaaaaggagattaagtaactggcccaaagccacccagctgtattgtggcagagttgtgattaagaggatgtctgtcaaccccctttcatccttttgtcttaaaaaatcgagtcagtaggccgggtgcggtggctcacgcctgtaatcccagcactttgggaggccgaggcaggcgaatcacctgaggtccggagttcgagaccagcctgaccaacatggtgaaaccccgtctctactaaaaatacaaaattagccgggtgtgctggcgcatgcctgtaatcccagctactccagaggctgaggcaggagaatggcttgaacctgggaggcggacgtgctgtgagccgagatcgtgccattgcactccagcctgggcaacaagagtgaaactccgtctcaaaaaaaaaaaaaaaaaaaatcgagtcagtagagagatgaggattgcaggattcctccctttccctcccctccactcccctccgctctttttttgagacagggtcttgctctgtcccccaggctggagtgcagtgcctcgatctcaggtcactgtaacctccgcctcctggactcaagctatcctctcacctcagcctcgtgagtacctgggatcacaggcatgcaccaccatgcccagctaatttttgtatttttttgtagagatggagttttgccatgttgtccaggctggtctcaaactcctgatctcaagtgatcctcctgcctcagcctcccaaactgttgggattacaggcgtaagccactgcacttggcccaggatatttcaggtgaagaagaccatcagtgccctggcacaacgaggtggaagtgccctgtgtacctgagaaacagcacagacttcggtggcgctggagcacagtgtcccttaatggcagcagtggaaaccgagcctgggatgacagcttgggattcgaggaggctttttattgtctgactacagggtctggtctttatttggcccagatggagactttgtgcagggtggagacatgatcagaggagtacatttcaggatgtttatgactctaagaccttcttatgattccaacatcctttcatgctcctaagctcttccatgtgatgctgaggaaactcccctcccctccccagatgtctcctgcagcctcagcccttgagcattttcatctctgggtttctgtgctaaggaactcagggccctggcttcccatcctaccattctgaacatcagcacctttaaaaaaaacccctctcaattcttgggattctgagaagaaaactccttcatcttcccctttctgctctttcctagattttaacctaacttcagctatttcagaacgttttctgttcaataaatgaataattagatcttcttgggctttgccagtgaaaaatataccataatatttagattaaaacagtgtaatgactacactagcaaaatacaccccggttacatgatgaattcctccttttcatttttatttgtggtatcctggggtggcctactggagaaaaaaatactatttgatcctccctgggtggtcagacaggacttgtaaagactcctgtttgttttgtgttgaggtttcaaaggcacgcaggcttttctacataaagatgttctaagaaaatacggatttttttttgaagttgctgtgtataaagggaaattcaaagcaaccgtcttcccttacaactaccagctaatgtgattagagcgtctcttttcaccaggcatctttgttgttaccatctctggtcattaccaccagtcttgaggggagatgtatgcttacaaaaaccacctccacctggctttatttttggcgcgatcacacaaacatgtgttttaattttaaagattatatttattgtcacatttagattttttttaaaaaaacactaagaaatctgagtgttgtgtgtgtgtgtgtgtggttcaggatgcactggaggtgtgtgctgccacaacaaatttcaggccacgtgttctgcagattccaattagcaaggccctcctgctgtggtgtgggagaaaagtttggagtggggttagggctggctgagtgtaggaggctttttaatgcaatctttgcagaactccctcattagcacctcgaggtcagtgggaactggtatacagagcacagttggcattttctgctatgcatggtgtgtgtcagccattttatttatccatgcttattttctccgtttcataaaattaattgtacttaatgggggaggggttgataatgctgaattattttaagcctggagggagctcagcagctgtgtcctagatcagaccaccgatctatctaataggttgtcttgctaccggatccactggacgaatgtgtttcgccaattagacgaatccctatatggagagaaaaatgaccttgagccccagaaagccagacagttgcttcgtgccatgtcttcacctactgaagctgcttcaccgccttggcctgataggagtgtagtatatatctaacctctagacaattaaatttctcctttaaaaaaatagccactcttatgtgaaatagtcaaatctttcatgacttgccaagatacttgcttttggaatcaggtgctttcgggtgtagcctctaaaaattttaaaggagagcaaatcttccaagcttccttcttgtatcaaggcataacctgctgaggtccaggctgcagtgatccatgatcatgccactgccctccagcctgggtgacaggctgagaccctgtcgcaaaaaaaaaaaaaaaaaaaaaaaaaagacataaccccctgctataaaatatatatatgtgtgtatgtgtgtgtgtttaagaggaatatcagagaaagataaatttttaagtaaaaggaaatattataagctaattttgttgggtattcttctgggcaattattttatcatcgaatacatttccacaaaatgccagaattcttttttttgagatggagtctcaccctgtcgcccaggctggagtgcaatggcgcgatctcagctcactgcaaactccgcctcccaggttcaagtgattctcctgcatcagcctcccaagtagctgggattacaggtgcgtgcctccacgcccagctaatttttgtatttttagtagagacggggtttcaccgtgttggccaggctggctcttaaactcttgacctcgtgatccatccgccttggcctcccaaagtgctgggattacaggcgtgagccacggcgcccggcccaaatgccagatttctttaaaagataagcctgggcacagaaaacaaacttgatgtatgatagaatcttgcactttttaagtcctggagttaaaatttactgtggctttggtgtgactctaccagcaacaggatggcactcagtagagggcacatggtatagtgggaaaacctcttgggggtcaaccaggtccagattttgatctgtgcctctgctgctactagctctgtgaccttaggcaagttactgcacacacttggccccagtctctttgtagccttctgctgctattgctgctagcttcacaaaatcgtttcaaaggttaaatgaagtaaactatataaaataaatatctagggctgggcacggtggctcatgcctgtaatcccaacactttgggaggcagaggtgggtggatcacctgaggtcgggagttcaagaccagcctgaccaacatggagaaaccccgtctctactaaaaatacaaaattagccgggcgtggtggcacatgcctgtaatcccagctactcaggagggtgaggcatgagagtcgcctgaacccgggaggtggaggttgcagtgagctgagatagcgccattgcactccagcctgggcaacaagagtgaaactcccatctcaaaaataaaataatatataatataataaaataaataacatctagcttatatattaatgttagttcattttcttttcttctcattacatccaaggactagtaattttccaagggtagtaatgttccattaattttgggagtcactctggagaatcctgtaaattttccagatactgaaatctaagcctacaaaggcttaatgactctcttgcaatgccttaggagtagcagagttggtgcccaaatcgtgcctcactgaatgcttccagctttactacaggtgtgaggacgacgtagaattctgcactgagtccctggcgtggctctaaaacagtcaagtgcagtgacggtcttaagtgtagaaaacactcgactttccagatcttctaggaaccttcaaaatacacagaaatgtgtagtgaaaccttaccctactgtgtcgccgtcagtttacttttacaacttttgactcagtttccctttctgtcccctagtaccctcaggtgactacagatgtgttaacacccagcatgttccggtaggagactttctggatggggaagatttccaggtaaaggaccaccctgattcccttcgtggctatagcctgctgcctgcccttccatgggctgccgcagacttcctgatggccactgctgccttcctccttctccttttttgcattgattgattggttccttatctatgctatttttctatgattttttggtattatttttaagtattcatacgtgtacactgttaatgatataaaacatgcatggagtggtaagccctaacttcagga

SEQ ID NO: 388 - DNA, 35127 bp, Homo sapiens
caggtatacatgtgccatgttggcttactgcacccatcgactcatcatttacattaggtattcctcctaatgctatcctgccctccacctcccaacaggccgtagtgagtgatgttccccaccctgtgtccttgtgttctcattgttcaattcccacttatgaatgagaacatacagtgtttggttttctgtccttgtgatagtttactgagaatgatggtttccagcttcatccatgtccctgcaaaagacatgaactcatccttttttatggctgcatagtattccttggtgtatacctgccacattttcttaatccagtctatcactgatggacatttaggttggttccaagtatttgctattgtgaatagtgccgcaataaacatacatgtgcatgtgtctttatagtatcatgatttataatcctttgagtatatacccagtaatgcgatggctgggtcaaatggtatttctagttctagatccttgaggaatcaccacacttcttccaaaatggttgaactaatttacactcccaccaacagtgtaaaagcattcctctttcttcacatcctctccagcatctgttgtttcctgactttttaatgatcaccattctaactggcgtgagatggtatctcattgtggttttcatttgcatttctctgatgatgagcattttttcatcatcattttttcagtgatgagcattttttcatgtgtctgttggctgcataaatatcttcttttgagaggtgtctgttcatatcctttgcccactttttgattgggtcatttgatttttttcttgtaaatttgtttaagttattggtagattctggatattagccctttgtcagatgggtagattgcaaaacttttctcccattctgtaggttgcctgttcactctgatgatagtttcttttgctgtgcagaagctctttagtttaattagatcccatttgtctattttagcttttcttgccattgcttttggtgttttagtcatgaagtctttgcccatgcctgtgtcctgaatcgcattgcctaggttttcttctagggtttttatggttttaggtcttacatttaagtctttaatccatcttgagttaatttttgtataaggtttaaggaagggatccagtttcagcttcctcatatggctagccagttttcccagcaccatttattaaatagggaatcctttccccattgcttgtttttgtcaggtttgtcaaagatcagatggctgtagatgtgtggtgttatttctgaggcctctgttctgttccattggtctatatatatgttttggtaccagtaccatgctgtttcagttactgtagccttgtagtgtagtttgaagtcaggtagcatgatgcatccagctttgttctttttgcttaggattgtcttggctatgcggtctcttttttggttccatatgaactttagagtagttttttccaattctgtgaagaaagtcactggtagcttgatgaggatggcattgaatctataaattaccttgggcagtatggccattttcacaatattgattcttcctacccatgagcatagaatgttcttccatttgtttgtgtcctcttttattttgttgagcagtggtttgtagttctccttgaagaggtccttcacatcacttgtaagctggattcctagatattttattcactttgtagcaattgtgaatgggagttcactcatgatttggctctctgtctgttattggtgtataggaatgcttgtgatttttgcacattgattttgtatcctgagactttgctgaagttgcttatcagcttaaggagatttcgggctgagacgatggagttttctaaatatacaatcatgtcatctgcaaacagggacaatttgacttcctcttttcctaattgaataccctttatttctttcttttgcctgattgccctggccagaacttccaacactatgttgaacaggaggggtgagagagggcattcttgtcgtgttccggttttcaaagggaaagcttccaggtttgcccattccgtatgatgttggctgtgggtttgtcataaatacctcttattattttgagatatgtttcatcaatatctagtttattgagagtttttagcatgaagggctgttgaattttgtcgaaggccttttctgcatctattgagataatcatgtggtttttgttgttggttctgtttatgtgatggattacgtttattgatttgcatatgttgaaccagccttgcatcctagggatgaagccaacttgatcatggtttataagctttttgatgtgctgctggattcagtttgccagtattttattgaggattttcacatggatgttcatcagggatattggtctaaaattctctctttttcttgtgtctctgccaggctttggtatcaggatgatgctggcctcataaaatgagttagggaggattccctctttttctgttgattggaatagtttcagaaggaatggtaccagctcctctttgtacctctggtagaattcggctgtgaatccttctggtcctggactttttttggttggtaggccattaattattgcctcaatttcagaacctgttattggtctattcagagattcaacttcttcctggtttagtcttgggagggtgtatgtgtccgggaatttatccatttcttctagattttctagtttatttgcatagaggtgtttatagtattctctgatggtagtttatatttctgtgggatcggtgctgatatcccctttatcattttttattgtatctatttgattcttctctcttgtcttctctatttgtcttgctaacagtctattttgtgatcttttcaaaaaaccagctccttgattcattgattttttgaagggtttttcgtgtctctatctctttccgttctgctctgatcttagttatttcttgccttctgctagcttttgaatttgtttgctcttgcttctctagttctattaattgtgatgttagggtgtcaattttagatctttcctgctttctcttgtgtgcatttagtactataaatttccctctataccctgctttgaatgtgtcccagagatactggtatgttgcgtctttgttctcattggtttcgaagaacatctttatttctgccttcatttcattatttacccagcagtcattcaggagctggttgtgattggcaggttttaactggacgtttgaaactcatttttatggagaacaacgaacttggaggggaaaacaatccagatgtgaggaataatttgaatctgtcaggtctattgtaaaaatcacttttgatttccatgtggtattgcatagagtgttcctgaatgtaaccagacagttcacccaggcaagcggtcaacaaggaacacaccttccccagagtctgcaggcgctgaatttcatcttctttttcatctaattccacagtcctttaaatccccataagctaaatttcttgattccaatttcagaaggagctttgttacaattaactaaattttaaattttaggctattcgaacaaaaaattctaatataggaagtaaaataatattgcatttcctcatacatttcttcccctgtgtgtgccatttcccaattcggaggaaaagaatattttaaaactgtttttttttcctgtacataatacacaatcccttcccctctcacacactcttttttgtccaggtttaaaatagcaactccagctgatggtagacactgtttggggattttaaaccactaatcaatttcgcagctggaggcaaagcactttgcttggaaatatttttcacataacatacaaggtgcttcgacctcagagcagcccagaggattccgctgaaggagaggggaggctgctgacccaccccggaaaccagaggaaagtgaggtggtggcaggaggccacagccacgggcaggccacgggcaatcactagctaccttctcctaacctttttctcccacacactttcatttttaacaaactgagccacagaacaaggaaattccaacttctgcaggaacctctgggagcagagaactaggaaggtaaaagctacctggttccacctttctggactgagagtaagacccaaagttaaagcgtaggaagaaggaaaccctcctttggaatgacactgttctctcgcctggtggtgctcaggcttcagcaggatcagtatcagagagggtatgttagaggctggacgtggcggctcatgcctataatcccagcactttgaaaggcaaaggcgggcagatcagttgagctcaggggttcaagaccagcttgggcaatatggcaatacctcatctctccaaaaaatacaaaaattagctgggcatggaggcatgcccctgtaggtcccagctacttgggaggctgaggcgggaagatcacttgagcccaggaggtggaggctacagtgagctgagatcacatcactgcactccaacctgggcaacagagcaggagtatgtctcaaaaaaaaaaaaaaaaagattgtgtgttagagcccagatagctgagcctgactcaagttctgattctgcaggccagggcaaggcctgagaatctgcctttaacaagttcccaggtgatgctgatgttgctggtcctaaaacgaccttgggaaccactgatcttatctaccccatccatttgctttctatcactggcatctttacttacaggctagttggcttcctttgtgcctttcttacaaacacactgcttcagacgggcgtggtggcttacacctgtaatcccagcgctttgggaggccaaggtgggcagatcacgaggtgaggacttcgagaccagactggccaacatggtgaaaccccgtctctactaaaaatacaaaaattagccaggcgtggtggcgtgtgcctgtaatcccagctactcaagaggctgaggcaggagaattgtttcaacctgggaggtggaatttgcagtgagccgagatcatgccattgcactccaacctgtacggcaaagcgagactccatctcaaaaacaaaacaaaacaaacaaacaaacaaacaaaaaaccacacacacacacacacacacacactgcttcattccctaacagtttctcaaatggcagtttagttgaatctgaggaggatggtacactaagacccatgtggtcacattattgctcttgcctaattttagagtaactacatcaggagagtaacagaaaggaccgtattgtaaaatcataattttaagaagccgggtgttgtggctcactcctgtaatcccagcactttggaaggccaaggcaggagaatcgcttgagcccaggagttccagaccagcctgggcaacataacaagactctgtctctacaaaaaataaaaatcagctgggtgtggtggcttgcacctgtagtcccatctacttgggaggctgaggtgggaagattacttgaatttaggagttcaaggttgcagtgagccatgattgtgccactgcactctgctcagggtgacagagcgactctatctcaaaaataaaataaaataaaaaagtaagagatttttctttaagctgcaaaatatatttcactgatacatgtttcattaattcaattcaataagcttttactgagtatttgtgtgtcagtatgtgatgggattataatacttcctgctatcagactcttttcccagaaaatcatcaaattattattttttgagatggagtcttgctctgtcgccccggcacaagtgcagtggcacaatcctgactcactgcaacttccacctcccaggttcaagtgattctactgaatcactcccgggtagctaagattacagatgcgagccaccatacccagctgatttttgtattttcaggggtttcaccatgttggccatgcttgtctcaaacttctgacctcaagtgatcctcctgcctcagcctcccaaagcgctgggattacaggcatgaagccaccatgcccagcccaaattatgcacaggtaacagttttcaaatggaagcagctttcttcattttctactcagaaataaattgtctatcatgccatagagtgacttctccattctcgctggagctcatttcagatgtagctggggttgttttgtttgtttgttttttaaagatagcatcttgctctgtcacccaggctgaagtgcagtggtgtgatcatagcttactacaacctcgaactcctgggctcaagcaattgccccacctcagcctcctgagtagttgggactacaggcatacaacactatgcctggctaatttttaatttttttgtagagacaaggcttcactatgttgttcaggctggtcttgaactcctgggttcaagtgatcctcccttctcagtctcttaaagtgctgggattacaggtgtgagttgcctcagagcttagtggttaagaacacagctctggagtgagatagactagaacttgggtgtgctttttaaaaattatgtttaagttggaaaaaaacaattcttttttttcttttatgagacggagtcttgctctgtcacctaggctggagtgcagtggcgcgatctcggctcactgcaagctccgcctcccgggttcatgccattctcctgtctcagcctccggagtagctgggactacaggcgcccgccaccacacccggctaattttttgtatttttagtaaagacagggtttcaccgtgttagccaggatggtctccatctcctgacctcgtgatccgcccacctcggcctcccgaggtgctgggattacaggcctgagccaccgcgcccggccaagaagaaacaattcttacctcatagagatgcaccaaatccatactttggctgaattctaaatggctaaaagtggaaaagttactgaggacaaagccaaatattaccatcataacatggatttctggaataaaaaaataaacctgatattgttattaaaatgtaataattaactgtatcagttatttattgtcataataacactatggaaccagtaactataaaccttcagttgtatttaacaataaacatctattcttcaccactctgtaggtcagttgggtggtgctactgacctgggccagacctgtagggtctcagccgggctgactcagctcctgtggctgcagccacttgccagatgggtggagggctgcctggtacaggctgttatcagcttagaccacctgtctctgcttcatgcagtctgtcaacttccagtagagaattgagcttgccgtcatggcatgagagggttctaagggtgggaatggaagcttgcaaggcctcttgagaactgagttcaggacggtcacttctgctgcattctgttaggtaaagtaaatcacaacgctgcccagattctaagtgtgaggaaatagactccacctctcggtgggaggggctccaaagtcatattgcaagggccctgaatatgtgcaggggtagagaattcgagccattcttgcattcaacctgccacattaacatgtttttatcattaaagttgtttcagttaaatgttctaagtttgacatgacggggaagatacaataatttctccactgtcagtaagatttctcctctgttagctgcctaccttacatataaataaatagagcccactttcacctgcgattgttagagaagcaaggtgtttgactagctcattttaatataaatatcctatgtttctcccttttgtctccctttagtctttattatatctgaatcaaagatgacgtataacatgccttgttgtagaatgatttgggaatttttcttccttgtaatttttttttttttgagacataatctcacgttgtcacacaggctggagtgcagtggcacaatcacagctcactgtagcctcaacctcccggactccagtgatcctcctgcttcagccttccaagtagctgcgactacaggctcacatcaccacacttgggtacattaaatatttttttggagagacaggggtcttactatgtttcccaaggctggtctcaaactcctggcctcaagcgatcctcctgcctcagcttcccaaagtcctgggattacaggcatgagctaccatgcctggcctactaatcttttttgttctgccatgtattatcatctaaatttccatgtacatttgtggactcaaaaaaggttatgtatcctaaaacatgctttcttttacataagattaatgacttctgtactcaccacagtcttgcaataagaagtatgaattcatactttgactgactgatagaattccaatctctaaacacttaaaggaggtttttcacttcaagtttcaggtagaatgtttacctatatttaaaagtgaatactgtattttaatattaacaacaaattaaaatatcacaccacatttgtatcactgatgttcttataatgattagatacactggttcttataatgattagatacacccctgaacttgcatcagatcaatggtcatctacttgcataggttaccagtgtatctgaccagtatggtgaaaccctgtctctactaaaaatacaaaaattagccaggcgtggtggcaggtgcctataatcccagctactcgggatgctaaggctggagaattgcttgaacctgagaggtggaggttgcagtgagccaagatcgtgccactgcactccagcctgggcgacagagtgagactccatctcaaaaaaaaaaaaaaaaccaaagaaattacttttctgtaagtcaactccacttcctctggtctgtcttctctgtactcagggacctcctaaaattttccttcatattgttaaagatagtttcaaagcaacctccctttttctttctttgtgcataataataataatctaaacttttctacatttttctgctttccatttttctaatattttcttctgggcctcatgtctccaaaataaatcattccactccaaggaataaagtaactaaaaatacatatacctaataaaaccaaaccgctgtgcaccaaaaaggaaattagtaatagaaattaagaatgccggctgggcgtggtggctcacgcctggaatcccatcactttgggaggccgaggcgggcggatcacgaggtcaggagatcgagaccatgctggctaacatggtgaaaccccgtctctactgaaaatacaaaaaattagcccggcgaggtggcgggtgcctgtagtcccagctactactcgggaggctgaggcaggaaccccggggggcagagcctgcagtgagccgagatcccgccactgcactccaacctgggcgacagcgagactccgtctcagaaaaaaaaaaaaaaaagaaaaagaaattaagaatgccggccaggcgcggtggctcacatctgtaatcccagcactttgggaggccgagacaggtggatcacctgaggtcaggagttcgagaccagcctgaccaacatggtgaaaccctgtctctactaaatacaaaaaaaaaaaaaaattagctgggtatggtagtgcatgcctataattccagctacttgggagattgaggcaggagacttgcttgaacccgagaggtggaggttgcagtgaacagagattgtgccattgcactccagcctgggcaacaagagcgaaactgcgtctcaaaaaaaaaaaaagaatgccagtgctttgtggacttttttttctgataacacgtctcttcttatttatgtagcattagaaaacagttcattgaaaataaaaactggaaaagattttgtgttaaaatactcggataacattctgcataggctggaaatctccttttaacttaggaaattttagaaaattggacgaattgaagcctttttttaaagcttacttaataatgtacttattagaagaaacactataatgatgtcaaaaaatttagcacacggcgcgggcgcaggcgcggagaggcgcacaggagacctcaggcccaggctccactccccagctgtgaaaggaccgctggccggacccccaagctagcccgccaggcctccatagagctgcccagcatggccgtggccagtaccaagagtcggtgggagacgggtgaggtacaggctcagtctgcgaccaagactccgtcctgcaaggcccagattgccttcctacagggagaaaggaaggaccaagaaaatttgaagaaggatcttgtgaggaagatcaaaatgttggagtatgctcttaaacagaaaagagccaaataccacaagttgaaatatgggagagaattgaatcagggagatatgaagcctccaagctatgactctgattccacattaacaaaacagccagttaatgtgaaaacaaggtcgacaactactcagacaaaggtagttcagtttctccagattaccacagaagacagctctgtggatcctcctcagatgagatgatttaatatggtactggggaaatgagaagccatccgatcacaagtgctccctgagggtgggccaccactcgtcggctgcaaattgtagcctgggaacgctccagccgtatttcagctcgccttcggggatcgccgcctccgaagggcaacaacaagcaattcagtcagtccgtggaccttggcacagactctcagcgcctcccgcctctcagcagaaacgcccaacagaaccgttagaaccagcgagcacgcgcaccttagccggccccgcccaacaggcccgaggcagagaaaccgccttagcagctctcgcggcgcccagtacaggcggcggttgctgcgcaggtgccgcgggctggcagggctccctggagccgcaaggcgcgccctgccccagggcctgtttgactgtggcccgcgccctcttctcctcttccaacggctcccgatgctcagagacccccgcgctgggccctctgcagcccagggatggggttgagtggtgcttctccacctggtgccgccgctgggcccacagcccgacttcgccactgcgtcgcccccggggtccgcgctgatgggcgcgaggcggaaggacgggatccggggttgccaccgctgcagtcagcccaccgcttgcaggtggcagctgcagctcgggctccggcgggggctggcggggctcccctgggatggcctcctgggcccagagtgcgccgcccatccggccagagggtgcgcgcctcctacaccctgggccgaagcccatgcccggcgctcctgccgcagactgcctgacttgccgcggccgggctggcccaggggtccgcgcggctggaggcgcccgcctggtcggggattcccaatcctcggcgacccctgctccatgtgctggtggcggctgcagctgcagcgcccatgggctgatgtggcttaccggagctgcggccggccacgcccaagggcctcacaggctgcgctgcccttgccagctgctcctgacccgcgcccagagagcaggacctggcgcttggcactgtgcagccacggggatgaggctgagcgccggttatcggcctcgtggcgccactggggccacagcctgacttcacctccccgtcgcccaagtcgtgtgatgggcacatgtgaggaggggcaatcggggttcccaaggctgctgcctgcatgccactccgtggccactaggatagggctgaggagccgccaggggatgagcacgttgtggccatcgggatggggctgagagtctatctttatccttatgcacctgcccagccgacttcctgacagccactaccgcagcgtcctgtcagggagtccttgctgttggggcggggatggggagggcatggagaatcagggatggtctggccattgctgctggtgcctgacgtgcaggtggcagctgcacctagggcacgggctggtaggtcttctcttttggatggtttccaggtgccccattgcgcagtgaccaagccagagggtccactccaccttagcccacactaggagtccaggggctacaggcatgggtactgcgtggccaaccagaaggggctcagcaaccagttcagctttcctgcctttgcagggctttttaaaaatttttttgtatttaacattttctaaaaatacatacaaacaaaaagatgcatatcaaacatattaggaagattgcacatgggaagacggggaatagaaatggggggtgagaatgaaagaaaataaatgagagagggactttgtatggatcaatgataataactcaatcctctatgtctttgacaagaaggagaaggaagaggaagaaaaagaaagtgggataaaggatgggaaagggaggaaaacagaaaaaattagagtatgactccagggtagacctgttttgttgttgctgggttggttggttggtttgttgtatttttcatatgtttcaccatgttggccaggctggtcttgaacccctagcctcaagtgatcaacccgcctcggcctccgagagtgctgggattacaggcgtgagccaccacgtccagccccaacactgcgtctggcccccgtggtagacctcccagacggggtggccgggcagaggtgctccccacatcccagacggggcagccgggcagaggcgctcctcacttcccagacggggcggccgggcagaggcgctcctcacatcccagatccacaaaagaagtgaaaatagccttaactgatgacattccaccattgtgatttatttctgccccaccctaactgatgtactttgtaatctcacccacccttaagaaagttctttgtaatctccctcacccttgagaaggttctttgtaatttgtaattctccccacccttgagaatgtactttgtgagatccacctcctgcccgcaaaacattgctcctaactccaccgcctatcccaaaacctataagaactaatgataatcccatcaccctttgctgactctcttttcggacttggcccgcctgcacccaggtgaaataaacagccttgttgctcaaaaaaaaaaaaaaaaatttagcacaatgcctggcacataccagatgctcaataaatagtggctattagctgattgaacttcatctgttcaagtacattttctaaagtaaaaacattaaaaaacaaaaaacccttccttctaattcggtaatgaaggtagttagttggagactctcccgataactgttatataagaattagcaatatgaagccagaagtgtactgaatgctgtaaagctgcgaaatggtctgaaatactcaacgagtcttaaggtgttattgggacggtaacattttcagaatatggaacttgctaaataaacattttcctgctcatttggatactacgcaatgcagaacattctctgtttattctttcatcggagacattttgaggaaagacagaggtggggtactactcaaggactctttaaacaaacatgaagtttaattcaattgtttcctgagaggttgacttcttccaagagccaaagaaaatgttttactaatccaaaaggtacaaaaataaggttgaagccatagaatgcaggagggtttgaaaaagttaatgtattttgggataattatgaccactgtgaggctgtgctgtgaaggccatcattctgcttctgttaaaataagcagcacaatcattcttttttctttttatgtttttactgggagactggtaaggctgctttgataaagtgagttcttatttataccaaatctaaacacccaagataaatgggacatgaaaggtgaggaggagactgagtggccacaatgtcactcatgtagacattgaactcacccagggggcaggtgtgagcagaggtggacggtgcattctgagctgtgtgtcaatgtcttacgtggccaagacagagtgaccagaggtcactgtgcagtggcaaaggtggggtcaggtgcatgtttgaggcatgggcttcaaaaaaagcagtgtcatagcttttgtcctctgtcacatgaggtcatttacaagaagaggtctaagatgatggtcatgtatgtatccattcgcccattcaatagctcactctaacactatgcctgtgattgaatggctttcaaaaagcatgttgttggatatactgaatgacaagtatctaccaaactctatgctgggcttgcaggcacggggtagatgaaaaagtctctcttctcagggtacccagagtcagaagcattgacaaattcgagtggaagagaaatgtcacactagctctgcattccatagagaggggacagagtgacacactctgggggaaagagtagaggagctggtggtggtggtgtctgaaagcactctgggcttggggaaacacgagaatggcctcagtggcctgaggcgtggtcagaggggtgagtgtgttggtctttgagtctccccatccctcccggttggactgactagactgcaggagcttcatgaattcgccagttcccggagtcttcttggaagaggacggctgcaagcctcgtccggctccctgaggagggaagagcatccagtgctcctgtgacccctcaccgtgggcactggccgtaccctctgatggaaacaggtttcttacctgctgccactctgcagtccttactcaccaggcacggatgtaggacccatccagccccatcttccccatacacagttgcacagtgttgtaaaatcaaactcactggccatcccaggtgggaattgggccctaccggaacctttgtttctgatgtcctcagaaatggctcaactaaatatttttctttttctaagtgtagggagtaaacagagaaaattactatcatttcttcttctgttaattgtccttatgtcaggccaggagtatatgggtagacagttccctgtggctgttggctcagtcttccaaactacagcatttgcacttttattcaaaatcccatctgtctggttttcgatggttctgtctgtagcattttctccacactggtctataaatgcagatatgtgtgtgcgcttctatgtatggatgcttacatgtacatgcataggtagagaggagagtgcctaggccagatcactcagagaaagtgttaaattacaccattttgttgtttcagttacagaaatcttaaactaagcacagcttctctgacaccagtatcaatttcattactgagccatgagataacagcggtttacaagagaagatggtgaaaagattgagaattcaaatgatgaatgggatgcacacagaaaagacatcactgtgcgcgtcttcatgaggaaactgaattgagactactgtgccacaaatcaagtaatgtgtaatttttctttgaaagcatgtagaggctttaaagataacaactagcttttgagaaaacctaggattaaaaaaataatagaataagattagaatcttcatcatgtattcagtactttacatgctatattaatagtgaactaatacagattgaattgcatataatgcatttcaaacaatttgggattgaagcagaatattaatatgactacagaaattcagtccatttttttactaatgcaaaatatttgaaaaaatatttacattatatatcagccattatccattcattacattaatgatttttagtaataccttctttttagttatgtatttaatttaacttataaatttaacacaatattagagacatgcaaaaacatattagaaaaaacacaatatacattggcaaatacagaacccattaaccaaaaaccagtacaggagaagccccttctcagccacactcccctttttcccatggcatcattttgtatgcttgctgtacatatatatatatatatatatatatatatatatatatatatatatacacacacacacacatacatatatatatatacacacatacatatatatatatatacacatatatatatgcacataaacagtacttattatttattcatttatttatttttgagatggagtctcgctctgtcacccaggctggagtgcagtggcataatctcgcctcactgcaacctccacctcctgggttcaagcaattctcttgcctcagtcaccggagtagctgggattacaggggctcaccaccacgcccagctaatttttgtatttttagtagagatggggtttcaccatgttggccaggctggtcttgaactcctgccctcaggtgatctgcccacctcggcctcccaaagtgctgagactacaggtgtgagccaccgcgccagccaatagtacttattactatgatatttttaatatagaagttgacttttgtctgttacatagttcctggtgggcactcctgggctctcgtctgtcctcaaggtctttcagggacctggattcctccctagggcagtacgtctctgtctttggtaaaacactgcttttaaaaatcttcaaagtatcatgaacccctattttgtaaatttcataaagacagatgcattattagaaagatgaaattaaaaagcagatacacaattttgctctgcagtcatcagtcaataaagagtcagcagtgaaatcccggttcttgtaccaacgcctatctgcgcactttgaacagataccatttacagcagtgtttacagttaacgtggcaactgtttccttcttgttaaatttctctcatctacgttggatggaccacagtatattcatttgttctccggctttggagttctctaggaaaatcaagaggttttcttagctccatggccatccaggggtgaggggctcctcacaggggcacagacgggactcagggaagatggcgccgccccccacctcccacccccgtgaaggtgttccttcccttgggagttccatcaggtgtcctggagctggctgtgagcaacagaccctgccccaagaagacctgggaatggtcagcacagtgcatcaattaaatcaattccgagactgctccatacacacagggctgaaaggttactttccatatgatttatcttcccaaattatgttcagtcgcagtatccgtgaaagctgtgggagagtctacagcgatagtaggctactagtaagacacaaaaggatactcagataacaaaatgccaaccacccgagacccccacattaaaccacacacttttcccattatcagatttgcagcaaaagctttaagtgcacctattgactttagctgttctattatcatcacaatccactgtctttgagaataaatcaaatgaattaattgatacgcatttgaaaatgaatctacattcccttttacatggctactttttcatgacatataggatatcttcgccacattgctttccattttaaaagatctaagagttcctcaaagtaagtacttttctgagagtccttaatttggaagaactctgctttctctgagtcgctaggagagaagttaacagatgctggaagatgacatcagcatttaattgcaaataaattctgttctctggcagcctggctattgtgctcacatttcaaaattgttttagttcttacatttttaccatgtttactaaatctggatggattatggctaggtgtgctggttcacgcctgtaatcccagcactttgggaggctgaggcaggcggatcatttgagatcaggagttcgagaccagcctgaccaacatgctgaaaccccttctctactaaaaatacaaaaaattagcccggcatggtagtgcactcctgtaatatcagttacttgggaggatgaggcaggagaatcacttgaacctgggaggtggagattgcagtgagccgagattgcactactgcactccagcctgggcaacacagcaagactccatctcgaaaaaaaaaaaaaacctggatggattatgaagccgtattcctaaaagatactcatatgtttagaggtgagaatcggggatcttcaatggactagaggattgcctttcttcttagaccacagaagcagctcaggaatatggtcacctggtgtctagcagggtaagcccaggacaggagctcatatttaagtgcgagaaatggagtgtatgcagggagaaaatggaaactagaattttaaggatgctttggggaatatggaatccttggtgaaaaggtgccactatacagctttcctggctggtaaaaggaatgaacaacatggttcttatttgtgtaaactcagtcttagaaaatttcaattcattacacacaaaaatatttatgaaacagtttggggccaaaggggtagtatggtagacgagtgtcttacagagcctgtgtggggaagcaaaaggcaagggtgtcgttcacaggcagaagcgagctgtgacattgtcagtgcagcgtgtaagtgtggctcctcacaggcggccattgattgtgagacctcatcttactctgaagatttcccggtggctgtcatgcattgcttctcaaaagccttgtactgtgataaggtttaaggagacagattgttgcaacaatagcctcttctaaggaatgttattatgtcactgcagatgatgtttttaagaggtgattcagaatgatagtttcgtgattacggaaaggagttccttctcaaactgcaaaaggaaagatgaaaatagtcatgaagcctccagaactgaaattgggcaccctttatgatggatatttactttaattcaatgcaacacatatttatggggcatagactgtatcaaatacttaataaaacccattcagtttggagctcacacctaagctgtgctgtaattggattttcttaatattcattaaaaacagaaaaaaatgtatttcacctttttttggtatttgcatttgttgcttatagtttgtggggtggagcagaggggtgtgaggttgaagaaaggcactatgaattaagccacacaaatgcctctaaaaaaaatagtaaatataacaatggttaacattcattgaatacttactatgtatcaggcgctgctaggagatttagaaataattacttagtcctcttaacagccatatggggtaggtaatattatctccccagtaagacagctttaattcatcctttttgtttctatccctttccatctctgtctgtctgtctctctctctctcttttcccctagtctctaggacagggatataaactctttagtgattttcagtaatagaagagctaagtaccgtttagtgtcattgtcagctcacttctaatagaaagagctaacccatgtccacgcagctgaaaattagttttgtgtctgagatgatggtgctcacaatcatatacagggaaccctgccactgtgctatgctgagtaggcaaacattggccttcccttggagggatcctcttctcttaggattaatgtgggaagtacagacagaaatctcttctgttgtcatggcgatactacttccctgataggatttcagccattccaagcgtgtttgtttcatttgtttttttttcctaccttaagcccagtctaggtgagttctgggtgctgtgtgtgtgtgtgtgtgtgtgtgttttaattgcagtaagaatattgaatatgagatctaccctctttgatttttttttttttttgagatggagtctcactctgtcacccaggctggagtgccctggcatggtattgactcactgcaacctccacctcctgggttcaagtgattctcctgcctcagcctctcaagtagctggaactacaggtgtgcaccaccaagaccagctaatttttgtatttttagtagagacagggttttaccatgttggccaggctggtctcaaactcctgacctcaagtgatctgcccaccgccacctacaaagcattgggattacaggcatgagccaccacacttggcctacgttatttaatttttaagtacacaatacagtattgttaactatagccacagtgttgtacagcaaatctctctcacctatgcatcctgcgtaactgaaactctgtgcccattgaacagcagctcctcatttcctcccccatcagcccctggcagccatcattctactctctgcttctgtgagtctggctattttagatcccttatagaagtggaaacgcgcagtatttgtccttctgtgactggcttatttcattgagcataacgacccccaagtttagccatgttgttgcttatggcaggatttccttcttttttcaggctgaataatatttccttatatgtatatgctgcatttttaaaaaccctttcatccactgacagacgtttagattatttccacaccttggctattatgagtaatgctacaacgaacaaagtgaaaatatctctttaagatcctgatttcagtttttttcaataaatacccagaagtggaatgactgggtcattcatatggtaattctaattaaacacagaattatttttaattttttgagaaacttctgtgctgctttccacagtggttgcatctgtttacgtacttaccaatggtgcacaagggttccaatttctccacatctttgccaacttgttatctgtgtttgtttaaatgacagctgtatgagttgtcccttgcctccatgcaattctgaacttcagaaataagcacctggctcctttaaaagctgtccatcgtatgttgtgtctacagccactgaatcctgtcctacattttctgattcattaactcattcaaccaatagctattgaacaccatcaataagtcagccaccatgaagatgagtattttatattgaattctactaacatatcctgtatgtttactatggtgccagagaggatgctgtgtgctttttttacattgttatctttactgttcacaagaaccatgtaaggtaggtgttggtaaaatgggtaattttggaaattcttcagtgattgaatagaataacttcccgctctctgtgagaagatatgttttaaataagatacaacccagggtcttggttacttgagacatattatactttctcagataccgtcagacctgaatcatttaataaactaaagcagaaatactaaaaatatctggttcaatagcataggggcatggagtagacatgcagaaaatgcttgttcacttgccttgaaatggctccaggtggcctgaaggaatcaatgaaccttctcaaatatctacattacaaccactggtccccactacacatttatttctaaataaaggaggagaaactgtagcaaaataatatttaatatttttatagcttccaggatgaattttactgaacatggaggatctgatagtggtaggtgtatcaggaatatcagggaaaatgcttttgatgttgttggcaaagtcaattcctatcatttgtacttgacaccagctacctagcaggctcattgtgaacttcaggtttcgcccacgttatttatataaagtatctcagtgtaatatagggagttgctggttatttgaaaatagtaacaaagataacccaaacgagaaactccatttccataattagttttcctgaaagtcaggcatgtcttcgaggacaggttttggcagtattatttttgtgcacaggaggaaatttgttagtaggtttatagatattatttttataatagaatgttaaacccctgaaaacatcagaatttatctcctagaactaattctatgttttaaaaacttgttttaaaaagggattctaaatagcaatagggtctttcctcctttctccactccaatggtttaatgggatagaggaatcaatgtttatatttttaaacctgtaaatattttattttgggtattttgtatatttgttgatataattccattttgtgcatatgtaccattgtgcatgttgctgtttttgatagtcactcttttaatgaatgtaagaagcttgggctaatagcacttttcttgttccattcaaacatctgaaaatgaaactacaacactgccattttactgttgtgtttaattcagtcaataaattttgttgctcctttgcatttaaagtgaattctgttggttgttatttctccaggatcaattttatttccggtcttttcaatttttataaattatactaatgatggtgatgatgagaaggtgatgtgtgtgtgactgtctcgtggaaagaccaatgggaggcccatatttctctccacactttgtaaacaagtgaaaaattccttgtttggtttgggcagctgtcttttgaaaagctcttttgttattctgactctgatctgaattctgaggcttttactcagaaaatctccattccttatcatctctcatgaggccggctaatccgtgctgactgtcgggtagcggcaacattagggccactggagtctttctaaagagttgctttctggtttttgtttattttgtttttggtggtatgttttcattttctatgtgtaacaggtagggaagcctctcaaggaaaggaggccagaaaccatcagatgtagctactgatccctggaggccgacagctttccattccgcggtccaagaatgggctgagaaccacaaggggaggtggacgcatccacagcaaggggggaaggactgtttcctagatattttttggtaactgatacatcaagcaggcagaaaatcagtcagaataaagatttgagcaacacatttggccacatattataacaactagagaatccatgttcttttcaaaagcaaatgaaacatttgtgaatgttgattacatcctagaccatgaagtaagtcatgacacatttcaaaaaatagttcctcacagaatgtgttctcttaccacaacacaactacactagaaattagtaataaaaagataattaaaatcactccatacatttggacttttgaaaaaatacaccttttaatagctcatggatcagagaataaatgagtaaggatattagaaagcaattagatgtgcataattatgaaaaggatctatattaagacatgaaatataacccaatctgtacttaggaaaaattttatagcttcaaatgattagattataaaagataaggagctgaagatcaataagctgagaatccattttaattaaatgtaagaagttaagaaaagaataacaggataaatatgtagaaagtttaattaagaattaatatgaataagagcagaaagcaataaagcggaaaacaaagataccctaaagtagatcaacaaagatgaatcatttttttgaaaaacatccaacaatatttttaaagaaaataatagaaagatacaaatatggttcaaaattagatgggcacaacaacagttacagtagagattaaaaatgtaatgaaagaatgttacaaatattatggcaataattttttttttgagacagggtctagctctgttgcccattctggagtgcagtggcatgatcatggcttactacagcctttaccctttggggtcaagcaatcctctccacctcagtctcccgagtagctgggactacaggtccacgccaccatgctggatcttacaaacaaaaatgaaggtgcctttttctattgctaaatgcgctggtctgaaatgcaatgaaaggacaagggtgacactcaagggaagattaaagaaagactcctaactattccagaggcaaactctatgtggctgagttagagtcatagaaagatcctcttgacaaaatgcgaaaaaagaacaaacaaacaaaaggcctaaaggttgtgtggaccatgtctattcctttagcaaattgagaacaagacaagatttctggcattggatacaagatcctaaatacaactgtgaagaaattagttacagttttagggaagttgtactgtcaaaaaaagtccctagcctgttgtacagagacctgtgaccgtccagcattatggtagaccctaaaccaagccccaacattgaagtgccaggatcaaagccattcactagcatctcctcaaacacctgcctgccatcaccaccacaagtgccaggatcaaagccattcactagcatctcctcaaacacctgcctgccatcaccaccacaagcaccagtaggaaatcctcccttggtgccttttctgaaggtggttccaacaatttattctacatccagagaagtgaggcaacaaagagaatgctcatgagacccattgtttctatcattcatcctgctaagcttgctcagcgagatatgctattatataatctgtaccagttatcaatgtaggcacttctttccccgtttttggtttgatttttattccatttcactgtatcgggtaggcaggagaagctacttttatcatttatgccataatctgcagaatggtgagaagtcacaaacctgatcaaatccaagctaatggaggaattgacactacctagaaaacctgaactcagaggggctaaattgtgtcacttcacagtacagaacctgtatgtgattttggattgttacccactggggagaaggtgagcacatttggaattgcacagaaggtggctggattaggattaagtaggagcatttttacaattaaatgtgtgagaagatgtgatagatatatatatatatatatatgtatatatatattaggtagccaagaggttactccatcttcacataagacattaatacaatagaggaaaaatatgtctgaccatccttcccacagccacaccccggactcatcttccgaaatcgctgcgaatctatgggatcagcgccggagcctctcccagcagatcgcagatcgcttgctcagtcagccctcaccgctgctccttcaactcccggacctgccgtgctgacccctttactttctccaacccactggatcctctttcttctaagatccctcccgtttttaaaagcctctccctgcccgagcccatgcgccttctggcagctggtctaccctcttccaacccttaagcaggcccggagcctggctccactccttcccctctggctggctgcttcctcagccaggctcatctacaccacagcagttcaggcacagggcacaggtgatgcctgactatgaaatccaatggcatgttttagccttcaaattactgcaacatacttaacctttcagcagcatttgagactatacctcaccctccttcacagcctctcctcctccgagctctgggctgccgcctctgtgtttccctgttgcctgctcccctcgcctctctcctctctcccctccttggccactgttattatgaactcacacagttcttccaggctgggcacgtggcctcttctgctcttacccctaactctctccaggtgatgtcacccaggcttacagctgcatcaccatctgctagaggtagaattgtgtcccccaaaagacattgaagtcctagcccgcagtacctatccatgtggcccatttagaaaaaaggtatctgcagaggatgcaggtaagctttaggtgattggggtggggcataatccagggtccttacagagcagggaaatttggatgcagaggcagaaccacacagaggaagacgacataatgacccagggagaaggtggccacctagaagcccaggagtgcccaaggctgccggaagtgaggatggaggcctggagcaggcccctcacagccctaggagaagcctgatgacacctcgcccgcaggctttctgcctccggagccatgaaggagaaggcatctgttgctcaagccgctgtgctgtggtcctttgttacagcaaccacaggaaaggaacccaccaccaagtcctgaattcacaccaataacccagggctctcccacaggctgcagatccacaattgtaactggctgcctcacatcttcaaccggacatcacaaaaatactacaaatccaacatttccaaaacctcattctgttcttttgcacactctgccaccaagtttgacaaaaataaaacaaaaagaatttcagccgggtgtggtggctcatgcctgtaatcccagcactttgggaggctgaggtgggtggatcacctgaggccaggagttcgagactagcctggccaacgtggcgaaaccccgtctctactaaaaatacaaaaattagctgggcatggtggcgggcacctgtaattccagctacttgagaggctgaggcaggagaatcgcttgaacccagcagacggaggatgcagtgagccgagatcacaccattgcactccagcctgggtgacaagagcgaaactccatctgaaaaaaaaaaaaaaaaaagaatttcagagttttctgtctcaagaagtcattttcctacatactggaaacagggtggtcattcctaaaacctctgagtctgtccccactaccgcctaacttcctagccaaatccaagccttgagaaactccgctggaactgcctgctatttcccaactgtgccgacaacttcatgggtaaaagatgccattgtggccgggcgcggtggctcatgcctgtaatcgcagcactttgggaagccaaggcaggcggatcacgaggtcaggagatcgagaccatcctggccaacacggtgaaaccccgtctctactaaaaatacaaaaaattagccgggcgtggtggcgggcgcctgtagtcccagctactcgggaggctgaggcaggagaatggtgtgaacccaggaggcggagcttgcagtgagccgagattgcgccactgcattccagcctgggcgacagagccagactccgtctcaaaaaaagaaaaaaaaaaaaagatgccattgcttcctgcttagcagagaggggccaggaggaccattgaggaggtggggcagcagcaggacccccagaaccgaagcctgtgtctctgctgtctcatcccttcattcttcccggctcgccacagctcagctacctgggctttcacttcctaaacacaaaacctcttccttccccagcagggcttctgcatgtccagccacctcacctagaatcctcctggggcctcctctccaccactgccccctggtttctgtggctaggtggttttcgggtaaaagttaatattgttttttggttttttttttcttttggattcaggagctacgtgagtggtttgttacaaggatttattgcatgacagtgaggtttgggcttcaactgatcccatcacccagatagtgaacacagtgcccaataggtaagttttcaaccctctcccttcctcctgccttttggaatccccagtgtctattttcccatctttatgtccctgtgcacccaatgcttgcctcccacttataagtgaaaacatgtggtatttggatttctatttttgcattaattcacttagggtaattggcgtggctaggttttttgtacaattcagttctcagcttaaatgtcacattccagaacatgcttcctagcccatgctgtctagagggaagcccgtcatagtccctgaagaagcagtcttgaaagacacaatcccagctcttaaaattctgaaagatcaaaaatccctaaaatccaaaatcctgaaaatataattctggaaaaaataattttaaaaattcctgaagatatttacttacattttaaggggagtgggtgtgggcacagtggctcactcctgtaatcccagcactttgggaggctgaggcaggtggatcacctgaggtcaggagttcaagaccagcctggccaacatggtgaaactccatctttactaaaaatacaaaaattagcccggcctggtggtgcatgcctgtaatcccagctattcgggaggctgaggcaggataatcgcttgaatccgggaggcggagtttgcagtgagcccaaatcacaccactacattccagccttggcaacaacatgagactgcatctcaaaaaaaaagggagggggggatttatttgagaaacatataaaaacacaacagaacacttcataggccgctttacacaataaaagaagcaatactagcgtacatgtttttgcaagaataaatactcaggtatacgactatacctggcacagatatagcatttatgagcagataaactgtattcctaaagaagtaggtcaaaaggaaaatgtgtaaacacatatcactatgattggtaattgtgtgcaaccagctttgtatatgtgctcatctgaaatactgtgataaaaaaccgaagtcttttgacaagattgatcaaaaaccacaatggattaccactacatatgcagtcacccaaagagctgagatctcaaaaaatgttgtcttttacaaatgcaggtgtacaaaaaggacatcactgaggaggtttcaatgttttcatgtacatacacaatgtttatacacaaaatcaacattgagataatgaactttcatggagtcacatttgcaaaaaaatgcatgaaacaaattaggactctctaaacgtctctgcacaacctatacgtcaagttttggaaatgatgcaacgatgaaatatatagcatagtgaattgttttgctatttaaaatagtgaaaaaaatagaagaaaaggaaaaaaaaccctatcctgtgattgtgattttcagaattttagactttagggatttatactttaggatctttgatcttttgggattttagcattcaggattatggtatttggaattttgtcttattttcaataaaaatgcaaaagtaattcaatggaaaagtatcattttttcaccaaatggtgctggaacagatggatgttcatgtgccagaaaatgaacctgaatccatatcttaggccctatatgaaaattaactgaaattgatcgtagacctaaatgtaaaacatagatatataagacttctgtaagaacacatggaaaaaaaatattgcactctcgggttaggcaaagatttcatacatgtaacaacaaaaagcacaatccataaaagaaaacaattggtaaactagatttcatcaaaattaaaaacttctgttttttgaagggcactattaagaaaattaaaaggtggggagaaaaccactacacacctttagaatggctgaaactctttaaggtgatgataacaagtgctgatgataacaagtgctgttgagaatgcagagttactggaacactcattcattgctggtgggaaagtgaaatggtgcaaagactatggaaaacagtttggtagttttttaaaaagttaaaaatacctaccacgtgacccagtcatttgtacgtagatattaccccaggagaaaagagcacatttgtccacacaaagtcctgtacctgttatttaggcagtaaacttatattgcatcaagtcacagaaatgctggggtctggacaaggcgtggtaatggggactcaggatggtggacacatggagggactgtttaggtagaactggctggcggtcttcttatttggtttgggctgctataacaaaatgccataaactgggtggcttataaacaacagacatttatctctgacagttctaaaggctgggaagtccatgtgaaaggaaaatatcttgggactccaaaatcactaaggaaaactcaagccgggaactgcttagggcaaacctgcctcccattctattcaaagccattcctctactcactgagatagatgcatatctgatttgccacctttggaaaggctaatgagaaattcaaaaggatgtaaccatttgtgtatcacctatctgtggcctggaagctccctccctgcttccagccttcctgcctttgcttcaagttttcccgcctttccagaccgaaccagtgtttcttacatatattaattgatgcctcatgtctccctaaatgtataaaaccaagctgtgccctgaccaccttgggcacatgtcatcaggatttcctgaggctgtgtcacaagcacgtcctcaaccttggcaaaataaactttccaaattaactaagacccgtctcagattttctggttcacatccgagaacactgcatcagcagattcaatgtctggtgagcgccaccttctggttcacaggtgatactgtctctcttcattcccacatggtagaagggacgggacagctatctgaggcctcttttctaaaggcaccaacccctttcatcaggcctctgtcttcacggcttaaccacctgccaaagccctcatctctgataccatcatcttggggcttagatttcaacacagaaatttgccgggacacaaacattcagcccatggcggtgatgtactggatgcggaggagagtggagagatacctgaaaagcaagacagaaaattaagggactgggaagttactctgtgggtcaaaggaacgaattcagagtgggacatgttgagtttgagttttccagtatgcagttagctgtatgggcttagcaaaatgaaatttaacaatatgctattactaagttatttgttatctggagtttacatattcaacttttaaaagataagtaaatcttaacgttaaaacaattatgagaatacagattgttataaaattctcacaaggatattattccttctgaatatgaaccacttcagtaaggcctcctaccgcactggactctcccctgaataaaacctactgtcaccaagccagtactcgatcaacggttttgaaaagtaggttttactaattctcagacaatctcctgtttcacagcagaaccccaaagactcccacaggctgcacaaacaaataaaagcacattttgtaacaacagccaatataaagaagaaggaggggaaaaaaccaagagcctaactgaaaagtgaacaaaggaaatgaacagatagttgcagtaaaagaaatacaatggccctgaaacattcagagatcacttaaaataggagaaatgtaaactaaaaccacactgagacaccattttccatcatgagatgagcaaagatgaaggaatttgttcacacgctgtgttggtgaaggcttgggagacaggttccgtctacaggagacataaattggtataatctccacagaaggcaattcatcaacatcccaatatttaatatgcccaaaacattccttttcaacaaatcaatatcaatacatttgattgacaaacatgcttgtatatgtgtgaaatggtttaagtttacagttattcacagaagcatggaaaaaactgaaagcctatctacagagaactggtttatgtcatatgttatcaccatagaacagaataccatgcagccattgaaaagaatgaaaacggtggcaacaacccaaatttccatcaacaggtgaatgaataaacaaaatataatacatacacattatggaatattactcagccttaaaaaggaacaaaattctgacatatgccacaacatagatggaacttaaggacaataagttatgtgaaataagccagacacaaaaggacaatactgtagaatccacatataagaggtacctagagtaggcaaattcagagacaggaagtagaacggcagttgccaggagcctgggagggcgagtggggagttattgtttaatggatacaaaattccagttttgcaagatgaaaagagttctgcagatagatggtggtgaaggttgcaaaacaatgtgaatgtgctgaatgccactgaagtgtacacttaaaaatggtaaataaggccaggcacagtggctcacacctgtaatcccaacactttgggaggctgaggcgagaggatcacctgaggtcaggagttcgagaccagccgggccaccatgctgaaaccccatctctactaaaaaaaaaaaaaaaaaaagccatacgtggtggtgcacgcctgtagtcccagctactaaagaggttgaggcaggagaatcgcttgaatctgggaggcagaggctgcagtgagccaagatcgtgccactgcactccagcttgggtgacagagtgagaatctgtctcaaaaaaaaaaaaacgggcaaataaaacacaaaacttttagaatccagggctttaccttctaattggtcaacatataattgcataaccaaattcttacgggcaaatcaggtcttttagagaagaaaaaaaataaagtttaattcagtggaattaacatggttggaaaaatgatttgtttgggcagagtcccagagctaacagtaataaacataatacttaactttaaaaatgcttgaacttttctccaaagaacatatttccaccatcaggggaagtgttgattttcatattattcaagctatcttttatccctctaaatatgaacattttgcaagtagtgtggctactcatttcctgataatagacatattctaatagctagacacggaagtattttctaaaatgccacatttgctatctagagacacaaccactgaaaggaagtctgctaattaagaccccaagatgactatcattttataaactaacagacctactttcatcataaattaggccaggcgcggtggctcatgcctgtaatcccagcattttgggaggccaaggcgggcggatcaccttaggtcaggagtttgagaccagcttggctaacatggcaaaaccctgtctctactaaaaatacaaaaaatagccaggcgtggtggtgggcgcctgtaatcccagctactcgggtcggggaggcaaaggaattgcttgaacccaggaggtggaggttgcagtgagccgagatcgcgccaccgtactccagcctgggcaacagggtgagactgtctcaaaaattaattaattaattagtttttcattttactaagaggctcagcagagttttcaatcccctacttcatttaaaatacaaacccaaaatatcaaaatttgaaacttgttgagattttccatgtagtgtaaaatgaccagtgactgtgcttcactctggatatgctggactcactgcaccaggagatccctccatgttttcaatccgaggaaactgcaggcatctaggtctgagacagaatacaacagcagaaacagccttcagtgacggacattcctgtggctaaatgactgctgaatggccctgctgctctctcaaggctaagacatcgaagctgaagacaacgctgtttcacaaaggaacaaaccaaagagaataaattagagtggagaaatcctcccctctaaaagttttctcagtgagaccttccctacctcttgtataaaaaggagaaaataccattattctcgcagcctcatagtaacagagaggatgcatggataaaaggggttgatacttgagaggcatttgggattcttagagaagacatgttccattttaggctggtttttagaaagaacagagagggccttagaaactgatcaaaaccctcttcctgcagacaacacatctaaatatttgggaatttggcttgataagcatttgtgcatttgtgcaagacttgcacccaggtcccctgatgctcctctggcccattttattctgtgcctcgccatccaaataaaattctcagatgctctaatcttcgtgttacaaaggctttgtgcaacaaaaatatatttcacttgtttggaatttggcatgtattttccttagaaacagggtatatgatgactaggtccccaaaccagcccaaacacctaatgtgtacatgtgagaccttggtatgctaaaaacacctgcaaacctgacaccctggaactgaatttgtcattccaacttgaaatgccaggaaggatggaatgagcgacagctgcacttctttctggggacccctccagctccatatcactgctgatatcatgaagaggggagctgagctccatgggtgaggagcagggcacttgaaggtaatccagggacacttggtccccaggctggcttcctcgtccctgggtgtctcttcttccatccgtctcagcatatggaccgctggctgttttcctctctttagtcactgtctagggttgtgaccagtgtttttctcctctgccctgatgttgccctcaacacagtcttatattcttatgttgcctgtgtatccttctgtcctggaaatgaacactcaggcagtcttttaggactttccaatgatttacgactactatcaataatgaagaaagacagccttctcttcctctcctgcagcccagtcccttttatttccttcagaccctgatgaaattcctccaggaagataaggcttgaaaccccacagccagactcacactggggtagacacaaccagagctaggatttcttgagccatactcattggactggaggaagaccctcggctgaaaagtgggacagagcctggattggggttggggtgatgagaatgtgcagaagacaggcatacggaaagaagccacagcaggggaggatctgggtctctggccactgagccccagcaacaggcattcctaggtggctgtgccacaacacaacctttccagtgattccctggtgcatggccgctcaccctcagccggattataaactactcaggaagaaaggtcgtgacacatcttgtgcccccatcagcactgagtatacagggagtgactgatcaatatttgttgagtggcttgaacttccaagccactcaatgtcattaccatcttcagtagcagaggggaagaaagggcatttcactatgccacacctgaggaagtcatcaacagccagaacaatcatttttcctcatctttatacatttgtgtttgcttgttctgttccttaatttcaggggagtgtgtctgtggtgagcaaaagcaccaactgaagagaccagctcacctcccgactctgtgccatgtgatgtgcacagccggccagttacacagatgtctggctcaaataaggagaaacagaccattcggtataccttgcagggacttgcactcactttcaaagctgacttttcaaactccaagtgctggcaccgatccctgtatgcacagctctgagaaataggcagcgttttttggctgggataccagtagctgttccacacaagaacctgtttctgaaagcacctatcaaggaaagctactggatcttgttcaagcagtgcattctgaa

SEQ ID NO: 389 - DNA, 208688 bp, Homo sapiens
gtcaagtgtgattcatggcaaggtgcactacaatcccaaagaactatttgagtttctaatgtttacaggtagaaatatgggagacatgtgtaagaatgaatattaatgatgtaggatgttggtggaaggaacataaactggatcaggctgaatgtattaacctggactcacaaggcagataatctgaatttagtgttgcaactcatagacttggaaagaactctaatagattgtttggctcattgtataaaactatgaccaaaaaatggcatacaacgagtaagctggaaatgccacatctgctttggttcaatgcataggaagggagtcaaagacttagagagattggaatattagagtgaatttattatttaagacctactcaaccactctggaagggtccaaaatacatgcctttttccaaaactttgagaaagttgtgattgggaactcaggattcttgaagcgctctctgatgggtctttcctgtaggccatatcatacagtggaaactgcagttactgaactgggaaaaccaaactcaaaggggttaatttaatcctggggaacaggggccaagtggtggcaattaagcactaaaagcaagatgggtgtggttactgcagtggtctccagtgccaaagcagaaaacagattagtctgactcatgtataactatggtgttgactagttgatcatgctactcctagaagtgaaagatgtcccagacgtgatagtgaaagtaaaaggaagcatactaaactagtacttgatctgtataagcagaaagttctaggtcaagtgaacaaaatactagtatgaaacataaaaacagacagtaattgtccctcaatcaatttccatggctaatgcagtttacataccgagaccctttcttcttgtgcaaggaccccgtatattgccaaaagtttacactgttatttttcccctagccttctccaaagagatatatggctttaacctgggtgagtgtgcatgaaacaaacaaacaaaaaagaaataatcagacttttcagggactactagaaattctctttgagctgactcaaatttgaggagacatctatgtcagtgtggcccatcagtaagagtacaggcttacaaaattcaggtgatcagtggagctttagctcaagtccatctcaagctgggcctagtgtgtcttcaatcccatttggttgttattttctcagttctaaagtgcataataggaataaatatactcagcagatggcagaatcatcacatgattccttgacctgtgttgtcagggctattatggagaaaaaggccaagaaggagctgctagaactgcctctacctataaaatagtaaaccgaaagcaatcatgatcacctggagagatctcagagttcattgcccctgtttaggacttcaaaaatgcaaaggtgttaattcccatgacatctccattcaactaatttatttggcttgtgcagaagacagcgggatcttgaagaatgatagtggattattataaatttaaccaggtggttattccaatggaagctgctgtaccagatgtggtttcactgctttagcaaattagcacatcccttggtacctgatatgcagctattgatctagcaaatgctcttttctccttccctgtcaataagaccatcataagtagtttgatttcagcttgcatggccagcaataaaccttccctcttctatctcaggggcatatcaactctccatttctttgttattattttgttccctggaatcttcctcatcttttcctatcacaagatatcacactggtccatacactcatgatattatgctaattagacctagtgagcaaaaagtagcaattactgtagactcattgataagacattttctgtcagaggatagaaaagatatgtgacaaaatttcttccacagtgaaacttctaggaggtcagtggtatgaggtgtgtaaagatatcccttctaagttgaaaggctatttattgcacccatcctctcccacaacaacaacagaaaaagggcacaatgcctagtggaagtctttggatttttggaggcaacatatttctcatttgggtgtgttattctggcacatttactgaatgacccaaagtgcttctagttttaagagtatcccagaaaacaaagaggctctacaaaaggtctaggatgctgtgcaagctcctatgacacttgggccatataatctaacagatccaatgatgcttaaagagtcagtggcagataggggatgtattagtacattctcacactgctataaagacatacccaagactgggtaatttacaaaggaaagaggtttaattgacttgcagttctgcatggctgaagaggcctcaggaaatttacaatcacggcagaagatgggacagaagcaaaggcacatcttacatggtggcaggtgagagagtgcaaatgaatgaagggagaagagccccttataaaatcatcagatcttgagacaaatctctatccctaactggagaaaagcatgaaggtagccatctccatgatccaatcacttaccacaaggtcctgccctcagcatgtatggattattgagattacaatttgagatgagagttgggtggagatacagagccaaaccatatcaaggttgttgtttggagcctgtggcactctcctataaatgaattgtagtgcaggcccttagaaattctgagcaatgttctgcaatactctgtgaataactacacgccttttaagaaacaactcttatgatatagttagaatatttgtccccacccaaatctcatgttgaactgtaatgctcagtgctgaaggtggggtatggtgtgaggggtttgtgtcgtggggggctgatccatcatgacttgttgctgtctttggaatagtgaggtttcatgagatttggtcattgaaaagtgtgtggcatcccccacctcatttgctcttgcttccattctcatcatgacttgtgcctgcttcccctttgccttctgcaataattggaagcttcctgaggcctctccagaagcacatgtcactgtgcttcctgtacagcctgtagaaccttgaatcaataaaatatcttttctttataaatgactcagtctcaggtatttctttatagcaatgcaagaagggcctagtgcaggctgctactgggccttagtaaaaactaaatgattaatgatttgccagcaatttaccatgcaacctaaattacccatcatgagctggtgttatctgatctaataagccataaagtttggtgtgcatagcagcactccattaccaaatggaggtggtatttatgtgactaggcccaagtaggccaggaaggaatgattaagttacattaaaagtgccccaaatgccagtagtcattgcttctttttatggtcttatccaccattatgataatttaaatagcattgttccttatatgaagaacttacattacaacagataaaatatgacaatggacgtacactcatggaattcattggtcttaccatattccccaccatcctgaagcagctggcttgataaaagagtggaatgtccttttgaagtctcagctaccattgcagctaggtggtaatagtttacaggatggagatgagattttccagaaagctgggcttttcataaacagcatccaatgtatggtgatattttccccattccaaggattctcagacccatgaatcaaggagtaatccaatagcaaaactgttgctttctgtagacagaaccttattctctgctggcctagaggtcttagctccaagaggagcaatgttttcaccaggagacacagttattccattgaaatgaaagttcagactgtcacctagccacttgtggctcctcatgcctctgaatcaacaaagatgggagttactgtgctggccattgttattgatccttaccatctagtggaaaatagacaactgctccacaatggaggtaagaaagaatacatatgaaatacagagcctccctttgggcttgccctgtagttaaggtcaatggaaaaactacataacccaattcaggcagaagtactaatggtccaggccctttatcaatgaagattttggttgccccattaggtaaagaaccattaccagctcagctgcttgctgttgggaaaggaaatacaaaattggaagtggcagaagttagttataagcacaagtctgactatatgaccagttatcaaaatgaggactataatgacttcttttgttatgaatgtttgtgtgtagcaaatatatatttttctcttttgttccctcatcatgcaacataagatgtactgacgtcatttaatgatatttaacttacagtatatcatggaaaggagtaaatatctgcaaaaaattgtgcctccttttttggaaaagggaacagtatgttttcagttttagtcacagtttaggcagaattatgaccttgtactgtttcatttgaagatctggtgtggttaaaggaaatacatatgggtgccaggtcaataaggggtaaactcgtgattgttaattttatatgtcaactcgattagaacacaagagtgtccagatatttgattgaacatcattaatgctgtttctgtgaagatatttttggatgagattaacatttaaattggtagtgtcagaaaagtagattgctgaccttcttccgaatacaagagaatttcttatgcctgacttattttgtgctatgtcattgataagttttcctgctttggaacttaaactgaaacattggctctttctgggtatgtaaacaatagccttcaaactagacctaaaatgtcagctcacctgtgtctctcgcttgctgactacctatcttgagactcattatactccatagccatttcctcataatagattttattttataggtaaatatacattatagtcttgcactgcctaatgacattttggtcaacagccgactttgtatatgatgatcccataagattataatagagatgaacattttttatcagctagtgatattgtgggcattgtaactttgtaccacaacacattactcacatgtttgtggtgttgcaggtgtaaacagacctactgcactgacagtcatatgaaagtatagcacgtataattatgtacagtacataacacttcttaatgatattaaatgactgttactggcttatgtatttataacactatacttttaacttttattttagagtgtattccttctacttatatttttaaaaaagtaaactgaagctcaggcagatccttcaggaggtattccagaaaaaggtattgttataggagatgacagctccatgtttgatattgcccctgaagacctcctggtgggacaagatgtggaggtggaagacagtgatattgatgatcctgaccctgtgtaggattaggttaatgtgtgtatttatgccttagtttttcacaaaaattttaaaactaaaaagtaaattaaaattggaaagaagcttaaagagtaaaaatagaaatacagtttttgttcagcggtaaaatgtatttgtttttaagctaaagttcactacacaagagtcaaaaatttggaaacagttgataatgcaaaaaaaagctattgtaaggtcaagttaacttattattgaagaaaaaattatatatatatatatataggtatacatttagtttatactaggtgtacgctatttgtcaagtttgtaataatgtacagtaatgtcctaggccttctcattcactcactatttattcacatactcagccagaaaaacttccagtcctaaaagtgccattcatggtaagtgccttatacaggtataccatttttaaatatttctattatatttttactgtatgtttctatgttcagatatatgtagatacacacatacttaccactgtgttacaattgcctacagtattcagtatagtcacatgctgtaaaggtttgtagcctaggagcagtagactataccatatagcctaggtgtgtagtaggctgtgacatctaaattcatgtaagtacattccacgatgttcacacaatgtggaaattgcctaatgatgcatttctcagaatgtgtcctatcccctttgttaagtgatgcgtgactttatctatctacctatttacctctgtatctatacaaagtaagcaagactattttaaaacgtgtaagcagattcccaaaacatgagctcaaaatttattactggtcactgattttgaagaacattatctcacattaaaaaagattaacttcttataaaaacagaacagtaattgtacttgcaggaaaacattatttaaaagactgcgagaagtcactgaatggattattgattttcctgtgagagataaacagtgcttctggttagagtgctttttcttatgctaacacctgactgatgggtggattctagatatatcctctgtaaaacaatatgatgtatctactttagctaaagccatgccagatgggatatcagattctgggaaaaattacttgtaaaattgtgttggcatgtgggcaaatgcaagcaaactgactagagaaaagagtagtcatgcaatggcattaaagtttgtaagttaaaatattaatcagctattctaagtaaaatgatattatataaaacattgattggaataaatgttttccatggttccattcctgtttggaagaagagtaatgataatgattattattattattttttattgattgataatgaatttatttatttttttcttttattatttttagatatagacaagttaagcataagtcttacaaattttaggagtattaccacaattttagaaaattagggtgttactaaaaagggaagaatgttttgaaaatgcaaatttataagaaattggcaagaaatcttagaaaattaataagattctgtatatatcagaagcacaaaaatgagtacaataaattaaaaatatcagtaatacattaaatatgaatgaaaagtttgcaaaaaatcctccttacataataaaattagtgaataatataaaagaaaatctttgaaaacatataggttttgattttcacacatccaactgttttctatagtttaattcactaagcattcttcatatctcctatttacacagctgatgctgacacaaggcagttaattttgaaaaaaacttagttaattttactatcattctcttaggaaaaaagtgcaataggtttataacaaattcaaacatattataactgttgtaaataactttattctttttctttaaactgattcataaactttagatgttaaatatatatgaaataaaagtagtatcgtgttaaatatgtgtagattgaatttataaatgaaagttttctcctcattaaaagatgcaaagggaacaatttttttctttgtgctcatgaaagatatgagagttgacattgaattgtagatacatcatattattttacagaggatatatctagaatccacccatcagtcaggtgttagcataagaaaaagcactctaacaagaagcgttgtttttctctcacaggaaaatcaagaatctattcagtgacttcttacaggcttttaaagaaaattttctggcaagtacaattaccattctgtttttataataatttaatctttttatgtaagataatgttattcaaaatcaatgaccagtaataaatggggagctcttgtttttggaatcacttacatgttttaaaataatcttgcttactttgtccaggatttcttggaagacgttactgtcatttgttctgctgatgtatcactttgacaaaactttcaaaaccacaggatgcctcaaatgactttgtggaaaatgctaaataaaaacattgatatttagcgattgttttcctaagacaaacacattaattatatctttcatgggaatatattagtttaaataccaagcacaaaactgttgattcggcatagtttattttgattataaggcacgtataaagtagagtataaaggcaatgtaagctgggtagtttacattcccacctgcatattctttgagaattgacaaacacaatacacaggcaaaaattaattagtgttggaaagaaggaaggatggcatcctaacaagaaacagcccactaagaatgctagatatatatactgaacttgatatgttagaaagaacaaatggggcatcttagcattctgactctcattaaatagcacagtggaaatgtggaagcgatccgatcaaagtatcattaatattgccaaacttggcacgagggtagatggggtacaggtaaatagaaaaaggagagattcttcataatgagatgggccctttcctcttagaagagtagtcacaagttgaaagtcaatgttgtgggaattccttatgaataagttatcaaaacaacagcaacaactagcaagatttatattagaacttgctgatagaactatattagaaatgttaaatgaggaatgatactgaattagcaaggaaaatatatctttttcgattaaattactaaaagaaactaaaaccaagttttctaaattattcccagagggagaaactggggaaaacaataatgaaggaagaaacatttaatggcaggaaagataatgtgaagatgggctttgagttaaataaatgcaacagtttattgtcattattgaaaattaatgaagaagagctaaagataaagggattctccaacacttaccatagtatttaactgtgaaacaatagacatagtgttatcaaagtcagcaatgagatatacctgccctgatctccaatttttatgtatataaaacatacacacaccaacacacacacacacacacacacacacacacacacacagagacagagagagaaaattccaggtaatgaaacagcataagaataggcatagatggttgaactagtttacagtcccaccaacagtgttaaagtgttcctatttctccacatcctctccagcacctgttgtttcctgactttttaacgattgccattctaactggtgtgagatggtatctcattgtggtttagatttgcatttctctgatggccagtgatgatgagcattttttcatgtgtttttcggctgcataaatgtcttcttttgaagtcagtgtggcgattcctcagggatctatacccagccatcccattactgggtatatacccaaaggactataaatcatgctgctataaagacacatgcacacgtatgtttattgcggcattattcacaatagcaaagacttggaatcaacccaaatgtccagcaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgcggggtggggggagcggggagggatagcattgggagatatacctaatgctagatgacgagttagtgggtgcagtgcaccagcatggcacatgtatacatatgtaactaacctgcacaatgtgcacatgtaccctaaaacttaaagtataataataaaaaaaaaaaagattccattgtggcctatatcccatatcttttagcgatggggcccacggttttatccgtaatcattctgtgtccagacattggattaggaggatttctgactgaatgacactgactaaagggcacagaatcctgctcctagaatgttgctatgtccacctcactgaatgttacatagagggtgggtgaaagtatctaagaggtcaaagacctaggccctcactgagcttcctgaatagattttgttcctgatttgctaatgagggattatctaataaatatctaaatgtgtgataaaaaaaaagaatagacatagatgaaaaagtttaaaaataaattaatattactactattgttaccaaattattttttccttgaaaacacaagagaaaaaccaaaaatctcatagaagtcaaggtgtatgacaatgaatggatatatgaatagagacttgtgaacacatgcaaatatataactaatatttacatggttgaaatacattagctgctttcagtgatttaaatattaataaaatgtagaacacctaatcatgaacttattttttaaatgcacaggatctgtaggaataagcgatatataaattagtgtgatataattcttgttggaatattaaaactgtttgtaattaatttttcccaaaattagttcataaataaattataatcataacaaaaaatgtgtaactgttattaataacagccaattatgatgtttgggtaactttataaaagtaacaaattattaattttgaattttaacttacctcattcctccctctaattaatatatattaataagtacaatgtaaaatataaaatcaaatggctagaaaaatattcttaataatctgtcaagttgggaggctttttgagaaaataaatatggaaattatttgttaagtttttctccttcacttattaatgagtttgaacttttcaacttatgattaatactttttgctttcatgaattatcttttcatgacctttgcatacttttttgaattttgtcttttaaaattgatttctttttctttttttaaattttactttaagttctgggatacatgacctgagcgtgcaggtttgttacataggtatgcatgtgccatagtggtttgctgcacctatcaacctgtcatccaggttttaagccctgcatacattaggtatttgacctaatgctctccttccccttaccccccacccccggataggtcccagtgtgtgatgttcccctccttgtgtccatgtgttgtcattgttcaactcccacttgtgagtgagaacatgtggtgtttggttttctgttcctgtgttagcttagttgctgatactataaagacatatgcacaggtatgttgattgcagcactatttacaatagcaaagacttggaaccaacccaaaagcccatcaatgatagactgaataaagaaaacgtggcacatatacaccatggaatactatgcaaccataaaaaagaatgagttcatgtcctttcaggaacatggatgaagcgggaagccataagatatttttaacagcaaaaatattaactttattttttcatatatttatttgaacttttatacatgttataatcctttttaaaaatagagcttttatatttaaagagtctcttctcatctttatagatttgatttaaaattcaaaaaaactaccaattttttttttattgttgagttgtgcaaatgccaaagaggagaccaactgtaggaggattgatcagggccttgatagctaactgaagcagtagcatgtgtgtggtccctcctcattttgtcacactttgagcaggccacagcaatctagcagagctaagagtcagacttctgagctaagagtcagacttctggctatatacttttggaactacatgattaggaaacaggagcctctctggtgttatgttcagagaggctgaacagactgggaaacaacagcaaaagaaagaggcaaagtttcacagtaccccaaatcttccagctcactgtgactatagataagggtagagggcaattagtatgattgggggcttatcctgagtattgtcattacagctggacgatgcggcaagaaaaagcaatatttgccacatcagcattcatgattgatgaagcatcaaccccttccttgttttgggttgtcagattccaaacttagcagtgatctgtgtttcacggatgcatgcacttggccacagctagttttcttaaaactttgtgggatctcaacttcttatgggggatgttagtttgcatgccatcagtctaactctagtgaaacttgacatctcagtccacttccaagatcccaaataaaagcctctgtgcattacaattcatcagcaattcttaccatttcaaatcataatgactctgagactagtcactggcaaaatggtagaggaaagttaatgtatttgcttgataaattttaaatttgcttagtctaaacgagattttataaaattaccttccctgtatgtttcagtaggtgagccacaataaagattctcatatgagattgagatggcaaaaatgaagcagcacctatatttgttggatgctcataaggttgcggcaaattcctcagaagctggtccatgtgaacaccaaatgtctgtcaatcataaattaagggctgtatctggggatattaatttctctgtaacactggcctatactctacttggtctggaagggttcccgcaacaaaaggaagcactaaatatgctctggaataatgtgccattgaaatattatgaaaaacaccatacccaacttaaaaatcaagatactattaatgtaaactcagtgaaaaataatacattataaaaagattttttaaaaaccatacagagtttaatagaacttggtgatggcttcttatctgtctgttccatctgtttttaaaaaatacaaaagaaataacaataccactgccaacaggtaagatagagtatgtctataacaactcaaccttaactttttaaatatttattttaaaatatttttattaatgttatgaatattaattttatcattgcactagtattttaatatttgtatatataatatataaaataataacatagcctcataaaatatacataaacatttggcttattaataattagtatcatttattaatattaaatacaaaatttaaaagtagtcatatttttatccgtgtgtggccaaaactcaaactcaggccaaatttcatgatgatgtaaatggggcataaatatttttatcactaaatatgaatatatctcaactcaacagtaagacagctgccacaaaaatgttttaacactaagatgtggtgagaattctgcctaatttgagtgagattctcccagatcatattatattataaatatggagctaataaagggctaaatgttttactgcacggtgaatatatacctgacaatcttcaaatatctaaatataaacagtcgtttcaaaaagcggaaattagtttttgtgcaaacatagtctccaaaaaatttaaaacttctctatttgctcaattatctttatctattttaaaaacactttctggatttgcaatgatagtttagaaagtcacaaactacagtaaatttaatttataaataaaggtaaagtaaataagaggcagatgttttcctagctgatcttttagagttttacttcaacatttactaaaatgcttagctaataaaatgcaataatgaaagaatctcattaatacaaatcgtgatatattttactccttttcttccttttctctttcctcataaacattctcattttgagtctttgagtcctcactgctatcactttctacgtactccttctcaaactccaagtatgtttaataaattaaaacttcatctgttaaatatgaaatgtcatatataaatgaaaaagaaaataatggtccttttttctaaggagtcttagagactacatttaagatactgcataaacttgtaaacttgttgacaggttaaattcctttttaggaacaatacactgtaactttttataaacagatacatgattttagcatgtattatttaatagaaaatgatttaagctaatcgtaatataatttgatatatagttcatagagttttactacatgtgaagtctattttcatttttaacatttacagggttaattttgagtttgaatcaataaacagttaatctctatgaccttagattaagaggaaaaatatcagtgaaagtttttatttgttttttcatggttcatataggcaacattgacgaatgacagttacatttatttacaatgaaccaagggaaacatgtcaataaaataaaacagacccatctgaacatttaccttgactcagacaaagataatatgtaataaaaatttatcgctttcagtgaaagagttataattacatataagacaatggaagctaaacattgtaggcatgaaaatagctaaattgcaaggaaaatgcaatgaaattaatgtttttgtaatgaagaaggtattgggttttctattaaaaggctatcattacaaattgaactacctacaggagaattggtttgaaacgttaacatgtacagtacttaaatactaacagcacatagatcctaaaagtgtttacaattgaaatgcagttgctttgtggttctatatctccttcaacatatatatatataacttcatgagttttatgagatagggctttgcatactatggtaccaaatgagaatagagtagatatagctggtaatagtttcaaaaagagaaaataatttctctgaaagaaatactgttttctagtttagaagaaacagtttaacattaataccaaaatatgtgtgtgtgtgtgtgtgtgtgtgtgtgtgtgtgtgtatatatatatatatatatatagagagagagagagagagagagagagagacttttttaagcaaatttattaatcatttttctagatcctgaaatcttgaattttggtactggcactacctgagtgcatgtaagacctgaagaatctcaagctccaccctagactggctgaatcagcgtctgcaatgatacatgtgtacattgaggttttagaggcccttttaaaagagaattccaacatatattattttaatcttatggattaacttttgagaaaatgtttttacataaggagagaggggcattgttttagcaattccattctatttttgaattattttcaaattgtatgctagaatggcaagttgagtctttattcattcatttttaaagtaaatatataaaatatttgccatgcaaaacaaacaatttttagtcagtgacatcttaactccaacacgaggacataacaccatagtgagattggagaggttgagatatacacatttcttttttcaacttttattctaagttcaggggtacataggcaggtttgttggtttaaaaaaattgaatgatgaaatgaaagagaggagcagactatggaatgtttcaggcagatgattctatagaagagaacaacagaaacttggtaactaaataaattacattaaaactttctgtgtttgagttaacataatattccctcttatttatcccttctcctcctcccagaggttgtgctacttccagtggacgacaactataaaaatgtcttcctctttaaggaagtagaatgtttaatatatggagataatggcgccacaataattataacaggccttccctcagtcttcttagcttgcatggggagtaaactaaactgatttattagacagcaggatattcagtgagctgtttttctcctggatgtagtatgtaaccattgaaaaaattcacatagaccacagagccatagttgtttgtttgcattgaaaaattaatggacagatttggatttttttttaaatttcagattgactttttcctctctccctactactcctgtaaattatttattaaattctcaacaatctgctaattgtcatatataagagaaatactcagcacacagcacacttttttttcaattttttcattttttttttttttttttgcaaaacccaaaactatacataccctaaaagaaaatctagacaataccattcgggacataggtacaggcaaagagttcatgatgaaatggcctaaagcaattacaacaaaagcaaacattgacaaatgggatataattaaactaaagagcttcttcacagcaaaagaaactatcatcagagcaaacaggcaacgttcaaagtgggagaaaagtttgcaatctgtccatgtgacaaaggtctaatatccagaatctacaaggaactgaaacaaatttacaagaaaaaaaaaaaaccactaaaaagtaggcaaaggacatagacacttcttaataaaagacattcgtgtgactaacaaacatatgagaaaaagctcaacatcactgatcattagagaaatgcaaatcaaaaccacagtgagataccatctcacaccagtcagaatgacaattattaaaaagtcaagaaacaacatgctggcaaggttgcagagaaataggaacacttttacactgttggtgggaatgtaaattagttcgaccatcgtggaagacaatgtggggattcctcaaagatctagaaccagaaataccatctgacccaagaatactattactgggtatattcccaaagaaaataaatcgttcgattataacatgcacatgtatgttcattgcagcaccattcacaatagcaaagccatggaatcaacccaaatgcccatcagtgatagactagataaagaaaatgtacttacagaccatggaatactatgcagctataaaaaatgagatcatgtcccttgcaggaacctggaaggagctggaagccattatcctcagcaaactaatgcaggaacaggaaaccaaacacagcatgttctcacttataagtgggagctaaacaatgagaacacatagtcacagggaaaggaacaagacacattgggtcgtaataggggtggcggtggggagggagaacattaggaaaaaagctaatgcctgctgcgttaaacacctaggtgatggcctgataggtgcagcaaaccaccatggcacatctttacctacgtaacaaaactgcacatcctacatgtaaaccacggaacttaaaaataataataatagtactttcacattttgtctttctgaaaaatttacacattattgtgtttaaaagaaagaaatacactttatcttcaaattattgatctgaattccatcctaatttttagacaggctgtgtctttttaactccttaatttataactatagatacatgtctcataagtactttaaattaagatgtgaaaaatgagagtaaacgtctgattaatctaaaccttcttcctcctcgatggtctatctggtcaatccatattatttcctttatttactaggttaattgctgataaattaaggaattaccaaatatttattaagcatttctgagtagcaggcccttttagaatctgaatgtgtgtatgtgtgtatagtctaataaaacaaatgctgacattaccttcatgaaaaatatattgtactgaagtagaaagctattaaaatattcatacaagtacacgtaaaatttcaaccctgtttattaccatgaagtaaaggtacttgaatttatgagcatatgtaataaggagacttgacccagcctgaagcagatcaagaaaagcttttctgataaattaatttcatgaggtcaagtggaccatggttgtgggaagagtagtgcaggcataggaaacacaccaatatgctgtggtggatacaagatgataatattgaattctgactaccagaaaaacattttaaataggcagaattcaaaagggctcctgtactagtttgctaaggttgctataacaaagtaccacagacttggtgacttaaacagcagaggtttattttctcagcagttccggaggttaagagtgtgaaatcaaggtgttggcagcattggttccttctgaggggtctgaggaagggatgtattccaggtctttctccttgtcttgtaggtagctattttcttatttatatgcctgtggagcaggttgactgtgcactggttaacacttcagcccactgcatcctgggctttacttttactacctgtctgagtctggtaaaacaaaacagtcacatacaaaataagttacataaatcaggtttattacttacagatagccaccaagggaaaactgaaacccaggtttcatagtgagcagatcccttgaggctcagggaagctgcctggggcagagagagtcttgtctgtgtatcttcacttgcaacacacctgtgggacccccgaaggcagcccagcctgggttttataccccagagcttcatactttactgggtaaaagcattataggacattttgtttctaggaagaacaagaacatagcttatgctctttcagccagttattctttatctcagaatgttgcatccccagtacatcctattttttttttattcctgagaactacagatgatagagggaaataattgaattgctaactcagagaatttgtctgcaatggcatgatccctaaagacatggttgtttccaaatttctccgtttcataaaaccatctatcatagtgaattagcgatccattctactatagtatgacttcatccttactcattatacaggcaaagaccccattttcacataagatcacgttctgagatactggagattaagacttcaacatatcaatgttaggggaacacaattcaacacataatggccccaagatcccattctttaatgtgcacacatgttctcccagttactcaatgaaacactaacatagatgctgctgtgaagggattttgcagatgcatttaaggtcctaaatcagccaaatttcaaaagggctattgtctggactaaccctaaaccaatcagatgagtcactgaaaggaactgaactctttctagtattagatattcttatgatagatattattttatgatagtctccatgctgcctcaaattatcttcaaaaccttcttatttttcttctatccgtctatagtatatcacttgccacaatctgacattttattttttagtatagaagccttccatgatctttatggaagtgattcctatcactccccttcagtcttgttagttttttgtttgtttttgtttttttgtcacaagctcactgaactaggagatactgtatagtttcaccttgatctgtcatgactgtaatttcctaaacacaccttattctcttcctagaatgcactttcttattttagtgactaatgagattgcccatgaatattttagaatctaattactaacaccttttctgtgatatcttcattgttttcttccataaccagaaataaacttacatttgcctatgttttcatcacaaaatgtggcaactcttttataatcctcatccaataatattaccaaatgctcttagtaattatttatatcatgtttatcctctcaacctgactgttatctctttaaaatcagaatatttacattacatatatatatatacacatatgtttgtgtgtgtgtgtgtatatatacatatatacacacaccagtatatatatatatatatatatatatatatatatatatatatatatatgtatattctggtccttcattaggaaagaagtaataaatttgtaagcttgaaagagacatttcaactaatatctcattattattattatataatcagcataaagagtgatagtgcacgcagttgggcatttttcttaggataagtgatacatacttgatgattgattttacacaaatcccaccaatctgctatattgtaaatgaagacagaaaaattatcttactcatcagaaaaaaatatcaaggcaaatttgttcttggaaacaatatgctcataagattttagtaattacttctgagcctttttgtattttacttactaccatcctccatatgcctttgatattttttggcatatatacatcttccatatttctttttacataaaaatattataaaaacactgtttctcaaagctggtccattgctcatacttttctaagtacttttggagtaccatattcaaggaaatgtacaaactgaattgaacttaatttgtaattatgactatatctgcttttaaccattcctatcttcatgatacatcatgtactctatatagcacaaaaatgtctcaaaagaaacttatttcctaattttcctttcattgttaaaaaacacttaaaccaaatatagtggtgttcattttatcactatatgagcaaatatatgttaaatgtgtaccttgtatataagaacatatttttatattagctttgcttagattattatgtatagtttttcattctgatgttcaatatattatatttagtctcaaagaatctggcttcaatgcaaagtaagatttatctactaaattatatttttacagctatacattcatattttctgtctctgattcaacaatattctggtgatgatgcacttaggttattaaaataggtagactacattgtttaatttgtattctgtcatttgttcatccataggtcaatgtagaaagtataaaaatttctgttgttctcttttaatgttgaggtttcctgatgtctttgtcttgctcaaacccagtcacccgctctcagactgtcattcaccatcctgttcggctggcttgtgctgtttcacaggagtttccatgtgggtcacacagtctgagattgcatgcttcagtttctgccagccagtcctacaggtcaggacctgctgttacccaaccttgcataagtcctggagagctgcgccagagcaaaacaatgctgacagactggcagtgtcccaaggccttgttggtaagaatcctgtcttacatttggtctctcccactggaatgacagaaactccaaattatcctgcattctttggcccacaaaacactatcctatttaatagaactcttccttgaaaattgtttccttaagaaatagtgatagagaatttcattcagataaacaggtaattgtaaacataagaggattgcttttaacattttttattttaaacaattttaaagttacagaaaaattgtaagcatagtataaggattttccatatacttatcaaagacattcaccaagttttaacatttggaagcatggaatcatatattctctgtgtgtagggggagtatgtgtgtgttcgtatggttttatatatgattatatatatatggtttatatatacagtatatggatgttgtgtatatatacaaacacaccacatacagtcatgtgtcacataatgatattttggtcaaggacagatcacatatacaatgttgattctgtaagattacaatattgtatttttactgtaccttttttatgtgtagctacaaaaatactaacatcatgttacaattccctacagtattcagtacaataacatgcttgtatttgttcgctttcatgccactgataaaaacatacccaagactgggaagaaaaagatgtataattagacttacagttccgcatggccagggaggtctcagaatcacagcaggaggcaaaagacatttcttacatgatggcggcaagagaaaatgagggaaaagcaaaagcggaaaaccctgataaacccatcacatctcatgaaacttattcactatcacgagaatagcacaggaaacactaacacccatgattcaattacctctccctgggtccctcccacaacatgtgggaattctgggagacacaattcaagttgagatttgggtagggacacagccaaatcatatcattttgcctgtgacccctccaaatatcatgtcctcatatgtcaaaatcaatcatgtcttcccaacagtccccaaaagtcttaactcatttcaacattaacccaaaagtccacagtccaaagtctcatctgcgacgaggcaagtgccttccacctatgagcttgtaaaatcaaaagcaagctagttattttgtagatacaatgggggtatgggtatcgagtaaatacagtcattccacttgggagaaattggccaaaacaaaggggttacagggcccatgcaagtccaaaatacaatggggcagtcaaatttcaaagttccaaaatgatctcctttgactccaggtctaacatccaggtcatgctgatgcaaggggtgggttcccatggtctttgatagctctgaccctgtggctttgcagggtacagcctccctcctggttgttttcatgggttgaagttgagtgtctgtggcttttccaggtgcacagtgcaagtgtgggtggatctgtccaactgtcggtggacctacccttctggggtgtggaggacagtggccctcttctcacagctccactaagcagggccccatagagactctttgggggttctccgactccacattttccttctgcactgccttagcagagattctccatgagggccctgaccctgtagcaaactttttactaggcatccaggcatttccaacatcttctgaaatctagacagaggttcccaaacctcaattattgacttctgggcaactgcaggcttaacaccacgtggaaactgccaaggcttggggtttccagcctctgaagccaaagctcaagctgtacattggcccttttgagccatggctggagcagctggcacacagagcactacgtctctaggctgcatacagcacatggacgctgggcccaggccacaaaaccactttttcctcctggatctccaagcatatgatgggaggggatggcatgaaggtctctaacgtggcctggagacattttgcccatggtctcggggattaacattaggctccttgctacttatgcaaatttctgtagccagcttgaatttctccacagaaaatgggattttcttttctatcacataatcaggctgcaaattttccaaacttgtatgctctgcttcctttataaaactgaatgcctttaacggcagccaagtcacgttgagatgtgaagccagctggacttgctgggtcgagtggggacttggagaacttttctgtcttacaagaggattataaaatgcaccaattagtgctctgtaaaaacgcaccaatcagcactctgtagctagcaaggggattgtaaaatgcaccaatcagtaccctgaaaatgcaacaatcagcactctgtaaaatgcaccaatcagcaggatcctaaaactagccaatcacagggaggattgataaaggagcactctgataggacaaaaacagaacatgggaggggacaaacaagggaataaatgctggccaccccagccagcagcagcaactcactcgggtctccttacacactgtggaagctttgttctttcactcttcacaataaatcttgctgctgctcactctttgggtctgtgccatctttaaaagctgtaacactcactgcgaaggtccatggctccattcttgaaatcagcaaaaccacaaacccactggcaggaaccaactctggacacatcttgggagctcctctgggatattgtcatgtggtgagtaccatcggaccccttttgcttgccattctgtcctatttttctttagaatttgggggctaaacaccaggcacctgtcacccagttaaaagcgactagtgcagctacaacactaaagacatgggtatcagtctttctgggaaagggctctctaacaaaccctgacacttcggagtcgggagcgtcggttttctgggaaccagcttccacttttcctgtactttgggctgagccaaaggtcaacagacagaaaagccattcagctccagggtcccaacaaaaagttggtttaccctgcagccatgagcggaactctcaaagttacgttgcccaagtgagatttacccatatatcctatctatcctgacccttgcctcctgggtcctaacacctatcagacaaactttctcttgcctctcttctctgaggctagtcctgcttctaaaaaccactccctgtctctggtgcttttctagtttctcctataaagacttttagtataaacttcagggctctgttcccttctttaggcacccaggctcaccaatcagaaagacatagttttttctcaaagccccatcgggggggtaccatccaaactttcagaatccctcctcagactagcctgcctaacaaaggctattcctgaagctaggacatggggagcctcagaaattacagactccaaaattggggggctatccttcctattcacatgatgagaagtgaggacaaaaggtgtcactcttccaaccctggagatcccttccctccctcaaggtatggccctccactccattttgaggcatatcatctttatgggataagggtaaggtcccaatactaaaaggagaaaatgcttaggactgtaattgatttttgagaatgcatcagtaagggccactaaatccgatttttctcagtcctctttgtagtctaggatgaaaactagtgtttctgctgctgctttggtgagtgccaactattctgaacagcagggtccagggactgttgcaggttctcgggcaggggaaaaaaaaaaaactgcaggaggttttttctttcagatgggaaacactcaggcatcaacaggctcacccttgaaatgcatcctaagccattgggaccaatttgacctgcaaatcctgaaaaataggtaagtggctcatttttttctgcattatggcctggccccagtattccctctctgatgggaaaaaatggtcacctgaaggaagtataaattataatactatcctgcaacttgaccttttctgtaagagggaaggcaaatggagtgaaatacctatgtccaagctttctttttattgaaggataatccacaactatgcaaaacttgcaatttacatcccacaggaggacttctcaacttacctccatatcctagcctccttacagcttcccttcctattaatgataagcctcctctaatctcccccacccagaaggaagcaagcaaggaaatctccaagggaccacaaaaccccccgggctatcgtttatgtccccttcaagctgtagggagaggggaatttggctcaacccggatacatgtccccttctccctctctgatttaaagcagatcaaggtagacctggggaagtttacagatgatcctgataggtatatagatgtcctacagggtctatggcaaacttttgacctcacttggagaggtgtcatgctattgttagatcaaaccctggcctttaatgaaaagaatgtggctttagctacagcctgagagtttggagataacctggtatcttagtcaagcaaatgatagaatgacagccgaataaagggacaaattccctactgttcagcaagccatcctcagtatggatctccagtgggacctagactcagatcatggggactggagtcgcaaacatctgttgacctgtgttctagaaggactaagaagaattagaaaaaaccccatgaattattcaatgatgtccaccataactcagggaaaggaaaatcctaccgccttactctagcggctacaggaggcctcaagaaaatatactcccttgtttgatcctaaaagataagtttattacccaatcagccacagatatcaggagaaagttcccaaagtgagccctgggcttgaacaaaatctggaggcattattaagcctggcaacctcagtgttctataatagggaccaagaagaacaggccgaaaaggaaaagcgagataagagaaaggccgcagccttagtcatggccctcagacaaacaaaccttggtggttcagagaggacagaaaatggagcaggccaatcacctgataaggtttgttatcagtgtggcttgcaaggacactttaaaaaagattgtccaacgagaaacaagctgccccttcgcccatgtccactatgccaagacaatcactggaaggcacactgccccagagaacaaagggtctctgggccagaagctcccaaccagatgatccaacaacagaactgagggtgtctggggcaagcgccagctcatgtcatcaccctcactgagccctgtgtatgtttaaccagtgagagccaggaaattgacttcctcctggacactggcacagccttctcagcgttaatctcctgccctggatggctatcctcaaggtccattaccatccgaggaatcctgggacagcctgtaaccaggtatttctcccacctcctcagttgtaattgggagactttgctcttttcacatgcctttcttgttacacctgaaagtcccacacccttattagggagggacatattagccaaggctggagctattatctacatgaataaggggaacaagttacccatttattgtcccctacttgaggaggaaatcaaccctgaagtctgggcattggaaggacaatttggaagggcaaaaaatgcccacccagtccaaaccaggctaaaagacgccaccacttttccttatcaaaggcaacatcccttaaggcctgaagctcataaagaattacaggatattgttagacatttaaatgttcaaggcttagtaagaaaatgcagcagtccctgcaacaccccaattctaggagtacaaaaaccgaatgatcagtggagactagtgcaaaatcttagactcatcaatgaggcagtatttcctctatatccagttgtacccaacccctataccctgctttctcaaataccagaggaagcagaatagttcactgttctggacatatgttatagagtagcattaggttggtgcaaaagtaatcatggtttttgccattacctctgtaccaactaatagacagattgcaagtttgtaaatattttgtgtattcaaagaactaaattacatcaaattttggaaagaaaaagcaatttctctaagtagaaaataaacagaaacacatgaacctacttaagttcacaaagaaaaaaatagtaatttcaaccaattgaatatcacagaactcttctggtaaaaccttagcaggattgaaaaagtcttaaaagacatattatcaattatggtatttgtaatgctattttgaaaaaaagttgatgaatacagcaggtacatatttatttattgtatcaagaacaaagattttcaaatacaaaaaaaaccctaaaattacataattgtggaaattaagtaaatttcctataataatttcataccgaaaaatgccagtatggactcatttaggtttctttttttcaagtacatatattttctggccttcatcacaaaaacggacctagaaagcatgcaaacccagcaacaatgaaagattctgtgatctggattttcctgtctgaatagaatttcttaccaaaataaactaataaagaaagggttgattttgggtatgtcgcagggaacttacgacaagtgttagaacactgactatccttgaaagcaacaaaactttctactaacaaggtggtggaaggggtaatggccgtgttagaaagatcaaggaaccagtgtgaaggttttccttatggtcagattgggacataaaaatatactaactgtaaatgattttaaaactatctaaaataaaaacctttaagtcaagagtggagagataggaagagagaatgagaatgaagttgattattacaccaccctcttgctctgaaaattgatagttaaaaataaaaaaactaagcatttaacaagcctttacaagaaaagatatatatatatatatgcatatttcatatatatatatgtcatccaagttaggaagaaaagttctcctttataaaacaattccagctaataaaagaatgatagaatgagaaaatcactagaatgtgagataaaattgcaaaatttttccaatctatttaacatattaatgtcatttttacaaaatgggcaggagatttttctagataaaaatagatgagatattctgattgatcatatcctactatgtttatgtaggagactgttcttgttttaaggagatcttttctaagctattctatggaaaagcatcatactgtctgcaacaaaattttaatatctatatttttggcatgtgtggcaaaacttaactaattttgagtcgaggtgacaaattgtgttggtcaatataaatttttttcaacttttctgaaaattagacatttgttgcaataaaatttgggggattttattttagattaaaatgttaagaaaccatgtactctctttggtagtcaccaaataatatttgtgttataatattatatgaggtagaatataagagattaaatatattatcattataatgctatttgctattttctgtactggtacaggtactgtaaacatgtaacttttacaaattatatttaactttttcttattatgtaagtcataatgctttaaagaaaatatcctattttgatattttaagtcttgtgaatgaattataaacagaatgttaattttatgaccagagaaagaggttgtttgcaagcagaaaaacttggaatcaaataaacaattttaaataaaacatcaacttttatccagccattgtcaaaaataaatagtaaatgaagaaaataatttatcttcctcctatctcaatcttagttggaaatgggtaccaatttagcatcacaaatagtatattacaattacttattgactagactgataatttcagcctttcttaatttcagtgggttaaccaaattgagagctaaactccatgaatttaaacaaaaacaaataaacataaactactgttggagtggtgtgaccaagaaattcgaacttgcaatctgtccttgcaagttctcatcctaggttatgaggaaacttgcaagttaggaaaaattattttgcattcaagaatttaagacatcattgaatgcaatggaataaaggaacaggataacgtatggaataaaggaacaggatgagtttatggaagtgtgtgcagacttcctgatagagattcttattggccaaattaaggattttgtattgttgcttgactaatgaaagattttcaaatatttgtagcatttactatcatctagcttatatttacaaatgatcaaaatgtctgttattttaaaaaggtacaaaaagggagcaagttgagtttgtcagggagaaaggtgagagttttttggactttattttaatgtataatagcaatacagggaagtatccaatttgaaatacgaagtttgaatttggaagctatgtctccattaccctgtattcttagcttaaggatatgtttattctactaaacgcactttagaaatattttgtccggggaaggaaaattttctttagtatttcaataatggctctctctcttatcattcttgactaattcaggaaaaaacgagaacctttaccacatttttggcattaagctatttgatttttcaatgcatattttttgagaaccacatatgtgaaaggtgttgcattaggtaatgacaaaaacagagaaagctcctgaattctgggagccttttttctagtatggaagcacatatgaatcagacagtgaaacaaatgcatttaaaataaggaatctagtagataacatgtagtggcttttccaacatccatttcaatttcctttttgcatacagtgattagaatgcttaaaatattacaatttagcctccattaaagctatagtttggaagaatttctttttacttattgattgtacttgcaagagactttgatttgagactgaattgtgtggctagaggagctaggtgcagggcttctgctttgatctagcactttacagcagcaatggtaatgtttttctgtgaacatttgttgtagtaacagaattttgcagtgagattaggatttttcacctatgggggcaacatgcttgtgaatacaggaattttccaggaagttcaagttggaggtttctccacctctaccaatgagcttgtatgaacctaaaatcatgtattagattgctttttgcaccaaccgtctagagtagattccgttattggcatctacaaaccactaagtaaaataaataggtaaattagagatgggaaacagtcattctaggacatcagtttctgtgagcgcctgtttaccctatttggtttgaaagttttaatattaccaaagtgtgttcatgtattagtcagggttctctagagggacagaactaatggaatataaatatatatttttattatatatataatatatattatacatattatatattattatatataataataatatacataatattattataatattattatatatttaatattatattatatataatataatattaaatataatatataataatattatattatattatatattttatatataataatattttattattatatattatataataatataatattaaatataatatataatattatattatattattatatattaatatattataatatatagtatatacataataaacatatatatgtttattaagtattaaattacaccttacaccatcacagagtcccacattaggctgtctgcaggttgaggagcaaggagagtcagtcagagttccaaaactgaagaagttggagttgatgttcaagggcaggaagcatccaacacgggagaaagatttagtgcgggaggctaggccagtctctcttttcaaatttttctgcttgcttatattgccaaaggaaattaacatttgaatcgggggctgggaaaggcacacccactcttaatctgggtggggacaatctaatcagcagccagagtgcggctagaatataaggaggcagaaaaatgtgaaaagagagactggcctggcctcccagcttacatctttctcccgtgatggatgcttcctgcccgggaacatcggactccaagttcttcagttttggaactcagactggctctccttgctcccagcctgaagacggcctattgtcggaccttgtgatagtgtgagttaatacttagtaaactcccacatatatgaatacacacctatacatacatatatacatatacatattccatatatacacacacacatatacacacacacacacacatatatacatatacatattccattaattctgtccctctagagaacgctaatatgataatttattggagacaaaatatatttcagttacattaggcatattattttcaaattattttatcactcttaacttttaaaagtacattaaccacagttatataggaaacctcattacagatattaaaaaataaccaggtgacttatcaatggagaatgaaaatatatcactattttataaatgggttggacataaacaaatgtttatcctcaaattgaatggcaggaaattcatgctaagaaaagcaagaccatttcagaggtaagctccaaatgtggacagttatgcaaacaagataagaataaagatactctgctaattgcactctgctacaacaaacatataaaactttcattacaacaaagaagtttcctgttacaataccactttaaatataaagtagtctaattagatcagataatcaaatttcttaattggaaagagaaacaaagtaataacaatcttaggaaaataaatgtttattttgtacagattcaaagaacatttatcattgtgagccaaccacttcccattgtcctttcttctagtcagaaaaacctaagtctcttctggaaaaccatctcatgccctattttcagtctgctgttggtgaagatgaacttagttgaactgaattactttgaaccagcagttttgttttgcttattttatttgtttatttgttttaagttgtggggtacatgtgcaggatgtgcaggtttgttatataggtaaatgggtgacatggtggttttaatcagtgagatttcaggtttaaaatattacctggattatgttcctgatacaagtctcttctaaattgtgactgaactacacattcaggaaacaaacaaacaaacaaaaaacaggtgaattcacataacaccactgtaaatgaagtctaataatcaacttattgccaatatctggaataatttttattgcttacaataatcagtcatgtggattggtatatactgtctgctctgccacaataagcagggtagttagtaaatactaatattaattcttagtccacattacatcaacaactaagagctttaaagtcagtagtgaaataacaactgttatgatgtttcttctctatttgaattatctgatctaatacatctcgaatatttccccaattatccattatattttctacatattccaaattgccatgtgataaaagcacaaatttctgtttcaagctatatagttgctatgtagatcatttatagagacagaaggagttatatttacagggtaaattttatgttgaagcttttcatttacataatacatttagggtttacataactcaggtagtcagaaaatgaatggaccccatcttgggccaatctatactattacattagacactgggaactgacgtaggaacaaaaggcatcaaaaaactggactcccaatgttatatcttgtaagagaatgtgtccagcagccaatgaacaaagggtggagtaaaggacactgtactatttttcacttaataaataaatgtataggctgggcgcggtggctcatgcctgtaatcccagcactttgggaggccgaggcaggtggatcacgaggtcaggagtttgagaccagcctgacgaacatggtgaaaacccatctctattaaaaatacaaaaattagccgggcatggtggcgcgcacctgtaatcccagctactcagcaggccgaggcaggagaatcacttgaatccaggagggagaggttgcagtgagccgagattgcaccactgcactccagcctgggtgacagagcaagactccatctcaaaaaaaaaataataataataataaataaatgtataaaatgatattggtaactttatttttaccacaaatacatgtattttatttcttacactttcaaaagcagaatataatgcaaaatagaaaataatagcaagacaaaataataatataaaaggtaggaaataccagaacatagaatagaaaaaaaaattaaaaatcactctaaaacctgtaaaactcctataagtagaattatatttctgtcatataataataactaaaaaaaaaggtttgaggatggaactacaaccataaatacagaacagatacaatgaaatgacaattctataaaatacctatgctaattttttaaataatatgataaaactccagatttctactaagctaaaaaagtaaaaaagaatcccagatcatttggaagagtatgatttgaccatctttttctagatttccagaaatagcttcatgaaataagaaaaatttaaaaagcaaaacctcatgatatcttcgaaaagtaatgtgcattaccaatatattataaatctgacaaacattttcctggaagaagtgaagcatcaagatattcatatccagtttgaaaagcatttcatgtccatatcgcagctgttactttaaaatgtagtgtcaatggtccagacagaagaaaagatatccaagaaaacttgcaattatgccttgaatgtgagtgcagagtatccataatgcattcctcagattcctctggaattagacaggttgggtaaggaagtaagatcacccacatagttgcttgactgagagatcaatttcacctttatggtaaattttatgaagtacagcattatcaatacatagaataattaagtagattgctcttttatctgagccactcgttgaggccaaggaattgtgagatgctgcttggtcagatttgattcaagtgcttactactgggatgacagattcaacctcagtcttcactaacagcagactgagaatagggcacgagatggttttccagaagaaacttaggtttttagtattagaagaaaggacaatgggaagtggttggctcacaatgataaaggttcttttaatctggacaaaataaacatttattttcctaagattgttcataactttgtttctctttccaaattagtgaagtgatttctggtctaaaaagactgtcatatatttaaagtggttttgtaacaggaatgaaagttttaagtgtgttttggttcctggtaaacatagaacctatgaaaggcaataaagcagtaaacttatttcattacaattcctgtaattaattatatgctctattttaaaactcctattctatttatactgtataacttactgtctttaatggttaatgattgtagttctcactcatgtctcataatcctccagatttgtccaaatagcacttccactgtgcagagttggacacttcaagatatcttactaacatacaaatgctttgcaataaatcattcactgctatttttttaaatagtaggaatatagaatataaataaataattcccgaggtgaaaacaatgagcttcaatacataaccagatctaggaaaaaataaaaatatttcgttttaatatattatactttaatatctgcacttacattgaaattaaaatttacaatgaatctttaaaactaaagctatcatgcagaaaaaaatcaacaaaattctgctcaacaagtgcttttaagctgagaaaacataagaacaaattgttcctctttggggtttataagtaaattttcgtttatatatacataatagtaggagaaaaaggaagaatagacatacaatatagaaggatggaaaaattaagagaagtgaaggtaagggtttggttgtgttctgtgtcagaagtataggacttatgatctatacttatgaaataattatcttttacacattatctctaaaaagaccatgcaagttcatttcattcaacctgaaggtatcattttacagctgaataaactgaatttgagaaaacatgatttaccttttctagtttccacattttcctgctcataaactttcaatctatcactgattttaggcattcctgccttatacattctcatgtagttatcagagaaaagaaaaccagtttggcttatgattcatcacacaactcaggtaattagaatattctttcatatttgtgttggtagttgttttgctattaccataaaatcaggagaaatatatattcagcattttaacactattgaaatgttaaaaatcatcacaatagaaatgataattatgtattcttgctaggtgacactaacagagtatctgtttaaaattgcaaggtacagagaacatataagcatgagtatcaaattattcagctcttataaatctattgcatttttccaagcatcaaatcagtgtgtttcttctttctcatttgcctaatttatggtaatccgtactgctagcagggtctctgaatactttgcatattacatgtatttggataatagaaaaacacttttttaatcattaaggaaattatctttaaaatattttattttagattcagcatgtacatgtgcaaatgtgttacttggatatattgtgtaatggtggggtttgggattctagtgtacccatcacccaaatagtgaccattgaacccagtagatagttcttcatccctcaccctctgtcaacatccctgcttttggaatcccatgtctactgttttcatctttatgtctatgtgtacccattgtttagcttctacttatacgtgagaacataaagtatttgattttctgtttctgagttatttcacttatgtggtatgatggcctccagctccatccatgttgctactaaggatatgatttaattttttatggctgcatagtattccatggtgtagatatactacattttctttatccaatcaaccattgatagaaacttaggttgattccatgattttgctattgtgaatagtgctgtgataaatgtcagtgcaggtgctgttttatataatggtttcttttcctttgggtaaatacctaccaatgggattgctggatcaaatgacagttctatatttacttatttgagaaatttccttactgttttccataccacattctatgaaaccagtatcactctgatataaaaatgaggtaaggacacaacaacaacaaaataaactacaagccagtatctttgatggcaatagatgcttaccatcctcagcaaaatagtagcaaaccaaatccagttgcaaatcagaaggataatttattagaatcaaatgggttttattccagggatacaatatggttcaacattcacaaatgaataaatgtaactcaccacataaacagagttaaaaatcatacgattatctcaatagatgcagaaaatgtattcgacaaaatcgaacatcctttcatgataaaaaccctcaacaaattaggtatcaaaggaatatacctcagaataataacaccatatacaacaaactcagtcaacatcatactgaacagagaaaagttgaaaacattcctcctaagaactggaacaagacaagaatgtccacacttagtattcttatgcaacataatatgttcaagccgagaacaaaatcaagaactcaatcccattcatagtagccacacacacacaaataaaatacctaggaatacagctaatcaaagaggtgaaggatctctatgaggagaactacaaaacatgaaagaaagaaataggtgtcataaacgaatagaaaaacaccacatgcttatggattggaagaatcaatatcattaaaatgaccatactgcccaaagcaatatacagattgaacacaattcctgtcaaactaccaaatcattattcacagagttaagaaaaaaatcctaaacttccttttttaaataataaaaataagactttttttttttttttttttttttttttttttttttttttttttttttgagatggagttttgctgtgtcgcccaggctgcagtgcagtggcgcaatctcggctcactgcaagctcctcctcctgggttcacgccattctcctgcctcagcctcccgagtagctgggactacaggagcccgccaccacgcctggctaattttttgtattttttttagtagatacggggtttcaccgtggtagccaggatggtctcgatctcctgatcttgtgatctgcccgcctcggcctcccaaagtgctgggattacaggcgtgagccatcgcgcccggccgacattttttttataaatacagtttaaagcattttaagaagagaaaaaagtgtcttcgacattcaaatggaaaaaaaaatggtaaaaatcccggctctgagttctcattattcaagttaattaatagtttatatggaaagaagtgaatcattttctcatttcatatgtgcactattggtttgcatttattcagaagctttgtaaatatccaaaagctatggttctctggcaagaaagagccaaggaatagatacttggcattcactggttgttatagtatattggctactttatccttcagtgttatttaggttgtcttctttattactaacacctcagcttagttccttgcttaatttaatgctaaattcatagtttggcattttccactggttatattgattgtggcaaagaagaaagaatatactgggggattttttttccccctagaattaaacaatcataccaccagaggaatatctacttttacaatatcaatgaaagatacacagataggtagagggatagagataggaagatagctaactagctagatacatagatacaaattgatataatatagatatggtaaaagccaggagattttctaaaggatagttaacttagaaaataagtgtgtagtgactaactgaagatagtttatctagatcttctgatggacataaccttgctctttaaaaccaaactacctcatttctattatctttaatatcaatttgatctatatatatggatagatagataacatatataattcttccctatgatcaaaaaacagtgtaaaatcacaagatgatttccatttcaagattaacttcaaattaacaaataattaatagagatccacagtttcctccatactgtttcagatatgaggaaaagtgaagaaatatactatccagtcactaaaatttgacagtaataatacatttaactatcacaatgtagagaaaaagaaatacgttctgagtggtcagggacatctcctcctttccttatccttttaatgggtggagactacaggccacatagagactatgtttacacaagaagtccagttcatttagtttccatgaaacctttcaacaaatatgagagataatttgttatgatgatcatgatcatgttaaatgagtgaacataagttatgaaaaaaagttattttcaatgacaatttgattaaaaagtctaaaagagtacaaagctcttcttgtggagactatttttttcatattcagtaaagttgctttagttttgagacactaaaataatttgtgtttagcttcaacaattactgaaaaacctggttttaaactttttgaaataaactaatttatagggacagtttttttgtgttctgggtttctttctcaattacattatttaatcttcagagttttcctaatgttgtacccatttgatatcttactggtatgctatcaaagagaatagtaagtgtctaggtgggatatgagatgtgagggtggaagttgaggtaagtggagagataaaatacatcagaatctgcaaatcaagaaaacatgactttgaaggccttattaggagactccaaaatcattcacacccttctctcaagataatcagcatttcttgtcttctgcacaaaggaaatagagccagaaatgtttacaattaacatagaaaggacagaaaaagtttaggtaatcaaaaggcacctccttttttttttttttcctcccttctgtgtctgaactccattgacctagagaatgaaggggaaaggaatgttccaggtacagataatgtaccctcctctaaaggctgcagaaaaaagagaagaaataaaagaccatactctgcacacatctcaattatcaatgctgtggagaagagattatatttaaattgtatatgagattaaagtttagaactagaatcaactgaagtatttaaaaaaataaataaatcatgtggaaaattatgatatctgcctgcattattgataaggtaactgaacttcatttccagcctcttgctgcttggaaaatcaatgctcaagaaacaagtgttggcaagaagaaaagttacctttattagggaagccagcaacctgggaagatagtgaactcacatgcaaaggctacctcttcaaatggtggctccataccagagtttatcagggaaatcaggggaagagcaagtggtgatcaaagtcttcttgtggcaggagctacatgtgcaatctcaggcaggcagtgaatcttctctgtcttggtcagagtcttgtgaccttttgctggcgctaggctcttcttacctagtagcagcctagactgctggccagtctgcccccgaaattgctggtcagcgtatttctcttaatctgtgtcaaaggtcccgtttttctgagattgttctgttcttagtgaataatctacagacttaggcaaagcagtaattaaaactcaaataagcaaaattttttctttaacatggtggacgttcaaaatggagtcagtgttgttacaaactccccactgccaatgtatctttccatatctatagaaaatgggcaaaggtctcatcttctgtaactacttctgctgaactgggacatagtgggtattttagttggaaggttttgacatggtgtcatacagagtttttgttcttttctgtggtaggtgagaaatcagagttaacttttcattaatggcattgttgacctttttgataaagcataacattaccaatttaaatcttaagaatatatcagtagttattagcagaattgttcattttaatttaaaaattttctgtcatgctgattttagttcagcagatagtatcatgctgatattttgttcagagaataggctaaaaaacaaatcccagcctcctccaaacaaggagatataatggtttagagtttgttgtaatcagatcacttgctctctaactttttaaatgtttgtttctacttgagaggaagtactgatatatatgcaacaggaggaattagtaacaacacaaacaccatctcgttctgttaaaatatagtctaggactattctgttatttagcactacttgtattaatggatctactaagttttgtaagtttgcaagagacttagtggctccagtagcaattacgattaaagtcctgggtagatttatcagttcatgataatataaagccattcccccatgaaggcagaaaagagtacccaaagaagtacatgggttctgaaggtatatgggtatatggtcagaaagaaagtctttcaagtcttgagagagcttgtccaatgtctttattgtgtttttttatttttttaggagcgtgaagggtgaaaggagttattaacatgtctattaggcattatcctgaatgtgtgtcattttacaagcaatgatatgcccatggtactcaatcaggaagttatattaatatatatcttccagggggcaaaacatatactcatttgttttactaatctaaatggctgtattgttttccccaagtatttccagggaaatctattaaatcatctgttatggatatgattacaggttcttggttttagagggggagggtcttccctggtgttggagtcaatgtgtagcttgtttaattggcattagtttttacccacctggaaaggcatgagggattgtgtcttttcagaggtgaaatgagtgattctgacaatatatgtaactcttggttttttatggtatacgcgacatactaaatggtcccacatgtcatatactgagtagtggttggaatggcaaatctaacaatcagttttttatgtattattggcaaagattaagatagtttaacttaagcaatatgtaaccgccatgttagatggtagcagcaccacctttagcattcagtattttattaggatatttaatatttttgttattagaggttagcaaatctctttttttctatattgccccatgtgcttgtattaccatgaaggcatatctagagtctgtgcagctctcctctttcctttgggataaagttaaggctctggtaagggttattcattctactttttggggggatgtaccagggggaagtgcaggggctttgattatttgttccagagtggtcagtgtataccctgctcaatggtgtctatttttcatgaaactgctgtcatcggtgaacaatttctagtctggagttgttatcagctgatcacacaagtctaggtggctggaataaacgacttgatttatttataaactgttatgcttaggctctgtgtcttgcactgaactgccaaggagcagtgttgtggggattagggttgcagtggtttggagggtggtattaggattatccagaaaaatggcctgacatttgcccatacgcccagcagttatctcctttttttaaatagggttaacacttgatggggaacatacacagttatgggttgtcgtagagtacatttgttggtttcttgtaataagtcacatgtggcagctactgccctctggcagggaggccatcctttggctgtttattctgtttcaaaaaatatacaataggttacagtttttccccaagtttctgggtcagaattcctagttcaattctcttttttaatgtacttacaggggaaagggctttgggggtcagggagccccaaggcaaacactaatgttaattttttatttatattataaaatgtattttggcatttcattgtctaatgcaagggttctgacccagtcattttaaagcatcatacaagggttttgctgtgagtccaaagttagaaatctaaatgtcaaaaaaagtgaaccatccccaagaattctcttacttgtttctgttttggggagggctttaatggcagctactgcctgtttcttatcagtcataagactgcttaccttgttgtaggtggaaccccaagttgacgatgtcttttttgcatatttggaccttacgtggggccactttataaccccattcagccaggttatttaaatccagtaatgtgttttccaggaagtctttataagtggggctggcaattagtaagccatatacacactgtaatactacccttcggtttaactgtaggtcactcagatttttagccgaaatttccccgaaaatggtgggggcatttttaaatccttggagtaatatagcatagtaatattggaaaattgtcttagcttttggatcatgccatttaaaggcaaacaggaattggggttttctttaactggtatgcagaagacagtatctttgaagtctcatactgagaaccagccataatctcctgggataatagtgacttgggtgtatgggttatgtactgttggatggatatcttgaatgatatcattaattgttcttgagcattgcacaaattgatattcatttgaatgtcgttattttactgggaaaataggagtattggatagagagagacatggttgaataagctcatacttcgaaagtaatacctttgtaatactggcagagtgccttctaatgcttcccttttcagaggatgctgctttcttgtttgtttgtttgtttttatgtgggattgtatctccttcttttaatgtaatgcagaccatctgaactctagtagctcatctggattctccatcggcccaaacagtattgcttattccatagtagacttcaggtggaaacaattcttgggtcttgtttttaggctgagtcatcaatgtctgcaaacacaaggcctttttgggtgggatctgggtccttagatgttgttttttaggagaaaattttacttaagcatttagtttagcatagtaattgtcattccaacgacagaacagggcaattaggcatattttaaaaaaactaggtcttaactttatgtctcccaatttggattctaaaggctgagggaaaggtatttgctccagttttctgttgactcctgccactggcactatatcttgtgtacttttagttaatttattatttaaactgaagttgcttcagtattaactaagaagtcgattattttatacttcaatgtcattcgtacccagggcttctgtggggaaatgatcattggctccattatatcaaggaaaacacctgagcctcctcagtcttatcagagccacaatctacttgtctgtttctttgcttcctattttttttttctttttctctcttatcctttttctactgtcatctttcccttttagcctgtagcaatcattcttttaatgcccagatccccagcagtaggcacattgatctttgcctgggagtcctattctgttttgtcccttactcttctcaggccctcttttatttttctgaatgctttctacaagagtgggcacttgtctggctcttgtttttctggcattgaaaagtttgtaagcaatttctaccaatagagaagggtttattctttctgattttttcaatttccttttgatacctgaagtgctttggctgatgaaagtcagattgactgtccaaatattttctggggcctctagatccatacctgagtatttttttataagcccgatatattcgttccagccaagaggctgaattttcattagcctcctgttggagatcatggattttgctgatgctacgcttctcgggtactcctttactcagtcccatcaaaacatgtttttagtagtattctagtcttggcattccccattgttatggtcgcaattgagctccattaagagagtcgtccctgtgggggatcaggggtcctagaagggtctttctgaagtagctgcctgacctcatcattggctttgtctaggacttgtctccttttaccagccattatcatgaaatttaatggtgtttgaatgtccacctaagtgaggaaatatgtggagaatatactggtacataattcagccatgtgctatgggtcatctctgtaggaagggcttatattatttttagtttactaagtctaaagtggagaaaggtgaatgtaatccccaaaatcccatgggttggccatgtgcatttaactcctgttggatcttaaaaggggagacccattggccttgtgcatttaagacccagtcaggtcttaaaagaggagactgtctccagcctgcttgcataatgtcgaggggacactgcttcttgtaaatatggattatttaaatagtcttctgggggagtgggtagaggaaggagcagttcagtgtacaacgctggcagggtcagcgtgggaacctgcacaggtgccagagcaggcagcaccagggaaggcacttgcaacaccacagcatcatttccctgtggcgagtttaaggctaacaaaattatcctatcctcctgcttctgttgggatgatcagacccaacaccaggtcatgggggcaacaaagtccgacagagccaaaggattgagaaaaagacagtttcagaagtaaagtgggaccagggggccatcgctagtgtatggaagctgctaaggccccaagctctgggagcccacactatttattggtaattcaacatagaaacaggtggtgagaatgtggggcgtcaaaagggcaggcacatgatctacagctgtgacggtttagcatttatatggaacatgttcttctactcgagataatgggaatacaatcgatctgggagcctaggaaggctagaagcaaggagccggcaagtctagacacattccagaggacattatgtcagacacgcaagccttgcctcagtttttttctcaacacttggctttttcccaacatacttctttttcccttctgtatcttcctcaggcagtagaggccaatgagatttcactttatgcagtcctctttgcaccactaactgggaacctttctgggaagcatctttattacatgatagaataaacacgtgagcataagtatttttttccatttacctgatctttgataaaactgttcaagctgtaagactgtataaaagttcaaaaaccctaaaggccacctctcttctaacacatgcatctgccatgttgtattacaacaaaatgccattttttttgttgttgttttttcctttgtcccaaggtcatagctataggctgaccagttagctaatatgctttttctttgagacagaatctacaaaatacctcccatggtaacaagaaaacaacacacaatcaaaacaaatgaagtgcttcccaaacaccatcttcttcaagggaggagaccagcacggagtcactacaagttgtttcttctaccaacggtaccacaaatggccccaaaggcccaaatggtaaggaaagaggacccctggtgttcacactggtggatgtagcttgttatagagctggtcagctcatctagagagcttgttaccatttaccagctcgaagtgaaaataggcagctggcgtcaattgagggaaagaagggcgtttccccaaagtgtaaaagagtcttggcagtttgcctgtgtcaggcgtggccaaccacaagtagctggtgttactgaaggcttgctgctaacctctggtagcaagagagggttagcccatacgtgctgccacagtcaactgctccacccattgggaatctaaatgagcctctcggtaacctgaacaaggtagccctggtgcactgctgcggccaattgcttcatctgttgggagctgagcaaacagctcagggagcatgagactccggactagctcaccaaatattgtaaccaaactcaggttcgggacacttgacacctgaacaaccaatgctcaagagacaagtgttggtaagaaggaaagttagctttattagggaagcaggcaagttgggaaattagtgaccttgtttcaagactacctctctgaattgtagctctggaccaagagtttttacgggaaatcaggataagtgtaagtcataatcagagtgtccttgtggaggagctacgtgtgcaatctcaggcaggcagtcagtccttgctgtcttggtctatgtcttgggacctttgctggcattgttaggctgtttttatctagttgtggctaaaactgctggtcagtctgttgccggaatttctggtcagcatatttcccttttatttatgttgaaggtcctattgttctgagattgttatattcttaatgagtaatctacaaacttaagcaaagaagtaattaaaactcaagcaaattttttcctgtaacatggcagggattcaaaatggagtcagtgctgttacaataagatcttctactcaataaagaagcaaaagtactcacagcagagtggggtaagtgaagaaaaataaaattatttcttatttttgttttttgtatgtatccctaaagttcaaactgttcagaaattgttataaagttaactcaaaagaaattcagtaaatgattttgtgttctattgcttcaattatttgaattgattgcatacttttcatgaaccaggttttaaaaattttctgtttctttataaatcacatggaaagtgcacactcagactgtttagtacaaagagcattcaattagaagtccgaaaacaagtgggtgaactctaatgcagtgtttaagacgatgtctggtctttgatatcattaaacttccctcagtctaagtttctatatcttaaaaaataaagatatttagtgtagtaaattttcattgctaacaattcaaaattatttatttacctaacatatctaataatgctgaataaataacactaagcaattataaaactaaaaatcgattttaaatatgtggtttcattaattttatatatttatgattaaaaattactgtttatgagtattgaaattaaagttaatcatcgaatattttggtaagataatgtttgagtattactttatagttattgaaagaaaacatataaatgtagactttaattcccataaaaggaaaatataaccacatgaacataattgagaaattaatagaatatattttaatgtagtaaaacagtgtaagtcacatcaatgaacagtatgagattacttcaaaataggttgtaaagaatagacataagaatttacatacaaaatagaatggattaatcacagaaggcatatgaaggttttccttgagagaggccacagtttggcattgacaaagatgagtgaaataaagcactacgagtagaaaagcatggaagcttgtaagccaggtgtatgttatgagtatttttaattagtttatttatttatttatttacagtttaagtttagtaacatgggcagttctggttctacctatgctggaaaaatgaacatcagaatttcccctactaccataaacaatgataaaactaaacccgtcatggaaaacaactgttttcaggtcttggacaacaaatattgcaagtctttgattcatttgataagggaaatatataatgggagctccacatgcctgggctttctgccttagaaccaatttcatacaacagcacagaggggtgaaatcctaacagattggcaattccactggcataaaaagcatgtggcagagattagtactgtggagattgctcaaatatgcaaatcaggattctgaagagagcaaaaagggagcacactagaatctgcatagaagtctctccaagcatttgtccaagtacatagctgtatatgtacaaaacaaaataaaatgtgatctctggaagaatcagctactgaagaactgtgagttaaatggacattcagaagttcacataattctaggagacacagaagttacaaccattcagtgtttagaaatttcacaaaaagctcactgaagcagttgagacgacaaataggccaaacatctgaagtgacctaatcttgctccagaataagaacaattctaacatgctctaagaatcacaaaacaaaactcctaaaacatcattttgagcagtcagtaaattaattgctttatgaatttaaaaaagaatactttccttagaaggacaacataatttaaagtctcatcaatgtaaaatttatgatgtcagcataaaacttaaatatatatatatacacacacacacacacacaaagcggcagaagagtctgaagcataaatagaagaaaaaccccatagaaatatatctaaatgttggatttggctgacaatatcttagaagagctattgtaaatatattcagtgatttgaagtaacagatgaacattatattgaaatagatgaaaaacgtcgaggagaaagttggaagtataaaaaaatgaaaattatagaacttgaaaattcccagtattttttagaaaattatcagataggcataaaaagtagatgggatactttagaagaaaacatctgtaaactagaagatgggtcaatagaaaatgttaaaactgaagcacagatggggaaaaagaaaaatgaataagacctcatgttcagtagtccaacaaaaaatatttcatacatatatgtaaaagtcatcccagaaagaaaaaagaggggaaaggggttgtgcattgtttcaacagacttggataaagctaagaattaaatagttactaccatttttattatcatttatcctgagtcagcagccactgaatatatggcttgaatattgtattagtatgtgtgaaagatgtttcacattatgttttgaaagtattgcatttctgtatgtttgtcttatgcaagttttgtactacagttaggataatatttgtatgaaaatatagagaagatatgtagtgttttattacctacttgttaaatattacaagtgacaagaaaataacacacataagttattctatataatctataaatattacaagagacaagagtgacaagaagcataagttattctatataatctatattctctatttttataatatttatatattatatacctagatttctatatatagatgtctatacttatatacatatatctataaatctatcttgctgtatatctatataatttataagcacatataatctactctgattatattttaggattttgtatacaatttaaagtatttttagggtcatttttaattatgaacattttaacaatttgattcagcaattccacatctaaatatttacccaaaataattgaaatcaaggttttgaagaagtattagtattcctatacatattgcagtactatttataatggccaagatatggaaacaaactaaatgtccactggtagatgagtagataaaaatagtgtgatatatgcatataagagagtatgactcagccttaaaacagaagaaaattctgcagtatgtgacaatgtgaatgaactttataagcattactccaagggaataggccagacacagaaagaatcataatgcctaattgcccttatatgaggtatttaaaatagccaaatttatataatcaaagattggaatggtgattgccaggggctgggagaaaaggtaaatgaggagttaataatcaatgggcataaagtttcagtaaagcaagatgaataagctctagaggtctataaaatgttgtacctatagtcaacaataatgcattatacagttaaaaatctgttaacaggacacatttcatgttaaatgttcttaccacaataacataacatttttaacacagaagtatttttaagccaaaattgtatcatcatgattggtaatttcttggtagtttgtactgtagttttgcatacctctagtcatagttcattccttttttttttttaatgtattctgcttgctcgtgttggaatacaggctctaccacgtactactaacatgaccttggctaaattatttaatttctctaagcctcaattcccttttatatgaaattggaataataatatgtaatttataggattatatggaggattacataagaaaattaatgtaaaactgcttagcctaatgtccagtataaaatattatatatataaaacttcattaactaaattctaaagtattttcacaaaattctaactttaaaaatacattaaaagtcatttattcataatcattagcattaatttagatgtttgttaatcatctcttcttaaataccttggggatattgtatgaacatttgaaaatcctcagcttttggttaaaaactaaatgcttgtcccaccaccaccaccaccaccaccaccaccacacacacacacacacacacacacacactctctcacatacacacaatgtgacatgtcacattcacatggcaacatgaatgaactttaagaacattactctaaggaaataagccagacacaaaaagaatattaatgcataattgcccttatatgaggtatctaaaatagccacatttaaaggatcaaagattggaatggtgattgccagttactgggagaaaagagaaatgaggagttactaatcaatgggcataaaggttcagtacacacaaccattcgatctttaccctcaagccttctgttgcatctgtgttttacaaaatccacagtattacagtcaggagattatttttctgtgatctctcttgatactacaacaattatttattgacattcctgattgacttgctattatatatatatatatctctatatatacacacacaattgtgtatatatatacacaattgtatatatatacacacatatatatacatatgtattatatataaatatattttatatatacatatattatgtatacacatattttatatatacatatatattatatatacatatattttatatatacatatattgtgtgtgtatatatacgtgtgtgtgtgtatatatatatatatatacacacacacacaattaatatagtatgactgaaaaatatcgtttcctggagatcctagaattgtcaagcctgatagtcaacaaggttacctaggcttttccctgaaaccagtgataatgtcgaaagttttctctttctctcaatttgtatccatctaataacgttttcttaatgaggttattgaacatagacatttatagataacttcagagtaaatgtgaggaaacatttataagggagagcctttataagatttgagtgttggcatcctctcggctttgtttactgctatttccttggtaatatacagaatacttttaatctaagaaagatgaataaatattaactacgaaaaagaatttgcagaattgttgattgtacggctacctgctcctgactttctttttccttcaacttatcctctttcatggttgaaacacagatggccttagatatttatacataaagggatactgcatgtcttttagcttcataaatctaattcctccattgagtgggaagatcaagttcattagtgtttaattctattaatgaatttatgtttttaagttttatgctctgccaacatataggtaacttatatttattaaatcaagcagagattggcatgagttgtgtaaaattactaaaatgggtactgtagaatcacaaagaagggtgtaagccatgatgattgggcaggtatcatggtgagattttagtatgttatgcttcaaatttccccccaccaaattatatcatgcaatagctttttccatgtttaatccctttaacaccccctaccaccacctttaacaatcaaacaaaccctgaaactgagttgaatatttatctgattatttcagctaaacatccaactctgagtttttatggtctcatcacagataaagcatgttcaatagtttactcatatttcatttttttaattatactttaagttctagggtacaagtgcacaatgtgcagtttgttacatatttatacatgtgccatgttggtgtgctgtacccattaactccttgtttacattaggtataactcctaatgctatccctcctccctaccccaaccccacaacaggccccggtgtgtgatgttccccttcctgtatccatgtgttctcattgttcaattcccacctataagtgagaacatgtggtgtttggttttttgtccttgtgatagtttgctgagaatgatggtttccagcttcatccatgtccctacaaaggacatgaactcattatttttcatggctgcttagtattccatggtgtatatgtgccacattttcttaatccagtttatcattgttggacatttgggttggttccaagtctttgctattgtgaatagtgccacaataaatgcaataaacatacatgtgcatgtgtctttatagcagcatgttttataatcctttgggtatatgcccagtaatgggatggctgggtcaaatgttttttctagttctagatccttgaggaatcgccgcactgtcttccacaatggttgaactagtatacagtcccaccaacagtgtaaaagcattcctacttttccacatcctctccagcacctgttgttcctgactttttaatgatcgccattctaactggtgtgagatggtatctcattgtggttttgatttgcatttctctgatggccagtgatgatgagcattttttcatgcgtctgttggctgcataaatgtcttcttttgagaagtgtctgttcataacctttgcccactttttgatggggttgattctttcttgtaaatttgcttaagttcttcgtagattctggatattagccctttgtcagatgggtagattgcaaaaattttctcccattctgtaggttgcctcttcactctgatggtagtttcttttgctgtgcggaagctctttagtttaattacatctcatttctctgttttggtttttattgccattgcttttggtgttttagtcatgaagtccttgcccatgcctatatcctgaatggtattgcctaggttttcttctagggtttttatggttttaggtctaacattgaagtatttaatccatcttgaattaatttttgtgtaagttgtaaggaagtgatccagtttcagctttctacatatggctagccagttttcccagcaccattcattaaatagggagtcttttccccatttcttgtttttgtcaggtttgtcaaagatcagatagttgtagatgtgtagtattacttccggggggctctattctgttccattggtctatgtctctgttttgatactagtaccatgttgttttggttactgtagccttgtagtatagtttgaatcaggtagcgtgatgcctccagctttgttcttttggcttaggattgacttggcaatgcgggctcttttttggttccgtatgaaatttaaagtagttttttccaattctgtgaagaaagtcatcagtagcttgatggggatggcattgaatctttaaattaccttgggcagtatggccattttgacaatattgattcttcctatccatgagcatgaatgttcttccatttgtttgtgtcctctttaatttcgttaagcagtggtttgtagttctccttgaagaggtccttcacatcccttgtaagttggattcctaggtattttattctctttgaagcaattgtgaatgggagttcactcattatttggctgtctgtttgtctgttatcggtgtagaggaatgcttgtgatttttgcacattgattttgtatcctgagactttgctgaagttgcttatcagcttaaggagattttgggctgagacgatgggtttttctaaatatacaatcatgccatctgcaaacagggacaatttgacttcctcttttcctaattgaatgccctttatttctttctctttcctgattgccctggccagaacttccaatactgtgttgaataggagtggtgagagagggcatccctgtcttgtgccagttttcaaaaggaatgcttccagtttttgcccattcagtatgatattggctgtgggtttgtcataaatagctcttattattttgagatgcatcccatcaatacctagtttattgagagtttttagcatgaagggctgttgaattttgttgacagccttttctgcatctattgagataatcatgtggtttttgtctttggttctgtttatatgctggattacatttattgatttgtgtatgttgaaccagccttgcatcccagggatgaagccaacttgatcgtggtgggtaagcttttagatgtgctgctggatttggtttgccagtatcttattaatgattttggcatcgatgttcatcaggcatattggtctaaaattctctctttttgttgtgtctctgccaggctttggtatcaggatgatgttggcctcataaaatgaattagggaggattccctctttttctattgattggaatagtttcagaaggaatggtaccagctcctccttgtacctctggtagaattcagctgtgaatctgtctgctcctggattttttggttggtaggctattaattattgcctcaatttcagagcctgttatttgtctattcagagattcaacttcttcctggtttagtcttgggagagtgtatgtgtccaggaatttatcaatttattctagattttctagtttatttgcgtagaggtgtttatagtagtctctgatggtagtttgtatttctgtgggtttggtggtgatatcccctttatcttttttttattgcgtctacttgattcttctctcttttcttctttattagtcttgctagtggtctatcaattttgttgatcttttcaaaaaacctgctcctggattcattgcttttttgaagggttttttgtgtctctatctccttcagttctgctctgatcttagttatttcttgccttctgctagcttttgaatgtgtttgctcttgcttctctagttcttttaattgtgatgttagggtgtcaattttagatctttcctgctgtctcttgtgggcatttattgctataaatttccctctacacactgctttaaatgtgtttcagagattctggtatgttgtgtttttgttctcattggtttcaaagaacatatttatttctgccttcatttcgttatgtgcccagtagtcattcaggagtatgttgttcagtttccatgtaattgagcggttttaagtgagtttcttaatcctgagttctagtttgattgcactgtggtctgagagacagtttgttaaaatttctgttcttttacatttgctgaggagggctttacttccaactatgtggtcaattttggaataagtgtgatgtggtgctgagaagaatgtatattctgttgatttggggtggagagttctgtagatatctattaggtctgcttggtgcagagctgagttcaattcctggatatccttgtttactttctgtctcgtgtgtctgtctaatgtgacagtggggtgttaaaatctcccattattaatgtgtgagagtctaagtctctttgtaggtctctgaggacttgctttatgaatctgggtgcttctgtattgggtgcatatatatttcggtagttagctcttcttgttaaattgatccctttaccattatgtaatggccttctttgtgtgttttgatctttgttggtttaaagtctgttttatcagagactagaattgcaacccctgcttttttgttgttgcttttcatttgcttggtagatcttcctctatccctttattttgagcctatgtgtatctctgcatgtgagatgggtctcctgaatatggcacattgattggtcttgactctttatccaatttgccaatctgtgtcttttaattggagcatttagcccatttacatttaagtttaatatggctatgtgtgaatttgatcctgtcattatgatgttagctggttattttgctcattagttgcagtttcttcctagcattgatggtctttacaatttggcatgttttcacagtggctggtaccagttgttcctttccatgtttagtgcttccttcaggagctcttgtaaggcaggcccagtggtgacaaaatctctcagcatttgtttgtctgtaaagaattttatttctccttcacttatgaagcttagtttggctggttatgaaattctgggttgaaaattcttttctttaagaatgttgaatattggcccccactcttttctggcttgtagagtttctgccgagagatctgctgttagtctgaattgcttcccttcattggtgacccgacctttctctctggctgcccttaacattttttccttcatttcaactttggtgaatctgataattatttgtcttggagttgctcttctcgaggagtatctttgtggcgttctctgtatttcctgaatttgaatgttggcctgcctcgctaggttggcgaagttctcctggaaatcctgaagagtgttttccaacttggttccattatctccgtcactttcaagtacaccagtcagacgtagatttggtcttttcacatagtcccgtatttcttggaggctttatttgtttctttttactcttttttctctaaacttctcttctcgcttcatttcattcatttgatcttcaatcactgataccctttcttctacttgatcaaattggctgctgaagctcgtgcatgcatcatgtagttcttgtgccgtggttttcagctccatcaggtcatttaaggacttctctacactgtttattctagttagccattcatcttatcttttttcaaggtttttagctttgcgatgggttcaaacatcctcctttagcttggagaagtttgttattaccaatcgtctgaagccgtcttctctcaactcatcaatgtcattctccatccagctttattccgttgctggtgaggagctgcattcttttggaggagaagaggtgctgtgatttttagaattttcagcttttctgcctgggtttctccccatctttgtggttttatctacctttggtctttgatggtgacgtacagatgggattttagtgtagatgtcctttctgtttgttagttttccttcttacagtcagcaccctcagctacaggtctgttggagtttgctggaggtacactgcagaccctgtttgcctggatatcaccagcagaggctgcagaacagcaaatattgcagaatgacaaatgttgctgtctgatccttcttctggaagctttgtctcataggggcacccagctgtatgaggtgtcagttggcccttactgggaggtgtctcccagttaggctacttgggggtcagggacccacttgaggaggcagtctgtccgttctcagatctcaaactccatgctgggagaagcactactctcttcaaagctgtcagacagggatgtttaagtctgcagaagtttctgctgccttttgttcagctatgccctgcctccagaggtggagtctacagaggcaggcaggcctccttgagctgcggtgggctccacccagtttgagcttcctggccactttgtttacctactcaagcttcagaaatggtggatgaccctcccccagcctcgctgtcaccttgcagttggatctcagactgctgtgctagcagtgagtgagcctccatggctgtgggaccctctgagacaagcacaggatataatctcctggtgtgccatttgctaaggctgttggaaaagcacagtattagtgtgggagtctcctgattttccaggtaccgtctgtcatggcttccctttgctaggaaagggaattcctggatcccttgtgctttctgggtgaggccatgccccaccctgctccttgggctgcacccactgtctgacaagccccagtgagataaacccagtacctcagttggaaatgcagaaatcacttgtcttctgcgttgctcatgctgggagctacagagctacagacaggagctctttctattcggcaatcttggaacctctccagtatttcattttgtgtagaaatactgataggtatactgcatagctaccttttttattccacattattgtttacattgtttacctctattctgtaaaaattctttaagaggaatatatttaagtaagatttttaaattcctcttttaacagtagaacaaaaatctttgctttatctctaacagcagttatttttcacttgctttaacgttttattcaacattttgaaggtagctgagcccttagaattaaatatttttacttgttttctcccatgttttgtaaataatccaccatgaaatttgagtaacaatttttaactaaacatatttgacttcttttccttacttaatgctaatgtctacttagcaaaatgtctacataccagcgtatcagagtatagattgaatccacactatggttttacctataatagcctctggatttgttcttaaaatatacttattattagctgcttttgtcttaatccttgagtttgcaaaatcaatatgtgcccatattaacataacagggcttacatcagtcaatgaaatttgaatctttaatagaacctgctttatcttctatctcttaccaaccaacccttacacataatatcagaaaatacaatgaataaatgtataggtgataaattcttccccctttaaaactcctctacaatgttttctgagaattaggaagactgtacaagttaaaaagacagtgcaattgtgtattcttaagaagctgtgtgagtatgcatttagcaattctctcaatagcaatttcctaatctgaccttatccatttgtgatctatttttatatttagatataatttgaaaaataaaagttcgcatccttgctatagagataagcaagtatttttttgatgatgaaataaacataagattacgctagcaatttcactcaaaattgacagatgagatgatatatgctatatatgatatgtgatataagcaatacatgtgtacatacctaatattgcatatgaaaaacactggaatatgatatacttttgggaaattgtatgttttctgccgataccaaatttaagtaccagtgatggatatcacacttttctcttgtttttctttattagaatatcagtattcattccttattcatttgtgtgtcatcggcatttactgcacaggcttaacctaaacattaataaaaagaatcaatatttattaaacattttatagagtgtggatcaagtatcaactctgaaaatgatttactatatgtacaatttaaggaaactactttatttttatatcaaacttattatcaaaaagatagcaataataatagaacctctatcaaaccgttgtatgagaatttagagaaatgacctaagtgaattagtgagcagagattttggcatacagaaattcctcaatattacaccggctattctgtaccagacataatactaggaactttaggtttaccatgttatttaaccctacaacaattctctgcaaggtaaataaacaaagtaaatttatatcaaataagatatagcgccagtaattaacttcagagaaggctgacccaaagcctacactgtaatatttctatttcatccttgcttagtgtttaacagataaatgattaaatatatatagtcataggattccttatgaagaaaatctagaatccatgtgtaccaacaccacacatttatttaatgttcattgcttgttaagtaaagagataagtgagggaaatgcaattataattcactttggaaggtttgagacatatatatacacacaacacacacacacgtcttatatatatatatacacacacacacacacatatacacacacacacttttaacaaaatttttttgtattttttactctaaaggttgacaaatgaaagcagcctataaattagaatccatacccaacactttgataagcttttaattacttattcaggaagtgctactatatagagtatcaggtgaagtagagatcttgctagactatgaagatataaattgacttagtacgctctagaaaataagttaaaataatacatgcattggaacggaatgggacatatcaggcagaagtaaacctagcatgcttgaaatgaaaaggctaagattaatttggtttaacagattctttatgtggaaagtagttggaaaaatgttaagtccagacgatgatcattttggaccaggctttcactgtcaaaatagggagattattttatatacgatatgataaacataaaggttttacagagttacatggcatcaagaaaactagatatagatagacagatctgcaaagattaggaatattgggaggaaaaaaattggagtctgtaggatcacttaagtaactactggaaaaataaaagcgctgtgatatactgatacacactttatagataaaagatttggtatgggttttagataatcttgcacttagtaaattgataccaaaaatatagacataaaagtgaaaacttaaaaaagttatttcttaaccctaaggttgattaaaattataattgtttatgttaagtataaggaaaaatttaacatcatttgaaaaacacattttcttattaaaggtatatgcattataaaacatttttctagttttttattaaagttttccagaaattcaaggaattctgaccaatctaaataatcagtgactgatagaaggttatttatatttagtttattcgctaatcatttttatctagcatttatttgattggacaaacaaaaagacttctgcttcatcacctcatggctaccttcttccttttcagttttgtaaaaagccattttagctaattcaagcaattcataaaactgcgttttccctatgacaagcaaataattcatctgggactatgaattatttttgcttcttcactttctatagaaaactgtccatcccaataataaatactaataaaatgatactagctagtattttgtttattcctcattatgtaccaggcatgttttaagcactttacatatatcaattaatttactccttctaacaaatataatgcatagataacaattttccaaatttccacatgtgaaaattgaattacggagtcatttcattttgtttccagtgtgtctgttgccagctcaacagcttaaatttggcccttctgtaccaatgggagtcatgtttctttagatggcaggttcataattccattctttgactctgagttcactgaaaacatctaattagaagaagaataaagctttttctttgactattaggtttataggctgctttcatttgtcaacctttagagtaaaaagtagaaaaaaattttggtaaaagtgtgagaaaaagaagcttcacaagtaaaatccaattacaggaaacagtgtttacttttggtttgcattttgctatatattttgacattctattttaaaatgagcatatataaaatagagagaatattataattaacccccatatatctgatttgataggaaatttaacattttgccatatttaattaattttttgctgaagttttataatgcatagctctgatattatggcattttacaccaaaattcttcattttgtctcggcaagagtacaggtatattcttatacaatcaaaatatcattatcaactgtaacaaaattagcaacagcaatttaataatctcatctaatatacagcccatcttcaagattattttctgattttctttcacatatatgaaagtacttttttatcatcactatattttaattaaagtacacatagggcattagacattatgtctcttaaatcttttaattttgaatatcacctatttttatgccattaactggcttacttgtcttacagaatttcctgcattctaacttatcttgttgccttcttattgtttagcatgttcctctgccccctgtgtataccataaactgaaaattcattttccatttgtcattgcagaaaaaaaaggaaaaaaattgcatatggtttacttcatgtttcagcaggtaggtgtataaaatgcctggttgtcccatgattagtgaagttaattttgttagtggtttcaggtggtagaatatgagtcctggctggtaaagatgctttttccctatgaccagcaaatcatcggcaggtgaaatttggcaagctctgggagttattttctcataaatattttatgtaagttttttttaagtactcatttatgttctttatgttcttttcttgaatcaattatttctttagtgtttgctaaatggtgactgtaccgattttgcttttccttctgcattcattagttcataatattctacaaataaagacttgctctaatcagaagatatggcttaaaaaccataaccatgaaggtaaattaagcaagcaactgcaaatataaatatatgtaatagttacatatatatatatatacacacacatatatatatacacacacacatatatatagacatttcagagtaaaaaaaaagacctatttagcattacttaccatttcctcaacttattccttaaatgatctaaatttagtgcatgttctttgcataataccatttgtgcatatatatgtacataatcacaagaaaattcaaacgactatatattcataaaagttattaggtgtacatatatatttgcaagtcaggcagagtaagtgttgagacaagaatgatctgattaatattattataaggatccatcaaaatgcttcataccttcaaataattatgtattaaattcacactgtgatgaattatctccagggaatatatttatgattttaagaggcatctgttacaaattagaaaggaaaaaataacattctgaagccagctttttatcaaaatcattttgacagctccaggcttcctacagattgaattcacctgaaaggcaacaaataacgtttatgtcaactgtaaggaaataatcagtgtgaggcttggaattgttagaaggaaatatcatttttggtacataattttattatatcaaagcatgcaaaactttcttatacataagaaaaattaagatgttattgaaaggtggtaatattaaagatatatttgtatagttgagatattacattttgtttcactcaaagttttttatcttcagtaaattatgactatcaaaaatcaatagttttattttaaaaacatataatattggtttgccttatataagtttaccccattaataaagaattatacatatctttacttaagacttcaaatttactttaaaaaattatataaaaattgagccatttattttataaaattgagctatcagacttacaaatcttttaactaactatctgacttaagaaagaaaacctaatcactattaactagacattcattatctaaaaaacaaagtgttacacattctacaaaagtaaatacgccaggacagtaaaagtattcaatttataaaagatagagcgaatacgcatatacatacgacaaaaaaaagtatgtgaacaatgcatattataatccaaatatctggaagataaacagaaacaaactaaagcaacatttcttattgttggagtggagtgggttattaaggattagcttgaggccagttgcggtggctcacgtctgtaatcccagcactttaggaggccgaggcaggcagacacgaggtcaggagattgagaccatcctggctaacatggtgaaaccccgtctctactaaaaatacaaaaaattagccaggcgtggtggcagacgcctgtagtcccagctactcgggaggctgaggcaggagaatggcgtgaacccgagaggcggagcttgcagtgagccgagattgcgccattgcactccagcctgggcaagaaagcaagactctgtcttaaaaaaaaaaaaaaaaaaaaaaaagaaaaaagaaaagagaagaaaagcttgaatgatcaagcagtaatcgattagtttttgatatatcagtataagtttatgttaagatacatgcacatggatacattaaaaatatctatagatatgtgtatatacacaggttagtaatacacatgtatattttcttgtgtagaaatcctagaaggaattacagcccaggagcatagtacttttctttctaatatcgttctccaatgaacggtaccagggctttttagataagtggcttattttagcacaatgacgaggtatgtatgatatgagcctggggtatcttttagtgccagaacgtaagacaatattaaaattaaaaagtccaaaggaacaaagaaaccagtgaaagagctgaggatgagcaaggctggaaaattcaacaaaaaataaacagagtggtattggattataataactcaatgtaaactttatgaatctactgaaaaaaactaaatatgaaaaaaacacaaatatcttgtaccaaagaatattaagtaattgatggcagacagctcttaatttcccactcactaaaagtttcctgcacatattaacttcttgcagagtactgtatagaaagtgggagaggaaagaataactaagtaaagagctaatgaactcaggtaatcaagatgaaaactcatagtggtaagtcttgttagtcacgttgattgtgtgtaccattaatgtgatttgatgagaaagacattttacctctgtggccttcttccccaaattacataaccccagtttaatcattagacaagcatcaggttaatctcatttgagtgaaatctacaaaatacctatccagtattttctcctcattaaattgaaaaataataaaaaataggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcacctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaataaataaataaaaaaaaataaaaaataaagtcttagaaactgccacagctatgaggagcctaaagagacgtaatgactaaatgtaatttggtatcatgattggaatcatggcacagcaaaaatacattataaaataaataaatatggcagatagtcaatgggatactattgaagcatgaaaaaaaatgaaatcctgtgatttgagacagtgtgaatgaatgtgaagggttattaggttaagtcaaagaagtcaggcacacaaagacaagtacagcatgatctcattcatttggcatctttgaaaaagctgatctcatagacttacagagtagaatagtggttacaagaggctgggggagggtagaaggaaaaagaggttgaagagagattggtcaatgactagaaaatcgtaggtagataggagaataagttttgatgttctatagaatagcaaggtgaccatagcttaaaatattgcattgtgtacttccaaataactgtaagagaggactttatttatttatttatttattattttattattattatactttcagttttagggtacatgtgcacaacgtgcaggtttgttacatatgtatacatgtgccatgttggtgtgctgcacccattaacttgtcatttagcaataggtatatctcctaaagctatccctctcccctcccccaaccccacaacagtccccagagtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatggtgccacaataaacatagagaaatgcaaatcaaaaccccaatgagataccatctcacaccagttagaatggcaatcatttaaaaagtcaggaaacaacaggtgctggagaggatgtggagaaataggaacacttttacactgttggtgggactgtaaactagttcaatcattatggaagtcagtgtggcgattcctcaggaatctagaactagaaataccatttgacccagccatcccattactgggtgtatacccaaaggattatacatcatgctgctataaagagaggactttaaatggtctcaacacagagaaacaatatatatatatattttttttgagatggagtttcactcttgttgcccaggctggagtgcaatggcgtgatctaggcttactgcaacctccacctcctgggttcaagcaattatcctgcctcagcctcccgagtagctgggatcacaggctcccgccaccatgccaggctattttttgtgtttttagtagagacagggtttcaccatgtttaccatgctagtctcaagctccttacctggtgatccacacacctcagcctcccaaagtgctgggattacaggtgtgagccaccatgcctggccaaagaaataataaatattttaggtgatgagtatgctgaatactctgatttgatcattccacaatatatacatgcatcaaaacatcacactgtatcccacaaataggtacaatgattacgtgttaaataaaacacaatagaactacaaaaggaaagaaataatggctttaatgaatagtaatatatcaatattggttcattaactgtgataaatataccatactcatataaatccttaataacatgggaaattgagtgtgggataataccaactctccatactatcttcataaactttctatgaatctaaaactattctgtaattaaaaagtatattttaaaaagtttatggacttaaatgtaatgtagagtacttgtttagatcctgaaaaaaaaagaataagtaatatagctaatactatacctactttaattttataattttgtcaaatgtgctatggttatgtaagttgttaacattaggggaagcatggaaaagacatcttttttttttactaccattaattttttttattactctataattgtttcaaaataaaaagtatattaagaaatataaattatcttaaaagttatccttataagttcacagttttttagagaaacacacacacacacacacacacacacaatcccctgttgtgtgtcgtaggcctagcctaatcctgtgaagaatggacctggtatgtaaaacatgtcctgtgtcctagaattagacaaccctcacctaaccttggcttctgctctggcccagcctctcctaacctctctgcaccaccttttcccgtttagactaatttccaatcttccagaaggaaatgatcaagtcatagagcaacccagttaaaactaagtttcccatgaaacattttcaaggtggagagggtttcaagaggacactatggccaaaaagtcagctctcattggcaaaaatgatgtagttcaataggctgtgcactccaagtagttactctccaaggtaataaaaacaacaaaaagtattcctggtgtgcagacctggagcttctggtgtcttatccctaagattgctcatgtacctgagaattcagtgcaggaatgagggccttaaattgaaatatacaaaaatacaaaactacaatggttatattaaggaaaaaaattcaaatgaacaagatacatcatttgcacacagctagtgtacagttggcatcccgaagaaagtgagactcaaggtgcagtatccaagggagtgaataaacaaaatcacattgatcagaatggggtaggggtggaggtagtcaatcataggagcagcagatctgcagctgtttcccaaccatcgctttcaccttcatcactattcattgtttgggacagttcccaacaccctatcccaagagtgagtatgaggatacaagatgtgaaaacaaaacaaaacactgctttactcctaagagattttctcccgcataacgtagtggcttggatacataaatctcgtcctacacccaatcctttcattctagcataggaattattattataccttcatgtaaaggaaaatgactttcctgtccaggccattttcaaaagctgagaattctggggatggggcctctgataaagcataaaggttctccgctgatttcttcccaaaagcgctcactgtatttggacagaacatggttggagttcctttgcttcacgtgttcccctgatcaagggggaagaagaggggatgctgtgaaccacagcccgagatccatgacagtgacacctagccccagtccaccctattaccactctctccactcttcctgctgcttgaaaattcctggtagcaaaagaagagcctccacccatagtggctcaattctgggcctcagggaacagggcacagctgtgtgtatcttcctcttcctccccaaaataggctggctttccctgtgtgctaggggcttgctgggccttcagcagatatgaggcaacggtatgactgatgctctgcacagtggtgcttcttgggctgatgtggcagctggcattccttggcatgatggtttagatctccactcttgtgccacctgcctgcctcttttttttgttttgttttgttttgttttttttgagatggagtctcactctgttgcccaggctggagcgcagtggcatgatctcggctcactgcaacctccgcctcccgggttcaacagattctcctgcctcagcctcccaagtagctgggattacaggtgaatgccaccacgcccagctaattttttgtattttcagtagagatgggttttcaccatgttagctaggatggtctcaatctcctgacctcgtagtctgcctgcctcggcctcccaaagtgctgggacctgcctccttttgatatctgcatttttctcccctttgtctgcctctcattttcaatacagaacatcccactaggtctggtgacacagatagatttcagacccttggtagacttcttacaggtgaagtccactgcctcatcctccttccagctctggaagccctccacgtgcagcttactctggtgcacaatgatgtccactgggagctcaagtgcaactccagagcaggtggtcacggacaggaagctcaacccagtgcacaccttgaacgatttatagatagttttaagatgggaacaagagatggaagtttcttagcttcttcaggatttttgcataattggtttaagagttgtggagatcatccaaaaattaaatgtgcatgcatgtgggtgtgtaggttttctttttgagagagatggaaaagaaggcaaagtaggagacatatttttagaacagatgtggtccaataggtaaaaggagatggggaacacaaaagaaaggatggttcaagatctccactttaagaatcagaatggattcttctgtgtacagcctgtgctgtcaagggatggatatacaaagcaaggactaaaatcctcaacatttcaaaatgtgggggttccagggagacccacaaatgggggttctttgtggtgcctgaagccactgttctgccctgctgcagtgatgatcagtagtgtcatggtagctaaaggagtaaaaagagagtttcatttgctcactgtaagatcactgcaaacctactttcctgtgttgaattgggaagaatgcaatagagctccttgggtggtgtgggtttgatcctgggttcttgtctcccaaatgctgcccccattctagtttttgtatttctctgggcttttagaacatcactgaattggtgattgccagatggcctagtttgtgtaaatataatgtgttggtctttctctatgttctttggggtttatgtttacaaacattttgtattgacagaaacatagccaaagcattcaaagatggttgggtaccagacaaaaatatctgagacattagtttttggggccgccttcttaaagtggagaccttgaaccatcctttcttttgtgttccccatctccttttacctgttggaccacatctgttctaaaaatgtgtctcctactttgccctcttttccatctctctcaataagaaaacctatacacccacatgcatacacatttaatttttggatgatctccacatcttaaaccaattatgcaaaaatcctgaagaagctaggaaacttccatctcttgttcccaaactcctgagtcaagaccattttttgatgtgactcgtgacaaacacttaagatactgctttattttgtttggatccatcctacttaatccttaatcctaaagcagagaaaagtaattgaggacctttcaggaagaagtggggtaaggaggccaagaaagggaatatgaatatgtatccaagtgactcaggaacttttatgcaggtgcaagaaacatgtcaaagtggccacaagattgtttagtaggagacatatggatgtaacgtcttgttgactggtagaaaccaaagatttgtgtgaaactattaatttatggggagagaatgggagggtaggaaagcctatatctctctgttcttttcctgatcctttcccctcattcctgaactgtaggagactgagcccctttggactttggtgacccccatcgctgggtgtgtttatttgatggtttattttgctgtactggaaactttcttattttctaatcattttgtaacacacatgttgactttttcacttctcttctttcctgggaaaatacgatgaataaataaagacttattggaactgggaaaaaaatagaactgagcacaaatacaaaacagattctggaaaactaacaagtatttaatatatttaaagatacttcaatgcatggatcataggagttcctataggtaaaaaaacaaagggacacacaaaaaaatcctaaaaaccgtaacccaagaaaaaaaattaaatagtgttggggctgcatatacaagaagagcacaccactaacttgagaatatcaacccagaatgaccaataccatgagagattccagtaaaattactgtattttaagaaaaaatatcaaaacacttaagcatctagacaaagagtaaatggcatagaaaaggaaagaaatgaaatatcagaaaacatcattataatgctttatagccaaagaagatggtataaaacatttaaagaaatcaaagaaaatatcaaagaaaaaaacgtgagccaaagattttatgaccaacaaaagtaactatcaagtatgatgaccacagacaaattgttatcaacatgcaaaaactgagggaatgttttcatgagcacttcctgagcaatctagcagagcaagcagtagaaaactataattcatgggccaaactgctttgattctgttttttttttttaataaggagttatatttacacagtcatgttcacttattaacacatcctttaatagtgctttcacagtagaatggcatacctgtgtaattgcgagagagaatatatggcctaaaaaaacccttaaatgtatactatctagtccttcatgataacaagttttctgacccatgaatgaataatgaacttctgataagctacaaagaatagtatgtagtggatttgtgttctatcaatgtatataatgtgacttgtaagtggagggggaagaatgaatagagtatatataaaatttattaaaccatatatcatattttatctatacatatatctattgatctatgtatttatttgtccatctatcctatcatcctgattgttcagtttcattggagaactctgactgatacatattaatagtactaatatggctatgcttcaaatactgtatatttcaacatagcaaataattaattatggtatattcgatttccatattctctgtaatcttgagaaccagtactgtcagtgagtaagagaggagacataggtgcaattcagtggtattttagtaaaaatcctgtagttaagagtttggattgaaattatccacatgaatatgaaacatattttatagtgtttgtgtatgcttgtgtgtattatatatttttctatgtgaccactgaaaatgcttaaaaacaatgaataataaagtagcaatgagcatctctagttatctgactgtagtcataaaatgtcatctcttacttaaagaaagcagtgtttcttagaaaaatgactaattccagtattggagcaaaaatttacaagatgaccctggagtatcttgttacatcagatagcaagaaagctatcagtgtttatggggtactatcaaaatgttaaaacaagaaactgaaaagatttctgctgtcaaatatgacatcatttgagctcatcaaatacaataattgcgacaaattacaacatatgtgttcaaatccattagtttataatgattattaaaatattaacaatttcagcattttcaaatatagtgactaaaacaaaatatttatgtggccttttctctgtgaaccataccactagataatcaaaggatagatgaagataagtgatgatttataacatgattcaatatataaatacaaacatataaccgaatattaccaattgtcagcctccaataaatcaatgtatcttgcagtgaatatcaatggctagtgatgtccaaaaaaaaaaaaaaaaggaatagcagatataatgagactccttatgaaataacataacaacaataataatctggccaaagggatgaaaatcaagcttaaattaaactctgagattctgtgacaattttggagaactatgaagaacagaggaacacgctgaaatgcaacaacagaatccagaaactgtggaaaactccattggtcaaaaggaagaggcactttaacagatacatagtaagggggaaattacaagatggagggagaacgtttaaagtaaaatataccatacagatcacaaaacttctagtgtctaggtatacaaattatacaaaaattataataaaattattcaataaggtaaaattataaagaaatgtaagaattgatgattaaacaagataatggttacttgtatgggaaaagaaggatttgatattgggactgaacacaagacaggaatttaatgggggggtgggcaaagttttattccttgaactgggtattggttagaatattgtacacttcataaaaatgtattaaaccatatttttatttatttatttatttatttatttatttatttatttatttatttatttagtgagatggagtatcgctctgtaacccaggctggagtgcaatgtcaggatcttggctcactgcaatctcctcctcctgggtcctggttcaagcaagactcctgcctcaacctcccgagtagctgggattacaggcacgtgccaccaagaccagctaatttttgtatttttagtagagacggggtttcatcatgttggccaggttggtcttggactcctgaccttgtgatccgcccacctcggcctcccaaagtgctgggattacaggcgtaagccacggcacccagccattaaaccatatttttacacgtttttcatgtatctgtgttttatttataacaaatatattgggaccaaagaactcataaccaggtcaatgagtatgtgctataatctcaatttattcaaaattggcttataaacaggagatattttatatttttacataattgtagagatagagatatttactgtcactctatttgagtgctttagttaattctagttcaagttttaaaatttttcatttgcatttataaaattttgaaacataatattcttatctattttctgtaatgtagcataatttctaggtacacttttaatacattggctgagtattaattgattcaacataactgtcatttctgtggaggaactttttgctttgggcttgcctatcattcttaattactttctgaaaatgtccccgtctgccattctctcagtccatatgaataaggaaggtctccagccctggtactgcacttaggacaagtgatccacattatgccaactgaagaaccaaatcctcccatccacagtggattttattgagagaacaccagatgatatggtggttctagtccgtttatatagatctatatcctggccatagcatttatttcaggaataggcctagtaaccattttgtaagcaagccaatcgtgaaaagtgtgtgataatatactaaaatagaactctcttattttgctattggatgtctaggtggatgtaggattgggactgtgggaagaattatgactgggcaaaattatgccttcatttcaaactggagaaaagccacatgttaaggagagagaacggactctgtttcttaacctgtttgacactaggttaagatagaactgtttacattataatttctcacttttcaattacgtaatataatcatctctaatggagttgtattttttgacaaattattagagtcaccatgttgcatttgaacactagcatgtccaaataacaatttgttatgacagttatccttgaatctatttaaacatattaaatatatcagggcatttgataaacaatgtttggtaaaatattttgtcaagcattgtggtaaattaataaaattttacaacattgttgaatttagaatcttacatccttgttcatttatttgaaaaggctttagtattctctactatgtgaagtatgaaatatgcagttctaggtgtgagaaatgtgacccgtgtgagaccaatctaagactgaagggatgtaacaggaagagacataaaggtgaagaaagtaagatctttcatttcaaggaccttatgatcacccacacacacacacacacacacacacacacaccaacagtacatataaacacacacacaatgtcttatgaaaacataagttcataattgttacttgcctaacttcttcattcagctgtatcctatcttaaacttttactgctgtgacaccatgtcttttatttggtttcttagaaggagagcctgagatgaaaattcttgttcaaattatttaaatggttgatctcaacgaggagagtgaatgaagcaggctagaaaacagagagaaaagctaaacaaatgtgagttatcatttgaggactaaaacactgaaacacttggaagttatgaagcaaaatttgtaccacagacatactccctctttaaagcaacagggggaatgtgtatcgtatgtgtcactcagacattggcagagatcagcctgcagaagtgaaattggtttagcctgcaggggataaacataagggtgcaagggccaattctccagagaaacaggaagacatgagttgctatcagccattattttcactcattggcgatgggtgtcacagccaaaatgaatctagcaggggactagtagcatccacctcttcatgtttatcaaagttaatatagttgaaggtatattgcttctctctacctaggctgcctatcaaaccctgccgtgccagagaaagttgggccctgcttaagtgttgtttatacagcactttatgcctctaggatcaattatcacagtaaatataatcactctcttttcttttctttcttctccttcttcttttttttttttttggtaagacacagaacttctctgtctcccaggctacagtgcacgatctcaaccactgcaacctctgcttctcggttcgagagattctcctgtctcaacttgccaggtagctgggattacaggagtgtgccacaatgcccagatagtcttttgtactttagtagagacaggggtttcactatgtttgccaggctggtcccgaactcctgacctcaagtaatctacccgaagtgctaggattacaggtgtgagccaccgtgcccggcctaatcattttcttcgaagtaggtcttcacaagtctgagacttacttgaggataataattaagtctgattaatctttatttcctcagaccaaatgcagtaattaaatgatatattattgtagattacatatatgttgtattttagttttttcaagaagttgataaaatgacaaacacaaaactgaaatttggatatatagcccagttggtataaaatagtgctttagaggtgagtctcttggagtaagtaaactactgttcaaatgtttgacagagaagttcttttaactccctaagcttcaattgcttaattttacatttttacaattagaattttatattaattttataaggatgaaaagtattgccatgatcctgtttcttgaactaattgagaaaatgtatataaaagggattcgtatagtaagtagaatggtaaatattaagtgttgagcatatgctagatattttaatgatgattgtaggaaaaaccatggttgcaagaaaattccaagtatcaaaatctcatgttgatatttcatgctttaagtaattttaaagaatcaacagataaaaagtagcacgttagacctgaatttgatattttctgaatctgttttattagatattcagattcatggcacatgacacaatggatcatgaatattgttgctttatctgaagctagacatatcattcagatctgtatgtattctcattgctgagcatagagtttatcctggcaatgtcaatataacatattcatgtaatcatggaattattctctaaatgggagcttcatgtttagtctcatatggttctatcagtttataaaatatatctcaggagtgacaggaaacatgaaaaagaaagtaccttgcataatgaagacctaactcctgcagcttttttaattaattcagtttctttaattaattatcctttaagactgtgcccgccgtagctatgtttcactctgccagaacactagcaaagatcaccagactgtttctgagacagttttttaaatttttttagaactgaaaaatatgaattcatttaataaattgccccatccaaaattatgccaagaacactttgagatggtgatggctgcaatgcattctttcttctgaaatctttgctaagaaaccacattaataacttaaacctctaattacagatgaaaggcttgtatttcattttgccttttatacctgttttcaaatgttctatttgctttccacaacttcttattcatcaaaatttgggaagctatgaattagaggtttgaggattatgtaattcagaaaaaaactgcctagtttttcattgtcattaaaagctatgaataaattaaaatagtgtaaaaatgtgttggattaatccacatttggttggtttaaagtaacataatacatgtgtatgcatgtctgtctgtgtgtgtgtactttatcacaataatgaatattgctggaaagtgaatgtgctggaatagcttcagagagcttatctccatatattttcttaattggcacattattgtacatatttatgggctacagtgtgagattttcatacgtgtattcaatgggtaatgatcaaataagggtaattagcatatccaccaactcaaacaattattatttatttgtgttggggacattcaaagtcctctcttctagctatttgaaaatacgctataaattattgttaattgtaatcactctacagtactatagaaaactagaaactattgcttctatctagctgtaattttataccccttaaccaaactctccctatcctgccctcaccactacctttcccagcctctagtaagcattattctactctacttccatgagagcaatttatttttgctttcacatacaagtgagaatgtgcagtatttatccttcgatgccaggcttatttcacttatcttaatgtcctccagggttatccatattgccatgaaaggcaggatttcggtttttcttatagcgaaatagcatttcattgtgtgtgtgtgtgtgtgtgtgtgtgtgtatgtatatatatataaaatatttttaatacattcatctattaatggacagttagtttgattccatgttttgagtattatgaatagcacagcaataaacatgagagtgctgatatctatttcacatattgatttcctttcctttggatatatacacagtagatggattggttgatttaatggtagtaccatttttagttttttgaaaaacttttatagtgttttccataatggctatgctaatttacattaccaccaacagtgtataagtgttatctttcttttctccacattctcaccagtatttgtcatttttttctctttttgtaagtagccattgtaatgtgagtgaggtcatatctcattgtggttttgatttgcatttctatcatgattagtgatgtcgattattttttatgcacttgttggacatttgtatgttttcttttcagaaatgtctattcatataatttgctcataagtaaaccaatttatttggtattttgctgttgagttgtttggggttttgtgtattatagatattaatcctttatcagatgaatggtttgtaagtattttctactattctgcaggttttctcttcactctgtggattgtttcctttgctgtgcagaagctttttagtttgatataatgcctcttgtctatttttgctttcattggctgtgtttttttatatcttatccataaattcttcgcccaacccaatgttttgaagtgtttcccgtgttttcttctactagtttcatagttccccatcttacatttaagtctttaatccatttcgagttcatatttgcatatagtgagagaaagcggtctagttttcttattctgcatatggatatccagttttcccagattagtgaagagattgttatttcctcaatgtaagttcttggccccttttttaaaactcagttggctgtaaatatgtagatttgtttctgggttttctattttgtaccatgtttttatgccagtatcatgttgttttgataactatagctttataatatattttgaagtcaggtagtgtgtgtcaccaactttgttctttttacttagaattgctttactcgttgacatattttgtggttccatataaagttcagaattgttttcctatttgtgtaaagaatgtttttgtatttggttagggattgggttgaacctacacattggtgtgcataataggtttactttcatagtactaattcttccaagccataaacaagggatgtctttccatttgattgtgtcctcttcatagtcttccttgtagagatatttcttatcttttggttaaatatatattttaggtatcttttatatttttgtagctattgtgagatttctttcttgattttttttcagctagtttgttattgttgtatagaactgctactaatttttgtatgttgatttttgcatcatgtaactttacagaatttgtttatcagttcttagagtttttttggtggaatctttaggcttttctctgtataaaattatgtcatctgtgaacaggaacaatttcacttcctcctttctaacttggatggcttttatttctttcacttgcctaattgctgtggtaaagacttccagttctgtgttcaataacagtggtgaaagtgggcatcaaagtgagcgtgcttgtcttgtttcaggtcttaaaggaaaagctttcaacttttccttaatcagtataatgttggcagtgggtttgtcacatatggcctttattgggttgagatacattcctcatatatctaatatgttgagaatttttatcatgaagtgatgttgacatttatcaaatgtttttttctgcgtctattgagataatcacatcttttgtcctttattcccctgatgtagtgtatcacatttatcagtttacatatattgaacgattcttgcatccttggaataaatcctactttatcatggtatataatatttttgatgtgttgttgcattctgtttgctagtatttttctagaacttttacatctatgtttatcaatgatattggcttatagttttctacatttttgttgtattttttatcaggttttagcacatgggtaatgctggacttgtagaatgagtttggaagaatttcctacccttcaattttttggtataatttgagaaaaattagtgttagttcttttttaaattttggtggaattcagcagtgaagccatccagtcctgggcttttttgttggtgttgttgtttggattttttttaaaaaatgctaagtcaatattgttacttgttattattctatttagagtttctgaaattgaagacaggtgtctttaaatagtaagacaaaaataaaacacaaaaataatagaataaagaatgaagaagtcctatgggacatatgcgacaccattaggtaaacaaatatttacattaagaaatgtccacaagaagaaaaaataggaaaacataatagaaaacttaataaaataacagctgaaaacatcccaaatctttagagagatatggacatcctaacacaggaagctcaaaggtctccaaatagattcagcttatttccattctcttacctgacctgcatgatgcaattaaattaagcactgtaagataaatatcaaaatatgtatttaaagacccaatatttatatgtgggcaaaaataaaatgttgaaatttcactaattttgttttttactcgaaatttcccctcccctttatcagggttcatattataaatccatccttttaaactacatttttcagtacttttttatttcccaggctctgttttaggcagtattttccaggatcattgtaaataagatatacaaaacctctgctattagacgaattatatttttattgcgaagacagaaaataaattataaactggtatgatatcaagtcataattaagtgctttggagaaacatgtagggcaggcaatgtgttgtgagatggtggaaaggctgctttatagagtccacaggactggcctttgtgaagagctaatattttagcaaagattttaaatgatgtgggcagcaatagttgtaggacacataatgtgtataggcttttaggtataaataaacttggtatatcttagatgcacaaaaaatgcctcatgtgcaagaagggagacttagggagaaagagcctcaaggagaggagataagcacaacaaagtgctccccttggctcttactggaaccctattttcattgacgtttttagtagccaagccccaaaaattttataatactctttccatctctttattatccccagcacctacttcattaaaaataaattctgcttctaagtggtttctaaaacttttatataaattaggggcttctatttaattgttccaattacccccaaggcctacatagagatatgagaaatctaaagttattctaggatcaggagacttctctcttgttagaggtttaacatttaataatacataaatcagtgtttctctggacagatcttactaatgagcacaaagttatataaaaacaactctcctttaaaataaaatgtcccaaccatttgactcctaaagtaatatgtgacttctgctgttctcttgcaagagggggaaattattaaatattcttcagggactttctccaagcttatacccgctttcatttttatcttgcaagcttagatgttcatagatagaactttaaaccatattctgtagggtgaagaagagcatttttatccttttatctactttctcattagccagacattagttaatcattgaaaatagagtccttacctgaatatacatgaactagaaaatctttcagggtcctgtcactcagcaatttcttcttgaataagcctcccagggctatgatactaataatgtaagataaatacaaatagaaaaaaaattactcttggaaacaagggaagagacactctctacaatctactcccttttattaaatatttacttcatattctatcacttgttaatgtaagttccttcttagtctctttgaaatgtatgtaaacctttttaagagctaaacaagcctcctgtcagttttaagattcaggaattactttctcaaggacccggggatgatcttttggaaatggaatctttaaggaagatggtactaccactctctgtgccttggtaagagactaacttcagtgggaaccttaccttatgttgcaaagcatcttgtgtcataaagatataagaagtttgtttgttctctggataaagctaattagctaacacacatggtcatcacaattgccaggtaaatctaggatgaactatgtttgacaaatagtgctgtcctttttgctttaggactagctagagtttatcttaaaaacatggatgtaataggttctatctgcttggctatataaaaaggtgagatttttttcttgtatttgcaatcccatagggatctgtctgtgatgtgtatcacattctggcttaatgattattcagcaataatgtgttttctttctctactgccattgtggagaggttttctgggtttcaaagacattttatatttaattacattttccacaaatttcatagactgtagatcctgagccagggatgagatggggagtgggcagtatctgcttgaggctgataaaaggaggatctgaaagatatttataagaaaaaaatatatcaagttggaaagattataagagcataaatttgaaggtgaagatactgggttcaggctttgagaaacaaatcagagatataacaatgagtttcaaatcttgatttaaagatgaaatacagatttcctaatgtgctgttatatgggcaaccattacttagctctgaccaagagtgttaacattgttcagacgttgttggggctttgctggcatcctgcacctgaatacattgaaaaaagcaaaatgctttgtttttctccccctgaaataaagacttttaagcacatttattgttcagaacacctgtgttccaggcatctatttaaggcattctaaattctaaggaaatttctccaaatcatatcttaatcagcaaaagggtgacagaatctagcaaagtctaggaagatcaacaaggacagaaatgaaaaaacagctcaaagaataaatataatttgtggtctaagagcagaaggaatttgttatactatctttatgctccttgctacaaaagtaggcatgggctcccaggtgtatttctgatcgtctgtgtgtgtgtgtgtgtgtgtgtgtgtgtgtgtgtgtgtgtgtgtgaggggagagagagagagagagaaagagagtgagagcttgtttcttttttcagccagtaagaaattaagctatagtagaactcatttataatacagctggcaacagtgatttcttgagatttacaatcaaatgtgcaacagatgtaatttaaatggaagagttaatattatttgtatgtgtgtgtgttgtgtttatatgcgtatgtagtatttatttttttataagtcaaatatggcaaacttgcatttaattcaagctcatgtcagttatttatatatgccctacatactgaagaaacaagtcttgattcttatttctgacatctcactaaataaaaaataatttagaggatttctaatgaatttgattttctcataatgtgaatatcttgtatgtatgtttatcttattttgtgcaaatatgacataatgaagctttatttttttgtaatttataccatggttaatcatagctgaaaggccaaacttaaatttaacacagtgctttaaaatgaaatgcctttccaaatgagttaatgttcatcgttactaattgcactttgaagggcttttacccaaaactacttgtatgatactgcagaaatagttgatgtcagtaaatggcattttaacatataaatttgttgctataatagcaaatcatttacttagaggaatataaaagttttgagaaagtaacttcctatcaataaatgtaacttttgcacatacatttctatcttactaaaaaaaaattttgctaagttttttttaagtagttgacctctttagtttgatatatgaacatttttcaaatgtgggattatttattagcaagcagctgtgtatctgaaacactttaattatataaataatgcagatgatggtcatatttcagttaaatgtcagtttttcattagacaatgtatctactcattgtgagaaagattccataatgaagaaaacaatgctatttgtgaaacgttgctttggttattctggaatatgttaaaaacatgtagcacacaattttgcaggcacttactactcattcatatactaatttattttctttatgaaaataataaatggattttttgtagaagaaaagcacagccttgggtggatggctacatgctccttttgccatcagttccctgcacagaccctgctcgtagaaggcagaagcccccccagccaatagcagcactctcagtatgggacaatgctgtgtgttgttttactcctctatgatatgttaaggaaagcaagttcagaaaaatagaaactatactaacttttaaacaaagatattttaatataggtaattgattaaacatatgaaggaataaaaggtacaaggaacactaaagtagcgtgggtcacccaagagctgaaagaagcaagggaacaaggggaagaagtcagcattactagaatatagatgcttagagaaagggcctttgtgagcctatgtctggggcccagacctctggtgagaggatgctggctagtgctggtactgctaagtggtatgagggtgagggatcagatagttctattaaagcaggcacgatctagagcttggaaccaatggccacttccaaggtcaactgtctttgcaatggcaacactgacaaaaaacgtaaagtgaaaaagaaaggggaacacctttttctcctccttttctcttccagtcagcatctactgcatcctatttcagatgctgacagacagccacaagacaaaggggaaattagcctccaaggttccggctcaccatcccaagcagaatttaaaagggtatgttcagaggtgagaagcattaggctcaatatctgcacactttccttgcatgagattcgatcaccagagggaattccgtgctgcagtctcagtgttacagtttttctgaaactggaaaaaaattcaaactgggctctccaagtcccaaccaatgtcttgggctgtgggcggtcttttggctaaattggaatatccagatccagatggatgagaagctgtgtctgatggtgaagggaattctaaagcagagttgaatgcaccataacagggtatggcagccactggggcaaaggtcagcaacaggctgacagccatcaaaataccaggactgactccacccaataaccccaatgagtttagaagcaaattcattcttataccttacacaaaaaagcagccctgtggaaccttgatcttttaagacctggaacagaaaaagtaggtaaaacacggtgtccagaattctgcccacaaaatctatgacaggggtgtccaatcttttggcttccctcggccacattagaagaaggagaattgtcttaggccagatatacactaacactgatgatagctgatgagctaaaatactttaaaaaaaaaaaaaactcatagtatttcaagaaagtttatgaatttgtgttgagatgttcaaagccatcttgggccacatgcagcttgcaggctgcaggttggacaaacttaatctgtgagataatgaacatgttttaagccattaagtttgaggtgatttttagggtaagcaatagaatatgactgcagagagcaaccaaggatagtatgtttacttaaatcttgaatccctggcttcttctcaccactttgaagaagtttcaagttctaagaagagaaagagaaacctctagtgtagctaacagtagagtggacaccttggaattacaatttgagatgtcccttcgtaacagctgaatgagtcccactctttctctattttcattgtggagcattcccttacccaacagtgagaccacgtgagcaaaatgaagactagtgaccaagtctgttttcttgccacccttaatgggactcttgactctactgtccaacttatgtacactgcaaaaacaaacaaaaaggaggctggggtttgccaggtaactgtgggcttgcttggaattgaagatttggatagctattatctttagagctaaggacggtcttaataaaaaaaaaaaaaaaagttcccctttcagtattttgaaaggtcattatttttggccaagagacagctgtcaaaattattttaaatattcctgggttctttaattaaattgtgattcatggtcattgaataaatgttacactgaatatggatattttatgttcaaacaccgagtgtaagcaagctagttagacacatccatgaactcttactgatgagttctatcactatatttgtagctcattgccaggtacctgctgtacttacaaaacttgtcaagattatacagttgaaacaatatcccataataacagaagaaaaactacttgttcttctcaaaaatatttcatgaaggcaggagctctttgggatgctattccattaacattgaacatcactgatgcttggatcccttctgtggaatatcaaagctaaaatgaaaaattagctcccacttcacaggcaacagctgatgttatcactgtgactaaacagactgctgccatgactggtagctggtatgaagctttggacattcaacactttgtaattttttatgactgttcttccaaaaaaaggccaggatcaatttgcttccatgtggcaaagcttgccgtacatctgtgcactccttttacaaggtatgtgaattattctgcattattttatcaaagggtcagacaagttttagcacagtatgagctactggtatgtgctaaaatatatcttttcatttaagacattctgatggtgcctcccaatgaggaaactgttcatgctggagtgatttaaagttgcctgggccttgagtgagaatacagtttagagccctgatattccaatgtcctctattgtaaagtgaaaatggcgtatcctgttaaggccagcagaggccctcaaatccttagccaattccaagaaagaggtgcgaggaacagacccatgatcaacagaatcagtaccactcactgtattatctgtaccactggtataagaggatctcagctataaaacttgtcaccagataagacagcgtgatttgctgatgaaacaatccacttccagcatggaatatctagtggaatgctacagcaatcccccataaaaacaataaacagctgattgtgtgtagtatcagatattctttataaggggcttaatttcaggtcctgctctgggatatgaagtatgaagagattgattgaaatgtatcttcatctagactcatgggtagttactaataatgtcttagctctatgatgaggccactaggacaccaaggtatagataacaaaatatgtagtgatgtaatgtatgtttaacttatagactctcatatatatataagaataatatatataaaaatatatttcacatgtaccatcagtcagaaagcaaccatttaaagaacaccctctagattgaataagtatgtgtactcaattctattatagcttggtgggtttatgctcaaaatattacagcaaagaaattatcacaaagaactacaaagtctatcctatttgcaacctatcccagcctcggtgaggaagaattctgtaagaactgttttcaactacttataagttacagaccatcattctcattctacctaagcttaattgctgtgtgttagggatgtaaaatcagaaagtctttggaaaataaagtgtatctttcattttattcctttgtagtttgtaactttatccctgatattctcaccttaatatcttggttcctaaaagaatcagtacttttccataatagctgggaaaaaaacaaacaaacagaaacccagatttgctccttaatgccctggtcatatttttctccatcacggagctaccttcattatactctctagcagcccccaacctgtgtgcccaccaaaggaagtataaatactggatagatttggatgttgtcttgaatacaagtgtgggtgagactctttgtgcctctaggacttgttttcctctacagatggcagggactctgctgtttccctgttggacctgaacacttattttctgaagattgctaaaaatccagaaatcattactgacacttcttttcattgtctctggtgtcaacaccacaacttttctgagtgatgaaagcctgatatacacaggctttcatcatgaagcacagatgattatgaagcccaatgagttatctcaaacttatgggacactgtataggaattttctgatcagatagcctaggtctttattgctaagcacagcaaatattactctttgtccaggttgtactgaccctgaactcttgaaggatctctaagaaggggaggataaaatgtctaagtattatactacttttgagtcaataccttagctcaaattgagatctcagagaaatatctgaaggagcaggcagataactccgagtgtgccaattggttttggtgtgatagactttatgttataagctttgtaatcttttgaattttgctgcatcttctttagctctgcaagcaggcattgaaggcccaattaaagtctaaatgattatgatgttagactgggaactgtacatctaataagactctatgggccagtgatagagtggagggagaagagaaaagcctttggatgaatggcccttcctgtccacttttctgttccatgtcgtctggcacagtgctgtttagttgcactgaactggttctcagagtaatatccagacatctacctgatattggcaaggttcatatgaaatctccctggcagagctctgtatttgtttcctaggactgagttttcttgtcatgttccttgttgcaaataatataaagttactttaccctattttgggatagcatacacctataacaagctatgtgagggaagagtattctgtcatgggattctcttcttgataatttgctggaccaaccagatgtttaaatggaaaaactgtgcaaagttaaaggggcttgtgtgttctggttcaactctgcttctccatcattatcaataaatcttttaacactttctcgttaagggcttgggtcactgtgcactctggataacaatatgcagaatccctgtgcttattgaggaaggacatggcagtatgttcttacccttccatttagagtatgaatcctttgaatactaaaatagatttctatatctcatataacccagaaatatccaggcacatactattcacagaagatattcctggattaaaattctaaattcatatcatttatttaaaatttcaaaaattagatcttatcttttcaacttgatcatgtgcccttttaaaggagaggtgtaatttacatgtttctaatatccttgaagtacctacctcaacttttaaatatagcggataataaatgtgtgttggtttatagtttcacaaatttacctgttttgggggcatagtcattgcatgaatagtcaaattttgatagttttatttttctgagtaatgtatttatttggagatatataatatatgtgcatgatcaaagaaacagcatatatattgaaagtgaaatgttagagttctctcttattactcattcagagtccctttatcctcctctattatgattctttctgcatgtatacagagatattccagaataaactaaatattctacctattaatataatttttgcccaatagcagcacataagattactactctgcttttttccccactaactgatattgatacatttccttcattccataaaagtatataaagttgcttcattttgtttttactatatgtttttaatagttacactctgtctcccaggctggagtgcaacggcacaatcttggctcactgcaacctccacctcctgggttcaaacaattctcctgcctcaggcttcccaagtagctaggattacaggcatgtgccagcacacccggctaatttttgtatttttactagagacaggctttcactatgttggcctggctggtctcgaacccttgacctcaggtgatctgcccgcctcggctttccaaaatgctaggattacaggtgtgagccactgggcctggcttattttgttaattttgcgtgtgtgtatatatgtatagatacaagtgaattaagtgaataaaatcccaactcccaacagactagcaatctttttttttttttttttttttgagacagagtctcactctgttacccaggctggagtgcagtggcgagatctcagttcactgcacactgcaacctccgcctccctggttcaagtgattctcctgtctcagcctcccgagtagctgggactacaggcacatggcaccaagcctggctaattttttgtatttttagtagagatgaggtttcactgtgttagccaggatgatctcaatctcctgacctcgttatccacctgcatcggcctcccaaagtgctgggattacagctgtgagccaacacgcccggcccagactagcaatcttattaggagagacagtcacttaataaatatatagtaacaaatatataacatattttattgtaataggtgatattaaacacttattcagcatccacaacaaaaccagaaagccaaggagattgttacagataagggtaaaagtagatatactgtttactagcagaggactactgaaggcctcatcgaggtccagtagagatctgaaaggaaggatctgcagttatccagttgcattacatcccaaagagtgggaaaagagggtacaaagagatgcaaatgttcaacttgcagcaaggaggggagaacaactggggtacaatgaaagagaaggtctgggagatcaggtctaacaatgtactggaatcagatcagttaagctttttaggctgttttattacattggttttacactgaggaataagagaagtgatagagtcatgagcagattgacacgaatgaaatattttgacctgacttacaaaataacaggaacactatgagtcttgttttaaaaatagacaatgtaagagtgagggcaacagcagcaagagtaggtaggagaaaatttcagaaatccagatgagaaatagtgtctgggtaagtgatggtgtcaatagatacggagaactgatcataatctgtttatattttgcagtcaaagtctacagaagataatgatggactggatgtactatgtgagacaaaaaaaaaaaaaagagtcaatgaaaagtccaggatttctggctggagtaactgggaggatgaggctgtaagggagataataagctctgttggggtctctggaagggctattagttgctgatataaacaagatattatggtgaatacttagtgtcaacttgatggattgaaggatgcaaagtattgatcctgggtgtgtctctgagggagctgccaaagtagattagcatttgagtcagtgggctgcgaaaggcagactcatccctaagctgggtgggttcaatctaatcacttgccagcacagccagaatataaagcaggtagaaaaacgtgcaaaggctacactggcatagctgcccagcctgcatctttaatacaggcctacctacaattatagataaaattacagctgatcatattttgaattctatagttaagaggaagcaagtactatagatattagagaagtattgtttcctgaagattcaagtacaaagatggcttactttttatcctcccttcaacatgtcattttcacatcttggcattatgcaaggaaatgctcatcttttctatctgaataatagcagttctgatttacttccttaatctgccacggtcttatagcacctgagatatttttaaaagttacagaaagtatctgttcacttggaacaatagacattgggcaccggggggtactagcatggggaggagagtgagagttgaaaatctatctgtggggtgctatgctcactacgtgggtgacaggatcattcatacaacaaacctcaacgactcacaatccacccatgtaacaaatatgcacatgcgctccctgaatctaaaataaaagttgagaagaaaaaaaatacacctgtttcacatgaagacttttctttttatgaatgtccgtcaactaacgtatcttttagggtgactacatatcaaaagtcaatttaataattgccataaaattgtcattacccaaactttttgacatcattaattttaattgtcattacccaaatgttttgacatcattaatgttactccttttattattccttttgaaatattctgacttaactcccttgcagtgaccatgtatttgcctaacacatgtacatatggacatgtgcgtatccatgcatgcatgcacacacagacaccttttgttacccataccacccttctccagttctaacatgctgttcctttgtgataagaaccttgttcctttctagcaaatcatactgtataatttcctattgctactttaatacattaataactacttagaggcttaaaacactttttttatttttaacacatatttatgacctcacaatatcatagttcataggtttgtgttggctcagctagtttctctgctcaaagttttacaggcagaaatcagtgtcaacagactgtgtcatcaagagactccagaaagaatctgattccaaagtcagtccagttttcaaaaaaatccagttccttgagggaagaagacttacagtcaccatttccttattggctgtcagctgggggctgtcttctgctcttacaagcccctttctaattcttacatgtggtccctttaaactcaaaatctgtccaacgttcctgctctcttctgcttccagctggagaaagttgtttgcttttaagggtacatgtgattagattgctcccgtctgaataatataaactaatctcaggttctaaggtaagaccagtgacctcagttgtattttcaaagtctattttgccacgagatataaacattcaaaggtttcagggattagagtgtggaaatctttggggaaccgttttccctatcacacatacatgcctccatctactcatatctgttttcagacttatctttcacacttcatgtttgatttgcaatttctttactttcttcatcaacatcactatcatatccatccttagtaacttgagtctagctaatttttgagccactgacttgtagacataattttccctttcccagttttcatgttcttagcctcttctctatttccacattgctctaccttagaaattgtattgacaatggaaggtcctatttcaacttagtaaatcttgtgtcttcaaaatacatagcaaaaatcagaatccacatcctcctataaccacctatgtgtcgaaggcagcagatttaactccgtctttgatttatttatgagaaaccgtgttgtaaatgctttctaactatgtacactatactgccatcattttaagttagtaatcctgcagatagctctttgacaaacatttccattaaattggataacataattataatcagtctttacccaactgtaaatcaaataaattcatttttattttactgctttatgaaggtgatttacagaaacttgcagaatgcggcaccagatccgcaggacttagagcctgaggattgtataactgggttgttctttagagtataggagaccttgaggcaaatagtggttacctccaagctattattaaggcttcccacagaggtcactgtgagaactatatcagaaatactcattaagaacaatgtacaacctaacaattactaagaccgttttcaatatctacatcatcccattgtgagaaaccctaaatccaaattctctgcagcttgaatatattaaaatagaaatgaatattttttcagttaccataacctatactttaaactttagtcaataaaaaaagtaacatgaacatggtataaccactttactatatatataactatatattacatatatagttatatatatatatgtatttttaaaaaaattattatactttaagttctgggatacatgtgcagaacgtgcaggatttttacattgatatacacgtgccatggtggtttgctgcacccatcaacccatcatctacattaggtatttctcctaatgctatccatcacctagtcccccctgacaggccccagtgtgtaatgttcccttccctgtgtccatgtgttctcattgttcagctcccacttatgagtgagaagatgcagtgtttggttttctgttcttgtgttagtttgctgagaatgatggtttccagcttcatccatgtccctgcaaaggacataaactcatccttttttatggctgcatagtattccatggtgtatatgtatcacattttatttatactatttgatccagcaatctcattactgggtatatacccaaaggattataaatcattctactataaagacacatgcacacatatgtttattgcagcactgtttacaatagcaaagacttggaaccaacccaaatgcccatcaataatagactgaatataaccatttttaatattttgattagtgcatatatttttatatataaagatattatgtgtatgtctatatgtgtatgcatataagtatttgtgcatctatatgtatagatttatatacatatatatgtacatgtacatatatatctatatattatatataactaaacatacatgcaaacctataacacacatattttatttcaaatcagcatggcatatatatgtgtttttatatttttaagatcgtttgtcatgacatttttagtaataaatacagttaaattgccgtacttaagaggtgaatctttactttgtagaaatgaaatattgaaggaaaggaatatgcatatttttaagctataagtgtatttctacaatatttttgatgttctcattctaggacctgagaaaagaagacaatttcagtttgtttagtaatgataatatgtacaagatggaaagtgcaacatatttctaaatatttctaaatgaactggactgttatgactgtaagaatgccaatgtccttagtgtggttaaatatcatcttatcacacttctcaataatgattacgcacttagttttatttagtagatcttctgactaaagtgatcaatagaagtacttgattttaaaaatattttatttgaaacattatgctcataaaagaagaagttatgatgtcaaaatgtacagaaagaggaagtaaaggaaacttagtaaaagacctgtcactaaaaaattaccttcagggtctttaatttcaaattcatattctctctctctctctctctctctccccctctcttcctcccccctgccatattatctgaggattaggataagaattatattaaatctagccaaatccttttttttttaactccttagctgccactttttgaatctttaatagcagtatactctgacatctctttgtttctggatatgaaagtttctacaaatttaaatcaataacataaaagttggtagtcacggatgaacattatgtaatccagcttcagtttaaccctggaaaccaggaactctgatccacaaagttctaatatgaaccactgatgtgatagatagttgagaattaaggcctgtttctgatagaagaggaggaaagaaatacacctaagtggcaaatgcttcattataaacaagggtccttctaggttcttgggtgagactgaacttcactatttattgttcccagttggtatgattctattgtagccaggccatattataaaagatgtctgtattagttttctgttgaatatataacaaattactacaagcctggtgactgaacacatatttattatctgtcttagatttctaaaagtctgaaatacaaaattgatcagcagagttgtgttccttcaaagatctcaagaaagagtctgtttcctggccttttccagtgtctacagactacctgcattcattggctcatggcccatgccttaaattttcaaagccaaaaccagcaccatggtatcttcatctctctctctctttctctctctctgtctctctttcacacacacacacacacacacacacacacttactcaactgtccttccattctcatgcttctatctctgtctctgactctcctgtaatcttggtcgttgcattaggccaacgcaggtggttcagaatgaccttctcatctcaaaacccttagcttaatcattaatcacaatctgtaatgtctcttttgggaatgtgaagtaaaatattcataggttctagggatacagatgcagatatatttagggggacactattccctctaaacaagaatgttaaataaagatgcttgacattatatggcataatgagtaataacccagtttctagactcaaagttcttggtttaaatcctactactgtcatttaatagccattttaccttctgttatatataaactatctgggcctcaatttttattacattatcatttcttatatttagtaaaataatttcaaaaccatagtacagtacctgactcatagtcaattatcattattattaaccaaaaactgaaaaaaatagcctgaattttagaatgcttcattcatatcacttacatgaatatcttgaaagggataaaaaatccttcaagcatcatttcccatgaaatcaccaccaattatttggtgaatataatttcatagcttttatttttaattttttaaagtaaaattgtacatgcatatagcttagagaatcaaatcattctttaaggtttatcataaaaagcagcaatcccctggcttcatcaaccaccttcatctttttactctccagaggcaacctctttcaactctttgaagcagtttcaaaggaaaactgttcctttggcatttgtttatgtttctatacaacatgcttatactgctctttcttgattttttagttttaggctttccgtctcaccatggaaatgaagaaaaagctgtcttcgattttctacactcttaataccaaccacacctacacttcctgtttccgctccttttatatggttgtattataatattcattggattaattgtatgttttctcttaactttgtgctaaattatattttatatataggtgatcatgtattttagcatttactcaagcccaggtttgagaataaaagtaagtattattaaagttagtactaagaaaagaggtaaaaatcataatttttggtcactttaattaaatttaaactggagtaataataaataatgtcattcatttaagtaatactgattttcactgcatactaatgcatcttaagaaaaaaatacactgtagatttatcttacaatggccatatatataaataattttatttttgtcatgatttccaacgtaaaatgaatgcaaccttaattcaaaatcctattccttcaccgtattttttattccacttattgtcatggagctcttgtcactttttatcttgtgtataattatctttgaatttatttttaattttaaatttatttaaatgtattaaattttgaagttatttttatatataaatgtacagtagtatctccatatcactatactatattgaataatacatgaagtcattgatcttttcaagaaattctaaaagcctgtttcaatacagtattgagtattgtagaaataagtatattctgaatctcaaatggttatcagttttttattcatattactgtagccaaattgaagataccaaaaatatcctaggaattccaaagcaaaatgcatattttttgcaaactgtatagattacagttttgtgacaactgtaatctatacacatgtagacttcatcaaattttgtaacaagatatagaaaatgtcttagtctaaacacagtacatgtaatttacatgaaggaaatgtacctttaacaatttaacacacagggaatatagatgttaattattgaacaccttccaagacaaacattccttaattattctcttcttaaaacttgcatgtcatagataaaaacatagtcaaatttgagtatacacatggaacacagaatttgtaaattgtaattaaaacattttaacaataaaaatcaatctaaatattttttcttgaaaatatatttggctattactgggctggattttttaatggacttaacaaacttaaatacaaatattatactgaacagtttttgattaaaacataactatttatatctctgacaggtagactctgagctttctaaaggccaaaatttaagaaagtttagtgctttaggacttttgtgtcctttatgttcttctgctaagcaagcacaatacttgacttagaaaatttttgtatgtaataaacaaatgaatgttagctatctacagtttactctacttaagaaaatcttaggctatgctgtttctgtgacaataaactaagccagagctttgtgatttgggcctacatatccagcaaaaatagaattttgaattgaatctaaatgctctcttggaaagatgtgagaaatgtaatctgcttaggtgttgagattcaaatctgcatgtgataaggcattttaaaaatttacatataagatccccaaataaatctgccattacactatcattcccaatatagaaagccgatgaacaagcacattttttatatgatatcttctataaatttaaaaatggcagttacatatcaagatttgtttccttcgtcaagattatctagtaagcaaatgtgttgttttattgagctgcaaatcaataaaatagagttaaagatgatagatttaattagcatttagtccaactgtagatgctttataatagatgaaataactttttaatatttgtatcttttatttatatccttcaaaatttatttttatcttttgaattcacatcttttatttagttgttttttatttaaacatgatagacctagttattaaaacatcaattctatttttaagaaatgttactaaacatagttttcagtttatagtatttttctgtcatttgtctctttgctttaatatgtttatctacctctaaaaagattttcaaaaacctatattttttctccttcgttatttgttgcctgcaatcttacttgatcaacatctttatctgtactttcttttacactaatatttgccaatgatagttatctataactcaaaatacatccagattctaagaattcttatcactttcgctgctgtgttactgttcaagccaccatcatctctcatctacactattgtgaatgccttcttactgctcttcctccttttatccttgttcctcccaccaattgtctacaaaaaaatcaaaggtaattgttttcaaatatcacaatgaaatacttgttcacccaaaacatccaatgactactcccctcacttaaaagagaatcagaaagccaggtgcagtagctcatgcctataatcccagcactttgggagactgaggccggcagatcacctgaggtcaggagttcaagaccagcctggccaacatggtgaaacatggtctctactaaaactataaaaattatctgggcatggtgttgcacgcctgtaatctcagctactcaggaggctgaggcaggagaatcacctgaacccaggagtcggaggttgcagtgagctgagattgcaccactgcactccagcctgagcgacagagtgagcctccttctcaaattaattaattaattaattaattaattaaattaaaataaaaataagtaaaaagaaaaatcagaagtccttatcgtgactacaatggcacaacatgacacagctccactctgtttcttagtgtgctccttaccaacctcgggtttctgttacttacctactctctgcaactcctgttagcaaacctagcaaacaggatgttagcaaacctaggctctgatccccaaatgactagcactttaagacctttatataagaatgagaacatatgaaatttaaagtagtttttccaattctgtgaagaaagtcaatgatagcttgatggcatagcattgaatctataaattacttgggcagtatcgccattttcacgatgttgattctttctatccatgagcatggaatgtttttccatttgttcatgtcctctcttatttccttgagcagtggtttgtagttcttgaagaagtccttcacatcccttgtatgttgtgttcctagatttttattctttttgtagcaattgtgaatgggagttcacttatgatttggctctctgtttgtctattgttggtgtatagaaatgcttgtgttttttgcacattgattttgtatcctgagactttgctgaagttgcttatcagcttaaggagatttggggctcagacaatggggctttccccaatcacatcatctgcaaacagggactatttgacctcctcttttcctgtttgaatatcctttatttatttctcttgcctaactaccctggccagaacttccaatactatgttgaataggagtagtgagagagggcatccctgtcttgtctggttttcaaagaaaatgcttccagtttttgctcattcagtatgatattggctgtgggtttgtcataaatagctcttattattttgagatgcattccatcaataccaggttattgagagtttttagcatgaagggctgttgaatatattgaaggccttttctgcatctattgggataattttgtggtttttgtcattggttctgtttatgtgatggattacatttattgatttgcatatgttgaaccacccttgcatcccagggatgaagccgacttgatcatgctggataagctttttgatgtgctgttggatttggttggtcagtattttattgaggttcatatggaaccaaaagagagcctgtatagccaagacagtcctaagcaaaaagaataaagctggaggcatcatgctgcctgacttcaaactatactacaagactacagtaaccaaaacagcatggtactggtaccaaaacagatatatagaccaatggaacagaacagatgcctaagaaataatgccacacatctacgaccatctgatctctgacaaatctgacaaaaacaagcaatggggaaaggattccctatttaataaatggtgttgggaaaactggctagccatatgcagaaaactgaaactggaccccttccttacacttgatacaaaaattaactcaagatgaattaaagacttaaacataagacctaaatccataagaaccctagaagaaaacctaggcaataccattcaggatatagacataggcaaaaacttcatgactaaaacaccaatagcaatggcaataaaagccaaaattgacaaatgggatctaattaaaataaagagcttctgcatagcaaaagaaactatcatcagagtgaacaggcaacatacagaatgggacaaaatttttgcaatctctccatctgaaaaagggctaatatcgagaatctacaaagaacttaaacaaatttacaagaaaaaaacaaagaaccccatcaaaatgtgggtgaaggatctgaacaggcacttctcaaaagaagacatttatgctgccaacaaaattatgaaaaaaagctcatcatcacgggttattacagaaatgcaaatcaaaaccccaatgagataccatctcacatcagttagaatggtgatcattaaaaagtcaggaaacaacaggtgctggagaggatgtggagaaataggaacacttttacactgttggtgggagtgtaaattagctcaaccattgtggaagacagtgtggcgattcctcaaggatctagaaccagaaataccatttggcccagtaatgccattactgggtatatacccaaaggattataagtcattctactataaagacgcatgcacatgcatgtttattgcagcactagtcacaatagcaaaaacttggaaccaacccaaatgcccatcaatgatagactggatgaagaaaatgtggcacacatacaccatgaaatcctatgcagccataaaaaaggatgagttcatgtctcttcagggacatggatgaatctggaaaccatcattctcagcaaactaacacaggcagagaaaaccaaaaaccaaacaccatatgttctcactcataagtgggagttgaacaatgagaacatatggacacaaggaggggaatattatacactggggcctgtcagggggtagggcactaggagagggatagcattaggagaaatatctaatgtacatgaggggttgatgggtgcagcaaaccaccatgacatgtgtatatctaggtaccaaacctgcacgttctgcacatgtttcccagaacttaaagtataataataataataaaagtatgagcacgttagactctccataaagtgagacaagtgatgctgggttacaaaatcatcttcactgtgtaattttgtccactgggctatgaccacacgattaagatctctggtgacatgtgtgtagcctcctggcggaccctcccttaagtggtcctccaaactcttcactcttctcttggctgaatcaaataacaaggagaatttatcacacattcagaaatattacataagtcagaaattgccttctttgctttgattcactgaaacttggggatcaatttgttgctataaccctgcctatgctttcatttgttttatttaattttgttttgcttattattatttatcatctctatattttcctccttaatttgttaatttggttaagtttttctgttagtagtgtaatagtaggtccttattttctaatctaagagtatcttttataagaaatcatgcttagttctagttttcataagaattgttataaatgattattcaaacttttttatcatttgatatacactacttactacgtatacttttatttacctattcatttattcttggtgtattcaatttgctgctattcattaggattatttttaattttagtaattattattcacttgtttttttttgagacagagccttgctctgtcacccagacaggagtgcagtggcaccatctcggctcactgcaagctccgcctcccgggttcacgccattctcctgcctcagcctcccgagtagctgggactacaggcgcccgccaccacgcctggctaatttttgtatttttagttgagatggggtttcaccgtggtctcgatctcctgacctcatgatccgcccgcctcggcctcccaaagtattgggattacagacgtgagccaccgcgcccggccacattttttataattgacaaaattgtatataattattgtgtaagccatgatgtttgaagtatatacacattgtagaatggttaaatctagcaaagtaacaaatacagtaattcacatagttatctttatttgtgtgtggaagcatttaacatccgctgtcttaaggttttcatgaatacaatatatcatcattaactgtagtcaccatgctgtacaatagatctcttgaatttattcattctatctaactgtaattttgtattttacctattttccaagaaggcaatgtttacttgctaggtattgctatataatattctactaatatttgaaaacagaatccatttttgtaagatacattgtttcttcctctactcttcttctctattcatctcttttggaatgatatccaatttaaaacgtggccttaaaatacttgtacttctctattacttccctcaactcatcgataagatattgaatttattgtttgctgcctcaaagtcttaggttttgctgagaaaatgtagtatttttaggttagtctagaccagggttttgttttgttttgttttttttcctttaaagagtcaaataacaaataagttttgggggtggattcagtcttcgtcccatactcacacctgacattatagtgctaaagcagccataaacactgcagaaatcagtggcatggttttgttccaataaaatattatttacaaaacaggcagtgggctggagtagtttgctgactacttgagcaaattagtaatactcgatactatatctcttcatattcaaaagtcctaattcacaatttaaataacatattccttgttgatcaccttccaccaaaatttaattctttcacaatccctctttttgtatcctgttctgtaggtttcaattctggaatgttgtttggtttctgacataactaaattattttcctcagtaaggtaaagatataaaatataattggatttctgagggtatgaaaaaatctccatttttttactcaaattatggataggcatagtatgatggatttgttatccttttctttacggatttccttgtgttattttctagctgaaatgtcaaatgctggtattataatttttcttttgcaagttacttttttctctatggtggttagtaatattttgtctttaactttagtatttgataattttatcaatactttttttctgatcaattctgcacgaaaccaaatcaaatttttcaacatggatcaggttttgtcatgagaaattattttatatgtttataaaataatttcttcttcctcattgtatttatttattcctttatttgtaaatatttataaaaattaaatttatgaaataatttcttcttcattgtatttattcctttatttgtaaatatttataaaaattatatttatgaaaatttcctcttcctcattgtatttattcatttattaattgtattattcctttattaatctgagatcatgatggaaagattacataattagcagatatatactatagatctatattttgatgtgtatatgtgctaattatgtaatctttccatcataatctcagattcaacaacttttctccatactttaagatatgtatcccatttgatttttatagccatcaatagtcctcagaagtgaccatattattctttgtttatatattatcattattattattctaaaaattttattacagatgctccttcacttacaaggagcttccatctgaatagattcatggtaagttaaaaatattgtaattgaaaagtgcattttccacctacaatattttcaatttaggatgggtttatctgaatgtaaccccatcatatatcaaggagcatagtgaatgaatatcatttttacactatcataaagtcaaaaaaattgtaagtcaaaccatggtaaattgcagactgtctgtcttccttgaaggtttttagattttcttatatgttattaatacacatttttttttgttcaaagtatcatcactctcatgtatgttttaatcagaagcccactgttttttgaatcttgcctcttaaaattattattctgtggttgctgagcaacattaggcaggttatttttattcaatgaaacctgtttcttgctcctttcagatctacctgtcaaacagaggtaagcctaactatgaaaagagtttgcaaaaccttatagcagtttccttaagcacaaagatactttggggatagtggaaattttcattttcttgattgtgatgatagtttcatgagtgtacatgtatgtcaaaacctactgaactgtactctttaggtatgtatcatttattgtattatgcctgaataaatatttttataatatatagttacagcaatttttctgcaattagtatagaatgagaggactcagacctgagtagtaaaacatacgtgtgtgtgttgggtatacacatacatgtacctacatacacactgcttctttatttcaacgtctcaacatttctaaagtcctggaagtaatgaggtatggtagagaaatgacaaaagtgctgttcaataacaatgaagtcagtaccattaatatttagaatatcaacacctaaaagggccatagtaagcaacagggtgatagatggatgaaataagggtgtatttgtgtgtgtgtgtttctctctgtgtgtgtgtctatgtgtgtgggtctgtgtgtatgtgagagttagtgtgatggattagtgtttagcttaatttatgtgatgctaactgaagcatttgagaagccctttctgatgagattctgcctgatgatgagaggacttgttaactcagatcatttgttctggtatcaacatgaccaagaacctctagccccattctcagcacggttgtactcttcctgctttacctttataatatttctccccacctcctagtcatattacttaaggtcttataattttctttgtaatgcttaagtaactgagtttaatttctgcctttttctttaggttgcatttgtgtcccttagctgagttgtgtttttaactcacatactccaatgtcttgaacatactagtagacaactactcccatctttaaaataggaatgatgatacctaccttattagtcctcaaaggatgttgtataaaacaggaataaaattataaggaaaggccattgtaaaactctaagacaaaatttaaatgcttctagtaatttatatagctattacaaagcgttgatgtaatatgcatgagaccagattataaaagaaaagactactatttgcatattgttagtactaatttattgacattaaatatactttgctcaaaggaattgacacttctaaatggaatctctttaacaactgaagatattaaatgcattattaggggaatgacatataatacatgaaaattgtattttaagggtatgtcatgaagaaaacaatacaaatatattttgaagggtcacaaatgctgtttaaaatcttgcttatgctttttgaatatttcaaagtcagcagaacagaaaatgtatttttaaattacattcattttccagaaacaggtattacctatcatcttaactctctcttgcctgtcaagacttgtcgcactgctttttgacaagccaggcaaagagatttgtccatagctatcaatttttattccataagtattcacaaagaaaaaatgtatttttctaagtggtcataggtctaatcccaaatcaaattaccatttcctgcactacctacaaaattttatggttaaaaaaaggacatgatttcacccccaagaaaaaaaaatcatgtatctctctgagtcttcttagttgaaaatttaacattctataagattttgttatcctatttacaggaaaaaaaacttttcattttaagatgataaattatataagaaaagacagtgctggtaactttgcaagagatcagagaaagaaagcttgtatttatatttctatattctgacatagagaatgtggttataatctagtattttctttcacataagagagatagctgatcatattagtcttcaactttttaaaaaattttgcctcatatttttaaatgtgccaaaatatttactagatttcaaaataaataaataaaatatgctttcagttacttatatatgagtgaagattaggattaaatggaggaaagtttgtgtgaaacagactgttacaggactacaaagaaaaacgttttaaaaaatttctactatgtaaactcctttttcattttacccaaagtatgttccattgatccctatgttttggggaaaatatatctgtatccatccacttatctctgacctatctctgcttctatgtctctatctgtggatgaatccatctatctatgagagacagagcatttcaatggtttttacttttttttaagaaagggtcttgctctattgtccagggtggagtgcaggagcacattcatggctcattgcagcttcagcctcctggaatgaggtgatcctcacatcttaacctcccaggtagctgggatttcaggtacgtgtcacaagaccctgatatatatacacatacgtatatacacacacatatatacgtgtatatatacacacatatatacatgtatacatgtatatatatacatatgtgtgtgtgtgtgtgtgtgtgtgtgtgtgtatatatatatatatatatatataatttatttatttttgtagaggtggggtttttccatgttgcccagactggtcttaagtgatctgccagcctcagcctcccaaagttctatgattacaggcatgtcttattgtgtctaggccaattttgtttttatttttttttctgtacagaattcttttttgtttgtttcaagtaacacttacagtagttatttaacatactttgggtaacatcactctatatttaatattttaaaacttttaaactatgatctggcattttgattttagtttattggtatgcatcagattttttctccaatttcttccaatgttgagaaaatttagactataaatcctgaagaatggtttattagtctgttctcaatgctgctaataaaaacataaccaggactggataatttataaaggaaagaggtttatttaaatcacaattccacaatggctggggaggcctcacaatcctggtggaaagcgaaggggaagcaaggcatgccttacatggcagcaggcaaaagagagcttgtataggggaactcccatttataaaactatcagacctcgtgagacttattcactaccatgagaacagtataggggaaactgcccccatgattcaattaaaactgtcccccacccttgacacgtggggattattacaattcaagctgagatttgagtggacacacagcctaactatatcaaatggaatagtttgaaataagtggtatgataagcaaattaaaaaaaaaaaaactccagccgatgattagagatggaaataatgtgaactatatataaattgtagtcatggattagcttgccagaaggctggacattttttatatattattttctattcatacttttgaattatctctcaaattaatatatgactatgcatatatgtgtaagggtatatgtgtgtgtgtatgcagacatggcatatatgtgggtatatacatatttatattggctacaaagaagcctattatacatatttaaaagattttgaatacagcccttttaagcatttcgttttgaacatcttgaagcatatcaaaattcataatgggataattgcagaggagcctccagaacaaggtgtattgggatgggaaagactcctaaatatatcctcacactattttggcatgtgtattataatgcagatatcctgactatgtagatatgttgccttcactctaaaactgtctatatgttatctgtctcaaaagttccttattgatgaactatgagaaaggaaaatgtgaataataaagtttattataccaaggttttgtgaagatgccgcatgcttaggatctccataggcaagagtttggtgaggcaagactgtcttatacaaaagtttttccctatcctagaacaaaaattaaaaatgaaacaagcaaattctcatgtattgaaaattgcctgtgaatctggtacttgaggtaccttgtgtgggtcacattgaatagtcatagtcatcccttaatattcatggaagaatagttcaaggagcttcacaaatgtcaaaatttgtggatgctcaagttcctgatataaaatgatgtaatatttgcatgtaatataggcacaaccttccaaatagtataaataatctctagattacttataatacctaatacaatgtaagtgccacatacatagttgttatactgtattgtttagggaataatgacaagaggaaaaagtccgtacatattcagtacagatgggattttttaatgaatacttttctatccaacattgattgaatccattgatgtggaacccatgaatatggaagagcaacccatggatatgaaggactaagcacataaataaattgcacactaaattaagtctcactttacaagattttggggtcttctttagcattagtggctatgaaataaattcttatgagatgctcataatattgtatctcttgaagaactttacttatattttcaacttctttttttttttttgctaatgtgtaccctaggttgagagttattaaacttttatttaacaacaacaaaacaaaataaaggtacttattggcagatttttgaaagacaggttaaagcacaaggatagcaatataattgggaatttggtgtaccctatcatttgctttcctttttaaaatcttccttggcattctcagtttttttgttttgtttatttaaaaagaatattggtgatttttatacctaatattatgggacttgtacatcacattgcacggatttcttatgcctaacatcacagcctatccctgactgaattagtaaatgcattttccatatgaatttacaacttatgtagtaattatcacatttgccaatgtttgtccttgtttacacatgaatgttagctaaaacactttcgattattgccaacattaacccattaaagatgtatttgattctcaacagtcaaaatagaatttgagtttcaaggcattttcgaaatcttctaatccactgatattctatatcaccatatcctaaagcttgtgtattttagacagataagctccaatttaggtagccattgggaaaactttttttgtgtgtttctatggctaaaaaaatgggaataagcctttgttttcttctgattttcttatttcactgtggagaatcttgaagaccccagaactcagtaaatctttgtccattgtctcattcatggtcacttggtagcagacatcttgcctcaatgtttgggcacaaaaatagtaaaataaaaattgttaatattctcacatagagctaattgaatattgacatattgcatagcactcagcaaagagatacatttattttttaaagaaatgggtattctatttccttttttaatgtatgaaacaaaaccattgatgtgcattattgttgctaacagccaaagtatatgtttattgactcattttttcacttcactatatgaaattaaattgaaaatttacagcattcaagtgtactttatgtgcagagcaatacccagggatcagtgtttacaaattaagagatggtccttaaatatttgtacaatgtaaaatgcccgttggctgtaaaatgatgttttgaaaataaagtataagatcaagacctgaaccagtagtaagaattgtgtaattgtaactatgatttccttgtaattttgctaactaattttctaattttgctaactacatacttcattgactttatacatccacatgacatcatttttcttaaaattctgaggcattgtgtgtgtgtgcacatgcatgcagcataattgccacaaaagaagctaccaagtatccaagcatatttaaaagattttgtataaagcacttttaaacataaatcaaaatatgtggctgtcatgactggttattacaacacaaatcatgtgttggcctatagctgttgaaatccctagctgctgaatgtcctagaaattaaattatatttttctttttctgcactctatggaatttgaggccgatctctgaggttaaatcacttttttgacctcaaagatctttcaagaagtattcataagaagctgtctctggagccttccactttaaggcaacaaatgatatgaactgtgtagctagtaaaaaaaaaaaaaaaacaagtaaaggtttagctaatagaatctaatgtcatgtgaatgagattttcttttgccacacagttgtttttcattttcattatttatagcaattattataccaaaatcacataataataatattccataacatattaataccttcaaaagatgtatgattttacttaaggtaataagcatagttattaggggaaacatctctctcccacaaatgatttttatgaaaagagattttctttaaatacaagtgagtttgagttgcaactttcacttccttagaaaaagatgatctgagttctctggtaagtcagcaatagtatttacatttcgtaattggtcagaattatttaataatttatcaagatttctggatgtagggtaaatttgtttctttatcttttgtttttctagattgctgtgagaaggagccatgtaagtaagtgagtattttctacaattaattgttttagttgaaatttacaaacactagactgagaatttagtgaatatatttttttctcatattagatgatttttaccttaaaatcaattttatcagtaatgtaggtgatatttggattctcttcatttttctttcttacttattaattgaagtatatttgaggaaatggtttacttcctttattatactttaagttctgggatacatgcacagaacgtgcaggtttgttacatagatatacacttgacatggtggtttactgcacccatcaacccatcatctacgttaggtatttctcctaatgctatccctcccctaatcccccaccctccaacaggccccaatgtgtgatgttctccaccgtgtctgtgtgttctcattgttcaaactcccacttatgagtgagaacacgtggtgtttggttttctatgcctgtgttagtttgctgagaatgatggtttccagcttcatccatgtccctgcaaaggacatgagctcatcattttttatggctgcatagtattccatggtgtatacgtgccacattttctttatccagtgtatcattgatgggcatttgggttggttccaaatctttgctattgtgaatagcactgcaataaacatatgtgtgcttgtgtctttatagaatgattgataatcctttaggcatatacctgtaatgggattgctgggtcaagtggtatttctggttctagatccttgaggaatcgccacactgtcttctacaatggttgaactaatttacactcccacaaacagtgtaaaagcgttcctatttcatcacatcctctccagcatctgttgtttcctgactttttaatgatcaccattctaagtggcatgagatggtatcccattgtggttctgatttgcatttctctaatgaccagtgatgatgacctgttttacatacattttttggccacataaatgttttcttctgagaagtttctgttcatatgctttgcccactttttgatggggttgtttttttcttgtaaatttaagtgccttatagattctggatattagccctttgtcagatggacagattgcaaaaattttgtcccattctgtatgttgcctattcacactgatgatagtttcttttgctgtgcagaagctctttagtttaattagatcccatttgtcaattttggcttttgttgtcattgcttttggcattgtaatcatgaaatctttgcccatgcctatgtcctgaatgagattgcctaggttttcttctgaggtttttatggttttaggtcttagatttaagtctttaatctgtcttgagttagtttttgtataacgtgtaaggaaggggtccagtttcagttttctgcatatggctagccacttttcccaacaccatttatcaaatagggaatcctttctccattgcttctttctgtcaagattgtcaaaggtcagatggttgtagatgtgtgactttatttctgaggcctctagtctattccatttacttcttattcactgggaattacttcctattcaatcgctgcacttgccataataacacaatgtttacttaattatccataaattgtttaaaattttttaattacacagatctatttccatttccctttaagaaaatggggtaaagggtttatattaacttagctcatatttctttactttttaaccaaagtatagtaaaagatgaacattattgttaatttaaatcttacacatctttccttttttaaaaaaatacaaaatggatgtccttaatgtacatttctataacaacaaaaatcatggtaaggattaaggaaaatctgagtcatacctaacataccataaaaaatgtaacgttggtaaaagagacaatgaataaactagagaaagctgtttgggatttaaatgtaattcaaatttataaatgtaatagagtatataataagtgtatgcgaacaaatgtgcattataatgttagagtaaaaaaatgctattatcaagaatcagctgagaaagttgaaaagcttcacaaattctgtgtattaacttaaagggaattcacatggaatagcattgtacttttaccaaatgaagtaagtcaatttcctgaagatagttaggtgaaatgactgatagtggtcaaaaaaatttatctggtgagttatgtattatttatttatttagagacagagtctcactatgtctcccaggctggagtgtagtggtatgatctgggctcactgcagcctctgcctcctgggttcaaacaattctcctgcctcagcctcctgagtagctgggattaaaggcatgggctaccacgcccggctaatttttgcatttttagtatttttagtttttgcattttaagttttgtatttcaccatattggccaggttggtcttgaactcccaacctcaagtgatccgccccgcctcagcctcccaaagtgctgtgattacaggaaccagccactgtgctttgccaaattatgtatttttaaattggtatgagtaaatcaaaaactggatttgtgtgtatgtttatgtctgtctttgtgtgtagtacactgtaaaatgagactataaaatctggatatttaaaattaaaaattaaggattcaaataaaaaggacaagctatatagtaagaataattttataattctgattttgactgtcataaagcattacgctaacaatattactacaactgctacttctactaagtaaaccaagagatattaaaatgggcctgtttcttgatggtgacatggtattttgttatccaccaacactcaattggggttatacattactttgtctatctggccttcaaaattatttatgaacctaataattttatcttggttcataatatgttactagaatatagaattatattactatattctctattatatttaattatatattctaattatatatactatattctacgtattatattctatattgctagaatacagaatatattaatagaatagagaaacatcttagcatttccatcctatcacaatgatgctcactccctgaaagacctcctgtgcccacgaggccccggtgcattttgaagtttttgttgtgataatcaatggtctgtttttgaggctggtgtcaatgtttagttcttgggctgttatgcaactctcagtttgggttgcttatgtggaaaacacagaaattttggttttggagattacaactcaacaatgctgtataatttatcttccatttggaggaatcaaaaatttcaatgtaagtgttttctgtattttacacctgaattgatagtgacttaaggaaactgagatgagactatggggccatacttcctttgctcattatgtaaagctaaggaagtattcattggtgtttagtcattgctaaagcatcctattgttctgcacaggttgattgtaatcaaaatagcttataataggaaagcactgacttagcagatagttgaactgctttgattataggaaacaatgtccctcagaaagaagttaaaatacatctgaacttatatgaaggagtgtgatagaatattaaaatggaagattgagctgaaacaaaaaatgtattttgaaatgaatagatattataaaaatatttcaatacattttattttctttattaaaacttctgaagctaggctaggctgagttacagaatatggtaaccactatttcagtttcccttggttttgggcatagccagatgaacaggttctagtaaatgggatgaatcaataactggaattgtgtagcttctggaaagtgttcttaatgggagataacttttttctcctcattgctggattttcagattctcaccctgtagacttttcatatggtctgaaggccgttgtgcattttgtaggtgttatactagtggccagttccagatgcagataccattatgattccagccaatgagggttatactagcggaagatggagtagagagctggaagaaacacagatctttgataaaccattgatgtagactaggtaccttgtgacaagacatatatcacatattatgcccctacttcatgtttctgggagattgtggcagtttccttccagctgggctgcctttggaaaccctatcagtttctctctgtcactgtctgcctctgtttttctcttactcttttcctttcagaactcttcagtcctaatacatacttagggttttctttattccttctacattttctgaactcccccttcccagattctgtggttgagtaaataatctggaatgttttgaaacacttctcaacaattattgctgccattttatatcccccagaagggttgatttattcattggaaacttatttaataagctaattttagtgaatttattatcagctgttattggacaactatacattagtttctagataacattataatgcttagtctttatgttcattaaaaataaaggtcagattatatagtgtgaacattttaggccatggggcttatcagcagagacagttaaatacctctcaaattttcacacaaggcggctacatcttctgcccatgtgtatgtccagaacggctataaaataggtgcaaattaattaataaatttacaacataaactatcttgcaaacaaacacacacattgaccttcacctcaggacagttataactctataagtattgaattctcatacttcatgtatatactgtttactgttattgaggaaaaagtcaaagagaactagtccttgttttgcaaactagatgacaggaggaatactcagtttactgtgacaaagtaggcaattctaagataaatagctcctagcaatgctttggaagggaaattttccttagatggtggctctatagaaactctgtgaacaaactgttatatcttttacaaatctgccagctactttttatgagcttcagttgctctttatgactataataaaaggagagtagaagccatgtgtatatccagtggtcccccaagcaagcatccttatgcagaaaatataatgagatcgtaggatgttcttgcccttaagctgctggatgctctcttaactcttgttttgacaccattttattgtgcctataataataaagtacatgtgaaatacgtttcacagatttcagtattgttaatctaataattggcaacatagtatgtccactatcaacaaagaacacacaaatcaataaggaaatgaaaattttaaataattcaaacattccattgatatgcaccttgtcatttagatatgtatttgttaacagtgcaatacaattatatattttaaaataacttataccattaagcatacatttgctattataattattaaagcacagttaaaataccttgtatataaaaatatcaactcatattttataacagtgatagatttgtaaatttgtaccttaaattctacatcaatgtgttctttcataattttaacctctcatagactttttactatagtttgccattaaaaaaggagatataaacaatttcaaaaaaatattgtttcatagtcactatatgtcataacatattgttcaaaatgacatgtaagaactatgttgagttttaattccaaaaattgtcatggttagtttaaaacttttatattttaggtacaatgtgtcttaattgactaatatttgactaacatttctttgacatcttgagaacccacagctacattgtcttcttatgatttgttgacctgtagaaatttatgatttaaattttgaactctatcaaaatatattttaaccttatttttcttcatttcaattttctgtttctttatatgtttccttggtgttgttttttaaaatcctagcaaacatagtaatatgcatttttatgtcactacaaactttttctgaatgatgttctggtgtaatgcaaataaacatgtaagaattcagtgcatcttaactcaaagctatttctttctcttctgaggtcagcaccatggtgtttatttctctctacctatgtcttaatttttcataaaataaaatctaagcataacaattgatataaaagtaactctgtagcatcctggtctccattaaacaaattttaaatccacatagacagaaaagttttgcctccttgttcaccttaccaacatctatttacttctccttttctttcatagttttaagatttaattttgacatcacttaactaaagttgtgacctcattttgagtgcagtgtcctgagaacattgagtattttctctcattgctcttatgtctacacaattagtactttcacattattggatacataaatattgactcaacccatcgatatcacctttgccaaaaataaacagcatttattttgcttttctgccttttcactatctgttgattttacatagaagccctcttcattctctagttttcttcatcttacttgtcatttggatcttatctcctctatcaacgcttcatcaatgtccaagatttttctaactcttcattcttctatactactacagtcattaccggttatgcttttcatctggcagtttgaacgttcttcatgttgttattagtgttgttaattgcttaaaaacgtgtcctgcatcctcaactaggttgaataccctgaagaaagaactggcttttaactatgagttcacggttgatctgggaatgttcttatgtagacctatgaatctcctgaaattatagataagacaatgtatttatgtacatttctatgtatactttttttttgcaaaaacacagtggctagaactctatcaatttagcaaagatattcatgtgtaaaatccattgatctaaaataataaaaatcatagtttgcacttttttcttccataaggcatgtaagtcaaaagtacttgagaaatatttgtaattgatttcacaaaccttaggctcttagttggaatccctggggtgatactccctagaagtgtacaaaaaccacagccagacaacgactaacagacaaatgcaaccaagctataagttagctcaaatccatatcggtcctctctcctattgggttgtattacttatattattttttaagaatgattttacatattttattttctcatgagatatgttacacatagtaattttgtaaaatatatatgtatattataagaaatacttatgaagagaatatccacataaataccatgaagctcaagatctggataattgcctgcaaaacagaagcaccctggaagaacctccatatataaattttcttctttactcctagagatgatattcttcctaaatctagatatattaacatataaataaacattaagatatgccatgattgccgatggaaagattcctgttgggaaaaatactattcatgggccgctcatgtttctgcatgttattcattcagaatcacaaactccattttttcctactattttttcaaagttgtttgtgattatattaatataataaacatcccatgtaaaaaagataatatctccttctcaggcaagggttagacagcctaatctttgcccagtataaagtatgtgttccccaagccagcattcttgaaactgtggcaggctaactggagagctgacacgtaaaataaaatttcagacccttcagagttcttggcaattccaccttataaagatattaagtctccacagatttttaagtatatgcagtataattccaatcatatcatatttttgttgaatgtgacaaatgtattcattatatgcatataaatgtaaagagagtatattaggcagaatatttctaaagaaaaacaaggtggaaggagattatctataagctagcataactttttatatagctaaagtgattaagaaaatgtggaattggtacaagcatttggaaatcagatgctggaacagaaaagagagccacaaaatagatctatagttatatggacccttgatatatcagagatatgttgtggtagataaataaggaaagaacagatatttcaataaattgagataccacattgtcatgtctatataaaaataaaattgaattcttatacaatatcatttccaaggattaattccatgcttctttgagaaaaatataaagattttaagcagttgatatacctgaatattatcatgaacttctttggatttgaaaagagtttttaaacgagatgaaaaacaaaaatcataagggaaaagatttctaaatatgaatgtgtaattttaaacaggattcaagactggtataatttaaaaaaatgattatagcaagtgttattggttataccatgtagaaatgaaatgtcttctactttgctgtagagggtgtacaatggcacagtgactttggcaaacagtttggcaacgttgatggtccatgtatggtatgacccagcaattccaactctagataggtactctgaataatctttagtctttgcatatatacatcaaggtgtcagaaatgtttgagagatttgtttatgaatactccaaactaaaaatgactcaatgactatcagcagtaggatggaaagtaaactagagtatagtacggcaatactttttataaatggaactaagtgaaatacagctacatgcaacatagatgtatctcacaacatgtttaagagaaagaagctagtgcaggaaaaaggggaatggacaagtcatcgatataaaccaaacttagtgacaactaaatgctattatatatgtatgaaatataattgatcacagataagctattaaatttttcagtcaatggcgaaagcttttagctcatggtcaaatagaaatggcattagtgtgcatctttgtttcattcctgatctgaggaaaaataatatttcctggtgaatatatttgctattggcttttggaggtaactattttcaggttgtggaagtttcactcatttctgatttcctaagagcattttccttattaatatgtattgcagttagtcaaaagctttttctgcatttattgtgacagactatttttcttattcaacatctcagataaattacgatatttgattttctagtgtaaaaatgaattgaatttaaaccaagtaggctacaatgtatgttttgatcagtttgctaatatcttgcttaatatttccactgtgttcttgaattagttacctataatgacttttccctgcattgtcttctcaattattggtaaagaggttatgttatgttagcctcagaaaatgaattgtgatatattttctgttttgtttatactctgcaacagtttataagatagttctgttgcttttcctttagcattattgaagtttgcaggggaaattatataggccttcaatttctttagtggcaaatatttttaatattgctgtcattgtattcatataattgttttatagttaaatcattatttgcatcatgaatcattaaataggcaacatttatattttttatatggcaagggtaaggagttgaattattttataattgaattaatatataagagttgtaaggtttatgtgttttctatttcatctatttgttatttaaagctaagtttttatttcatgataaaaatcattcataacatgataggttttatttttggcagaatctggtgctaatggctgtttatcattctgattttggttgtatgtcttctacctgatcagccttcctacacatgttgtcttctacctgatcagccttcctacacatgtatcatttttgtcacttgaaactaacaatattttaaaagacttgaaactaacaatattttaaaagatgtgtttatttatgcttagttttagtttcattatattatgctctgctctacattgtaatatttttcctatttttaatttactttgaactctttctggtattttgagttggattatttttaacatatttattttcagtctttctcttttatgatacacacacgagatgccacaggtctgttatgtatggatttagttacattacaatgtttagctttcattttaaaatattttctattaatttctatcatgatttcctctttgacctgttttctatttagaagaatattgaatatcacaacacattaaggccttgtctagacatcagcataattatttttggtgtcctacaattactgcatacattttcaacccttggaagattgttgaagttgcattatgatccattaagtaatcaatatttgtaagattggtgtattataggtgtaagatgtagtgatattggtcttgtgttttattggatctgttaaaaatgttccattataattatgaatttgcatctttctagttctatcattttgatgtttatgtattgaagtaatattaatagattatcaatataaatattaatcaatactataatttatattcaaatattaatataaatatgaatgcattaattatggtttataaataatatttaatgtgattaataggataatttggaattctgtattttggtactaaaatattaccctctttaattcacattgtttaaagtctcgcttgtatattaataatataacttgtctgttgtgatatatctggagacagaagggctcacataaggcattcatatctgtttttttttgttttttttttttttttttagctcgaaacacaatcagcgtagaaaacgggtaggcatttttctttttctttctttttttttttttttttgagacagagtctctctctgtcgcccaggctggagtgcagtggccgcgatctaggctcactgcaagctccgcttcctgggttcgtgccattctcctgcctccctgcctcagcctctggagtaggtgggactacaggtgcccgccaccacgcccggctaatttttttgtattttcagtagagacggggtttcaccgtgttagccaggatggtctcgatctcctgacctcatgatgcacccgcctcggcctcccaaagtgctgggataacaggcgtgagccaccgtgcccagccacgggtagacatttttcaataacattaaaaagtgatttagaaacccaaaacttataggagtgaaatattatggttatgacatacaatacatagtctaaggagtaagacgaaaagagaagatgtgaaatgagttttttcaaaaaattttggctttgaatgtgcttttctgtactggagaagctagaaagcaatttgtatgtccaggagatgacaactgcccaaaagagacttaagttttcatcactggctgatctataagctcagtgtaagaaggaagtaaaagctgaacctgaggcagaattacaaatggcccccttaagtgttaaaggagtgccctggcactgggtcaatcctcaaagattaagctcctgacattcaacaaaatacctgtcaaaacactgaataaacaaaggtagccttcaacaatcaagataatcaaaccttgagaaagagagataatctgatatataatgctatcaaattgtaatagtccaaagttcattaagaacgaccagaaaaaaaaaaaaaaacttaagctacaatgcatataaaaaatagtgtaggcaaataatttctgactaagccctgaaaaacaaaacacaagcaacaaaaccaaaaataaacaaatcacagtaaaacaaataatcaagagttaacagacaacctgcagattaaaaaatatttgcaaacagtgcaactgacagaagattgatattgaaaatttataaggaactcaaagaacaacaacaacaaaccaaataaccctatcataaagtgggcaaagaacatgcatagatatttttcaaaggaagacatacaaatgggcaacaagaatataaagaatactcaacaccactcatcatcagagaagtgcaaattaaagccacagtgaggtaccggctcacgctagtcagaatgactattactacagaatagaaaaattatgttggcaaggtacacagtgaaaaagaatgcttatacaccattggtgggatataaattagtgcaaactctttgaaaaccagtgtggagatttctcagaggaacaaaaatagaactaccattcagtccagcaatctcactgtggggtatcccccacacacacacacaaaaagttgtattaaaaaatccctgcacgcatatgtttattgcagtaatattcacaatagcaaagacgcagaatcaacctaactgtccttcaatggatgaataaagaaaatatggtatatattatataattcacaaatacatatacacacataaaatggaatactatttagccgtaaaaaggaataaaatggtgtattttttttggagcaacatggatggaactgaaatatcttaagtgaaacaacttaaaaactgaaattcaaatattgcatggtctcatttataagtggaagctaaataatttgcacaaataggcataaagtgtgaaataatagacattggagacttaggtgacagggtgggagaatagtaagggatgagaaaatacttaatggtcacaatgtacattatttgtgtgacgattacactaaaatgccagacttcaccactgcatcatatagccacataacaaaactgaaattgtaccccttaagtatatacaaataaaagaaaaaatagattgacaaaaactgtccacgagaaatcataggcacttaacttactaaacaataactttaaatcaactattttaaatatgttcaagaacctgaaggactaaataacatttttaaaaaatgacttatgaacaaaatgatattgtcaatgaagagatagaaatggtagaaaggaaccaaacagacattctagaactaaaaagtaaaataactacactttttaaaaaatcactaaatggattcaacagttttgagtagatagaaaaaagaatcagtgaagatgaatattgaacaactgataatacaattttagtagcaaaaataaaaatgaatttttttaatgtgattagaatttaagtgacatttgggacaagaggaccaacctacactttataggagtctcagaagaagcggaagaaaatagaaaaaatatctgaagaaatagtggtcaaaaccttctccaatctgaaaatatgaactgcatacctaagaagctaaagaatctccaactaggacaatctcaaaaaaatcaacggagagaaagattataatcaagttgccaaaggaaaaagagaaatagagaatcttcaaagcagcgagaaagaagcaaatcctcacatagaagggatccccagtaaaatttatagatgatttctcatcaaacatcatgaggaccagaaagcagtgggatgacatatttaaagttgtaaaagaaaaaaaaagagagacaatcaataattctaaaacttgcacaattttctaatgtaaaacaataattttatatccatcttgttaaagaatgaaaaaataaattaatgcatgcacagataaactaaatataagagggtttattattggtagacctgccctataaataacttaggctgaaacaaaaggactctagacatcaacttaaatttgtataattttttaaaaaatgataaggtaattacatatgtaaatttaaatggcaatattactaaactttggggttgaaactcctctttattttctatatgaatttaaagaaaaagcacagtattctctgatggtagtttgtatttctgtgggattggtggtgatatcccctttatcattttttattgcatctatttgattcttctctcttttcttctttattagtcttgctagcagtctatcaattttgttgattttttcaaaaaaaacagctcctggattcattgatttttttaaagggttttttgtgtctctatatccttcagttctgctctgatcttagttatttcttgccttctgctgcttttgaatgtgtttgctcttgcttctctagttcttttaattgtgatgttagggtgtcaatttaagatctttcctgctgtctcttgtgggcatttagtgctataaatttccctctacacactgctttgaatgtgtcccacagattctggtatgttgtgtctttgttctcattggtttcaaagaacgtctttatttctgccttcatttcattatgtacccagtagtcattcaggagcaggttgttcagtttccatgtagttgagcagttttgagtgagtttcttaatcctgagttctagtttgattgcgctgtggtctgagagacagtgtgttataatttctgttcttttacatttgctaaggagtgctttacttccaactatgtggtcaattttggaataggtgtggtgtggtgctgaaaagaatgtacattctgttgatatggggtggagagttctgtagatgtctattaggtccgcttcgtgcagagctgagttcagttcctggatatctttgttaactttctgtgtcgttgatctgtctaatgttgacagtggggtgttaaagtctcccattatcattgtatgggagtctaagtctctttgtaggtctctaaggacttgctttatgaatctgggtgctcctgtattgggtgcatatatacaaactaccatcagagaatactataaacacctctatgcaaataaactagaaaatctagaagaaatggataaattcctcgacacatacaccctcctggatgtgcttcctgggtactaaaccaggaagtaccgaatccagcagcacatgaaaaagcttatccaccatgatcaagtgggcttcatccctgggatgcaaggctggttcaatatacacaaatcaataaacgtaatccagcatataaacagaaccaatgataaaaaccacatgattatctcaatagatgcagaaaaggcctttgacaaaattcaacaactcttcatgctaaaaactctcagtaaattagatattgatgggacgtatctcaaaataataagagctatctatgacaaacccacagccaatatcatactgaatgggcaaaaactgaaagcattccctttgaaaactggcacaagacagggatgccctctctcaccactcctattcaacatagtgttggaagttctggccagggcaatcaggcaggagaaggaaataaaggatatttaattaggaaaagaggaagtcaaattgtcactctttgcagatgacatgattgtatatccagaaaaccccattgtctcagcccaaaatctccttaacctgataggcaacttcagcaaagtctcatgatacaaaatcaatgtgcaaaaatcacaaggattcttatacaccaataacagacaaacagagccaaatcatgagtgaactcccattcacaattgcttcaaagagaataaaatacctaggaatccaacttacaagggatgtgaaggacctcttcaaggagaactacaaaccactgcttaacgaaattaaagaggacacaaacatatggaagaacattccatgctcatgggtaggaagaatcaatatcatgaaaatggccataccgcccaaggaaatttatagattcaatgccatccccatcaagctaccaatgactttcttcacagaattggaaaaaactactttaaagttcatatggaacccaaaaacagcccgcattgccaagtcaatcctaagccaaaagaacaaagctggaggcatcatgctacctgacttcaaactatactacaaggctacagtaaccaaaacagcatggtactggtaccaaaacagagatatagaccaagggaacagaacagagccctcagaaataatgccgcatatctgcaactatctgatctttgacaaacctgacaaaaacaagcaatggggaaaggataccctatttaataaatggtggtgggaaaactggctagccatatgtagaaagctaaaactggatgctttccttacatcttatacaaaaattaattcaagataaagacttaaatgttaaacctaaaaccataaaaaccctagaagaaaacctaggcaataccattcaggacataggcatgggcaaggatttcatgtccaaaacaccaaaagcaatggcaaaaaaaagccaaaattgacaaatgggatctaattaaagagcttctgcacagcaaaagaaactaccatcagagtgaacaggcaacctacaaaatgggagaaacattttgtaatctacttatctgacaaagggctaatatccagaatctacaaagaactccaacaaatttacaagaaaaaaacaaaccccatcaaaaagtgggcgaaggatatgaacagacacttttcaaaagtagacatttatgcagccaacagacacatgaaaaaatgctcatcatcactggccatcagagaaatgaaaatcaaagccacaatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaaatatgctgctataaagacacatgcacacgtatgtttattgtggcactattcacaatagcaaagacttggaaccgacccaaacgtccaacaaagatagactggattaagaaaatgtggcacatatacaccatggaatactatgcagccataaaaaggatgagttcatgtcctttgtagggacgtggatgaagctggaaaccatcattctcagcaaactatcacaaggacaaaaaaccaaacaccgcatgttctcactcataggtgggaattgaacaatgggaacacatggacacatgaaggggaacatcacacaccgggccctgttatggggtgggggtaggggggagggatagcattaggagatttacctaatgttaaatgacgagttaatgggtgcagcacaccaacatggcacatgtatacatatgtaacaaacctgcatattgtgcacatgtacccaaaaacttagagtacaataaaaaacacaaaacaataattataaacttctgtcaatgggtatgtaatgtataaagatgtagtcagtgacaacaatatagagacgtagatgaagatgtgtagaagcagagtatttgtatactgctgaaataaagttgatgttattaaaactaggttgttataaatgtaagatcttaagtaagatcttaattgtaatccccaaggtaaccactacaaaattaaaatacacataagagaaaggaggtaatcaaagtggtacactacaaaaatatcaactaattacaaaaatgaaataattgaaaaattgagaaacaaaaaacatatgcatcaaacataaaacaaatggataaatgttaagtaattgctttcttataagtaataaaatgcatcaaatcttcaattaaaaggcaaagtttagtagaacaatttaaagaaatgatctatctgtatgtgccacctacaagaaacttactttagatccaaagacacgaagaggctaaaagtaaaataataaaaatagatagctcatgaaaacagtcaccaaaagagcacttggatgtctcttaataatgagatgaagaaacagacagaaaaccagtatgaaaatagtggacatgaacaatataataaaccaattaaacctaacagatatatacacaaactattccgcccaacacagaagacccatttttgtattcaacatataactggaagttctagatagggcaagagttacatagaacattttccagcatataccatagcttacaccaaaacacaagccttaacaaatttaaggagacttaaatattacaatgtattttccttctgaacacaaaaattgtaaccagaaattagtaacagaaactggaaaactcacaaatatatgaagattaaacgacaaacttttaaacaaattgatcgaagaataaaacacaagggaaattagaaaatattagaaaatgtcttgagagaaatgaaagaaaaacaacacatatgaagtcacatgggtcatagaaaatgcagtacttagagatatattttaactataaccaacaaattttaaaaagcagaaaaatcttaaatttacaacctaactttacatcttaaagaaaaaaagcaagtcaaaccaaaatcttcatatggttgtgtgtgtgtgtgtatgtatttattacagtgacatattattcagctataaaatgagggcattatgctaaatgaaatgagccaaacacaaaaatacaaatactgtatgatctcacttatacatggaatctaaaaaaaaatctaactcacaacagcggagagtagaatggtggttggtggttgccaagggtgggaaatgggggaaataaagagattttggtcaaaggtacaaagttttacttataagatgtgtaagttctagaatctaaattatagcatggtgactataataaaaaattgtgtaatacttacttgacatttgctaagggagtagatcttaagtgtcctctccagtgcacacaagtgaatagtaaataaattcagtggattgatattttaattaattttattgtggtaataattctgctatgtatatgcaatctacatgtgctccttgaatttttaatatttttatctcaataaagctaaaaatatagaaataaaaatgtataagtaaaattgtacgcaatagtgaaaggctgcttgtccctaagattgggaacacatccattatttaatattatacgagaggctgggtgcggtggttcaagcctgtaatcccagcatttttgggatgctgaggtgggtggttcacttgaggtcaggagttcgagaccagcctggccaacatggtaaaaccctgtctctactaaaaatacacaaattagctgggtgtgctggcaggtgcctgtaatcccagctactcaggaggctgaggcaggagaatcgcttgaacccaggaggcagaggttgcagtgagctgagatcctgccattgcactccagcctgaggtacaagaacaaaactccatctcaaaaaataaataaataaataaataaattatactggaggttctagtcagaatatcaaggcaagaaaattaaatacattcacaaagattggaaagaaaaaaatgcagaagaaaaaagaatttgtatgaagcatggaaaatgacaatctgtcaaacagataattggtgttcacgaagtaggaatggaacaaataggacaaaaatattcatgcaattatttttaaaaattaagttgtttaagtaataaataaatttgttaatcacagggcatatcatattcacagtacaagttttaaaaagtattaaaacctttagataataaaaacatcactaagagagtgaaataacttatttacaaaatgagataatgtactgtgaagtatgtatcttgtaagagatttatatcaagacattaaaaaactacaactctacaacaaaaagacaaaacaacccaattaaaaacaggcaaaggatttgaatagacattttgctaaagatatgcaaatggccaatgagtacaacatgaaagttattaaaaaaccattagtttttaggccattgcaaatcaaaatcacaatgacataatgttatacctactagtatcactatagttagaaaatgtagaacaagagttgacgagtaactgggaaatttggagaatcatactttgttggtctgcatttaaaatgatgcagctgctgtggaagacagtttggtgataccttaaaatgttaaacagaattaccatatgacccagcattttaatttggtatcccaatgaatgtaaaacatgaattcagataaatgcacactagtgtttatagcagcattattcataacagccaaaaggaggaaataacccacgtgtgtctatcaacagatgaatggataaacaaaatggggtgtgtgtgcatactgtggaatataattgagccataaaaaagaaatgaagttctcatacatgtcactatatggatgaagcttttaaacattatgcaaagtgaaattagccagacacaaaagggtcaatgttgtatgattcctcttatacaaatatttagaacagggagattcacagagacaagatttagagtttactaggggatggattaggaataaaaaatggggagttgttactaattgccagagtttctgtttggattgatgaaaatttttgaaaatagtggtgattgttgcacaaaactgtaaatacaattaatgccactgaattgtacacttaagaggttaaatggcaaattttatacattttacaataaaaaatattaaaaatgtgaattataattttcataacagtatttttatttgtgaaatttttttacaatttgctttttttttggtatgttctacatttttttccatgtactaagtatcgtgggaagttccaacctcatacttatgctgcttttctacttgctaatattggatgcttcttgccaggctccttaaattgtgctgtaacctggaagaaaccttcctactctccacaaaccctgaataatcctgagagtttaaacctcacctaattattctctatcatttagaaactagaggggtggaggactgagagaggaacagtataaaattcgaaaccagtgatgcattggctgaaaaacactgacatgaattgtgagagcaaagaaaccacagctggttttgcaggtgcagtccaggtgggccttggcagctgatgttgaattgtacgaattgtagctcttatattttctgggctacagctgatactgtaggttcagctaaaatagtaaattactaggaggcatcattaagttccaattaagattcacttcaaatcaggtagctcttccatctgaatgttttttcaaatacagctcatgtccacatgctttaagttgtgcactaatacatatcagtagtacacaatttgtggcaccattagtaataagatttataggagtgctataattccaaactctgaaaataaaagaactgcaaataatttatacagatactctgtcaccataatttcctgctttttaaatgtctgctgcacagagtgacttcatttcaaagagcactttatgagaaggaaaagcataaagggtaactttaaagtcaaaatcctgaaaaagaatatcttagccaggtgattaaaattaacatcaacagtgataagcccttttgatagtatgtagcattgatatgatgtgaaaagaatgtcacttcatctctgtggccttcctccccaaaatacatatccctagttttctcaggagataagcatcaagcaaagcccaagtgagggacatactacaaaatacctgaccactactgtaaactgtaaggtgggcaaaaccaaggaaaacgtgagtaagagtcgcagccaagaaaagcctgtggagacatgactactcaatgcaacatgatatcctgatgagactctggaagacaaaaagaatattaaatacaatataaggaaatttgaataagttgtgaactttatttaataacatattgtatgggttcaataattgtgacaagtatactacagcaacataagatactacatagggaaactgtcaaatatataggaactctttgtactgtcttcacaatttttctgtaattagaaaactattgtaaaagaaaactgtattttaaaaaagcattgttatattaaaaatgacacaaaacatgtgcagcagatgtgggttggagccagaaattctgcatttgtaataagcctacggtgctctttctgttgctggtgctgcttgcctgggtctcatggagtggcaggcatagagtggcctccaggtcaggagaatgggcatcatgtggaacttgttagacatacaagtcatttcatgtcagatctatcgaattagaaagtctagggttggggcccagcagtatgttttatagcaacccctccagaggtgctgatgcgaatacataaggaaaattgatctaaaatccaccactagcatgttattctctcccccttttttgttggagtgggagtggaagataagttggaggtaagggtgtatatttgaaaagttaattcactgaataaatagttataaaaaatttacatcttgagactgaatttcatgctaaagaaatggatttatgcaatttgtccatgaacgtctagtcactgcttatgcaagctttccatggctgttcattgacagaaggttggctgatttatatcaccacataaaaagagcataaataataatttatcaatcatttgtatctcctgaaagatctacaaattatattttacaaattaaaaataaattactattggattcccgatcagctcaggaattggattcctgattctagctcagtcatctagaggtttaaatgtatctttttattgaattttttgtttagttactagatacacatataaaggatgtaattttttaaaatatatcatataatagcttttaatttcatttttgtttttcttgtataacctattctctatatactcacgtattttggcttaatagtatgtttgataatttattcatgttgatatgtccacaaatatattggaatttcataaaaatttctttggcaaagaaggcacaactttcctgttcttcagaggattgttcctttctgatatttgtaattacaaacgatgataaaataaaaacattgtacaaatctacttttgcacaaggatgatgatgtctatagaacatataaccatgagtagaaatgctggacccaaagttatgacaatattttactttcctaggtattgccccaattttctcttagtgcatattttaatggatttcccacttaccagtttttgaggtatcctattgttccacatattcacaacatttggtttcatcgaactatttaatttccaccaatcacatggaattgaggtcaccacatacatttccaaagcatattaactggatattatgaggttgagtatattttcaaacatttgctgacttttcaacttctgatctatcaattatttcatcatatctcttatttttttcttttggcacatacctttatatgaacatttatattgtaactgttaatctacatgagtgtgtgcactgcaaatatattgttcaggctgcagcatgtatttttaatttttgtgttgtcgtttgagaaacagaagattttaattttgtttagttaacttcattactttaactttatagtttgtatttcttttttcctcttgtagtaaccctttccttactcctttctgtgtttaggttggcaataagacttttcttattttgttttcagttaggtttgtaaggcagaagttaagctgttaagctgtgagtattattgcaagtaagcaaacacttgcacatcttgtggtttatctgcaggctcacctgactggtatggagcaaaagccaagggctttggttcagtcctccactgctcatcagatctcccatttcagcttcctgggccaggtgcatgtgcagatagatccagctcaaggagtatgaacttctcctcctgatcagctgtcatgtcaagggtagaggcagtgagaacaagattttaatttgtctttatgatttctgaacttactctcttcactttgcatacatcttttcttcttgactatcagccaccatacagtgactccaagtccactaccagatatgaagacaaccaccttccatggacttcttcactagcaccacgtgttgttcttggttaatggtgtctcttatattctaatcgatcctttttagctctttagcatcttagcttttcaaaaaacgtgaaagatctaatctttaaaataaactcttacccatatcattcgcattgattcttgttccctagccaactcaaaacactaagtttaacttttcaagtaatgtggctttacacacgtaaattttgaatacacagattattaatcaatgtagaatttatatttttgcatgagataaggcacttatttggttttcttttaagttctataggaaaacaattgacccagcatcacaattaaataggtcatcaaatgataatatgcatatgtctttctctattacttttcattaatttatatccctggaactattccacactgtcttaaacattttgtaatttgtaatgataatgtatgttaatattcaatagtatatatcatgccaccttgctcttcttaaaagtgtctttttgttttacattttgttgcaatacatatatgtatgaaacttatgatactaagtcttcctactactatatatacatgtggtatgtagcttagttcatttagatcttgtgtgtttgtatgtacatgatttattcattcctatgtataaaatacatgtccttttttattttaaatgatatattttcatactttctattcgttactctttttttttcctttaccctaaggaaataatttagcaaaggtttatcctccattcaaattcaaattttccttaagttggttattcaatgtcctatattggtgaattggttagaaagatagaaattctaatttaattcttacactaagttaaatttagtatataatcatcccccatttatacagcacatatgcttgttatatatcagttgactctgttttctggaatccaaactggtacagaattcaaccaggccaagttaatggtaaatgtttgcccccctttaacatctcaataatgaaaatggcatatagacaacaagatttccctgttgagacataggtggtaacaagccaagtctcttctaactataagaaggattttactaagagcttccaaccccaaatagttaattatatagtgataaagaggtcaattctttaagaagttatctaactgtaaatatatatgtgtatatatatgtatatatatatgtgtatatatatgtgtatatatatatgtgtatatatatgtatatatatatatatgcacctaacatcagaacacctcaaaatataaaccaaatattaatagaaaggagagacagggtacaattcaataacagtatgggacgtcaatacccagagacagattttcagagaaaagatattgaggaaatgtcatatttaaattacactttagagcaaatgaacatgatacacaaatatggaacatttgaccaagagcagcagaatacaaattcttctcaagcacacacaaaatatttccaggagagatcacaggtaagaaaataagtcttaacaaattcaagaagattgaaatcatatcaagtatgtttttaaaccacagtgttatataactagaaatcaataacgaggaattttggcaaattcatatattcataaaaattaaacaacatgctcctgaacaaccaatgtatcaatgaataaattaaaagagaaatttaaaataccttaaaagtaatgaaaatggaaatacaacataccaaaacttatgggatgcagaaaaagcagttcaaagagggaagtttactgcaataaacacctacctacctcaacagaggtaaaagatcttaaataaacaacttttttaatgagctaaaaaaataaaaacaaagtgcaaaattgccagaatgaaaaaataataaatatcaaagtagaaataattaaaacagatactagaaaaaacaatggaaaagatcaatgaaactaagaaatgttttttttttaaagataatcaacaatactttagctaaactaggaataaaagagagaagactcaaaatcaggaatgaaagaggtgacattatattagataccatagcaatacaaaagattatgagactaatatgaataactaaatgccaacaaattggataatctggagaaaatcaatacatttcttcatacatacaatctaccaggactgaatcacaaagaaatagaaaatctgaatagaaaatatcaagaaaagatttaatcagtaatagcccaggacccaattacatcactgctgaattttaccaaatgctaaagaatagctaataccaataattatcaatctttttgaaaaaactgaaaagggaataattccaaacttttttacaaggccagaattatcctgataccaaagccagacacggacattacaagaaataaaagtacaggccaacatccctaatgaaaatagatgaaaaattcctcaacaaaatgctagcaaaccaaatttaacagcacattaaaaggatcattcccttttagatagaagaaacaaacttcaacataacataaaggtcatcttcaagaaatccaccggtaacatgaaactccagtgaaaagttgaaagtttttcctctaagaccaggaacaagacaaagatgcctactctgccacttttatttaagatagcaatggaagacctagttaaaaaaaaaaaaaatcaggaaagaaaaagaaataaaaggcatttgaattggaaaggaaaaagctaaatagtccttgtttgcaggtgacataattacatattaaaaacattaaatattccaccaaaaattattagaactaacacacgaattcagtaaagttgcaggataaaaattaacatccccaaagcagttgtgtttctataaactaacaataaactatcagcccccccataaaaatcaagtgaacaataccatttaaaatagctatgaaaaaataacgtacttaggaaaaaacaaccaaaaatgttaaagaggtatatactgaaaactataaaacactggtgaacaaaattgaagaaaactcagataaatgggaagttatctcacattcatggattcaaagattaatattttcgaagtttccaaactgcccaaaaggatctaaaaattcaatgcaaaccctatcaatattccaatgtcatctttcacagaaattgaataaatatccccaaattcatatggaaccatgaaagattctcaatagcaattgtcggtgaaataagcaaagcaggaacatcacactaagcaggaacatcacactacctgacttcaaaatatactacaaagctatagaaaccaaaagagccatggtagtggtataaaaatagatgcataaatcaatggaactgaatagaaacttcaattcataaatttataatcaattgatttacaatacattgatgagaatacacaatggagaaataacagtatcttcaataaatattgtttctacaactggatattcacacgtgaagaatacaattagacattcttttcacatcatatacaaaaatctactcaaaatgtcttaaagacttaaacataagaccgaaaattgtaaaactactagaagaaaacaaaaaggtaaaactccatgcaattgatcttagcaatgatatctttgaataggaaaccaaaatcacaaacaacaaaagcaaagatagacaaatgatattacatcaaactaaaaagcttctgcacaaccaacattacagtcaaaagagtgaagagacaatgcacagaatgagagaaaatatttgcaaaccatacatttgataaggggttaatatttaaaatatataagaaactcaactcaatagtaagaaaacaaataacctgattttaaaaatgggcaaaaggtgtgactagacatttctcaaagaaagacatattaatcacccacagatatattaagaaagtctcaacatctttagtcatcaggtaaatgcaaattaaatccccagtgggacatcatctcagaactgttaaaatggaaattatataaaaaaaagataacaagtgttagtgaggatgtggagaaaagtaaacccttgaacaatgttggtgggactgtaaattagtacatccatttggaaaatagtatggaggttactataaaactaaaaatatcactaccatatgatccagcagtcccactactagctatatatctaagggaaatgaaattagtatatcgaagatatcattacacccatgttcactatagcattatttttaataacaaagatatggaatcaacttgtctatcaatggatgaataaagaaaacatggtatacacacataagggaatattgatcacttataaaaataaattaaatcctgttatttgtgacaacatggataaacctggaggacattatattaagtgaaataaaccaggcacaggatgataaatacaaatgctcaagtatatgagaaattttaagttaaatttagaagaagaatgatgggtaccaggggctgttggtgggagcaccaagtggcaaaggaattgaggaaatgttggtcaaaggatacagaatttcaattagatggaagggaaaaaatatgttgctttctcaaatgtttactgcaggcttagatattgacttagggttaaacttagtgcaagaaacagtgaagttcaacataagttttcacataacagtagtgtatttcttgttcatgtaaatgaaggaaggtggaagaacaagactaggattgtagctccccaatgctcaagaacacaggttctttccagttcatcatcctgacatccccatgtgtgggattcattattataatctattggatggctactggtgactgtaatatttaatctgcataccagaaaataaagtagaaaaaagaaaatgagccatgggacctgcctaatgactaaatgtttttaatgagcactttcctacatctcattgactaaaatgtggccacatggaaatatctccacagaaagggagtcctggaaatcttgtctttataacagaaaatcatgtgcagtctctgctacagtttaccaaccacatggttgcatggtttctcaaaacaacagattgagggagattggcacaaaccacttttgccatgtgaacattctttccctgagctataagtgtaaaacattctaccttctcgaggaatttctaacggacaaaaaaaaatatgcttctgtcataattttcctttagttcctattcatttatttttatgaaattaatccaattgacaaatgtgatatatttggaatcatttttattaatgtgtatagaatgccattattaaagcaagaaacagactctgctcctcattcctcatgaagtagtgagaggaagagtgtcattttctatactttttcttcccaaataagaagcacatgaggaaatgtctcctacttcctcatgtgcaaaagtaagatacaacccaaaagacaggaaaagtggtatgcaaaacttccaaagctaacttaaatcataaagcaaaattcagaccatttccatcaacataattttggattaatttcagttattgcttatatgaagttctggataaacaggaatttaaaaacacacacatatgcaatttcttagtataattcaaacaaaattcatacaccatttaatttcaaattaaatatgtggagtattatattaaaaagacacaaaagccattaagaaaaaaattcagaaagaaatatgagaaaacatatttatgctaatttgatgctgttaaattcctaatagtcacagcaagaaccgctaaaaattatgaccattttctaaactaaatattataccttaaaaagactgtttcataaaaaatttgttttttatgcataattccaagctcatatttcaaacaacatccttactcatggatatgggcaatatggtgtagcttcttgctgaccatccctgcaataattcacaagtttcagcttctacagtgcagctgtgaagtcagtagggagtcattcagttatttgtgattttagccatctgtcagctaaatccaagcatcaaatgcaaaattgtacacatggggatattatggggatttgtgtctcgccctagaggatattggatctgcatacctacaaaagatccataaatgattatttgcataagagacatctattccttttccactaatgcttatgctatgctaggtctgagaattttcaaaacagaaggagtccctgtaatcatgaaaaaactgaaaatggatcctacagattactttggcatcttctttagaaaatgtgtgatttctgagcacagcatgacattaggatgaatactacttcttaattgaaaatattttacagtaccagaggaaataaaattagattgaaaattattcagatccatatgaatttaagtggaagacttcaaaataaataaacatttcagaggtctgcaactatgtaaaacacaaaaacatacctcactgattgtacagaactacttgttagcgtaattcttgcagtgtatttcaatttcagagagaagagttatgttaactgcagtatttaccacttacaagctttcagtcacatatactgtgaaattttgttttgtgtataattaagaaaaatatatggatcatttattccatacatgatactgtttcaacactttcagtttacagtcagctagaaatttaaaggatgcctggcttctaatactaaaaggtacattttaaaacagttttgagatattgattcttcttaccttcttgaaatgttttttactttattttcctagcatcatataatataaaggatcataggccagaaaaatttaattagccttatagccttccacttatgaaatgtgtgcttagattagtaatttacaactcaagaatcaatttcttcatctgaatttcaaaagtaatgacaagagctcttagaactcaagtaaatggtaaacaaggaaacatatccgtatatgtttacgctattgataataaaacagcaggtcccttactctctttagttaatattggcacaattagtgataatatattaagatattttccataatcagatcatatgtcatactgaggtgtaaaatcaatttccctttactccaatctaaaatactgaatatgcataagactgaatttttgtgtcctcacaaaattcatatgttgaaatctaactcctaatgtgaaggtattcacatgtgaggtctttggaaggtgattatatcatgaggatagaactctcatatgtgggataaattatctatgaaagaagactccagagagctcccttgtcccttcttccatatgaggaacatattgagaaaagattctatgaaccaggaagcagaccctcaccagatatgaaatttgcaaaacccttgatgctggacttcccagcctccacaactgtgagaataaatttttgttccttacataccacctggcctgtgacattgtcttatcactactcaaatgaactatgataccatcaataacaatgcaggaattctacatacgtatttttttaatcttactaaaggaaacaccaattttaaaaagaaataatttaagatggtacttaggagagatcttgaaacaacaatacttctattaataaataattatcttttttggttatccattaaatgttttaggaacatcttcactccaattcaacccattgtttttgtagacaagattgaattttgctgcacaattctctatttatgcatgaaagcacttccaatttggtggtgatagtcctgaaccttttccattttgaataaaaataaaaaaaaattgagggcagtaactgacccaatagcttagtaactatcatgattttctactatagagttaaaagcccattatcaaaattgatgggatagggaagccatttggatactacctccgtatttaaaaacaacaagaaaaaacatttttttcaatgtattctaaccttgagaaattaaaataaaaataagcacatcatgatttagagcagaaatactagaacagagacagaacttatccaccaagttagaaccttagaatctgaaatagtttaactgagaggtcaaaaatctgctcttccatcttctaatgggagatctcaggcagatgcaagtatttaggtcaaattacttttaaaaacttggggcaagtattaatgctcacctatttaggtgtgctagatattgttgctcaatatatagtaaggtctagctatgggcagtaaagatgttctgaacttgatactggaggtttatgcagatgtagaagtaaatagggtcaaggttgggtattttcaaatagaaatagtgtgatgttccccccttcctgtgtccatgtgttctcattgttcaattcccacctatgagtgagaacatgcggtgtttggggtaactaagctgcacgttgtgcacatgtaccctaaaacttaaagtataataaaaaatagaaatagtgactgtagatactaatttgtagatccattgcctttgtctgattttataatttcaatgaatactatgtataagcagtgtgtaatgccccatccattttaaggagctgtctgtttgtacctcagttccaattggccaacctattaggaaactggaattgttcaaggcaaccacaatagtaaacattgaaaaatacacaattccagagttaaaattcttaactctgattaaagaaatgtttgtagcaaatgtttttattctcagtaactctttttttacctgacttctgactactatgctaacctgatacttttatgctagaagatatttcatatagttagttatggtccatttgaaagaccattgataggttgttactaggcatggccaaaaatactctcatcaatgaggcaatgtcatcagaaatttttaagggtagaaatactgatcatgttctgtgcaatgttagagaggtattattcaggagagggcaactcaatgaagtttacttggaaagtagcagtggtgtattcgaaaacctctaagagaaatagctggcaaaaggaactgccacatacacaggtaggttactttactgtcattggggccgaatatagggcaaccagaaaccttcctgccacccttactacatggtctgaacattatgtttctttgtcagtagaaacaaaacactgcccatttaactaataggaatgcctgaattaagagtcactgattggctggctgagaggctaagttggaaacaatttcacactgagtcctcaacttatacaggttccacctgaaaggcttccataatcttaaattacactttcttttcagaaacacaatgcgtgatcatagaattgtacttctatgtggaagacagaaattaaagtgtttcctttcctaaaacattgtgaactataatttgggaatgatcataagagaaattgaattattttaggaaacatcatcttttgctcctgtagtcctaagatgactgtaaagatctctctaaggaccattcttggttaattggtggggtttctatagggattactatatttatagtgtgtattttataggaagtaatccctacaatggaagtcatgtaattggactttaaatgctgtactgaacaaactaaatgtatttggttccatctctgtcacaaaaattagaatggacaataaagtggcgtactcaaaaaattatccagaagtaaagacagtgtagaaagaaaaagtgaatattttggggagaaaattttcagtgggcctctcttgtgtctgctgctttgcaagtaaggaaccagctgcattttgttctgggaaatctttataagaatgttcgtgtagggatgtagggaactgcctaggaagatagtgtctccttcaggaacaaagaaaacatttgcttacagcttggaagataagagatcatctatccctttggaataaagagcagaaatatttacacacgaaatattcagattgcctaaaatcataattccttttatttaaaaattcccctctgcatcggcatgtgtctgctggatctccttccaatcattctatacaacccctgatactcaggtttttgctctcactgggagtaaaaatatttccttctgtctctgaccaaggaatcttatatcttctaccaggatccatgaaattttggcaggcataagtgtttgttgcaaatagtgcaaaatctcagattattccagatcggtacaactaaaaattccatctggataattcagataaaaaatggcaccctttcaccatgacacgccattgtctcaattgaccaatatacaactacagttaccattaagttcatgatttataggctataagttaatagattaattggataattatcgtaattgaacattataccactggcaatggcaacagctttcttaaaccatcacacagaaagaactattggtattctaaatagtatgcaacaaatatatttaaaaggtaggattgctagaggtacagaagctgatgatgattaatggaaacactacagtaagtctcagggcagaacatctctgaaaaatgtagtcttcatatttaatatagaattagctgattaacataattaaaaatggaatttgactttctgtagcaactggctggcagtggatagaggaagaaaaaacatcatcaagttgttgtgataggagtggatgaatagtgaccaacatgacacctggaaatcagtatctatggaatcctgtagaagatacctgaaatatgcttacattcacaaaccagtacaacctaaacttgctggtcagtatcatgtggtcaaaggatctgtcactggcaatatgcggtacatgatcaaagtttacttctgctgcaaagaattgaagaacggtactgtaattttaattgatgtatggcatgtaaaacattgctttgctttctgctacatgtgtgttataaccaaaaggttataattttattgtcaaaattaaatgtaattcagacttatgtacagcatgaaccatagaatgagtgaatatttctggaagcttatttaaagcctctaattaatgtaatacttatgaagagttactggctagaaaaagacatttggcttttaaaataccacatgccctattataatcttacaaatattcaaatgcctatgaataaaaacaaaaaaaattgagctagaaatacacaattaaaaggccttagaaggaacacagttattaataaaaatattacagcaataactcctgaaccccattttatgtttcaagtccagatggtcattgaggtgtgaagtatctttttttgaataaaattttgaggaaattttaagacacattaaaaacacaaccaagacatatgtgtcaaagagatactgacagagcttagaaagtgtctccagaagaaaagagttatccagagacctataatccattccgatcaaatctcctgaaagatatgctagtaaaagagatttaataaatatactatttactaatagaatgtagattatttgactagaagttcttatgacaaacttgtaatccatagattttggagacaagggaatatagcttcctgtaacatgtcatgaaagctttggtatgtaaaataagcttttttcttgatgaaaatggctttcttttatgtaaacaataataacatctagcacttaggaaactcatatatcatatacagctggacatcactgtttcctaatgaggctggaaggaaaataggaaaaaatatctgtagctctagacttgccatttcacctgtgcttcacaactacttctactttgaaagtaatattaaagtttgatattgggtaagatctgagattcctgtatctgacttgatgatatgatattttctgttatctcaatatacatacatctcaatgtataattttttgaaaggcatacacgttacctgaatgatacaagtttccattggagttttgtttcattgtgttttgttttttatcaagggaaaataaagagggagaaataaactgtcattactcaaggagagcatgcacaatacaactttccagctctaattccaaagtttgatttctcttatttgaagctcgtgatattttgtttgctcaaaaatgggaaggatggggtggttaacagacttcttgttggaattatttaacagacttatgtaatttcctgagtctgttttcttttccatgtttcaattgtgtgatgggaaagtgagtcatttttctaaggactaaaatacaatataagaataaactttataaacccaaagagtttgaagacaagaatatctgaccaaaaatagacacatttccccttcattgttgtcatctgcaaacacccaagacatttttctacttatgaggttcttgagtcttggttcacactatttctttctatcccttttcctccatgagatccatatccatatggaaaatttgcccataattctggtctccaaatttgtgtagcccatcaacaaaattatactttattttccacctttatcccccaatctcatagacaaacttttcaacctgtcagtataataaatagcataatttctgaaatatctaattcaagtatcctgtgatttgaaacaccctcctatatttcttgttcacttaagtggtaacactttcaaaatctctatcattccaagacactaaaagttttaaaagaaaatggtgctttcatagatttggtgctaaaactcactttgtggtaaaacctgacatgattgacttcattcatcacgtttttatggtcattatttttcttatttgatgtgactatgcatttgttcagagcagaaaaagaatcatatttaattagcaggttcttctccaatccttcttggagatgttccataaaaaacttaattatttaagtctaaatcatgctgaattatgaaacaaatttggttccaaggatttcagacaagtgattgtataccaggaatacaatatttatttgaactcgccaagacttaaaatcctgcgttcagctactttttatcttattatcaccatacatcatctttcatgcctcctgtttagaataacaagtccatcattacaagaaaaagttgcaaacacaaggaatgttttcttctcttattaacaaaacaaaacagataacttgtctgtgtttttcctgggtgcatctctgcagttgaaatatcatgaccaccagtcctctttaaattcatctcaagagaggaaaccacagacactcagcttgccttctagcaatggtaaattccttaagctaagtgtttcctaattgctttattctcctttgaactcactcagtttctctcctgttgctcatgatggataatcagatgtgcttacctccaccgatttattatccagccaattgaaaggctcaaatagaaaatgtcatgcttctccccgaccaaaccatgaattttgtcttcagttcctcactctcattcaatttcaattttttaacaatgcataataacctgaaattctcctacttacttgttaatttgactgttgtctgtcttcattacagctggattagaaactacaataaagaaaaaaaaaaaaaaagtttcagccttattccttctgaagtttccaggtctagaatagttcttgtaacagagtaggtgcttaatttaataatataatttaaccttaaaatcctgttttattacaatctacttaaagtggactcctagttgtgggtgaatgagtctaatttaaaataaagagataaagtttctttttttttttctgtgccaacaatcttaaaatacaaatttaaaactgtgccttcagttttgcttctccttaaatacaaaattggcgcttgataaaataagttatatttacttttcttggaagcatttccgtttgaattatgttgaattacctgaatcaacagagcattttcaagatataaaaattttaaaaaattagatgtatttctcattgccagattaaaattctctttattactttaacactttatgagcttgtcaggtatagaatttggttctatctgatctgaaagttaattactgtttatgtgagaaagttgattcacctaatatttctttgcacaaatttgctagttttagattcgagacttcaagtgtaaaaataaagtcgttaagtacattaaggacaatatgtttttcaagggtccttccagatgcttgtttttgtgattatattcgttaaagaagaaaggaaagaaacaagagaagaagaaaaaaatgagaagaaagaggagaaagaaaagaagagtgagcaggaggaaagacgaagtaggtgctagagaaactaaaggtgcatagtctccagcattagcttgtgtactgtaacaccacaatcatgaagttttatctcatagcctctttatatactgctgttggaatatatgagcctttaaacacattttagaaggttttgttagctccctagatgctgaattaagggccggcacaattttgcattgcataaaactgccacccagggctccagatccttcttttagtgtccttttcctcagtcagtgtctcacatttcctgcttattccctctctcccagtacttgactgtgcttattactgattcacactttagattcaaagtggttttttttcccattctcttaacaaaactgtgcttttctcaataactgtaagccttatactaagataaagcctcggagtaaagttgttctaatttctttgaccaagcctggggaaatggaaggagaaaatagaaaattcaaaagttgctcccccccaccgcccgatataaccagtttcttgaccaaaaaaatagcaaggttgggaattcatatttttgcataagaagctatcatgcaatcagggatcatatagaaagtaagccgttacaacacagaatcgtatctatttcttggaacaagaaatagaagaaactgtaaaagggcactgcagatggtcccttgtcaatttctagctaccaacaaccacggcagcaattataacatttaaaatagtgattccttataatttactctatcatagtagtctcccctggaagcacccacacttttatcagaacacaataattaggcctgcttgggcctttaccatatatttcattacacttgagtatacaatgcgtgaagcactcatctgccatcttcactgtaatgtgtgctttaacatcagtgagcatttttaccctaaagacagtcaacatgtgtgttttgactaagtatcaaaacttttctgagtgtttatcagttatcagttcttctcacaaataatattctaaacagtaaaacacctgccacaaaacatcttggacatttgtaaaattgcccgaagcttaggcttacaaattaaataataaaatcaggccttgtaaattactgagtacaaaggcagagcgtgggattgtggacaaatgtgatattttgagctattataccctttatataagttcaccaacgtaatttgattttacaaagtagggattttattgttagtaatgaatgaattgactctcagagagttgacatctaaattggagttcaattcttcagataacttcctggaataaccaatagtagttcgaagtaaagtactgagacaaattgagataaattcatcaaaaggaaaatagattgtaaacaactaaagttactttaagaactttgattaggactaccaaaacagaagttcaacattcctaaaattgtaggttaaattgtaaagatttggttggtaaaattatttaagcaggaccaataattggaggagtaatcaaaaattatctttatcacttcagaatgatactacaatgagagaattttctaaaaaaataaaaaaaacaaaaaaacatggtgtctgtggcatccattcctgttttgtggtatttttatgttaaattcagagagaaaactgtcttataatgaagactgaaaagcataatcagtgaagataaaatctgtaaatgcatgggtaaatctaaacaattgttgacacaaaaactgaaatgtcctcactgtattgatgacttttagataaaataagagtagtggataataaatttttgttattgagaaatgtttaaaggtttaaatatagtgtgttaaggacattgcattatttgaaaagaagttggataaatttacttcaaattttagtgaaatataatttttaatagctatttagagaaattaagtacaaaacttcaaaatgatagaagaaacatgtaatcggcatgtagtatatatgactgaagagaaaaaataaaaacactgaaatataatatggggtaaataaatcttaacatataatatttccatattaataaaaatgcttagaactgaataataatgcaaacgttactgatatagattgtgggatgctgatcaaatgatacttagaagaatatttatccttttaaaatcttgtatatgaaaaaaatgtattgcatttagttacatttgaacagtatataggctaaaataatatgaaataggaatatcatttgaagagatacaagaatgatgcaaggaccttataaatagtttattgaaaaattgctgaaacaggaaacaaatatttaatagagatgaacagcaaagccaaaagacggttctttgagtagaaaagagcagcgaacatttgcggcagcagttttatgttgtcaatgtcaggttagtttttgctaatattcctttggagttctatgtgatgtgatgaaaacattttatgttcttccattatttgtgctatataatttagactgacgtaattcatcactttatatattcttcccctctacacaccttctgaatcacggtaggtggtaacttttcttacctttttatattgtggagagtactcaaaaaaaaaaaaaaaaaagatggctggatcatagggcagttctgtttttaatgttttgagaaacctccataatgactgtactagtttacatttctaccaacagtgggcaagagtttgttttcaacacatctttaccaacacttgttatcttttgtcttgtttaataataaccaatgtgaggtgatatatctgattatggttttaatttgcatttccttgattagtaatgttgagaattttttcttattcctcctgtatgtcttctaaaggaaataaaacgaatacgttgaagggatacctgcacactcatattcatggcagcattattcacaatagccaagatattaaatcagtctaagcatccaagaaggaaatcccatcatttttggcaacatggattaatctggaaaaccttatattaagttaaataagccagccatagaaagacacataccacaagatctcacttaaatgtggaatctaaaaaagtcaaactcacagaagcagaagtagaactggtggttaaaagggagttggccaatgggtgggtgggtggttggggcagactgaggagatgaaggtcaaagaatacaaattttcacttaggcagaaataataagtttaagagagctattgtacaacatggaagctatagttaataacaatggatcaggtactcaaaaataactaacagagttaatgttaaatgttctcaccacaaaaacataataagtatttgaggtaatgcctggcctgtgataattagtttgatttggtccttccacaatgtatgtatgtatgtatatgtacgtatgtatgtatatgtgtgtgtgtgtgtataaatctcaaaatgccttattgtatgtgataaatatataaaatttttgagaattttaaaataattaaatacacacatataaaaaggatgaaaacaaaaaatcacgtatattttattagaaaggagagcataaaataagtagatataccttgattataagattttaattattaaatttctctagtattagcacaaagattgacatatcaagtaatagagcagtggagaaccagactcagtctttctatatgacaagttaaagattggtcaattacacaaatagcactaataaaagtcaataatatggatcaaaatatatcacaatcttaagcaatacataaaaaattaattcaagatgaattaaagacatacttgaaaagaaaatctgtatacatttttagagtagtagggtgttatgtttatgctttgaagattataaaaaatgtatttaaaatcaacacaaatcaagaaataaatgataaattagaatacatcaacatttaaaatttttgctcccaaaaagatgtcctaatctgcaagaaagtatttaacacatagactagattattagtcataaaattcagaaaaatacacaaatcaaagaaaaataaaaaaattccacatttgtttatacatttaagagaataatctcacccaaaacaagaataaatccctatttccaaaaagaaaatttgggaaaacagcctaatatttaaacatttttgtaaataaatattgtaaaatagtaatccacaatgaaactgaataaactgaagctacatataacaaaagtatcaatcaatgttcaactaaatcaatattgaattgaaaaagccggtggaagaagacacacagatgaaatgtgtagaaagtaaaaagtgtaaagcatgcttaggcaagagatataaattttttaaagttacaggaatgatttaaagaaaatccaggatagtggttacattagaggtggagagggatgttatcagttaaggtaaacaagaacttcaaatgcacatatttagtgtaatactaaaatgtggatatcagtgcattaatatttaatgcattattctttttgaatatttaaaatattgcatgataaattttagctggactaatactttatatcttcttaggttattctgagaattagtggttatataagtaggcataaagcatggtatatggtacaatcaaaatatttttattgttattgaaattatgatgtttacagttgtttaggaagacttcctagtgaatggactcttatgatagcccatttcaaaacccgtgtatgacaaattatatttaaatatttaaatataatttaaaaacacttttctcatcaatatacaatttcattgcaatttcagattatagtaataaacttatttaaataatgatgttaatattacatttaagaaaacctgtgtttctatttgctttaaagattattatttgaatttgatttcaatttaattttcaatccttaaagttgataatatgtagactttattgatctctttattatgttctgctttcaagttagaaggtgaaaaacaatagaaaaaatgtaattaatgaaaggatttatgtgaaagaaaaactatgaagagctaaaatacaatataaatatgattatagtgaaggaagaatgtcattatattaaatagacagtacaatttgttttttttcttttgtgggtttcttgtacatgtgccttaatgtttcatatgtttcctgtaaaaaggaatcagtggagaaaacatcacataattaggatttataacctatggaactaaagacattcaaactatagttatagtcttccattatggttccacaaaccaaaatcaaggcagaaccaaagaactcttctgtgtaatgaccaagtgaagggatatacgtagacaagacaaggccatttcagaaaataaataaataaataaataacagtaaaatagaagcaatctatcaaaataatttttatgtactgaacattggcttggaaacaacatggacaatcaagttcatagacagacaataatgtgccaaaattattaaaactcagataaattgaacatcttctggcccctttaggaaacttccagtttcagctcagacatgaaaagagctgggaggtcatcgcttacatccttacaataaacaaagactggacaaaaataaaatcaacaaattttcttggacatatcagataattgacttggaaaagcaaattgaggtggaaaagaaaatcactaccccaatatctagagagacagactgatccaggtaattacagccaacttttatttacctggggtagaaaccactgcaaagaaaaactgttaggacatattatataaaagtcctaacatatatattgtatcctttctcatattatttaataaagtgtgagcattacaaaacaacaacaaacaatagcaaaaactggaatgtacacttaaatagtaactatgacaaattgctgaaagatgattgtgaactgggtgagagtgagaaaataattgagggaatatttttagtggtccaatacatttttatgggctttacatccagaattcctaggagattctcacagtaaccgtttgagaaagatctcatggctctgataggggacaatgaataatctctgtgacatactaccagagttatctgcaaaacaaggccttctcttcagagagaaagactgtatgagctttgtcccagtcattgataagatgcaagaaaatgggcaatgttagcaaaaggattttaaacaaatctaagaaaggatcaaaagaaagtctagaaattcaaaaataatgtaatctacatatagaatacgtttttggactcaatagactagacatgactatgaaaagaatcactgaatttgagtataggccaaaagaaacttcccaaaataaagtgcgaagaaaaagaatgaatgaaaagaagaggaataaaatatccaagaactatgggaaaatgtcaaaatgtatatattcaaatgaaataaaatcagtatgtagaagagatttctgcactcccatgtttatttcagttgtacttaagtagccaagacatgtaaaatagtgtccaccaacaaatgaatggataaaggaaaaatggtatatatacacaatggatactattcagcctttaataagatggaaacactgtcctttgcaataacatgaacaaaccagaaagacattatgttaagcaaaaaacgccaagcgcataaagaccaacactgcatgttcttacttatatatgggagtttaagaagttgatctcatagaagtaggaaatagaatagtggttaggaggctggagaggggaggggagatgatagatgaggagagattggtcaagacgtacaaagttacagttaaatatgaggaatatgttttggtgtttattggacagtaagatgactataattaacaacaatgtatcatatatttcaaaacagaagagaggattcacagtgttctcaccacaaagaaagtttgaagtacttaattttctatttaccttcatttgattaatacacaatataaacatatattaaaacctcacattgtaaccataacaatgcacaattctacgtgtcaatcaaaactgaaacaaaccttttaaaagtgtataatgtcaaatttgaacaccagaatgagaagacagaacaaagcagaaaaaaaatacataaaatgctaataggtgaaaactccttttcaaaattgatgacagacaccaaaccacagttccaggaagcacagagaaattaaagcagaatatgtatcaaaaaatactattcctatacatagcatattcaaacttcagaaaaaaaagacacaaataaaattttgaaagatactggcacaagatgaaaatactttagttttaaagggataaagataagctttagtgctgatgttttgtcagaaacaatacaagccagcagaaagttgagcaaacatgtaaagttgaaagaaagaaaaaagagaaaaatagagaaagcaaaaagaaaaatagaattcaaaattctatgtccagctaaactaactttcaaaagtgaaggagaaataaatgatttcttaaacaagcaaacacagaaggaattgttttccagcaaacttgatttgtaaaatatgtccatagacatgaggcatgaggaaatgatgtaagtcagaaaaaaaatttacatgaagaaaaaaatatcagagaagaaataaatgaagatgaaggaaatatttttcttattgttattgatcttaataactttttaaaagtattaatattaagctgaaatgtgttgtgtgattatccatgtgattatagcacatggataaaaaaatggatgagtgctataacatgggagacaggaggaaggaacttggaactctccatcataagacacataaattacacacaaagacaagtagtgttacttaagagttgagttagattcattaaaaatattttaaacactagcacaaaccaacatatatattttttaaactgtgtagctgatatactaaaggaaaaagtaaaatgaagctatacaaaacacccaaatgaaatcaaagaatgcataaatatatgcctctgaaaaggtatagaaagtgtaataaacttgactgtcattaatctaactacataatttataactttaaatgtgaacagtctaaatgcagcaactagagcttattataatgaataaaaaattatctaataatatgtaaatttgtaaaagtactttttaatatgaagggtcagatagtcttgaaataaagaaatgaagaaacatttaccatactaaaactgatcaaaggaaagctggagtcactacattaattttgaaatagcagactttagagcaagaagaattattggagataaacagaggtgcaacataataataaaagtgtcaattctccaagaagatataattctaaatgtgtatacacctagctacagtggtaaaatacacaacaaataattaagagaagttaagacataagtaaacaaatccactattatagttgtagctttcaaaatagctgttaagaaggatgaaattgacataaatggcattataagtccatcttatgtatatgatatttatggaaacttccatccaacaaaaaaataaatacacattttgctcaaactcacataaaacacccaccaaattagaccacattctgggccataaattttattttacaaattaaaagaataaaaatcattcaaaatgtgttattaaaccacagtggtattaaattgtaaatcaataagagaagtataggtggaagacccacatatatttgtagattaatcaactcgattataagtaacaaatgggcaaaaaatatttttaattaaaactattttgaagtgaatgtaaataaaaaatacaactcattaaagtttgtgtgatgcaacaaaaatcaatgtttagtaggcagtgtgtcatattaactccataattacaaaattaaaaacctgtaaaacttggcaatctaaattaggacactaaaagtagcaatttaaaatgcaaacaagaagaagtaaaaaaaaaaaaaaagtaaagcagaaatcaatgaaattaataattgaaaaataataaaatcaacacaaccaaaagctggtttattgaaatgatcaatagcatcaatcaaccagtagtcagactaagacaaaaaaagataacacaatatttactaatatcagaaaaaaagagatactatagctactgttcccatggacattaaaatagtccatctcatccactaaacaagcacataagtaaaccaccacaaaagctagccctggcgaaggagtgatagtaagcatccataatgtctagaatatattacttataatgtcaagttttaagcaaatattataagctttgtaagtaaacagcaataccacataaacaggaaaaaaattagaagttactcctgttaaagccaacatatgaaacttaatagacaaagacattaatggactttaaaaatatttgtaaaaactagaagaattcatgcttacagaagtacaatgacaatgtcagagtattaagaaagatataaactactttttaaaaatcaaattgaaatctggaaatgaaaacataaaatccaagttaaaaatttactagagtgtcttaagagaagatttgagctggtaaaaaaaaaataaaaaataataaaacttaaagatatatagaaattatgcaataaaaatcaggaaaaatgagcgaattaagattcattaattaacaaaaataaacagagctcagggaaatgtaggacaacattaagcaaactagtgtactagtgtgagtacctcaaagagaaactaacaaaagaaaataaaattttcaaatgacagaaatcatttgaaatttgatgaaaagaaatctatacactcaggaagctccagaaactctaagcaggataaatccaaggatacccacacagacatattataaaagtttattaaaagacaaagaggtctatctttaagggagtaggaaaaaacaaatgacttgttacctctgaggggattccactaacagttgacaactcataaaaaaataaaaaataaagaggccagaatgccaagaggctatgaaataataaataatgacaaccaagaattgttttccagcaaatgtatcttttaaaacaaatggtaaaatcattacccaaataaaactgagcaaatgtgttatttggaaaattggctttacaatatgtaacaggaagttattcaggctgaaagcaagtaaccttgtatgataatctaaatctaaaaacaaaaaaaaaagagaactgattaaagtatttatgtaattataaaatactatatatatatatatttcctgtcctttatcttaataagtgattttaaaagtaagtatataaaataatatgaatgaaattgcatcattggacttacagcatttaaaaatatatcagataatagaataaaagaggtgggtaggagaaaacctaaatgggatgtaacaaaattgtactaaactgtaacttgaatcaacagcatcaacttaaatctacagaagctaatgaatagaatcagaaatgataaagtggttaatacgaaaattttaaagtatatatttactcttttttattcagcttctttaaaagataaatgcatgtatagcaataataataaaaatgcaggtttgggttctttacatatataaatgtaatatataaaacaataatagcacaaaaatggaagaagatatagaactatattgaaataacctttctatatctcatgatgattaagttagtattaatataaagtagattctgttaagctgtaaatcataaaccctagagaaatcactaagaaaatcatttttttaaaatagagtaaggtattaaataaattaaacaaaatgtatgctcaatgcaaaagaaagcagtaaaaaaaagataacaacatgagacatacaagaaacagcaaaattgcatacatcagtatcccaaatcttatcagtaatgatattaaatgtgaacgaattaaaaatccaaccaaaaggcagaaattgtcaaattaaatttttaaaaagttccaactatatgttttcgatacaaaactcaatttagatttaaacatacaaaaaatcaaaagtaaaataatggaatatagtatttcatgttggcaacacaagaaatctggaggctacaccaatatcaaataaagtaacaccaaaacagttaccaaaagaaaaagagggatgtttgataatcatataataatcaactcattagaaacagattacaattatgaatatatatgtacctaaaaagcgataacactacactaagcaaaactgacagaactgaggggagaaaagacatttccacaataactggagacttcaatgtccttcttttaataatggttagagcaactatgaagaagattaacaaggcagtagtaaagttaacaatcaacaagacctaataaatatgcattggacacttgacccaacaacaacagagtacacattcttcccaagtgctcatggtacattttccagaatagatcaaatgccaagccttaaacagaatgaataaatgcaaagcagtagagatcaatcaggaatgtactccaaacaaaatggaataaaatcagaatcatcaataaaaagggcccttggaaattcacaaatatattcaaattaaacaaacacacttctaaataacctgtgggtcaaaaatataacacaaaattctaagtgcctacctgtgttcaaacaaggagattcttgtggatttagggaggcatcttttggcaaggtcaattccaatgacatgttaatgcatcgattttagagccgagttgtcctcttgcaatctcctgtattaggattagggaggcatatttagagataggatgacctcagcaaaatggaatggccagatttaactatcatctctccacaaaaacactgaaaaataagtataaccagtcagatgcaacttcattagaattttaaaaaatagttccagatttacagcaagaaatgaagcaacaaagcaacaaagcaaatgctgactcaagaaaaacatagctgatataagaaataaaaatacttgtgatatttttgctttcccttgctccacccccttcacagcatggtaacagtcttgaaggtagcttatgctcccaacgtaggaccttggttcctgggactgaaaagagtagaacaaacttcatttgcaaattattgtgcatgcctgctataaactctttgaggactccttgaaggattgagataaggtgctcatcaatctttcacttaattcagaactcaggctggaaaaagaatgagcatcattcaaaaaaaccacaagatgggccaggcacggtggctcactcctgtaatcccagcactttgggaggccgaggtgggcggatcacctgaggtcaggagttcgagaccagtctgaccaacatggagaaaccgtgtctctactaaaaacacaaaattagccaggtgtggtggtgcatgcctgtaatcccagctacttgggaggctgaggcaggagaaccacatgaacccgggaggcggggttatggtgagccaagatcgcaccattgcaatccagcctgggcaacaagagcgaaactccatctcaaacaaacagacaaaaacccacaagatgatctaaggaatcaaaaatgcgtgggacaaaatattatgttctagacatgtaataaactactaaggctgaggaggaatagctaggggagagtttctttgaaaaattaagacattcaaaaatatctatgcatacaagggaattaagaaagccacatatatgtccagagcaagacacatgctcaacaagacccagagcttttatctcaggctaataaatagacttaatacaagtctggctaaatgtctgtgtctatggcacagagctaatctcaaatattgggagaggcattttttgtttgcttgcttgtttgttttagaccctggtaataaaaacaaaaaaatgccagtacaatagctgaacacaagctaaagaacagacatgtcagttatcacacgagaaatggaatagtctgcaaaaataggttagaaagtaattagacagatttctactagtctcaaccagaaaataacaaactttgaggaaaggagagaatctccaagttaccacacagtaatatccaaatatccaggtttctacaaaaatcacaaggctgacaaataggaaagtatggcccatgtaacagaacaaaataaattgacagaaactgtccctgaggaagtccggacattggatttactagaaaagattttaaatatacagttatatgttactaaccaatggcaatatgtcctaagaaatgcattactggacaattttgtcaatatgcaaacatcagattgtattcaggcaaagctagatggtatagcgtactatatatctagactatatggtgtagccgattgctcctaggctagaaacctgtaccgaatgttactgtactaaatattgtaggcaactgtaacacagtgataagtattatgtatctaaacatgtataaacatagaaaagtacagtaaaaatacaatattataatcctatgggaggacaatcataaaagtggttggtcccccactgactgaaatatcattacgtggtacataactgtcctcacagaaaaacataaaagtaaaaacataaagaactaaaagaaatcatgaaaataatgcacaaacaaaatagaatgaaagaaagaaagaaattccaaaaagaactaaatataaattctggagctaaaattataatagacattttaaaagacagaagatttgagcaagcagaaaatatagtttgagaactataaatacttgaaattatcaaaatgtgtaattaaatataaaagccagtattattgtattttttatttataactgtttaatttctagcagaaacaatatcaaaataactatatcaaaatcattataattctgagcataaaatgtagaaatgtgtaacttataagagaaacaacataaaatggagtgaagttacataggagtagggtatttgcatgctggggatgttaactttaattcaaagtacattgtgataaatataggattttgaatattatacctataataagcacagagaaaatatccacaaaataatacacagaaaataaaagggaattaagtagcgccctatttttcaaactcaactaaaagcaaacagaaaaggtaataatagagaaaatgagagcaaaaaaatatagttgtgtagaaaaaaacagcaaaatggcagaagccctttttaaatcaatgattacttgaaatataaatgtatcaaactcttcaatcaaaggcaaaatagagtgaattctaaaaacaacacaatttcaagagactcgcattagatctaaagactcagattgaaagttaaaggatagaaaaagatattccataccagtatcaaccaaaaagagagctatggtggtaatatcaaagtaattttataactggtatatgaggaagagggaggtatatattttaaaaagtgtcaattcattaagaaggtgtaattataaacatatattctcaaaacaacatagtcctaaaataatctgaagcaagtactgacaaacttgaaggtaagaatagatagttctacattaatagatggagacttgaatacctcactttcaataatggatagaacatctagacagaagttcagttaaaaaaatacatgagttaaaaacatataaaccaactgatcctaacagtgtgtgtattatatattatatattttttatttatatattatatattatatatatatggagagagagactgagacttggtctatgactcagatttagaagatgtctctacttaagattttcaaaaagtgatgcttgacaaattagacaccaagcatgtatctcattggcttctagcaaatgacaaactcatttatacattcatgaagttaatgatgtgcttctaggtagtttcttacaagttactattttctacctaattttaaaacaactaggcaattttattattctgttaattgtaaaaatgaaaactttaaaatacttctagaaaacataaatattgtgaatgtgtgaaaagtaaattgaaatagatattaaaattaatgaatacatgaagagtaatatacagtattactgtaaatgctctatatgctatatactttatatactctatataatctgtatgctatgtactatgcataaatgctatattatacactataaattttctatgtactattgtgtgtatatatatgtaatattattttctgaaagttgaaggtattcataaggttccaaatgactacatatatctgacttttcctagaattctaatatcttacttcctaagcatgagaggagttatatgaaaaaatgacattataactgagttctgtctacacattctgtcctttagttactctaaggaaagataaacaagtagtttgtgcttatcataataacttcatttgcccataataactcatatgcccagtttaaatgagtaacaataagcccatatttttctaagtagttttcttagactaaaggctaaactgctggggggaaaaatgtaatagcttaaagagtgaagtttatctcacacacgtaaggcagcttttctctgtgaatttttattgagcccgttttcatcctccatcaatcccatggatgttttcttcatcagcatgactgatgctgcacctctaccatatgtacatttcagtctgcaagaagggaaaagtgagcaagaccagagcaagaaatcttcttttaaccttttaatcttcttttaacacattactttgttcatattccattggtgagaacttattacagagcttcacatggctaatacgtgtgaggacaacagaaattgttcacagctttgtagccatgtgcccagaaaaaaagaggggaaaagatttgaagggaataactggtaggctgccagagtccatcctatggcaaccatttattggtgcacactctgcttccaacaaagtgaactcattcttccgccaaaggacaaagcccaaggtcctatcctattacctcttccatcacaaatctcagaatctgtggttaatgggcatccctctctattaggttcagtcacagatcctatatcctgacaacttataaactaatagaaaaataatctgtcatattttggtatgtgacaatatttatgggggcaagaaaaatattacaaatgtagtcttacatatcctatacctatgcaatggtttgaatgtttgtgtccctccaaaaattatacattaaaacctaatcctcaatgtgatgctattaggaggtggggcctttgggaggtgactagatcaggagggcagagcctctgtgaataggattactgcccttacaaagagacctcaaaaagctaactaacccctttcaccctgtgaggacagagtgagagggtgtcattatgggaaagtgggccctccctggacatcaaatctgatgacgccttaattgtggattttctagcttacagaactgtgtgaaataaatttctgttgtttataaacaacctgatatatggctaagacaaacaatattaaataattacatacagccctggtgcggtagctcatgcctgtaatcccagcactttgggaggcctaggcaggtgggtcccttgattcctggagtttgagaccagcctgagccacatagtgaaaccccgtcttcacaaaaaaaataaaaaattagccaggcctggtggcacgttcctgtagtcccagctactcgagacgctgaggcgggaggatctcttgagcctggcagatggaagttacactgagcccaggtcatgacactgcaatccagctcctcaaaaaataaataaataaaattaaaaatatataaaccaaacaaattatactgttaaatataatacattctattcacttacgttgacaaattcaaaattctcagattcttgtttttccatcctagaatatatgaaaacacaaggaaagataaccctagctctgaatttgtaaccatgaccccctcttctcttcactcacttttcttatgattaattgagttacactctagtctgcaagccaaaatacattgctgcccttagcccattcttgggtttaagttaaggccagcaattttcaggaggatgacgtgggtagaaggtctgtaaaatacctggaagccaattagggtctatttgagcagggatctgtggactattaggcattcaaagcatggcccggaagtggagcctatgcttcaactagacacaggcatcactgccctttggcctatgcaactcttaccttgaaaattggggttagactggggaaggacagaattgagtttgccaaaatacggagtccaaggcagcacccctttttgcctgggtctgaagttgctaatgagaataatatatgagagtggaacagaaacaaaattactgcagttaaaaagaattcattagaatgggtacagcacaccaacatggcacatgtatacatatgtaacaaacctgcacgttgtgcacatgtaccctaaaacttaaagtataataaaaaaaaattaaaaaaagaaagaaaatagaatgggaaacaggtcagtcagcacataataacaatgtctttctgggaaggactaataaaggctgactgttgaaagttgagtaaattcattgggtagacccagattctgagctgtgagaaaaaggatctcatcctctgtcttccacggcacatggctctgccttctgggaggtccatctttgtgttcattagcttctgtggctacatctgaagaatgaatctatattctccttggaggctgcatacttacacaaactactttttgcaggtgcagttctgggagcctgagaattgttttacagataagcaatcaattcttttaggccaattttgtgacttctttgtaattgctctctcaaaaatttttagacccatggcctatttgcttcccctcagtattaatatgccagggaaaaaatcacagcattattttatggacatacttcctaagcctgccttgtgattttcttgtctgtgcctatttctaacttattttgattgaggcaacttgaagatctctgacacaatacatgggagtgaaagacaatactccaaatctgatgtttgccacaaacttagataccttatggattagaaatcttaatcagaagtctgaacacatgtttttagactgacacttttatcttgatgttttaggggagtaaaaaaatgatttggatattgccatcctgcaaagccccatatttttagacgctccccttcattttgttttgaaagtaagtcagatcttatctgaggttctctttattgtagtaatttgcataaagcaacaagaaacaggcaatatatagttacattatggatctttgtaatgatttcctcaaaaatataggctcaagagtcacctaatttgcttaacaaacacgtggcttagttaccttttcaaagacaacaatttatcagctatactggcataacaggggtcaccagctttccaaccttacccatctatactgcctgagtactcttctaatgtcacatattttcagtttctgtcacaggaccaaccctctagtgatactagtatctgctttagttagaatacagtttaggttgcaatagcaagaagactcaaaatacagtggcatgaatacattaagaatgacattttctagactcgacagcagctagatgcagccatattcccaaaaagactcagggagtgtatttttagatgacaattggcataccattttaactttgaaaactgaaaattccactatcacttcaaaaagcactctattaaagatcaacaataggcatccaatggttaaattcaataatatccctttgctttaatatattccactaaactcctttcccactttcactccttttcaataaaacatctcggcatttgacaataacccctcataccttgtatatctgttctcttttaattcatcagagagtccatttttaaattccttttttatcacaatttttgtccttatttttataaactgtagatctaattggctgtttttcttattctatatgccatgatcaacttttaattcttatctgtttattagatttttcttctaacattcactccttatttcaaactgtcttataatatctccaattacacctctacttttctagtttaacaccccattttttctttcaatatccagtaaagaacactgttccctctttccaagtcagattatgcgacattgcttgtgacatttctttttttgcataagattatttctatctccttttgtcaacattttacacttccttcaacgtttatgtcaaatgctaaaaataaaatatccataggaactcatgcttacatgaacattccatcgttaaacttccatacaaccctataactttttttaaatgggactcatcttatactgtaacaaaaattattctccctattctagtgttctaaagtcatcgtcttataaaatgtactggaattgtgtgattcgtctgacgccactccagacatcctgttttgagtttcgtgttcttattctctgcttctatctctgggatgagttattccattcaaagcaaatactttgaaagaatcatcaaagagataatgatacctctgtaaagacaccagtaacaatttcaaggtagacaggctcactttccttgatgcccctacaattttagtggccacagtagcaatgcacaagtttgtcaaatgtacagttttggaagtggtgcaaataattaaggaaaataaaatcacaggagtaaaacattttagaactgttctaaattgactacacagtccacaaaaagaatatacaaatagactaaaacattacatgtgattatctctgttgccaggccccaattcaaagacttgcttttctttcctcaggttttcagttcattttttctgtcttaaaagaattctcataactagtttggtttgtctatttgttagtattttgtttaactcaatgactatgttttcatgtatataaaatttctagttcttaatatgcccgtttttaatgtattttatttttcctttcaggttcaagttcatttttcagtgtgatcactttacacatgcttaaagtctctttcacagttctgtcttatctttagttatttgtcagctctttagtatataacatggaagttgttttctgtcatatttgaaatacctcatatggaaactttcctataaaacattttatttgtgttttgtaacccagatggattgtctaaattcagaccattttaaaatattaatttttaatttgtagtttctataacttattggcaattcaagcatagagtcatatccttataagcctcctgcttctttacttcatatccaagacattggggtaaaaattgagtctcatttagaagcagagttagcatctcctcagtaatgattttctgcaagatactcagtttcatctccctctagctaaatatgaaggtctatggcatggccatctttttaaaacaaattgaaatattttgatccaacaattctgctttacctgctttttatttgtaccttagaattgattccgttgtcatttcttttgagcctaatcatacatattaaaacatgattcctggagtttttgaatttttcagtgtgtcggacctaccctcattagttcagtccaccgtattgacaagtatcccctcctttccttcctaaggcatcatttttacaaacagctggctataaatcttggctttcctttcatgaaatttatcccttacacacatggctttatcttatcctaagctttaggtccttgctatcagtaatatttgtcaacctatctgaaatatacattccaaaaaaaatactgtgccatatagcagcactagacagcacttgggacttcagatgcacaaaacatttcagaatggggaagggcattccaaatcccagctcttcaaaaatatccttgtcagcatgatagctcatattcttcctgatgttttgggaattagataaaaattaaattaaatagcacattgacaaacattaaagtgaaacactcagccttagatgcactgccttggaaaatctctatgacatagagaagtatttttctatctgttcataagatgtgtgatagctcctgctatgaaaatatgatttaactttattattagagaaatgtcaatattccccctctatttgttattgatgtttccatgctgtgtcactgggcagaggtatttgaactaaactttttccccccatcaagtgattacaaaaagttgaaaactttttacatgattgttcacagtaactttattcataataaatgaaaacaatctaaatttccattaaaagatgagctgataaccaaattgtcatatattcatataattgaatactattccacaacaaaaatgagcaaactattgatactgctttgtcattctacttcaaaccataatctgagattaaacaccatctcctcatataagcaattgggattttatagtaaaagcagaaactatacgttagtgaagcaacagggagaaaatagcttttgattaactttgatctttattataagtttgggatgtttatctgaatcaatctactagattataaactttgaatataaaaaagtttattcaacatttgccttctaaatattagtttctcattaaaaatatatattaataaaatttcaattgttatatcaatttagagccatatcaactccacagaactgagaattcaagccccacaaagaatgtgtttagaaatgaaaagttcagagactttcgtaagccacacacattctcaatgaatgtttatctatttggtaaatatctatatattatataataatatattacttttttctaaaattttataaagcctaaatccttctaccaatttatgagatcatgactttcaatctttctttactaataaaaataaacaaataatctcataaaaagaaaaaatgttacttgacagaggtttatttttaacaagctatatttagtgttgaagaaaaaatacttgtttgggttgaaagtagtttccctttttatatcacctcatttcatatatatatttagagagagagcaattatttagagggaaaaagtcatcattctattgcaataaaatatcatctttaagaagaataaatagctaatggtaattttctaatggctccataattggttatattaaggtagtattcacaaactatttttattataaaattgtttcttttgtcattaattggtaatttgtgaggcaataatttcaggcttttttaatatcttggcatctaaaatctagttacttcacattgactatgaatttttccttagtttttcttatgatgattattaaatggtgatgtttctatttttaccatttcttctaaatatttaattagcattattctataaataagatttttatttcccctttttactgttaaatgtcagtatcttgccaagaaattagtacaattaatctgggaaaacttgagctaagaatatacctatatagtaaatttatacctatacctataatgttaaagtaaattttattcaaaagccttcacattggccgggcgcggtggctcacgcctgtaatcccagaactttgggaggccgaggcgggcggatcacgaggtcaggagatcgagaccatcctggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaagaaaaagccttcacattttcttcaaagttaatcattgtttactaaatggagaaaacctgaaagcctttcctctaaaatctgaacatgacaagaatgctcaatttcaacactgttgttcaacatagcactggaagtcctagctagagcaatgagacaggagaaagaattaaagggcatcaaaattggaaagaaaaaattccaattgtcttgtttgctgatgatatgatcttatatttggaaaaatctaaagacatcacacagacacacataagaaaaacaattagaaccgataaattcagcaaagttgttgccatttacaaaaatcaaatcaaaatggaattaagacttaaatctaagacctcaaactatgaaactactacaggaaaacattggggaaaatctccaagacattggtctggggaaaaaattatgagcaatacttcaaaaacgcagacaaccacagcaaaaatggacacaacgttaaaaagcttctgcccagcaaaggaaacaaccagcaaagtgaagagacaacccacagaatggaataaaatatttccaaaccacccatctgacaagggattaataactagaatatatgaggacgactctatagagaaaacctaataatctgatcaaaaatgggcaaaagatttgcttagcaatttccctaaagaagacacgcatatggcaaataggtatatgaaaaggtacttaaaatcactctcagagaattgcaaattcaaaactacagtgagcgatcatctcaccccagttaaaatggcttttacccagaagataagcaataacaaatgctggtcagtatgtgaagaaaagggaacctttttatacagttggtgggaatgtaaattagtacaaccacaatggaggaccatttggaggttcctcaaaaaaacaaaaattgagctaccaatgatcctgcaatcccaatgctgggtatgtacccaaaagaaaggaaatcagtatatcaaagagattcttgcactcctatgtgtgttgcagcaactatttacaatagctaaaatttggaagcaacataagtgtctatccacagatgaatgaataaagaaattgccgtacatatacacaacggactaccatgcagccctgaaaaaagaatgagatcctgtcatttgcaacaacatggatggaactggagatcatgatgttaagtgaaataagtcaggcacaaaaagacaagcattgcattttctcacttatatttgggatttaaaaatcaaacaattgaattaattaacatagagagtagaagggttgttaccagaggctgagaatggtagtagggatttgggaagaagatgacaataattaacgggtacaaaaaaaatcggaaagaatgaataaggcctcctatttaatagcagaacagggtgactatagtcaataataattgtacattttaaaataactaagagtataattgaattgttggtaaccaaaagcataaatgcttgagggaatggataccctcctctccttgatgtgattatttcaccttgcaagcctttattaaaacactttatgtatcccataaatatatacacctactacatacccataaaattaaaaataaaaaaattttggaaacataatcattttaattatctctgtaaagattattcttaaaaatattatattaagtacaatatcagtgagattaattttagaacaactcctttggaataaatatgaaagtaaaattaaggaaacttaaaataatgactttgattcaaaccactgaaagggagaattatttttattattccttccaaaaatgcatgtggtaaataaatggttaaagtattcaacaaagtagtgcaaaacaagcttttaaaaggtgcaaacacaataggttgcagcagaaatagaagaatttcttctcagcagatgagagtaaatgaataagagaaaacaataacctcgatattcatgccatagcaagattttaacaccatgtgaaactactataaaatataaaatttttaaaaaattatcattgggcaaaagaaaataaaagtttccagtttaatttctgcatgggctaaaggaatatttttattagatgctagcaagaaataaatgagaaatatatttgattgtatttgaatttactatgggaatataaaaaagattatatatttttaaagtgcatagaaaacgaaactttcaagtgtaacatataactactaaaatattcattttgtgatcctttaaaaaaataataggttctagtaatagaacaaaaatatttaatatacttctaatatgcaaaaacaatgcttttaaggtatctcactataatgaactataaagaatctgacactttatatatatcaattccaaagttcttgaacactctaaaaagttattgaatgtgtgagatataatttatttaatgactatttttattgttagagtaattgtgaagacattggaagaaaccaaatcttaggcctcaatgtcaaatgtgcaatagagatcatcacaggatcatagttaagtaaacacagtaattataatatgttattttagataaacgttttgattttttatgttattatttcctgataagaaagtaaagcaatcattttaccatattccaaccatgtgatatctgtttttaccagggatatccagcagctatttaaatatttataaatgagacagttttaacctttatgaaaatttcatgaaatttaaataaactcaaaatataaatctataaatacagaggaagttaatagcacaagtgtacactctttaaaggaatatttgaaataatattaaatagtaattgttggctcttcctacaatgcaatgaaataaatctttcagctgtgctgaaattaaaaaaaaaaagaaaaaaaaaaaacattgagagtaactggacctaaactactacaactacaatcaggaatacatgtgaaaaagatgtgtagatgttagtgggggcaatagtcttctgaggcagattcttgttttccctgggctcaattgaatctcctaaaagatgtttagctgtttctctacactttctcatgtcaataatttgaatctgtctgcaatgttcttttagtcatatatacatgactgtcctctcttcaaatgttctcccaatgcatgatgtaagagaaagaacattgcagacagcttaaaactattggcatgaaaatgtgtagagaaacagctaaacatcttttgctagattcaattgagcccaaggaaaacaacactctgcctccgaagacttatatatataatatatataatgtacatacacttatatttactatatatatacaatatatttaatgtgtatgtgtgtgtgtgtgtgtgcgtgtgtttattcaataaagctaagtgacctgacagcctgccttgccaaattatcccttgtgtgtactctgaccatttccattttattataagggacatcacaaattgctaagatagatcacttgtagtttgaattgagtaccgttacaggattttgcaatatcactaaagattcatcaataaagataataatatgtaatgagggttcttaaatatatttttatcaggttaaggaatgttcaagatatgatttgctaagtgttttgtttctgtctttgcttttattcatgagtaatacctgaatttttaccaaatatttcaatgcaacaactgagattatcttgttatttttaaatgtataaatatactgtcaatttgtttacactaaagctctttgctattgctagaacaaatttaaatatgatttactttaaatgtgatttattttatataaaaacatgcaggtttcaatttggtaacagtgtgcatgctttctacatctgtgttcacaaatgagtttgctctacaattgcattttctggttctaattttatccagttttatcatcgaggttacgcaggtctcataaaatgtgttatggagtacttccttttttctattctttgaacagcttgaatacagtaagtattgtctatttgttgaaatatatatttttaaaacattcaaagctatattggccacatatttcctaaaactttttgaagaaattttttttggccactgattcaagtaatggttctatatttcattaacattaactgataatatattttgaaatatccctatctttttcaagtatcctatcatttcatagttttaagatttttaaacaacttccacccatctaactctgttgttttgcttctttacgctttttctagtttgctttgatgaatcattttgtatcttagtttttcaaagaattatattttggttttattatctctatggttccttctcccaagatttaatatctttattttattaatatcatatatttatcatttactatttttctatttactccatattttttattttcatgaattaaaatatttaactaatatgatttcatgatttcttcctctttaactcatacatgtaccactataatttgcctctaatcaggactctgaccaaatctaacaaaattttaaacatatattacattcatttttattcagttctaaatacttattttctcatatgaatttgtttacaattgatttagaaatgtacattatatttttcaaatgaagtttttcctggttaaaaacttgatatttcattgtattgctttttctatgataaaaattattgtatttttaagattttctttgtaaatacataatcatccattttaaaaatatttaatgtgtctttgaaaagaatgtatgtcttatgtgtgttgggttaacatccatgttagatcagatggattgtgttgtcaaatattcaatatccttattaacattttatcaaatttatctaaaattttaagaaatatattaaaatctgcaagtatcatagctatgttaaaaacattgccttataattctatggaattttaaattatttatttttattgttttattttttatttttattttttgagatggactcttactctgtcatccaggctggagtgtagtggtgtgatctcagctcaccacaacttccgccgcctgggttcaagcaattctcctgtctcagcctccagagtagctgggactaaaggcacccaccaccacacccagctaatttttgtatttttagtagagacagggtttcaccatattggtcaggctggtctcaaacccctgaccttaggtgatccacccgcctcggcctcccaaagtgctgggattacagttgtgagccaccgcgcctggctaaatattttattttaaattttacttttaattgacaaatataaattatgcatatttatgaggtccaatgtgatgtttccatatacgtatacattttgtaatgatccaatcagaataattagcatactcatcatctcaaacattcatcatttcttcgtgatgcaaatattcaaaatactttattccagcaattttaaaatatagaaaacaatattattaactatagcacctctattgtacaatgaaataccagaactgattcctcttatctaactgtaactgtacctattgaacaactcccctttccgtttctcccatccccctaagcctattgtgtccaccgttttgctttctaagagtgccactgttttctatcttacatataattgagatcatataacatttgtttctctatgcgttggttatttttcttaacataatgaccactgggttcatccatgttgtcgcaaatgacagaatttcctgtttttaagtgtggaacagtatttcattgagtatatatatcccatttttaaatccattcatttgttaacaacacaggttgttcacatatcttgactattgtgaataatgctacaataaacatgggagtgcagacatttctttggcatactgatttgagttcctttgtgtatatacctggtagtgagaattaaacattttaaagttatattgctatcttcttatgatttttacatatcctcagtgaactgttactcttataatcatgcctacttatataacacccttaggagaagattccttacattttgaatactattaatattgttagatcagggtgctctctctcctttctctctctctctctctcctctgttacgtttattctctttattcaatctttatgctcctatattttaggcatctctccaaacaaacttgtagatagtatttttaaattcaattggatagtcttttttaaatataataagcacattgcattttaatgataatgattatagttgagtttatttttgctctcttttgggtatctacttatgtaatatctttaaaaaatttctttgtttcttgttaaaaatatgtctttattttttctccgtgtgtattgagcctaatagctgaatgtatttaatgtgtacattttgtaatgtgtacacttttaattgacaaatataaatatatactgattaatagatattaatcagtataattaataatatacattaatcggtatatatttagcttcttcataaaccaaaactacacctagacatgattcatatagaacagacccttcctatttcacttcttacaattgactaaattaagacatttgtttagttttttacccttatagatagattgatagatcagtaagtagaagataatcagtcttccagagaaataaaacaaatagaatatatatgtatacttatatataagaaatatataaacatataaatatgcaatatatataagaaattggtacacatataagaaatgtatatataaagaatcacctcatattcaactgtaattgattatgaaagctgagaagttccaagatatgcagtcagcaagctaaagactctggaaagccaatgatatcattccaatcaggatccaaagacccgagaaccaggaaagctgatggtttaagccccaatcctattctcagtccaaaaaccagaagaattgaaggttaagttctatctgagaccaagtctgaaggcaggagacccatgtcccagcttgaaaacagtcattcagagagtgaattattccttactctgccttatgttgtattctggccttcaacagattgaataaggtccattcacattcagatgaaaaaatcagctttactcagtgtattcatttaaacattaatctcatctagaaatactttcagaaacatagtcagaataatgtttaaccaaatatttgggcacctagtggtccagttaaggtcatacataaaattaaccattttaggtaggcagagatttgcctactggtatatgttgtatatgttttcattcttttgactcatatatgagtcaaacatatatacatatatatacatatatatacacatacatatatgtgtatatacatatatacatatacatatatgtgtatatacatatatacatatacatatatgtgtatatacatatatacatatacatatatgtgtatacatatatacatatacatatatgtgtatatacatatatatacatatatgtgtgtatatatatttccatctgacttcttcacctggttctcttattctcacagacgtatatggtgattacttcactgtgggtccatgagtattacactatttaggttttatatatctgaaaaagcctttgctttttattttatctgtggacacaattctcagaatattcttactttgtttcccttcctgcttctgacacctctaattgctgagcataagtctgctggtgcataattatacttccattagaagtgatctttttctttgtgagttattaggaatttttgctttatgtttctcattctgctttttatccatgataatttagaagaggatgcttcttctggaggattaatatgtcccttgtgtctgttaattcttgttttatatattttttctcattatctttgtggaccgaatcttctctgaatgccttaatgtgaattttgtctttggctttagcctagagcttcctatattttgaattgtttgatatcactgtctattattttcatttccaggatttccaatttattctttattacatttatctattacctcattctaaagacttgttatagtaaatgtggttcttagatcagcagcattagtattacctgggagtttctaagaaatacataattctaggtctcaattcaaatttattgattcagataatgcatttttacaagatttatcataatttttatacctattaaagttttaatgcatcagatgacctttggcatatttatattaaagtcaattgaatattttgatataatttgctactatcaggaatgaattaatttcttaataatagtgttattggttgtcttttctggtgttagttttacaattggacttgaatttttattttaccgatacaaagtatggtccagagtcttttaaagatatattttttgttgtctgtattcacccatcagattcatctctgtgggttctaccatctaaatcctacagagcagtgatagtggagacatttccattatttatttgactttaactcacataccacatttcgtgtcagtagtttttgtggtaaacagatatatgcatttagttatgaatatattctggataaaaacttacctatttataaaaatagtaatctacatgacttttaaatatgtaacatctttttatatgtttgaagaagagagaggagtataatcgtaaccttggactttaagtcttaggctctttaaatattgtattttacttaatagattgtttggccaagtattactatattattatttaacagataaaaggccaagattttagttaattaaatgtgttgaaattcatacagagcacaatttttaaacctaggtcttattgacaaaaaaataagctcaagttaataatggcataaatagtaagtagttaaggttttttttttttttttttacgtataccttcattccacagctctttgtagggcctccaaaagataataatagtaacatgagagttcattccattaaacatctaccatgtgcagacactgtttgaagtgtggagacactgtttttcacacaaaaaaattagtaaaaaaactaagcatacaattaatatttttgttaatagagtgaggagttgcaaacaaatactgttaagaagaaaacaattagctgagatgaagaaatgcataggaaacttcatttatgtagggaggtcaaggaagtcttctttgaagagggaatgtggacttggataatttggctatctgcagagatggagagaagagacactgggaatcatatgcaagaaagagcttaccaatagccagaatatgatcacaggaggttagggagtctgaaacatagggaagaaatggggaagttgcttacaaagaaggtagagaaacatgtgaagaattgatcatgtgggccaagtcagtctagattttgtagtaaacgtaatatggagccattgaaatgtttaaattaagaagttacatgtgacctaattattttctgagaaaatcacttttcttgctctgtagagttaaataggggaggggaaacaataggagtggctggattcacctgcagtggcaaagcaaagggaatgttgcaggaagaggttttgctgggtttctgtgcctctagggatgaaactaaagctgtgtctccagtggtcaacttgaagggacatcccatttgcaaggaaatggcaatgttggaggtctcctcggcagagaaattgcctttaaaagatcctcagtgcaccctcatgaaataacaacaatatcacgtgagtatatgtgccattgagagtataccaatgttagattacaaatataccagctaggtaataccttccccagcccattgcctcacctcccttcctgtttcccatccccagaggggccagaggcagcacaatctaatgagaagcagtggatgcctcaagaagggatatcacaccgtcttccagctgctctgtgaaattttcagaccatagtctgatcaaatcaggaactggtgcaatcatttaggtgagacaagtcagtggtttggactaatatgaaaccaatgaggatcaaagacatatttgagtaatactttgagtaatatatttgagtaatttttttgaaagtgtaattgataaggcagtactgatagttttacaaagctgaactcaatgctgtacaatgtataaaaaccatatttctttctcacctcttcctataagtaatctctgtcagctcttactttcttgcccctggatagtatgttcatatgcaaaattattcttggttactttccgatattggaaaactcattttcatatattaaagaagtccagctaacattaatatcaacattataagctgtcatccattttaagcacatcttctccctgcctggacttgggtctgaaaattccaaagagcagcaggaaaaggtgtgatatcccttcttgaggcatctattgcttctccttgctagattgggctgcctctggctcctctggggatggaatagggagggaagtgtgacaatgggcttggaaaggtactacctggtggctattttttttatttttatttttagagggagcctcactctgtcacccagtctggggtgcagtggccagattttggatcaatgcaacctccacctcccgggttcaagcgattctcatgcctcagccttcctagtagcagggattacaggcacaccccaccacgacaggcaatttttttattttttctagagacggagttatgccatgttggccagactggtctcgaacccccaacatcaagtgatctgcccagcctggcatcccaaagtgctaggattacaggcatgaggcaccatactcaggcatgaggcaccatactcagccctggctggtgtatttgtaatctagcattggtatactttcaatggcaaacatactcaaatgttatttttattctttcatgggggtgcactggggatcttttaaaggcaatttactctgcaaaggagacctccaatattgccatttccttgcaaaggggatgtcccttcaagttgaccactggagacacagctttagtttcatctctagaggctcagaaacccagcacaaactctcactgcaatattccctttgctctgccactgcaggtgaattcagccaagccagtttagtaccttgagacttttccagacaaaaggtatgagtccgtgtttgcattgatcaaacacttcagaagggcaggcttcatgagcataaaacccatttcgacacacttctctccaatagcaacacagaacaagccaagatttgtcagctaagaaagcatcttgttggagcaatgactgatgtcagtctcgtctccgtatagaccagccttccctatctcatcaaatctcgtgaaacttcctgagctcgtcttgaaataagaaaaaaaatcccttgttcttggagagagcaaagcgatgtaaaatgcagaggactctgacaagtctttttcaagtcaaagacatcccccatctcaaatcgactgaatctctagccttttctacataaacttggagtaagtgaggagctaaggatgacagatatagtttttgaaagccttttatctaatactgaacatgtatttcttctagtccccttttacattttaaaagaaaaaaaaccaatgttgattacttagcatttatttccttagtctggaacactctctgtaattaccagaaataaccaaaaaacttaatattttcaatgaattctcaagttaattcttcctttttgctttttttttattttcagaaagggaaactgatgcctgatacacagtaaatgtgagtaaattgtgcatattcacatgtataatatgtagtacacaagcattacaagcagattactcagtttttctgccaagaagatgacaactcagaattctataaacctgaactaaaatattgctgtcacttctctgaaatgtgaagacctatgttaaaaacataaataaataaataatggctgggcgcagtggctcacaactgtaatcccagcacttagggaggccgatgcaggcagttcatctgaggtcagcaacttgagatcagcctagccaacatggtgaaacctcgtttctactaaaaatacaaaaaaaatttagccgggcctggtggcgagtgcctatagtcccagctactcgagagtctgaggcaggagaatcacttgaacctgggaggcagaggtttcagtgagccaagatcgtgccactgcactccagcctgggcaacaagagtgaaactcgatctaaaaaaaaaagaagaaagatatgtcttatttgctcaaaaaacatgtggcctcagtgtaaattcttgttttgtatgttacttatacaagagtaaaaaatgaacctacgtttttctttgcttctgtgttgaacctaacctcctataaaaatgaaaaactttccttgacttaatagacatccttttccaaaatcttacctgcatttttcttaagtagaatacaagaaatatctccttagaacttgacatatgtatttaattataaccaaaacacattttcattttatctgatcctcaaaaaggagaaaatataatttaatatttgtctgattaagcattttggaattattctcaaaaaaagcataaagaaatgatcttttgtagaggttatctgtagccaaggtttatataggattgctttcttgttttcctttttgaagaagggttggcgtttaattctaaaagtctgtgtgatgaccaagcttagcagagagagaaagacagagaaagtaaacccagtcattatatattctttgtctgttcacaagaactcaatgttctgatctgaaatactcaccacccactcatgcatgtcactagaaagaaaacgtctgctgtagtgctagagaaatacttgttctgttaaccaacaatcatatttttttcaaaagccctagacaaagaaaaatataatttatactgtttataactacatattttaattttcattcaattactattttatagaatttgtgaatttcaaacactttaaggtagttctgctttgcattttccagattatgcactaaaagctgctagtttgatatcttacactaagaatattttcttttctcagaagatgacttaaatagcctcacatgtacaaaactacaggaagctgtactgtagaaactagcctaaaacgtattgtcaaagggtcagtgtaaaatgctcagccctaccacttaacagccaagtgtactttagcaaaagagaatctttctgtcataatatctttatttttttaaaaaaaactggagacagcaatagatatctcttggttttttaagagtacaaaatgataacacttttgcaattgctttgcaaactataaagaaattggtattattaaaatatctccacaaagtaagttacatagtttgtgatgtcttgttaactgtttctgaatactgaagtactattttgtgtattgaatcagcagtgtactgaatggtactttattggtctgtttccagggaataactttcacgtgggtattatccagttgcataaaatgaaatgtgacataaaatcaagcattacacgtttaatttatcatctgggaaatctgaattgtcaggccctgaaaaaataattgaaatgcaagcttcttcggaaagatattgaaattcatttctgaggcaaaagatacgtgtgggagaaaaataaaagataaaattgctttctcattctttcattttcaagaaaatataattcctggaagaatgcagtgtgatgtgtaaggaacaacacaactctggatggtgtgcttgaaaatgttatttcagccgcaattagaaaataagagaacattctgaaaaatgcactgaaaagtaagtgtaggtactaagaatgacaatactaaaacagctgagagtatgatatgtaatgaattactgttcaaagacattcaaccccatgaagttatactgttttgtaaagttccaagcagaagtaccttctctgaataacaaaacagcttatattcattcataactcccagcaggagatgtctttctccaggaccatggacagcacaagggtacagcgatcctggtaaaaaatctgtttctgtatgtctgttttttctgcctgattctactaaaattagttaggtgtgcctacaaaaaaaagtgttttggattggttcttggtcttcatgactgctacaatttacagtactgttacataaataaatattttgtatcacatcacaattaaatacgttgtcatcccaaatttataatttatttcataaaaaaataatttagcaaagcatcatttagttttcagcttctcggttgttttgaataaagctaacagctaaattgaacgaaactattatattgtctttgcttattaacttttttcaggagtacgttttgtatttcaaaccaagtaactttcactcaggctactcagcatgttatccaggaaaacaaaatgatatcaaagagtttggaccacttattcgagagaattaagcattttcctgtagctgaaacctgaacatccatatatttagcttttgagtttgcataatcgttactgctactggtagagcagtaaagatcaagcaaatctttcatttataatagaagtggaccctatttaatatgctttcaaccttttttaatcaatcactggatctttccaaatgcttgcaagttggaaaagggagaaaaatcaattatatggctctgtacttatagcagtagttattttacactagtgttctttagtaaaacacactcacaaggttttctccaaagtactgtgtcaacaagctactgcaccatttctcctcccctttgaccatcaacattcttagtcaccttgatttccatctgcagcaagcacaaaatttctttttttcagtgatgattccacatcttctgacctgtgaaagcttaacaaccagttctcaatacagaattcctttctctgccatcatcaatttattgtatcagcacatagaattttgcaaaaattctaatacagtttctaccataatacaatcctgatttctaatccactcttctaaattatatttctccatgtcctcttccagatctttgcctttatttttcttttattacttttgaattgataatgtaattatatgcaatgataattgtccttaataatgtaattatttgcagtgataattttcctagccacatcaagctggcgtaaatattatgggtaacactaaaaaagtcttccaaaagtcttcagctaatctcatgagttctgtctttccatatcctgggagacgtgagtctctgtctctttttggtttccttaggtgtctcactatggatatctgagttattcttccaaatataagaacatgttttcgtactctgatactctaatgaaaaggtatcacatggatttggctcttagtttctaactattactgatttagctaataccagaaatctcatgaactttgttttctataatctcatgtgactaaatcacctgcttactctaagaacacaatcatgttgcctataggtgaagacctaggctctaccactcatcatctatgaggtcttagggaaaaagaaaaagaaaataatacctacttcgcgtggtttctataagggttaactaaagtaatagttttcttgattgcttaggacagtaattaggacacactgaatgctaagtacacactagctagtgttatgctgccttttgttagttattgcctctcccaataatataagatttgtaaatcaattttctctattgtttgtagctgttgtggtccaaattgtgcctctccctcttaaaaaaaaaaaaaaaagtatgttggttttaatccctagtacccgtgaatgtgaccatatttgggaatagactatgcagatttaatcaagttaaaaagaggtcattagggtagaccttaatctaatgtgactgggtccttatgagaaaagggaaatttggacacatcacagggggagtgccatgtgaagacctagagacattcagacacagagaaaagacgtgaagacgggaagagattggagttatggtcccatagcaaagcaatgcctaggcaatgagatgctggaaaagataaggaaataacttacctaaaggcttcagagagaacacggccctaacatatgccttgaattcaagcttctagcctccaaaagtgtgagacaataaatttccctaagtttaccccccacatatgatactttgttataggagcctagaaaattaatacagtttccttgtcatgaaatgtaactcacatttttctgatttttttcttctcccaaagcctttgggtccaaaattgtctaaaatagaataaatagatgaccttcctatctgattaataaattgtttgattgcttacaggttcatagtgcccagatttcttttgtaatttgataaacgtgttttaaagactatatcatgcctagtagactgtatatttctccttgctgcctcactatccctgaagctgaatggtatacctagattatatttattttcatagtaagctctcccactaccatattttttcaatacatttagagctaatcaatactcaatcttgcacctaattccagactcgtatctgtgatctcaatgtcagttccaagttaatcagcctttgcatttcctagaatgtctatttgccagtattcaagaataatctaatccaattcaccctagtatgccagaattttcactgttgttcttaggttccctatctataattgtatctcaacaaatagattctgttgcagccctattaaaatcctaactaataagtcataagcccaattggcttgcttccatgtctttgctcattctggttgctttctttattacaaaaattcaaactcctacctgttttgatttctatctggttaattctacctactaccatatttaacattatgcattactctaatttcctcttttcattaggacctacaatatggaaacctctgcatttacgcatgactaccaaaccttcccactcataactgggtaaaacatgcttgcccctatctcaagggtagatccttttcatgagctgcagtggttttccactcgtgttctcaagtgagagtgtttactggtgttctctctgcaaatcagccacaagtaagtaatttcttggacatctctttccccagatttcagattacttggtttctctgtaatttcaggtctctcatagcttcaaaggaacagttaatttgcagtttcttcagatattttattattatcaggatgtcaacagtattctttctagctcactctttctgtaagctgaaaattttagaaatcttctgaattgttttagaaaaatctagccaagcatgatgcatatctttaatcccagctacttgggaagcagtggtggggtgattgagcccaggagttcagggctagcctggtcagcattgtgcgaccccatttcattaaggtttctttgcatatactatttcatatgtaactatcaccattttaggtagccctttttttctttcccaatacctatgccatagcataatgaataaccccatgccatttttttttaaaatgacattttcacatgctaagaatatcttggaagattatctttagggttaatcagaattcctaattccctcagagatcctcagagagtttttttttttaattgtgttaacattaatgagtattgtgacaagactaaacattaagggagaaattaattttgttatactgctagatcttgtattattatcgtgcatgtataatttcctctcttctatatttaaatgtctttgaggaaaaaactcatattaaaattattatgtgtgcattatcttcatattaggtatgaaatagttattgaatttattttgagtacttatgaatcttcgtgaagaccaggagtcaaaataacaatcactaataagagtattaattctactttgtttgcctctctgcattttttctgttagtgtaaacatccactagacaggtaggtaaacatttcataaatctcaagttaaatgagataaaaatgacatggcaactatgaaaagatccaatagtcaataacgtttgtggcattaaaattgtcactacacagacttctagcacaaaataagcaccaaaaaaataaagaaatgtatctaatctactcttattcttctctcaagaaattatcgaatttagctggacagagatagtagaaagaaaattttgggataccaggcagttaggggtcaaataaccctgtttgaagcacagggagatttcagtcatcataaggcatcttatggtcagcttgctaatgagttactgcaaaaaagttaataagtaagagacagaagcaaagaaccatgtggagtggtgacagaagcaatttcacttaattttatcagagttagcccttatctctaccctgcggatgcagctgaatgaatgtagcagctatcataaaactttataaaggcctcccaatgttctatgcaattttttacacaaaatgtaatattgaaaaaaatgggaaaaaaataaactgactttttgattatggtgatgatgtatattctaatggaggtaggaaggtgccaaagacatttccagaaatacttgtacttagttaaataatgtagatattttacacctaatgtaaagatgatgttgttctattaagctacttttgatggattcccaagggcacacttgttctctcaatactgattcccagttgtttttagtgcaggcataccttgaagatattgtgcgttctgttccaaacttctgcaataaagccaatattgcaataaagtgaatcacacaaatttttggttttccagtgcctataaaagttatgtttacaagatactatagtacattgtatgcaatagcattatgtcaaaaaactgtacaaatcttaatttagaaaaaatctttatttctaaaaagataacaatcatctgagccttcagagagtcgtaatctttttgctggtggaagggcttgactcagtgttgatggctgctgattgatcagcatggtggttgctgaaggttggagaagctgtgggaaatttttctaatgatacaaccatgaagtttgcctcattgattggctctttctttcactaaagatttccctgtggcatgccatgttgtttgatagcattttacccacagtacaacttcattcaaaattggaattaatcctctcaaactctgctgctgttttatcaactaagattatgtaatattctaagttatttgtcgttccaacaatgttcacggcattgtcaccaggagttacaatttcatcttaataaatcactttcttttttcgtccataaaaggcaacttctcatccattctaattttatcatgagattgcagcaatacagtagcattttcagtctccacttctaattctagttctcactattgccaccacatctgcagtcatttcctccactgaaggactgaattcctcaaagtcatccaagagtgctgaagtacacttcttgcaaatttctgttaattttactttgacctcctcccatgaatcacgaatgttcttaatcacatctggaatggtgagttctttccacacagctttcagttcactttgcccagatccatcagaagaatcactatctatagaagctatagccttacaaaatgtatttcttaaatagggagacttgaaagtcacaactaatccttgatccatgggtggcagaatgttacgtttgcaggcatgaaaacaacacaaatctccttgtacatctccatcagagctcttgggtaaccaagtgcatgacaatgtaagtaatattgtcaatattattgtcaatgacaagtaatattgtgaaaatgaaaagacatattttttgaactgtaggtttcaacaataggcctaaaatattcagtaaaccatggtataaacagatgtcctgtcattcaggctttcttgttccatttatagtgcataggcagaatagatttaacataattctcaaaggcctgaggattttcagaatggtaaatggcatttgcttccacttaaagtcacccgctgcattagcccctaataagagaatcagtctgtcctttagagctttgaagccaggcattgacttctcttctctagctatgaaggtcctagatggcatcttcttcctatagaaggctgagatgtcgacagtggaaatctgttgtatggtgttaactgccttcatcaatgatcttaactagacctcctaagataacttgctgcagcttctacaacagcacttgcagcttcaccttgtaattgcatgttatagagagagcttctttacgaaacctcctgaaccaaccgctgctctctcctgtcttttctttttcagcttcctcatctctctcagtctccaagaaattaaagacagctaggactttacccaattaggacgtggctttggctaaaggaatgttgtgatttggttttatcctctatccagaccactacaactttctccataaataaataagcctgttttactttctcatcgttcatgtgttcactggaatgtcaattttaatttacttcaagaaattttttacctttgtttcacaatttggcaattgtttggcataagaggcctagatttcagcctatcacagctttcaatatgcctacctcagtaagcttaatcatttctaatttttgatttaaagtgaaagaagtgaaagatgtccaactcttcctttcacctgaacatttagaggccattgtaaggttataattggcctaattttaatattgttgtgtttcagggagtagggaggcctgagcagagacagagaggcagagagagagagagacagaaagaggagagggagaaaagcagcagggagtgcagctagttggtggagcagttagaaggcatacaacacacatttaagtttgacatcttatttgggcgcagtttgttgataccccaaaactattacaatagtaacatgaaagatcactgatcacagataagcataacagatataataataatggaaaagtttgagttttgtgagacttatcaaaatgtgacacaaaaacatgaagtaggcccatgctgttggataaatggcacaaatagatttgcttgatccaggattgccacaaaccttcaatttaaaacatcacgttatctacaaagtgtaataaagctaacagcaataaaacaaagtatgcctgtaattctgttcctctcaggtgctttcttgatgtgggaatgagcaagacagataatttgtatacatggaggtaaggcaggaaggtcatcctagtcttgatttctcagctatgtttcttgctgacttttttctgttagttgtgtgaaatctgtattttaatgtctatcaaatattttcctaagcaattgataacacgtatactctatagctgtatagttccaaactgtttacattgttaaatatcagttttctctctcagtggccagggaaaagtgagaaattaaaaacaaccctaattttaagaaaaaaaaagttattagtacagaaatactccttgcctccacacacacaaaaaatgatacctacagtatggttgaaaaacttttcagttgaaaattcttaaagacagatcaaggagatttggggagagatgaagcaacttaaatgcaaagaatgtaagtcaacatgtgaaaacatgaaaaagtatgccaccaaaaagatacataaaggtgaatccatcagtttttaacttgaacactgaaaaaaaatgtacttttcaatttaaatttatttctttcttcctagatatgctcatgtgtttctttttcattctgactatatgtcctatgttgacgatagcactgacgtggtcatttgattctttaggtcacggtagccctatctggagtattttctagtccttacctgttcacagcctgctttaaattagtcaaaaggcagcaccttaaggtaggtagcctctgggaccacaggtctttcttcattcgttctcccttccctcttaaaccttgtggcctattgtgttactttgtctatttcccctagctagagatctgctgtgattagccaaatctcctgaaatctgaatatcatgagcctgcctgagtctcaccattcttctcctgagcaaaaacacccatgcatttggacggcccatattccctgaaaaaggaagcttctaaattgtttcatcagtttctgattttgccagatctggcatccttcctctcctagaaagttaattttgctgaaactcttgcaaatacttcttataattccaaattttgaaaatatgtagtaacccttgttggcatagtgattgtccagtgcgatttgttgcaccctgaatgtaattatggattttaggttgaaaaacacattttactggataaaacccatgatctccatattaaatcttacaaattaaatcagaatgcaacacaacttatggatctaaattttattattatcccttaatactcatgcctaggcacttgcaatgtactttccccttgtcaagacctttcagtttaaccctctcaaatctacctatatttagttatcactacatctcctctatacaatactaacttgaatcttttaaaagatagttcttttttctgtagtggtctttccaatctctcgacatacctcaaagcatctttctaaaaatattttagcccatattgtttacttcctttcctgatctcctctgttaaataatattgacatgaaatgatttcactcttaaaattatctgacagtgctatagcacagagattgtcattatttggtttttatttaacagttgaggaaaagtagaagtcaggaataataaatgccatttttttcagcagatattcattaatcctcatttattcaaattaagttcacagtatttcaaatgtaaaatattcctgtgacaagtttattgtgtcttttacttactctgatttttttttcagctttcattgatgcaatctcaacaggagacctgcctagtactggaaaccagtatcagaacttgaatttgctttccacgcctgtggaaatctgtattattttcataaacattctctgattagttgaggagtaaatttagtataatctagcacacaaaattaagaatcattaagtgatttggcttattaccccaaaacttgggcagaaatcattttattatacttatttattaaatacatgtttagtgcttttcatatcccaggcaatgaacggggtgcagcaaatgtaaatataaataagacataattcctgcttctaaggattgtacagtctagtgagagagagggcataaataaaaatatttatagtgttgtgaggtaattgccagttggtgcttctacagtgctgtgggagacactgcatgagaaaatgccctgttcctgatatgctcacacctccccacatggaaagcccaaaatacaatcctttcctgtgtaaatccaaacctctgcgttcttaaaatttgtgtgaacccaaaaggttgaacttgtctttcttactcttccatgttctttttccaggttccctgaaacatcttagatacacagtaagtattttgtaaatatgggcttataatactttatctacaataacaaaatatatggagttttcaaaatctagtattttttaaattatttgactcatttgcaaattgaacctgaattgaaataacatgctctgtaattgctatttattcctcttcatgtgactatcatgtcttttgggtacaaaaatattaatatatttgattatgaggtgctgcctcagaatttattcaaagtgttatgtaatatttggtatgagatgggcacagtggtgcatgccagtagtcccagcactttgagaggcctaggagggaggattgcttgagcctagaagttaaagaccagcctggaaaacatggtgaaaccctgtctctacaaaaatcacacacacacaaaaattagcctagcatggtggcacaccatgtagtctcagctatttgggaagttgaggtgggaggatcacttgagccttggagattgaggctgcagtgagctgtgatcgtgctgcagcctgggtgacaatgagaccttgcctcaaaaaataataattaaaaaaattagtatgtgcactatattaacttttttgaaaaatatatatgtgagacacatataaaacatttcaaatgttttatatatacatacatatatagtgagatctatatatatcatttcaaagtgtttgtggcttaaggggtctcaggagataagaatctgcattcttgtctgtgatccagcatgaagtgtaacctgcccaagcagacctttctttgaatattcttcagccgtggcaactcttgccacatcactttctcgctggttcacagttgtcagtttcaaatcgaggatcaattgcaaggcaagcccaaacagcatagaacattctgagcaaaagggctgttaaagaaggcaaagccccaggtatcttaaaaattgacttgtaagccaagagtagccccctttagatgtacacagactgaagtcgataatatacggactcctcagtttacttgagaaatatggatacacatgggaaaagtatttcctttacattcagtgggcttcagcatgatgctaaggtgtgaataaaaagttggttttacagacagtcactgcgtttcctcatcatcttttttgtaattatcacattttcttcatctctgtctatatatattatagattaagaaaatgaattaactttccatttggcagtacatatattttattctaatattttatttgaagtgtttatttcagatgttagaaaattggtcaaatcaaactactgttctttccgtatatattaataccttagaatttttcataaattataagtgagattcataatattaatctgaaaatgtatcaattcaggaaaaattttttttttgcttttgtcatcagtgaaaaattataagaaactatttttaatgaaccttgtatacacataaattatctagatcagattctgttttttcccctttgtaatgaaatttaaagatttcactttcttttagcaagttacaactacaatttttctttagaaaggagaaaaacagaactccttggatcctttaagaaaaaatcttgagaatgcagtttcttttacctcttaatgtcttaagtttcaatcatctatttcatttttacaggacaagaacagcagttttcgttaaattgctaagttctacctagttcaatacattttctaccttaggcctttcttgagatttctatgactactaagttgtaaaaagaataaaaagagacttttacttctcagctggatgaaaacaagtcatggcactctggcttactgttgaactctagcaaaggggtacaaacagcaattgtctcttgtgatataatctgacactttccaaagattttcagggtcaacttaaatagcagctcattccctcgccacaatccatcagaactaagcttgaaatgtaacttaagttccttctaaataataaaaaacaaattcatgaaaactcagaaaaacctgcctcagtttttgtttgtttctttgttttgtggacattgttttgttgttgttgttgttgttcatttgtttcaggttttttaatagaagatattatggcaaaatataaattggaaggtagaatttaaagttctttatatattttatatgcttttaagctatcaatactaaagtcgtattattgacaagaaacttgtcacaattttaatgctactgcaaataaagctaatgctgcttaggatgtaagagaagaaataaaatggggaggctaagttaataaaagtgctagtgtaacatgcccatccagggtagtctgttctatataccatgtgttaaagcacactgtcacttaccttcagaacatgcatcatactatgttactatatatgaacttatggattttttctaaatatctgcctcccaaacatgctataactttcctaagagcagaaactgcatttgaatactcaaaactggatcagtatagttcttgatagtacagaatacacagacaataaatattttttaaatgaatgaaaaggtcctgggcaattttatcagactgttataagatctgtaatttttgtcatatcagagaacatcagatatactaagtaatttattttggaaaagggaaggaaaggagaaggaaaaggtaagaaagaagccatagtcattggcaaatgtttgaagttattttatataaaagatgaaatggcctttttttttccagtaagcagaaccatgataatagactagacattacagaaatatagacttcaggtaaacaagaggaaagatttttctaaaaagtagaattgtttataacataacatgttaatgagagatgtaccaagctgcttaatagaaatgtgaagcagagaaaactacttacccaagcacacataagaaatgttccaggataggttgggactttgtaggaaatcatttctgagatcatccatggcattaatattttatattcagttgatattgttatctaatgcaaaagaagcaattggaattattataatttcctaaaataagaaacttttaaaatcaactgacatattcaataaacttaatattttgtagacttcatacaaaaccgtaaattttttttttttcttttttttttttgagatggagttttgctcttgttgctgaggctggagtgcaatggcgccatctcggctcactgcaacctccgcctctcaggttcaagcgattctcctgtctcagcatcaggagtagctgggattacaggtgcatgccaccaagcctggctaatttttatatttttagtagagacagagtttccccatattggtcaagtggcctcgtctcctgacctaaggtgatctgcccgccttggcctattttacaatttatattaaataactagagttgaaaaagtagtgtagcactggaattcaattagtaaattcaaatgtattctgtgtttagttaaaatcaggaatcttgccttgatagtgttcaaattcaattgtgaatggcaaatctttgaatctcacatcagttctctctcttggatttttgagaagagtcctgaagtcagtcattttctcccacagtggtaccctgcctaatgcatttgctaattgattcttttcatttacttattactttaagcaggtgacattcacatactatattatggcctcttatatgtgaaggaaaaataatttcctaacaataatgcctgtgtatacaactgtacgaagatgctgcagcagcctcatgtcatcattctgatctgtctttctggaacttgcatttccaagacagatttttgccctgcttctgccacacagacttacagtttgccaaagccttgcttcaaattgacaacctcatttcggagggatgatgatagattacacctttcatatttccaagtcaacttaattttcttggtcaaaatgcataccaaaattttggtgctggtggcagtgactgtgaaggcggggaaggttatattactgttgaccaaacaggttggtgctcaagatttcagcaaaccagcaggtaacacatatatcctcaccctgttgaactggagcattgtcatgagactaaatttcacaagatttaaacagaattggactttgtcagttccaagcagacagtttaatgagccagtacatcgtttctacgtccctctgccgcaaacctgtaatgttctatccagacactactctgcccaccttggacctaaagtaaaggcaccatagaactactacacaggcagtggtctcaacacctgagaatggtgttgagtaaaaatattcctttgttgtgagcctctgcagttcagggcttacttgtcaccacagcacttcctaacctatcctgattgattcagaagtgtaaggtttgagttttctcaactcagagatttgaatgaaaggaattataaaccaatcatgtctggcattgaaaacaatgtgtagaggcaaagtgggcaggtctccacgtgaacatgcagaaagaagagcaccagggtgaatcaaaaagaactcagcttccaacaagtcaaaagaaacttaatgtaaaatagttaatcaccttgaatggaaaacaggaattttgctaatttatgtggctgataaaataaaccatagaataaattttgagtagaagaggagaacatgttgctgtagataaagatattaggatgaggtttttggcttcagaaacggagaggaagtgacagcttttaaggacaggaacaggaagaaataacagaattttgaaatgtgttgaacagcctggatgtgggagaaaaaaaaaagtaggtttgttagtgatgccaaggtaaagtgattgaaaaatgagcatgccaccaaatggagagagaggaaaaaaagaacacagaaagacagatgaacacaaaaaggggagaggatggcaggtaacttttgcttatacccaagcacttggcacaatgagtctagtacagtaatttacatggggtccacaatgttccttctctcctttagaaaagaaggaatggtcactattttgtattactttgaaataatttatttattttgttataaagtcaaattagcataccacttgaatgagttccatgtacatatagagaaattagtttatgaatatgtggaaatattaaagatagagtgaggtaatgtcaagaaaatctcaatctttgttatttctgacgaaccatttctaaaacataaaaatgaaataaattaatgtttttagactataaatatgaactcatctatatagtttctcatgagaatatgatagtctgtttttatttaaagataaacattgatgctgcttcaaccaagagaatgataaccagaggaagaaaatgcatgttaagggtgaaaaaagtaacactagaatatctttctatgacaatgatatgccagtgatgaaagttagagctatcactgtcagggattccaaatcttctaaaaggaagcacacgtttcagaaactttttctgttctactcatatttgaggctaggactgcaatgatcatgaaacaagagctggagacagagatgatttcacaatttctagctgcatcattttcctctttattgttcagaaaactgaggaggataatagagtatgtgcagatcatgagggtgcctggtggcatgagaaagcagcaatttggtcatcaatactgggatttgagatgctaaggtaaactggtaggaggatatatcctatttggagacatctcctttaatcatttattaacccatcaacaactttttcatcaagcaagtaccacctgccaggcataactcaaaatatgggggacatacaagtacataagccaaacaaaattcctttatctagcagggtttacaatcaaaatcagaagataaacaatgaaaaaaatgcaaaatatagcacatgctggatgttattgaataatttagaaaaaaaatggaaaagataaaatgaaagtgtgtggtatctggagcaaaatttaaaatattttgatcagaggaggctttatctgaaccatctgagagataatctgcgaggaacaaacacttcgggcaaatagtagtgactgatataatcaagaatggattccatgatgaggctttctaaatggactcagggaattaaagcagtggtttttcccagagcaccagaccccaggctcctttgtactcttgttggtagaaggccagaaggtagaaaacactcatttctggaacatccagctcactcaaatcaaataaaaatgtgggacttccttctcactttgtcagtttaacttcctaataaatgcgaatgtgaaggtgttagcatttttttaatgaaaataagtgtttgatctatgttctcaccaattccttaacacaagccactgtgggaatcatatacctggtatacatgtctgaacgaataaagtagcgctcataaagctgtaggtgcttggatgcatcttagattacacactaaaactctcagctttgtttgggtgtcacctaagcatacattcaaatacaaatacaagaagacagtgacacatatctgaatttgggtctgaaggtagaagtcacagaattttcctgtgaaacaatgaatgtgtaaattaagctgcaaaagcatttgggcaagggattttgttgttttctatctgttttaattctcaatactccactgtttaggtatacttcaggactttaaaaatatacatatcccctaattcacatgcactgttcttgaatcttttcaaactccttcctttaaaaaataataaaaatgttgagtattctacatttacattttaatattaaggattttttaaataaaaaaacatttacaaatatttaaagcattagatttatatctatattattttcttgaataattgttggttaatttttataattggaatttgtggtaggaagtttctctcaatatttttactctcttatttaatgttttgtgttattgctgcaaagctaattccaagtcaaaatctatcatattaaacagtagaatataattttgacaatgtgcaatgtttatatttgaactgattatagtttttgaagggaaataaaatataaaatcaaaagtaaaatatacataaagaataaaatataaataaaaagaaaaaaaggggatacgtgggccatagaatattctgtagcaggaattcttattctgcattctgtgaaatgccatgttttgtaagcagaattaaagggatccctgaacttttatgagacaaacagtatatctttattttcactaacattaatggaaattattcttctccttatatatgaatataggcagcaaaccacaaaataagcactacatgactttctcaaaatagtattcacacattttcatatcatattgcagtgattgcagttgccttttgtcataattttcacttgctattaccttgaaaaaaataattaacagccctctcactagatctttttatttaatctattaataaataagtatatggattgcttaatcacaaatgtgtttttctaatattttgattactatatttcaatgtaatctactgtattctagtccaatgtgttttatacgtttaatttttattcttagtggggaacatgagcttcaagaaattgttaaaaagtccaagacaccaaaaaaattacatatgggctttgtcatatacatttttgaactaaataggaaatcctcaaaatgtctgtcatattagaaagttctcttttctctgagagttgtggtggtacaatgaaaaagcagtctatatcttaacttctgtgaattgcatcaaggaaaataaaaaatgcctttcatatttctgcagtaaagagtcttgtgctaaagctttatcattacactcactagaggaattctaacttcatacaatgcagcatttcctaatgcagtgcctataatatctgtatgtgtgtttgtgtgtgtgtgtatgtaggtgcatgtatatgtgtgtatttttcattacccaatgagatacttgatttcttccctattctgatgcaacattttctttttaaaatacatgaaataacttatttagagacaatgcatcttattgaagagaagctaatggcctaaacattttttacctcatttcctcagattttacaaagtatgttgcatagtgaaagggaaacaagatttgatttcattcccaattttgttacttacgagtatttttatttaagtttccgatttcctcataaaaataataagcttgtttttcacttgcttcaagaggctgttgtaaagttcaaatgaaatacaaataaatgtatagtagaagatatcttttcattactaactagcttaataaacagatgttctccattcccttctgtagactgtacccttctggtggctttggctttctgaatgccagggaacaacaggctccttgtcagcctaagttccccacaagtttcactggtgatcaccacagaagaatttttgtcaaatctgttgtctcactcatacttgttattcaaattactcaactcagttaacgagtacacaaaccaatggaatataaatgtgaaaagcaaaagatttgtggtttggaaatttggagcttttggaaatttggaactctctaatacaatttttaaactatgttatcaaactgattttgtgtaagaaaatatgaaagtagaaaaataacttgtaaacatcaacctagaaattaatgaactcagatcatttcccatttatcctcatgttctaatataagtttaaagaatttgaacctggattttgtatggactgcattagcggtgtattttattcaagaaagacaagggacttcaattcccagactgctaagttggctcatatatggctttacttactcatcagtacaacattattattattttatgctatgtgttgggctcccttttaggtgccaggtataatgagattaataatacaaaataacattgttatgaaacgtatataacattgtcgttgactaagcaagtaaaatattatagattgtaacatactttcaagtgatataaagaaaaataaagctagctaagggataaaaatgaggtgaaaaccttttaaatagatttgactggaatggcttctttgctgtgctcataaatgagctcagacctaaattatgtgtcctgaattattgaacggggagagacgatttctggcagaggatataccaagtgaaacatccatgttcaaatatatttgaggagaagcaaaaagtctattcctgatggagtaatatgtgtttggaggcgctgaaaaaacattgtgctgatcatatgagaccaggtaagggctttgattctatgctaagttgatgaaaagtccttggaatgtcttaaatataggaatgtcatgatctgatgactttattacttaaaaaaatgacgatagtaaaatgcaagtaatttattttaaaattaatgtataaaagtgttttaatttaaaatattatatttaaggagatatttatgtgtctttgctataattggtatttatttgttcttgaacaaattaagtagatttttactaaaagtactcacatattttatgaaagtaaaccagtatattaatagtaataaaaactggtaaatcttgaagttttgctatgtacaatgaatcttactttgaattttagaaacaggttttaatcaaatcttcataaaagtcctatgaaaaagcaatagactgttttgattacatgtttgacctctagaatcagattgtttaaaaatgttttactgctttgttatttactacttgaacaactctatgcctatttatatatcatagtctacagactatcctctataaattgtggaaaatattagtgcatactccttgtgctttttataagtgttatatagcataatgtagtacacaatctgacacacaaacaatattagccatcataattgttcccttcccttcaaaaatgaaaaaaaaaatgttttaattttgaaatttagaaaggtaaactcctcatgcagaagcatataacaaatatagttgccacattaagacataaacttgagtctatagattctgaagaccaagcatcctaattagttaattctgcagtaattctttggctttgagtaatgctttctacctcataaattctcacagcatctggaacttcaaaattcatgggtatcagcaaagaatgaataacacaaatctttctgcttcctgatgattagaatgactttgtagcagaaatgaacagcctcaatgtttttatgttcagtaaattcatatatcattcttgtacaaataaatgcacattgcaagtaaccaaattcctatcataacccatgacctcattatcaaagctcaatttctgaatattgagataagtgtattaacttaatgtaagattatgtgtttctaaaataggtttgaaaaaattataaattttctgaatattgagttgagatatcaagaaatatccccaacaaaattgtgaacataaaacaagagtagttgttctaatcctaaagagcaatatttgtttttcaaactactatacagagtttctgtaatttaaatagacattttataagacaaatatgttcaaccttttcaattatattgcctctgaatcctattatttatatatacatgttttatgtatatatgtaatttatacctattgtataatattttgttttttctcaaaaaaattccagatttaaagttgtgtgaattatttatttccaaataaaatcagtagcacatggtgaaaatttctgaatttcaattatttctaatttaggttaactttgtaattgatattttttaatatacttatttattttgggaatgattttttttca

SEQ ID NO: 390 - DNA, 40231 bp, Homo sapiens
gaatggaaggagctggtgagtttctcctaacttaagggattcaaaaataatctggacaatcagttggagatatgatactcattcaacaaatatttgttgagtatttactacatgctatgcaccgtgcaaggagctaaagatgtcacagtaaacaagacagatgtggtacctacgctcctggtgtttacactgtcctaagggaggaagacaataaacaagtggacaagcaaattaaataattacagatcgtaatgtgtattatgaaggcaataaataaataggctattgtaatagcaacgaagcaactttcattttatagagagaactcattaaagggataaagatttgaagcagataattctctatataccttccaatataatagtggtaattcattccattgttcatccattctttccttcagcaggcatttactgagcatctactatgtgccaggcactgtggaaggcacttagggatacaaagtaaacagttccacattgtaaagactccagagtcttgtgagagataacaagatgtatacagagatgctgatcccctgtgataaatcctacaagggatcctacacaggagccgatgcacacaggagtgacaaccctgcctgtggctgccagcgaagtcttcacagagaggccatttcagctgcattttcaaggataaggaaggggactgacaatctgcataagaatctttctgaaaagtcagcatctgagatgccaggccttgttaaggagaacgaaggaaaagagacaaaagtgaaatgcacgtttaatgagttaacggagcctgacgaataaatgcactctgaattctggctcctgtgccactgcctgaaaatgcactgggctgagaactgaagctcattgcaaatttaaaacttctagagagaaaccccaacactacgggctcatcacagccctattcccattacagcttccctgtcattccccgccacaaaccttctgctccagactgggtggcctctcactacgccaccactactccaggctcctacagtctgcatgacttaggatgtcttttcccctcttatctccaaatcccacctacccatcaagtcctactgctcccctgaaacctttgggccactctagcctgtggggatttctccctttgagacaccattgtcttaatctgtcattggcacgaaagtgtctcttgtacaattgcattggctctcaaatagattgtaactttgggcaagcaagtaatctaaggtacctacgcctcagtttactcatctgcaaaatgggagtaataaaacacttgttgtaaggatgagatatgtgtgaagcatttagaccactgcctggcccatagtaggcatgatatgaactgtcagctgtgattattgcaagccctctgtagatggaggcatgctttcccatccttcagggacccagtaaagggctcagcattgtcagtgtcaccgctatctgatgagtgaataaatgtcttttattcttattccctcttaatgttcataccaacaagctgggctcaagtttttctcagagaaatgagttttgggcctgaattatgttctggaggttttgtttttcctttccctccaggtgccagctctttgggttgtatatgtgaaataacaattggatggcactttatttaaagccacaacccaattggtaaacctgacacttcagcaattatattttccagctgagagacgtgcaaaacttgagccctagttaattggaaggcataaaaagagcctttttattgcctcacatggatacttcattatggtaataggaggacgggagcctcatttcctctgttgtttctcagacactcttatgtatttctttatgcactaaatatgctttctggtcatttctgtcttcttccctatttccagttctgtttgctttgtctccttccctcccttctgtctctttctcttcttgtcaggcagaaaggatgtaggtctattttctcctctactctccgccctcagtgccttcctccagttccagctttatgcatgagcaaaggagcgatcagccaacaagcttgggaagctctccagaaccatgagtaccttctaggttacagaggctagagtcctacatcttttgtttaccctgggatgccattgtaaacatcctcctgtgtcaccttgtgaaccaggtagggaactcaagattactattttcccattagcatgctagcaaaattacatctatcaaatcggtctattggtttggaaatcagagcacaaagctgagaagtaacataagacagctaagctttgagagtatcttaaagggagtgttggggcacaataccaactcccaggtctctgtctccagtgctcactcccttctgagatagaaacctattgtctttgacagtccactgtacatccccctctgaaagaccccttaaatgtcaagtgtccacaatggaatatatatcatctcacacattcctcattcccacatgtcccgtgggttctcttcttgaatttgttgtcttggaaaaatataccactgaggtggtagatatacaacccagtggcccttatgagaactctcagagccactcccgtctcccttcctgcatatcaccaggcgttccatcctctttagtctgcttcctgaacagccctccaattcatcccttcctcctagccttagctcgcagctctcctctggactgttgttaaagcctcttaacatgtgtcaccccccctacactctcactggacaatccatcttcatacaatgccactgaaaaggtcactctgctacccgaaggacacactctgccttctctcatctctaagcttttgcattagctctcctcccctcctatattctccatccccgtgtccagttgacaagttctgatctgtctttcgagaaggtgttgagtaccttttcaagtgttactttacctgggcagaattagttactcccttctctgtgccccctttaatacttagtacacataattctttgttttacaaatatctgctttatccatctctgcggcttcttgaaggcaggaattatgtcttgtttttctttggattacctcctccaatacatgtttgctgaatgaatgaaaggcttaaatttcacaaaaattcactaaacacctgctttatgcagacatattattctaaaatagtgtaaaactcaatgagtctattctcaaagagcaaacaatctagtctaaaatgggcccaaacattccagtttaaaataggttcaaggagtgccggggtgcttaggagtttttacttaatactgctgcatgttcagttcactgtcaccaggtggcagtagtgtgccatggtcatgtggtccaagccatgaagttcccagaacttcaaaaaagtggttctgcttgggtcgggttgctagattaatagcaagagaaccacaaggggaatgtagactgcgtctgggttctatgtgtggctggacttgcaagggtttgctcttgggagctgcccacagctgcacctggcatgctgtgctgcatttagacacagtgctctctttaatccgtaaacctaaaagcaaggagacttagagatctccaggttgggagcagatctataccttggaagacctcctgctgtgcaattctttttaactgctctcagtggtgagcttctattccgctgtttttaattcagacaacgtctatggcaattaggaggtcttaggtgatctctgttagaacactttccgtaaagagatatgagctgattccaagctacaccacatgaaaaaaaaaatgagtgaaaactgaggaaacagagttacaacagaggacacagagagtgagacaaggtcagtaaaaagtccagtctcttgactagcactacctgaatccctagtccaattccccgcccaggatggggaagacttagctagagccgcaggccaaggacatggacagaaacagaaacagaaatacaagagggagagaggataagagctagatcagtgtttggcagaagtcaggaaatgaggacaagaatgcaagtaggggattagccttgaaaaaattgaagagttaaacccttctgcatttgaggcaagaagtgaacttggattttgccagagtttggtttgtggaaggagatatggagatttgaagaagttcatgcctaatgtcccccatgtgagggataaaataagagggcaagtaaccacccctctccataccaaagagtgagaattaaagagtgatgaagcaggcttgaaaagatggtaaggactagatgaataggaaaagaaactgattaggaataaatttaagaactatacttaaaggtagaattcatgcatttgtagtaaagtaattggcagggttaccaggttttgtgcagcagaactcagaagtcggggagggttccattgttttgcttggttgatttgctgtaggttgggggttaaagaggaggaacagaaataaaagaggagagctaatgaagaatggtggttaggatatagttaaaatgattgaacatggtgtccaggctgggtggggaaggaattaacaagatgggctggaaaaaatcagaagtgactaagcagctgtagacctcaatgacatagaggaggtgagaaatgggaaagctggaagtaaaatgagaaagtgctattgggagctcaagattcccaaagaagagggtgtttctgtgggagagggctgctgatatggagggaggccaagctcattggagtagaggaggttagagcagagactaaattgtcagctcagacttcatcaggctaatctcccaggcccatagcatgagacaataggcaggaagctagagagccagttgcagagtccacagtggctgcaggaaagtgacctggaggctacagatgatggagataggatgaaggagtataaattggatgctgggagttttaatgtaggagggactcttattatctcttacttactagaatgttgatctggatacggcaatgggcaatcgatagaggaatgctccagagagcagaaggaagggcaaaactgaatggagaccaaaagactggagagacgggtgatcggaggagctcataccttacatggaattgtgggatgggcccaatcagattcaggattccaaaggtaatgtaattatatataattggctgatgcctagaacacagcaggttctgaagaaatatctttgtaattaatgaatgtcttttgcttttaggattttttttttttttttaccgtatgtacgtatgtattcagtttccataacttagtctttaaacttgctggctcacctgtagacagcttccaggcctcctcaccacagattacaatagattattcagtgcaattcaactccttcattgcctatctgttttctttctctagaaatccctttctataaaatgtccaatttaactctatatataagagaaacaaaaacataaagtttctagactctttttctgaattaataaaagtaacaataataactgggtggggttattgtgacctcattgcagtttacaaattatctcagttacccatttgtttctcaaaatcccacaaggtaggcaagatgggtattactatgtccaattttgcacataatccgtgtagataggtcctgtgactttccaagactgcacagcttcacatggtgaaaacagaagagccagcctggaacccatgtacttcaagtctgaattacggtctaggacgacggttccttaaacttcagtatgagtttttcttcaaagtacagatttagtaggtctgggatgaggtttcggaatctgcctttgaagcaaacatctgatgctcatgtttcaatgaccatactcagaaaaacactaatctagaaaatccttttcccccttctctcttaaagcggggagaaaaaagagggagatcttacctcctatgaatcaaaggacttttctcgccttggagaactggagcccccagctcttctcttctgcgacctacccacacacactgataaagttaattatctgccctggctaaatgactttccttagcaacaccctagcaactgacatcagctctgccttaggctacaaaaactggaaggagatttcttgaagtccagtatattttacaaaagaacaaaacatctgaacaggaaattaaggggaaagtaaactggattcattgctaggagatgagaaatagacacatgaaatagttcatgacaatccactggaccacagtagtcaaaatgggaaactttttctcctcctcagttctactgaagtccacaggaggggagactgcaggatctcattctatggaggaaaatttaatcaggcaggaggagggagggcattccaggccatgagaaagctgtaagcaaaggtgctgaggcaatactgaagtggaggacacggggagcccagctgggtggtgctgggagctcagattgggatctatgaccaggcatgaccagatggacacagtgagaccagattgtggatggccttagaggccaagtcttaaaatttgggcagagtcagaaggcactgagggtaggcttgttaaaaagtttttattcagagaaaaaatatttatggaacccctaccaggggccgggcactacgatgtgcacggaaaatacagtggtaagccccatagacatcccctacccttctggagcttagaatttagaatggagacaaatactgaacaaatgtaaaattttaaacatcaaacttataaatcaatgggtcattataaatcttaatattaaaagaagccaggtgtggtggctcatgcctgtagtcccaacactttgggaggctgaggcaggaagattgcttgagcccaagagtttgagaccaacctgagcaacataggaagaccctgcctcaagaagaaagaagaaagaggaaaggagaaaggagaaagaagaaggaggaggaggagagggaggaggaagaaggaagaagaaggaggaggaggaggaggagattaaaagaaaaggtactcatgagcttcagcagagttttgggggctggatctattctaggaaatcagaaaggccttctttggggaggcagttttgcactgagatctgaagagtacataggagttggccaatggagagtggtggctaggagagaccaaagagcatgataggattccaggcagagagaacagcacaggcaaagcccatgagagaagagctgcatggctggagaagcagatcaagcagagccttggaggcctggctgaagattctgtctttattctgagagccctgaaaaaccaccaagaaaaaatgttaacctcaggattgacattcaaatctgcatttttaaaaagatcacttgggcttcagtgcagaagacagatggaaggagagcacaagtagacaagggcaacccagttaggaagatgagagaggatgtcaacacagacaggggtagtggtggagaagagcgtgaaacttgatgtggtgatggatcggatgagtggagaagacagcagaggtctgagtgacagccaagctggtttaggaaaacctagctcatgtagtgggattggagcttggtgagctggttagagcctgccgtcatagcccagatgatagggcgaacactgtgtactggaaagtacctcatttggtgttggggatgcctgttttaaatcctggctctttcccttaatagccatggaacattacctcagcaggtaatttcataggctcctaatctgaacaatgggagtgcggaggtgaattgggactgcctacttcccatagttttcctgtcaatatccaataaaaagttaaatattgcattcctgcctacttcatgcccacccatctccaacttagatttgaaccttttgtagatgaatagaggttcaagagcacagatttgagctttcagacataaaataagctttgtgaagacaggggtcacaatttattcatttctgtagtttcctgccctctgagataagatcaggtacactttcaagaaccacttattttagtttgtagcatacatcacaattataattttaaaagattcatataattatgtatttaatatttgcctttgccacaggcctgtaaaatcctcaaaggcaagtaacatatctgtgttttgtatccaagcactgagcacgtggagggtctttgtcatgaatgaatggatggatagaaggatgcatggatggatggatggatgaatttttgttccgtcttctacctaccggtcagcacagagtctagctccaaatctacacttaatgaaagtttgctggatgaatgggaccgtgcaacttggagtgcagcatgagctctgagccagtcgagtgaagatgcagacaattccctcagcactcagacatggatctgagcctcacctcaaaaaggagggccgatcagctggatcaggtgctgctagggtcaagaagggctagggatgagagaagagcataattggcttcagcaaggggttactttcaggtgacctctgagagaaggcgtccagttaatagtggcagtgggaattccagcacaagcactaaggagtaagtgggcaggcagggaggaatggagatctcccatgcacctagcgccctgggcctgtttgtagcattatgaaagagaaaaccctgacctggaaagcaaaggagattgcttgctaattgtaggcacttgaggtgtgtcgaaggccctgggcaaagagaagacgaggaaaccaaagcttctgagggcacctggggagggatgtttgtgtgcactgagaggcagggggcttatggtatccccaagcgggtgagggagcaggcgccactagagaccaactagagtgttttatatgggtcatatcatttacttctagcatatcaccccactacctctaagaaggatgtactggcacccacccccacttccttgttctccagagcaggaaacaagcttggagagtgcgataactagcccaagcttcacaatgggtgagtggcaggactgaggtttgattcgggtctcttcccagagagacactgggagagattcttgccccaggtcttttcccttcaggccctcaggctcagcacctctctgaacatctgtccctggggagtgagaatctgaactaaaatgtaagccaagaaaacacaggctcttcattgaatctttggaaactcctttcctgggctgtaggaggaccttcctgagccttaggcacttttgcctttgctggctctttcctccaagtcaagcatattttatgactgtggaggtataaatacaaatatattaacattatatagtaaaacattttgtttgacataaattttttcttctgatttttacagaaaacattttcatagatctccaaaagtatcgtgggccctaagcgctgtagctaagtcgtttctcctttctcagcctccagtctgacatgttccactatggccttgggaagagcaatgggcccggagtcgccgcatctaaccctgctgtaactggtcgcaagtcacagtttgctcatctataaagtgagcgaaagtaatgtaatctttattgggagtagggaacatgaaggcgagtcgatacagtaagtaagccgccaagcatattgctaggcacagagcaggtgtgcaacaaaagttatttctcaggctttccctcctctgagcgccgtcctccagagggtccggagtgtagctgggggttggagcagcagcctcctaggcgatgggacagagcccacagggtccggtatgccacggtttcttcgtcagaccctgggaatccaacgtcgcaaaataaacacggccgcgccgctaatcgccagttcggaggaaacaaaacagcgctgcgctgggggatctgggcaaaatcagccctccctcctcccgctccttcgccgcggccctcccctcctcgcgctgctctcgttcgcttggctcagctcagctcagctcagcgcagctccgcggccgccaagccgaggcgggcacggtctccgagtcgcggacgccagctccgagctccctctctccgccgcgcctccgccaggtcgcgccttcgtcgggaccacttcgggcaggagtcgcgtggcgaaggcctgcggccgcggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgcagccgtatcctgcgcgcccagggcacgcggcgcgagggctacaccgagttcagcctccgcgtggagggcgaccccgacttctacaagccgggaaccagctaccgcggtaagtggccgcccggcgtggcattaggagagcgggacccggtccccggagggcgccgacctcgcggtgccggaggagggcgcgcggtctccgggcgcgtggcgcgggtgcagcccggcaagggcccttctgtcctggctgccctcggcccttgcagtcgcgagctcggcgcggatcataatccagcgtcccgggccgtcgcgggggccgcagccaggagaggcaccccgcgtttccgacgcgcggttcccaggcggaggatgtaactgagccacacgtcacgccggcctgactgcaagggaggctcgcttctcccccggccgtctgcaggagggaagtaaaactgcctttctccaaatcggtctggaggggacccaggcttctcttggtcgggtcccgggcaaggcagccactccagctttccccgctcagtccctgaaggagagggtacccgattctcaaagactggccctgggcgggacagccactccggcttccctggataggtcccttcaggagaagggactttggcttctccctaaccggtcccggggtgcgggaaggaggggcagggacagcctaaagctcctcgaaagggtccttggaaagaaccccaaattattctctcgtggtcccagacgagatagagtatcttgggtttccagaacaggttcccagtggggacagggtcctcaaagagcttggggtaagctccgagctgcaaggggaattggatgaagatggaaagagaagccccgatgcccgaggcctgctccctggaggccggggaaccttggctccggcagctcggagtctccacgtcccagggatgtcgcgcctacgccgctcggctgagagtggggtttcgggagctcagggaggaggtgtccaagcaggtgagagcctcctaggcgggacaggcagttcgaccagcaccgatctgaagacgcctgactctgtccccacgcccgccacctcgctcctcagcagggtcatctccccagacatcgtttccccgtgcagcagcagccgctctccgggtgggggacaggtaaccaggaagggaagcgagcctgtctggcctcaccttagctcccgccagggagcgtgtcctctcaccctcgccccttcataagtcagctctggtgctaagcagggatgagcgggtcactggggcacctggtggggcaaatgggctcccagctgctgtactttcctcctcgccttcccagttccccagagagccttggacggaagcggtgggagcaacacaggagaaagtctggggcagcgtcagcgggcgccagggtcacgccggagaccaaagccaggggccacccttcttggagcgcttttccccctttcccgggtttgtgtccccgactttctccacccggagctacccaaagccggctccttggtgcccttggcaccttggcgtgctgagcactttgcgaggaacagtctgaccccggcgcgcagctccgcgggatcctgggtactccacgaagaaagattctgggcggagaacaccccgcccagcccgggagggagcgcgcggcttggcaccgcggctagagcgagccgcgccgacgggcggcgactgccactcggtgcagccgggaggcggccgatcctccctgtggaccgcagggaagcgggtatgacttcagtggcctattcggccctccccaaaactgaggacctgagttcacaggggaaactgtccccgctccacgtagcagagaaagaagtggctctggagtccaacagacttgggtttactcgctgtgtgaccttgtgcaagtcatttaatttctctgcacctatttcctagctggaaaaaaaaaaaagctgtttatccaccctctcttggtggtagggagtaaatgagtttacaaaggtgagtgtgcctgagctaaaagagattcctaataagcctaacagttgaatgtgaggcctttattggtttactaatggaggtaggttcttgatcagatttttgtttttgaagagtgttgtgcgtttgaaagcaggtttcctcagctctcctccagtcccattcatctaccagtggttatttgggtcctcatgaattaattgaatgaatgaatgaggtattttttcatatcaggagccttgcctaagactgttgctaatgcaagcccaggaagattttttcagtgacttagactagtctgaggttcaggccaagtgtacccagcgtctcttttcacactaatcctccgtgttttagttgagcattggcagctggtggccctagcactgggaaggagatacagctggtattcacggggccaaagaggtttcagaactacctaaacgtccagggccagcaggtggggaactgggactggatagggagtgtcctggactttcaccctacaggctactcctgcctaaacagccatctggactttgacaccccaactcaggctatagattgggcaatcatcttttctcccttcttatggctaaaagaccttggaagagatcttgcaggaaccatgctgaggttttccaagtaaatatcctgcaattagcaaacctgattctgccactcaaagtccgaaagaaaaggtactggcctagtttgtgacattttctgttggctccttctttcttagaataattatgttaaaagtaactcaaacacattctgctcattgtcctgacttaaggctgtgaagctggcattcccctggtgttctatttgctttttaattttttcatgaattaggattcctcacaatccttggaatcaatgacttgttttcctgcctcaaatctttgtccacagtattccagttcatccccaagcagcttctgttctttgtgcctgctgtctaagtacagtctttaggtactctagaccggaataaaatggtcactattaaaaaagactgaaacatggagtttcttccccaaaacctgaatccagttgagatcattattttgtcttttccaagttgttagtattatattgatttccttttctttcccaccacttctctctactctccctccctcttcccacagtcccccctccctccaacggcaataattgtgctttagaaagctctgaaaggcctgctctgtttctggccagggcctcctttgaaaaggagattacagtgattaaaaataacaagttgaggatcctcaaggggcttcccttatacaggaggacaattcgcaggaccagcctttcccagatcacaatttcaagccaaacagaagaaaatccactgaaatattcaagaattgattgaaaataaaagaggctcttttgtcttactggaggtctgtttattaggaaaataaagtcagactctggctaatgagagtggcttttcctagatgtattttaaagagacatttcaaggaacttgatgggaaaagaatgtccagtagaggtttcaaaagctggtccaacttcaagcataattgaggggtttatcctaaactgggaggtttggagacctccaaagctgcatggtttttcctttgtcccacactgagacacacactgaccacaggggtggacacctcagcctggtggaaagcgcacaggctttgatgttgggtgggttggtttcaggtcctccttggtcacatattcactgtgtgatctcaggaagccacttcacctctctgagccaatttctccatctgtaaaatgagggtgttttgattttttcccagcattcctgtgagaattagaaataattcatgtcaaaagaaattgtcacacagtggttgctaaaaaaatatgttatgagatgattattttggaaatagaaaaatacttagcagcaaagccctggataagatattgtgttaagttcttccgactcatctcacttattccttacagtactttgaggaagtttctgatcgttactgttttatggatgagaagactaaacctcagagaagtttattccttatccatggtcacacagctaataatcagcagaatcaggatacagtctcaggtctgtctgactcctaaatctgtgctcttaaccagtcttatgtgctgactcaatgaaattagttgggaatagaatgaaattcactcagctaccctcagccttctggatggtgagccttccttcaaggaaaacagaacaacaaatcaagatagtaactgacatctctcaggagaattactttatattactacaaagtaatataaagtgataaatccttattcacatttgctgttttctcttattggcttcagtgttgcatttccccataaactagaggattaatttagaaacatgaagaaccttgtcagcctttggccaattccttttgtttgtggggaaacaaaaacaaattggataggaaaaaaaaaacccagaaagaaaaaaaaaaaaagaaaaaacagatttgactgttgttttgtttttacatacagatgttatatgaccatgcctgtaaaattatatgtttggaaaggacatatttaggctctaagaaatttacacaagatgaggtcttttaaataaactatttcctggatggtggagtttttaaaaacttaagtgctgctgatgatattataattaagccacccctcctacctctcttcccttttttgcaccattccctgcttttttgttatgtaactatttctaaccattacttaagtatttagttcaaactgataataaaaattagaaaatgcaaacatagctaatgcttaatggttgtggagattgtttattgctctgagttttaggaaatgaaagaaataaaaacatacaaaaaagcatatcaaaatggaatttttcaaggtttaaaacttgagtactcccccatacacagataagctgtttcattacagctgactctttcagttgcatcaagaagctataatcactgatacgtttaccactatgggctggtatatcaggagcttttcactctcacactgtccatttgcttgttatacagactgtcacatatatataggtcaatatcaatttctgttgtgaggtggggggactcttaccatgttatattagtcatagtacaggctaagctcatgttactaacagaatccaaaacacagtgttttaaacaagaggtaaatgggagatccagcatgatgggaggctttgctccataaggccatccaggaaccaggctccttctaccttgttccctgacatcttcttgcactctgctgtgtagttggtggctacttagccgtgtgtagctatgaagtacttgaaatgtggctattctgaatggagatgtgctgtaagtataaaatacacaatgactgttgaaaatttagtatacaaagagtaaactcattaattgtgtattattacatattaaaattataattgtataaagtaaaatacactagttaaaactaattttgcctattttcacttatgttaatggatacctggtaacaaaattaatttcacccagcttgagcttatttctactaaacagcactgttttaagttgctgttctcctcagcaccgttacagccgaggagaacctctgcacacctgtattcagtcagcatgcagtggactggggggagaggaagtagaggacttcagttttcttttaataatgtgacccagaaactgcacccagcacttctaaacacactccgttggcaaaaattcagtcatgtggtcatacctagctgcaaggaaggctgggaaatatagcatttagctgggtagccacatgcccagctaaaacttgaagaatttatttttcaaaaagatgaaacaaagtaaatttctaaggatcatattaacggtctctgtcacatattttcatgcatagtcatgtaaaaacacaatatatcttactttctcagtgaaaggtcagctaggtgggtcaacttgacaacatataaactgatgttcctgctaagaatcagcagaggaagccagatgcagtggctcacacctgtaacctcaacactttgggaggctgagacaggtggattgcttaaccccaggagttcaaaatcagcctggacaatatggcaaaacccatctctacaaaaaaaaaaaaaaaaaaaaattagctggctgtggtgtctcatacctgtagacccagctactcaggaggctgaggcaggaggatctcttgagctggagaagttgaggctgcagtgagtgaagattgtgccagtgcacccagcctgggcgacaaagtgagaccctgtctcaaaagaagggaaaaagagcagaggcaggagtgctggggtgtgtatgtgcaagcttatgttgtggcttgttttgtctcattctcctttctcaataaaagaggaagcagcaaagaatgaaaggaatgagggtaaggtaaatcaagaaaacaaaggggtggtgtgggaagagaaaaagaaaaatgaaaacccactggggtatacattcagaatgaaaatgaaagaaaatatttgagtatggcagagtcccattaggatgggactacagggctagatacaagaagagccatggaaagcaaacatcacataagtcaaaattagtcctttgaaattatacgtaagatataacccagataccagcttcaacctagccttatctaaacaccctacccccaatattcctgtaagtgaggaatagaaacgaattggcatgtatcaataagtctagcccttctagtttccctccagcattggaagagagcaatgtttcctcagttgagtagcagataaacccttggtttgctctgacatgcaagtacaaaatcttcatcatgtgatggagtaagggagctgagaggctcatctcatgctcactcaggcacatgcatgcattgaatggagtagcaagtggcccaaatcatttaaagcattacattctctgttttttctcctccaatagtgtgcagttgtgtttgatttttaccaaatgcacctctcttggagcatctatggtgtcaggaagcttgctatatcacataaaaagctttttgtgatgcttgtcagctcctgctggtataaaatgccccacttttacagaatgttttggcagggatggagttggggtgcagataggacagggcaaggagttaagtgagaccactagaagtcctttgtgaggtctatgtagagcaggcttctacctttcgcagaatattcataaattccatgaaatgttcaggaaaacttaagggacctacccacatccactgattttcttgaggctaggagacccataggaaataacttgaaccctctctacagttgtggttgagatatttgccaatatgtctcatggactgggtgagagaaacagggaagagttccaagaacaagtcaccatctgtggggcaggagtgtgggcaggtgggcacagtcacagcaggatgaaccaaatggtgattctaggtgctacaggaagctcttttctcctcctcttcctcctcctcctccttgtcctccccccaactcctgccaacactatcctttgaattttccaaatacactaagctcattcgctccccagggccttcatccttgctcttcatgcctgggatggttgtcctcagatctttgcatggctgactccttgtcttttaagggaatctctttaaagaggctgctctcactaccaatttatgtttcccgtcactttcgcctgattttgttttcttcatagccttaaacactctctgaaattctctcgtttattgtctgcctcctacagctagaatacaagctttatgagagcaaagactttgtctttcttatttgccattttatcttcaattcccagaacagtgcctgggcatagcaggcattaaatcattatttgttgaaaaaaataaagtatcattgaagccccaagaaccctggtgtgagctctctaagagagctggatggaggaaggggaaggtatttctctctcagccagagagaaaggtgagcacccaagggatggcagacaggaggcaaggagctccaggtggtggcagcagagagaaaggatgccagtgccacaggggcgttggccagaggctgagggcagatggcctgtgtccagagtgcagaccactgggagggaagagagagcagttgcatcatggtggaagctgaaacgctgctgctgtggcatgaaaagcagagcaacagcaggcaaaagggcagaggcaaggggctgccaacctcagaaactggctctgagaaactggctctgagtatctggagaagtaggcctgaggggattattgagccatcaaacctagacatcaattattaaagtgacattccctagaaccagcacattgtggagtcatttgtagtactttccaaacctagctatgcctttggagagtgtaaaaactaaactaaaatttaatttaataaaaaaacttcctgggccccaccctaacaaaaggctggattccaggaatcttatattcttctttcttttttcactcttttaaaggaaaatgatgagacacaaagaaaaggtggcccttttcctatgagcatgcttccccatcaccacctctcctagccccagccccagcctcccacacactttagcacctggtcacatcattgccctatcctgttactatgggacacactcatttagtgaccagtggaatatcctcaaagccaacatgactgcaacatttcccgcttggcagtagggtgatggggagaagagaaccatgagttttccttaggtggccacaatcacagactggcgaagcttgagccagggctgacttgcttgtacttctctgccaccaaagtctgcctaccatgtaactttcacacatctgtccaaggttctgtcctttggaatcaaggaaaataaggtctcccctgggccatatgtcagcccttgagatgtttgtgaataaatagctgtcatggcttctcttctgactaaaatgccccatttctttaaccattctttgtgggttgcagttgcttgctcccttgtactttgtgccccagatgtggtctgttaggggcaggacatgatagaatgattatctccttgtcctggacattgtggttgtgtgaagcttgccaggtcttgtgtttgctattttggcagctgtgccgtagtctggaatcacactgagcttgcagccaactcaaattcttgcaattttctggaaggcctgcttccctctttaacctagactggtgaaaatggtccttgaacataaaatttgacatggtttatcgttagatttaatccagcatgtttggatccatccctgtagctgtcagccattcatgaatctgtatttggtccctgagtgatttattcacataatctaattttggattatgcacagtgttgataagaaggtcttgtaagtctttatcaatgaagttgataagaatattgagcaactcagagtctaggatagagccctctgacattccttagagtctttctctaaagctgatatttagctaaatagttttgaagtcaagagatctgctgtcatcccaatgacatttacataccaactgccacccccagcataagccacctcagtttagttctgaatactgtttcctgagcctgctggtgattcttgtagtttaggcagagtgttttctttctttgcttcaaaattagtcaggactctttccactgcaagtgataggaacaaagtcaacctaactaaagcagaaaagggaatgcactgattcccatatttgcaaagcccaggggtggctcttgcttcaggcataaatgggtctagtgactcaaatggggtcattccatctctctctctctctctgtcccccgttccctccttcgctctatctttttgtccctcgcttctaccttctctgtcttgctccttccatcctcaatctcttggctgtgttttgccctcattttttcttactacagataaactttctccaaatgacagggaggatagctgccagcaaccttcagtgaaaatcctcttagctcatcctgtgactaaaagaaaagcccctttccttctaactacaaactgaaacatcccagggaagattgtgattagtccagtatgggtcacatggccagggcaatggcatggagatagactggatctggatcacagtcacttttgtgacttgatatttgaggaaggaggatgaactgtgattggaagccccagtgaccacagggtcagagtaggggcagcagtgggggtcccccagagcttcctgccctcatccacattcccagctacgttctcttggctgacacatctctacctccccagaggcatccttcccattattcctcctgctatccacgtgttgttcagctcaggacccattcatctggctctgagctgttccacgacgaggtcacacaatggggaaaggattaacttttattgagctgctgcaatgtgcttcattgcattatctccttgaatcctcatgacaaatccacgagatgataattatgatccttatttcacagaggagactgatttatttttaatatattttattgatttagcaaatgtttttatatacttcctattaccaattcattaattgtcatgatgacaacaggaggtaaatactattaaatattactgctgttttacaggtaaggacatgtagacaaggagagcttgagtaacttgcccaaaattacacataataaacagggaaatttgaaccaagtctgttaactacgtctgttatagaaaaatgacccttacaaatttaagtatgcatgatcttcagtttgagtgggagaaacttcatctctgcctggggatgctgagagcactggctgaagaaggccatccaggggaacagcataatccaaccccaccatcctcacctgctcacttttggattctcagtcttgccttccagtcttccaggccatcaccagcaaatcttttcttgcctgacctggctaggtggcctgaattactgtgccaaatttttaaatagaaatatatgagttgcagctcctcagagctctggaagttgtgcagaatagaaaggggagcactgtgactaacttaatgtcccaacagtctttataactccatgttataagttaaagcagaagctgacgcgcattgtggttgaggtgtgtagcaagactggggcatttcagtaacacatagcaggtggatggcaggggctggccataggatggagctgggactcagggtcttctcattgaggttggagttctattaataattctgaaacccaagagacagagtgcggaggaagatggaactggacaagatccagtgagggtaataggcatagaagatgaatttgggtaatagtttattagagtttttgttagaaggttgacacaccaacatttgaaagacccagaaagctatttggtaattaggtagggtaagtgtacccaaggatggaaagaactctgccctgggtcgggatttgaggccaggctctagtgtgaaatatcagtcttcatataaataaggcaggcctttgttactgatgtggcttttagggcaaagctgtaattcaataattacacaacctccagcctgatcttcctaaaccataaatctgaatatgaaatgtcctagcgcaagcccttcagtactgcctcatcccccctccccagggtgatatccacacttcttatcaaggcattgaaggcctttgatcatcttccccctgcttatcttcctcaccaagccttttatcacacccttcctcccagaatgcaacttatgaaatacagaatcagttctggtttccagggccaagactggcccatcacacatttctgctacatgggatgctgttgattcccttgtccactggataaactcctattcttcattcaacttacaacacagatactacctcctccttgaagcctcttcgaattcacccagatagacgcagatgttctctcctctgcaaccccagaacacattgttcatacctccataacacactttacatgttataaaaaatatctgttgctatattttttcccccaggtactagactgtgtgctcctagagagcagacgccatgtcttttttactctgtgtctccagggatgtagcactgagctagtgtagaccaaatgctcagtaaagataaaaggatgagggaggttgatgtattgctcaaggtaacccatgggaactttggaaaagggaccagaataggaatgagaaaactatgcatttaagacaaataaaaccttttttgttcattcattcaacaagtatatattgagcatttactatgtgtaaagtggtatgctagatgctaaagatgcagtggagttcaagacaatttgtttctgcactcatggagagtacaggttattaggggagacaagcatttaacaaatagtttcataaacacgtatggaactgaaattgggtgagaggtattccagaaaaggggtattgtgtggaggtgaaaggggcagggaggtcctcacagggcactctgagtgtcatgggctgtaggaagccttgctttattataaggacttacccaaatctctccataacctgaacttgtaagaatcgtccccaaagccaattctctccattgcaatccttccagtggtccttcattggcacctactagagtttttctttggaggttcaatcattgttcctgaggaccagctctttgaaacacattgttgggtaatcagcctgatgagcattatgatcttttatcataatcacaaatttcatcataatcttcatccccaatatcaccatcaccactcaccaccatcaccatcaccatcataaatactaccaccatcattatcatcatcatcccttaaaattcttgaacagtttacatgttccaggcactgggataaatatttatttaactctacgttcctataagaaaggcgatatcatcaacctctttttaaaaataaggaaatagattaagtaatttaccagagatcacataagtggtagctctgggattctaatcctaaatgtttgctgttaatcagttccccggatgtactcacaagatggctctgaatggaattccttttttttaatccttcataagcatttttctttaatttcttggatctcttaatagcctctcaggggaggcaattgggaggagtcattagagagaagattctattatttactgccaagcagtcattttaggttattactgggactcagaacacactgcacatttgtacctttcagaaggaagttgtataatgaggttctctggaaagatagagtctcctctattccttcaaattatactgtgtaacaacatcatcaccagtgataattatggattaaaaccccacactgagttcagcttccagagccttcatctcatgtgttatatttaatagggttgtgtacaaccttagctttctagaacctacaggaatgcagtattatgggaagctgagtttatgattagccctttaagcacactgagcagatgtacaaaagttgggatatttatcattcagaaacattgtttaggaatcttttaatcaaaatataacttacataaggaaaagtttacaaatgatagagtgtggtgaattatcacatgttgaatatactcatgtaaccagcacccagatcaagaaacagatcatgactagctcttcagcagcatcccttgttctgcctccatgttgcactccctccctttcctgtacatgttactactgtcctgacctctagcaccatgaattactttgcctgtttttgagctttatgtaaatatatataaatgtaatcataccatttgtattctcttgtgcctgtcttctgtcacttgagattacgtttgtgagatttatccatgttgcatgtggcagtatgtgttcattttcctgcctgtgaggcatttggttatatgaatatgccacaatttatatacctattctagggctgaagggcatttgagtatttccacttggatgctactacaaataatgttactactaatattcttataggtatctttggtgcacatatatatgcatttctgttgatttaagatggtattgctgggtgatagggtaagagtatgttcagcttcagtaaacactgccaaagaatttagcagcaaaattgctaattttcacttctatcaacagtgtgtgaaagttctagttaacatcactggatattgttaattcttttaaatttagccaaactgttagatacgcagtactatttcattgtagatttaatttttatttccctattgactactgaggttgagagcctttgcatatgtttattggccattgggcaccttcttttgtgaagtattagtttgtgcatttgtctttcttatttttcttctgttgagttgtctgtctttttcttattgatctgaaatagttctttatgtattttagataaaagtcagtttctggttatatggttgcaaatatcttctttgacactgtgacttgcttcttcactcttaatggtatcttttgatgagcaaaagtttgatatcaccccatttatatatcttctcctttattgttagtgcttttttatgctctatgtaagaaatctttgttactccaaggtcattcgcattttatttcatgctgccttcttaaaattttgttttgcttttcacatttagctgtacaatctatgtggaatttactctgtgtatgatgtgagttaagggccaagatttacctttttctgcatggtcattcagttgtcctagcaccacttactgaaaagattatcttttctccattgctctgatgtattaggttggtgtgaaagtaattgtggtttttgccatggcaaaaccattaatggccaaaactgcaattacttttgcaccaacctaatacatcctttgtcataaaccaagcttctgtatatttgtggaactttcctggaccctaagctgatcaactggcccatttttcttaccttgctatagtccactggcttagtttctgtagctgtgtaagtcttgatatctgggagtataagcccttcaattttgcacttctttcattaagattgtcttggacaatcttggccctttgcatttccatataaattttagaaccagcttgtcaatatcacaaagagcatactgggattttaatttagattgatgaaacctatagatcaatttgaggataattgacatctttagcaatactgagccaaccagtctaggaacactcaagtaaatttaatagcacgtcaactccgcactggtcactgtgctgagcttagatgggttcttacccttgaacgtcttacaaatgtgtaaagaaacacataaacacaaaatataatctaattcgatactcttatcactgataataatgagttcatatttactaaggactttacacatattacttcatttatagcttgcactgatactttgaggtaagtgctgttactatgcctattatgtaggtatttttaatttcagtagggtccaagagaaaaggcatgcaggtctttatggggaaatcagaggaaacatcacacaaacggtggagatttggctgacttttgaagtttgcagaatggaggagcttgaccattccaagttatatgagtagctcatgaaaaaatacaacagggcgacatgacatggattttcaggaaacttctagagagtgaatccaaggattgaaatgtagtatggcaggggaatgggagcatggttagtgaagctggagaggcagagcctgagggcttcttggtctgcggagtttgagctttgtcctaaaggcagtggctgtggagcagggattatctgtcttggctggggttccccggaggctgattgtattcatttcctaggactgctgtacaaattactataaattgttggcttgaaacaacataaatttattctctcatatttctggaggctagacatctgaaatcaaggtatccgacggtgttttcttctggagggctctgagagaaagttggttccatgcctctcgcctggcttctggtggttgtcaacaggccttagctttctgcggcttgtaaatgcatggctctaatatctgcctctgtcatctcgtggcattcttccctgtgtgtctctgtgtcttttcttatagggacataagttgtatgggatttagggcccacctgaatccagcattacctcatcttaacaaactgcatctgcaaagaccctatttccaaatgagttcacattcccaagtatggattagaacttcaacatatcttaaaccgtaacacaagcctcagatgaggattcagatgaaagtgattcttttaaggaaatgctcccaggggaaactagtaagagagtaggggaagcaggacagcaactgggaaggtgtcctgccagcctgtgatcccaggcatggtcccttcaggtagtttcagtcagatcctgcggggccattttggagtgtaaagtgcctctaagaattgtcctcacctgatgcaaggcagctggacctttcatcttaggcagagtaggctccagtaacctgaggaccagggacacaagagccacaggggctggccacgggaagcagaaatatattagtgccagggtcacattaaaatgtaaaaaggtatttgaagaaatctggatgaagtatccttagtgtttgttactttgtcctctgttccctttcctccagaattgtgtataatggccttgaagaccacccaccctcaccctagagagtctaagactgctttttggctgtctgtctgtccttcagagattcccagctctgtcccctgacagcataaccaccattttttttgcttgacactgaacactacacttttcttactcttctttgctttattgtgctttttttcccctcattccttctttttttttttgacagagtcacgctctgttgcccaggctacagtgcagtggtgcaatctcggctcactgcaacctctgcctcctgggttccagcaattctcctgcctcagcctcgtgagtagctgggattacaggcatgtgccaccatgtccggctaattttttgtatttttagtagagatggggtttcaccatgttggccaggctggtcttgaaccctggcctcaagtgatccacccacctcggcctcccagagtgctgggattacaggcatgagctgccgcgcctagccccttctttctttttttctatctgatcttttacagacatcagtagctcctttacttttgtgggataaccggccaatcacagcatgtcatttaccttctttatgtcttagagttctttgctgtgtcattctgttggtggctcaagagcagccactacattatccaagacagtggttttatttgttggagttttagggtacttctttttattattattattatattttaagttttagggtacatgtgcacaacgtgcaggtttgttacatgtgtatacattagggcacttcattttcaagactaaaactagtttaaggaatttggaagactaaatgcccctctttaacaggaggctgcatatcatactcacaaatattatatgtcaaatgaattgattttttaaagtttaaaaacttaataatcagtcaatatttgtggaagatctataacatgatgaatatattcggtttgtgaagccttggatatagtgttaaactggggagtgggccttcaaatctgaccctaagttgcccactggatgattttatgatcttaggtgtgtctgttgacctttctatgttttactttcctatccgtgaaattggagagctgaattagaagatacttgagatcccttgaaggtctaatagtctgtaactccatatctaatgtccaggatcttagcacttttatgcaggcagtaaagtaatttaaatctcaatttacatcaatttaaagaaacttgaattgaacatctattagatgccaggctctgtgctaggttctggggataaaaagagaatgaaaacccagcccctctcctgtattagcacagcccagtggagaaggcaaatcaacaaagaattgcaattcagttcaaaaaaatactgcaataaaagatttccatctcaggagactgggggtccaatgggatggaggaccatgattgccatgttgagaagatccttgagctagattttttttgttgcttttgtttttgttttttgagatggagtctcactctgtcactcaggctggagtgcaatggcacaatcgcggcttactgcaagctccacctcccgggttcacaccattctcctgtctcagcctcccaagtagctgggactacaggtgcctaccaccacgcctggctaattgtttgtatttttagtagagacggggtttcaccgtgttagccaggatggtctcgaactcttgaccttgtgatccgcccacctcggcctcctaaagtgctgggattacaggcgtgagccaccgtgcccggccgagctagattttaacggaaaaatcgtttcctgggtagatgtaggaatgaagagtataacagacttataattccagctgctgtaacaggtggccctccacaacataagtttatttccagctcatgcgaagtacagtatggatgtttctggtcagtaggtgattttccgtggggttgtttaaaatccccagtttccttccctcttgtggttccacggccctgctcctgggacatcagagtcttctgctggaccctgcattaagcaggcaaaggcaagagagtgagagtgcagggtcatgtggaaagcttgtacaggtcaggcttggaagtagagtatagcagtactcccttatccgaggttttgctttctgtggtttcagttacctgcagtaaactgtggtccaaaactatcaattggaaaattccaaaaataaacaattcataagttttaaattgcatgctgttttgagtattgttatgattgtgtcttattagttattgttgatttcctactgtgcctaatttataaattaaactttatcatatgtatgtatgtatgtatgtatgtatgtatgtaaaggaaaaccatagtaagcatagggtttggtactatccatgatttcaggcatccatttggggtcttggcatgtgtcttggccttatctgcagggggctactgtatatcatgtctgtccatgacttccactggcagaacttggttataaagctgacttaactgcaaaggaggctgggaaatgcagtgtagctgtttccacaagaaaaatgaaatatgttttgaagaacacacagcagcctctgccacaaaggtcatcctacaggattttgtgctgtgaaggactagttttctcttgggccagtctaatggaagtgtaatgttagacaattgtgaagattgagtttctgaccagggactatctttatcaaattgtggttattgggagagagctcaccacacccctggttgggtcaagaatccccaagtaagatagcagctcagatatttaacaggttctgaaatgtaagagggagctgggtgaagagggtaagagttctcacctcaatggatgaaggcctcaacactgtccacggcctctgtaactcacaggtctgggatatcgatggagaactcaggtctatcccatttgacaaatggacaataattgattcttatacttaaaacctgcttttttctctctctgcagtaacactttcagctgctcctccctcctacttcagaggattcacattaattgccctcagagagaacagagagggtgataaggaagaagaccatgctgggaccttccaggtaagaccctgcctgggcttattcagtggccctccctgccctaggaggtagaggctggagaggtacaagtgtctcaggtggcttcccatgcagtcccttgaccgttggccaacgggggcaggtccatttgaaagggtcatcatggagcaagcagcaaatgccgcacacctatctgagcaaggttggccatggggcaggccttgttttgtctcagcagatcacggggctcttctctgggcccacagtgtccttcagcagccaagcgtggggagagcacttggagccctggctaggcctggctgttttgcctgcacaggcatttcgtgattgactggttaattctcaaatgtaaacggaacaagagctcgggaccgccaggctggagggagttcaaagcacaggagaaggactattaagggaatgtagagattgatttatgagggaagattaaaagaattaaacatgcttttcttggccaaatgaacagggccgagtttaagaggtggtaatggtctttaaatgtcagtcctcacagaacaacctcctcaaggggaagcttcatttgactttgcatgaaagggcacactaagacaaaagtgggtcaagaaaagaaagggaatcgcacagacaaggaccccgacagtgagtcatatttcactgtggaatattcttccaagggaagtggtaggaacgtcatcccctttcagaggtttagaaaagagccggcaagttgtcagaacacatcccagaaggactggagtgatcctaggaggaggcctggccaaatttgctgtaattacttctcatctcagatttccattgttctggaattcatttttatctggcatttgcaaattaagaagaaaaaaactcagagaatacttatacccatagctggctgctggagactctggtgcaatctgtgggctccgtggaggaccctgacccaaatacctcccttatccaaaggcatcttttaatccttgtggccaggttgtaatttttaatcctgtgatttaaattatttttctgctctctgggattctaggttttgggcctggtgagacttaattccacgctcaccgtaatgtccttctatggcaaagaacctcttggcatgtatctgaaagggtgacccaataataatactagcaacagccaatatttgttgggtacataccatatgccagacactatgctaagtgctttactttatcttagtttatcctgtctttgtttagtttatctttgtttaattctcaaaacaaccctagtatgtaggaactattatccccatttttggaccaggaaattgaaactagagagattaaatcacttgcctaagcttgcttattgcttgttttagtccattttgtgtttctctaacaaaacacctgacactagataatgtataaacaatagaagtttatttcacttacttgacatgagactgggaagtctcatatcaaggtacctgcatcttatgagggccttcttgctgcattatcccatggggaaaggcagaagggtaagagaaggtgagagcaagaggggtccaaactcacctttataacaaatccactctcaagataactaatccactcccacgacaaccacaatccattcacaaaggtagagccatcacgacttcatcacctcttattaggccctacctctcaacactgttgcattggggattaagtttccaacacataaactttgggggacacattcaaaccatagcagcactgttctggctaaattcagtaagttgatagtcttctctgactcacagttgtttctgcttagcttaatccttgttcttgcaactgattggtgaatacagggccctgctcatagtgggcagcgcataaatatttgctgaatgagtggataaacatttgactctttctgctagtgtccagacctcagtcctatttggaactgttgttgaactcctatctctgtatgcatcctcccttcttcctcctcttagagcttcagacatcctctcttgttacacagcagtggttctcagaatgcagtctcaggaccagcagcatcagcaacacctgggaacttgttagaaatgcaaaatctcaagcccatccagacttactgaatcagaaactctgagggcagggccctcacaacctgtgttttaacaagccttcagggtgaatctgatgcatgctcagatttgggacccattattctaatgagacatagaccagccctctaacaggatgtcgtccatcatcacgtcaacacatctgtctgttcctatctattctctcattgtttccaccagccctagagggatcaaagtgggataagaatatgaaaatgcctagcatatgataacgacaatagctaacacttaaacagtgcttgtgtgccagatactgttctgagtggtttatatttgttaactgagtttatcttcagagtgacatgatgaggtaagcattattatcctattttccacagaagagaaacttgtggcaaagaacaactaagtaactttcctaagatgcccagctctaagtgataaagctggggttcaaacccgggcagtctgtctctgggtacctgcctgtgaccactgtgtatgccatctctcagtgtatacctgttaaatgaaaaaataagggcccactatgacttttatgacagtctctgtgccaggtgctttatatgcattagccttttcttttttccccttaattcttgtagcaaccttgtgtggtcagtattgttatcttcatttttcagatgatgaaactgagtccccaaggagttcactaagttgactaagacagtccagcatctcaagggtccaaacactgtgccagtttcttatttctcaaaagttatctcctcacccctgccctgccctacccttgtgccatcaaaatgcacactccgcttgggttccaattgtctcagagatttgggggaaggaatcatagcccatgcccctcatcttacttcacctgctcctgtgatatgtggcccccatgctgtcccttccaaatctatcatgaaagtattttttctctgtaccaaagctgttatctttggagtccttgatttattcagcagcatttgttgagtgcctgctgggtgctaggcactgagttaggcattggggatagggtggtgagaaaaacagagatagtcctcatgaagcctaaggagtcctccttgtcatcatcccataaactgacctctgttgctgaaagtcaacaagtcacccattgaaacataagccaacaatcagaaagaacaaatgccattgtaattaaatatatatatatagtgatttaacaaatagataaagacttctgtttaacaccttcacttcaaatatgatgactttgagggcttaacaacaaccacaaaattctaatactcattcattgatacataatatttaacatatttgttggatacgtatgatattgttatatatatagaatgtgtaatgatcaagtcaaatatttcaggtatcccgtcactttgaatatttatcatttctatgtgttaggaacaattcaaatactctcttcttgctactttgaaatacacaatacattgttgttaactatagtcactctgaatattcttttttttttttttaagttctggggtacgtgtgcagttttgctacataggtatacatgtgccatggtggtttgctgcactcataaacccgtcacctacattagatatttctcctaatgttatctctcccctagcccccgaccccccgacagaccctggtatgtgatgttcccctccctatgtccacgtgttctcattgttcaactcccacttatgagtgtgaacatgcggtgtttggttttctgttcttgtgatagtttgctgagaatgatggtttccagcttcatccatgtccctgcaaaggacatgaactcatccttttttatggctgcatagtattccatggtgtatatgtgccacattttctttatccagtctattattgatggacatttgggttggttccaactttttgctattgtgaatagtgccacagtaaatatatgtgtgtatgtgtccttatagtataatgatttataatcctttggatgtatacccagtaatgggatcgctgggtcaaatggtatttctagatctagatctttgaggaatcactacactgtcttccacaatggttgaactaatttacactcccaccaacagtgtaaaagcgttcctatttctctacatcctctccagcatctgttgtttcctgactttttaatgatcaccattctaactggcgtgagatggtatctcattgtggttttgatttgcctttctctaatgaccagtgatgataagcatttttttcatatgtctgttggctgcataaatgtcttcttttgagaagtgtctgttaatatcctttgcccactttttgtttgtttttttcctgtaaacttaagttctttgtagattctggatataagccctttgtcagatggatagagtgcaaaaattttctcccattctgtaggttgcctgttcactctgatggtagtttcttttgctgtgcagaagctctttagtttaattagatcccatttgtcaattttggcttttgttacctttgctttggtgttttagacatgaagtctttgcccatgcttatgtcctgaatggtattgctcaggttttcttctaggattttcatggtcctaggtcttacatttaagtttctgatccaccttgagctgatttttgtataaggtgtaaggaagaggtccagtttcagttttctgcatatggctagccatttttcccaacaacatttattaaataagcaatggggaaaagattccctatttgtgtcaggtttgtcaaagatcagatggttgtagttgtgtggtattatttctgaaggctctgttctgttccattggtctatatatctgttttggtaccagtatcatgctgttttggttactgtagccttgtagtatagtttgaagtcaggtagcatgatgcctccagctttgtttttcttgcctaggattgtcttggctattgcgggctcttttttggctccatatgaagtttaaagtagttttttccaattctgtgagcaaagtcagtggtagcttgatggggatagcattgaatctataaattactttgggcagtatggccattttcatgatattgattcttcctatccatgagcatggaatgtttttccatttgtttgtgtcctctcttttgtccttgagcagtggtttgtagttctccttgaagaggtccttcacatcccttttaagttgtattcctaggtattttattctcttactagtaattgtgaatgggagttcactcatgatttggctctctgtttgtctgttattggcgtataggaatgcttgtgatttttgcacattgattttgtatcctgagactttgctgaagttgcttatcagcttaaggagattttgggctgagtggttttctaagtatacaatcatgtcatctacaaatagagacaatttgacttcctctcttcctatttgaataccctttatttctttctcttgtctgattgccctggctagaacttccaacactatgttgaataggagtggagagagaaagcatccttgtcctgtgccggttttcaaagggaatgcttccagtttttgcccattcagtatgatattggctgtgggtttgtcataaatagctcttattattttgagatatgttccattaatacctagtttattgagagtttttagcatgaaggggtgttgaattttattgaaggccttttctgtatctattgagataatcttgtgttttttgtcattggttctgtttatgtgatggattacgtttattgatttgcatatgttgaaccagccttgcatcccagggatgaagctgacttgatcgtggtggataagctttttgatgtgctgctggatttggtttaccagtattttattgaggattttcatatcgatgttcatcagagatattggcctgaaattttctttttttgttctgtctctgtgaggttttggtatcaggatgatgctggcctcataaaatgaattagggaggattccttctttttctattgttgggaataatttcagaaggaatggtaccagctcctctttgtacctctggtagaattcagctgtgaatccgtctggtcctgaacattttttggttgataggctattaattactgcttcaacttcagaacttgttattggtttattcagggattcagcttcttcatggtttcgacttgggagggtttatgtgtccaggaatttatccatttcttctagattttctagcttatttgcatagaggtgtttatagtgttctctgatggtagtttgtatttctgtgggatcagtagtgatatcccctatatcattttttattgcatctattgattctactctcttttctttattagtctggctagcagtctatctattttgttgatcttttcaaaaaaacagctcctggattcattgatttttttgaagggtttttcatgtctctatctccttcagttctgctttgatcttagttatttcttgtcttctgctagcttttgaatttgtttgctgttgcttctctagttcttttcattttgatgttagggtgtcaattttagatctttcctgctttctcttgtgggcatttagtgctataaatttccctctatacactgctttaaatgtgtcccagtgattctggtatgttgtgtcttcgttctcattggtttcaaagaacatctttatttctgccttcatttcgttatttacccagtagtcattcaggagcacgttgttcagtttccatgtagttgtgcagttttgagtgagtttcctaattgtgagttctagtttgattgcactgtggtctgagagacagtttgctatgatttctattattttgcatttgctgaggagtgttttacttccaattatatggtcaattttagagtaagtgtgatgaggtgctgagaagaatgtatattctgttgatttggggtggagacttctgtagatgtctgttaggtctgcttggttcagagctgagttcaagtcctgaatatccttgttaattttctatctcattgatctgtctaatattggcagtggggtgttaaagtctcccgctattactgtgtgggagtctaagtctctttgtggtctctaagaacttgctttatgaatctgagtgctcctgtattgggtgcacatatatttaggatagttagctcttcttgctgcattgatccctttaccattctgtaatgcccttctttgtctcttttgatctttgttggtttaaagtctgttttatcagagattaggattgcaactcctgcttttttttttttttttttttttttttttttttttgctttccatttgtttggtaaatattcctccatccctttattttgagcctatgtgtgtctttgcatgttagatgggtctcctgaatacagcacactgatgggtcttgaccatttatccaatttgtcagtctgtgtcttttaattggggcatttagcccatttacatttaagtttaatattattatgtgtcaatttgatcctgtcattatgatgctagctggttgtttttcccgttagttgatgcagtttcttcatagtgtcgatattctttaccatttggcatatttttgcggtggctgataccagttgttcctttccatgtttagtgcttctttcaggagctcttgtaaggcatgcctgttggtgacaaaatctctcagcatttgcttgtctgtaaaggattttatttctccttcacttatgaagcttagtttggctggatatgaaattctgggttgaaaattcttttctttaagaatgttaaatattggcccccactctcttctggcttatagggtttctgcagagagatctgctattagtctgatgggcttccctttgtgggtaacatgacctttctctctggctgcccttaacattttttccttcattttaaccttggtgaatctgacaattaatgtgtcttggggttgctcttctcgaggagtatctttgtggtgttctctgtatttcctgaatttgaatgttggcctgtcttgctaggttggagaagttctcctggataatatcctgaaaagtgttttccaacttggttccattctccccgtcactttcaggtacacccatcaaacatagatttggtcttttcacatagtcccatatttcttggaggctttgtttgttcctttttattctttttttctctaatcttgcctgctctctttatttcattaagttgatctttaatcacggatatcctttcttccacttgatcaatttggctattgaaacttgtgaatgcttcaggaagttctcgtactgtatttttcagctccatcaggtcatttatgttcttctctacactggttattctagtcagcaattcatctaaccttttttcaaggttcttagcttccttgcattgggttagaacatgctcctttagctcagaggagtttgttattacccgccttctgaagcctacttctgtcaattcatcaaacttattctctgtccagttttgttcccttgctggtgaggagttgcgatcctttgtaggataagcggcattctgatttttggaattttcaaactttttttgctggcttatccacatctttatggatttatctacctttggtctttgatgttggtgaccttctgatggggtctttgagtggacgtgctattcctttctgtttgttagttttccttctgacagccaggcccctgtgctgccagtctgctggagtttgctggaggtccactcctgaccctgtttgcctgggtatcaccagtggagactgcagaacacaaagattgttgcctgatctttcctctggaagcttcatcctagaggggcacctgccagatgccagccagagctctcctgtatgagatgtctgttggttcctactgggaggtgtctcccagtcagaatacacgggggtcagggacccacttgaggaggcagtctgacccttagcagaacttgaatgctgtgctgggaggtccactgctctcttcagagccatcaggcagggccttttaagtctgctgaagctgcaaccatagctacccctttccccaggtgctctgtcccaggaagatggggtttttatctataagtccctgactggggctgctgcctttttttcagagatgtcctgcccagagaagagaaatctggcagtctggccacagcagccttgctcagctgcagtgggccccacccagtttgaacttcccagtggctttgtttacactgtgaccataaaactgtctactcaagcctcaggaatggcggacgccccttcctccaccaagctcgagcgtcccaggtccatctcagactgctgctgtgctggcagcgagaatttcaagccagtggatcttagtttgctgggctccgtgggggtgggacctgccgagccagaccacttggctccctggcttcagcacccctttccggggggtgaacggttctgtctcgctgctgttccaggcaccaccggggtatggaagaaaagaactcctgcagctagttcagtatctgcccaaatggccacccggttttgtgcttgaaacccagggccctggttgggtaggcaccagaggaagtctcctggtttgtgggttgtgaaaaccgtgggacaagtgcagtatctgtgccggagttcctcaggctcagtccctcatggctccccttgtgtaggggagaaaattccctgaccccttgctcttcctgggtgaggtgacgctccatcctgctttggcttgctctctgtgggctgcacccactgtccaaccagtcccaatgagatgaaccaggtacctcagttggaaatgcagaaatcacctgctttc

SEQ ID NO: 391 - DNA, 103556 bp, Homo sapiens
aattaggttctacataattaaaattttaactgctaactttaatagataaattatattttctaaaatctaatatggaaccatgacatctggctttgcatgcaacccatatagaagaatttattgaaagttagaagctctaattctttatctaattcttcatttttctttgtgttttttctataactccagaaaagttatatctgagcttaatcttttaactcatgatcagcataatgttcaggcttttgattctggaataagtacctcactcttaccagaataacaggtttattaagctgtttttatattattattctctgggctttgcttatatttccagtaattcctctgcagcaaaataaaatagtccctgcttcattaggacctggcagtgctaccctctgccagatcattgtggttgttactacctttttatgttaattccaagttatttttgttacatttttaaaagtcacccattttatctgctttcttgcttttcattttgcccagatgcattaaattaggaccctcaacaaaataaatttaaactgccttctccaaggcctaatattctaagatctaaatccaaagaaaataactaaatcctatctttttgttaactcgctgtagcatttagcctggttaatcactgcccactttatagaaatctctcctctcttaatttctaaagcatcagacttttgtttttcctgctattctccaggtaattttgctctgtcccttgtggactcttctattctttaaagtatggtgtcccaaggctttcttcgacttttgacacttatcttttcctgctatatagcttcaaggttttatgtcacgcactcatagtttaactttctaagttcaaaactttaagctagagcattctcctggcaggtacttgcaaattttctggactttgatgttccataagcacctcaagaccaatacattaagaaatgaattccaccttctcaacttctcttcttactgcacttatgtgccgtaaaatgaaatagtaatgaaagtattatagtatgcattgatggtaaattaggtaccaagtaatttcagagtatatattttgatgaaaggacacatacatcctcataaattacacaccaacaacgtacccataaaaaataacaatttaaaaaacttttaaaaaaggacgaatatatctttcccaccttgagtactcatgttggattgatgccatatcaaatcaaatcaccactgaattttgtgaaataaaatactaacagttgagattcaaatatgttgggtagtgtgataaatcccaggaaaagttatacatctttatgagttagacattctgacaaatacatcaatgaaaaaatgaaatagatatgtatcagagatgggttcatttagaaacaagtgaaaagaaaggttgacagtagtcatgtagaaaagaaagacattattttaacaaattttattcttaagttttttcctatgaattcaaatgtcacaagtttttccttatgaggcaaatctggataattgtttttaaaaatagttgtactttaacaattgtgtgcgtatgagccgtgtgtgcttatatgtatttttagagctatatattaaatgggtttattgttcaaaaaattaaaaacacagaattatttaaagtagtatttaattccccccgttatgcctgaccctacattgaaataattactgtcaatattttggtatgtattctagatttttaaattttagaatgccctatttagtgtacatgtaattatttttattaacattttaaatgaattatttcatttcattcaatttcatttcagagttcacgtgctatgaaaagggtttgtttttcctttaccaacaatattacagatactttttatccctgcttccttcccttccacccccatctgcttggctaccaatctatctcatttttaagaggagacaattccattctatgtttgaacaataatttattagctaaatcaccattggtgaactttagtatgtcttcatttattttactgagaatgttaaaacaatgttgcagcaagcaccctgacacatctttggaagcttttgtgattacttagcaaatctataggcaaagttgcttactcgactaaaatatacatttaaaataaatgcacttgaagcaaattttctctcctgattagttatatcaatttaccttactgccaagagtatatactttcttgaatctttgataacaatggataattcagatttttgaatcttctattctgattcatttctttaatagagaatttgaacataattttatttttactggctgttaatactttcttttagtgatttttatgttcctgtgcttttcctattttctttcagtatatttgtctcatatatttgcagaagctctttcctcattatggataaacactgtgtcttcttttatattgtaagctttttttcaattgtcttagttttcatttgccttagttgttttttaatttattgcataagaagaaaatgttgaattttatttctctatttttatatctagatttatatttgtgtgtggcctaaaatcatattttaatttttcttaatggtcatattagataacaatattttcagcttcatgttacagtgtacctgaacacttgtgacttaagcaataacacctttaatggtctcagctaagaattttggaggtaggtagtccaggacagggaaaacaatttcatcgtatcttcaaagacctgtgttccttctatgttttttggtttacacttttagagtattggcttgttgacttattcacacaagatcattgctctatattcaggtatcacattgtgttccctggaggaagaagtaatcagaaaaatagagccagcaacatcttcctctttttacagaaaagtaaacgctttactgaaagtcctaatagagttatggttatgtttcattgacaatacctgactacatggggcccctagatacaaggaagctgagaaagtaatagttgtagggctgtagagtagacctataatctggctatcatgcttttaaacgtatatcaaaaatatcttacatggttttagatgattgcgtacctatgcttctgctgtagcaaataaggaacataacattttcatattcctttctctctttctttctctctctatcacacacacagacagcacatttagcctctgagattgatatggacaaaagggagtttggaaatgcactagctaaacaaaagtggctccatattggctaaggttttccttaccagagtttattgaatgattattcaatgaataaatagtcatttatttattgacttattcctttgaaaaacatcattttatcataaattaattttccatatagagtaagcatcattacatttctggactatgtactcctttttttttttttaatttctactaagaaccaaactgtcttagttcctgtagttcttatttgtactgagacgctgtcagagccagtaactgtgtttctgggacttggctgccaaaaatcaggaagacacatattcctattgatgattgcatgtccatttctcccagctgtgttttgtaggccagaataacctcgctcattaaggttgtctgactaagttaaatttatgaacagcccttgggaagaacttattttccacaaaaaatatgcattgttctgaatttgatcacaatcatatgggttccccagagttagatctaggagcttaatacttctctcaaatctttacaatatttctgttgatcaaaaaagttatctcatggttttgaaaggtgagctactaatttgaaataccttagagtagatctatatcctggctggcattcttttaaatgtatatcttaaaaaaatcaatatggcttttaggtgatttgcatacctgtgcttctgctgtagcaattaggaaatttaaccttttccacctctccctctctctctctttctctctctctctctcacacacacgcacattatatgtacttattttttaattttacaagaattgaatcatagttctgcacacatgcaaagtaaatgcttttcctttaccaactatataataatttccatcctgtctatctctctatgtattttatcatctaaaaatctcattctaagaaaacagaaccccattctatatgtgaaccataatttattaaacaatttaccatgttgagcattttatatatttatgtatagtctttttgcatatactcttgtataataaaaagacttgtgggcacaaagtaaaacaaagtaatttaatttttatatttctcattttctaagtcttcaatatatggaggttgcacctggtcatctctgatgttatgcacagttgaaaccctctgttttcttgtgaggtccagtgcaggccattcatatgtgtggaagtgctttgaaatactctaaataattctaaaaaataagatgatatcattattattattgcttaaagataataggctagagatctataatgggattctagagggacattacagtactataatataaaggctcaggttaaaataaagtctatataagtaagccagacactgattactatagttttgaaagccaaattttgaatccggaattaaaaataaaagttatactattttgtcagcattagaaaagaaattgtttatgacactggttgtacattagaattactagtctttttttaaaaaaaagaattaagtgacttaaaagatactcttagggattttgacttaattggtacagaatgaggtctgggtatggatatttttaaaaaatagctatgttatttaaacatttagcctgggttaaaagtcaacatacgataagttgatttttctacatttatattgctttttcctgcttctgacccctgaccttaactctagatagaatattatggttttatgttcttatcatcttgttaccttaaaagcctatttaaaatggtggggcatttgtatccattcttagacctactcacacttgctcaatgaccttgagtcaccaaactgggacttgactccatggatgtgtcttggtttggcctatacatttcctctgaaggcgatcaggatgcaacatacaaatgaccaaaaatgagtggattttctgtataattttaaataattttagattttgtgtactgatggtttagctcttaaatgacaaatagaaaatcagagttgggactctactttcaattatatgcttgattttatggtgcttttatttaactgtttggtacgccaatgttactcagtttccttagaaaaataggaatatatgcattcactaaattgatggaaactgtccatcaattcagtctgctcattaaaaatagtaattactaaactttcatcatgtgcataatacattaacaaatatagtgtttctcagtttattaaaaacataacatcaaattttacccttctacacacaaaattgatgtgttttatttcccagattacagaaagaacaaaatgaatactcaatagaaatttgtattttcaagattctgctggtgtagctaagcaatgccatcataatgtgaagtgttgctgccatctgcagcatgaaagacttattaaacatatatattacctaggcatatgtaactggattttaaaaagtaacaactgtttaattctctattagtctttctatgtattttctacagctagctttcaacataattaaaaatatggtatagtttaaaacattcaatgtacttaagaatataatataggtgccaaaatgaatactgacattttattttattatttggttaagctaaaattaatattgaagaggcaatgaaatggtagaccgaaactgcttttatgatttattgatattggaaaatattttccaaatcttttatgtttaataaagttttttattaattactccaatataatgtaaactttttctcaaaggtattttttcaggcttacacattggctactttatctattatgtggaataataaccacaaagataaccacagaataacaccacagatatactatcagtggataaaagagttaaagttgtttatatgttacctttctaaatagaaagagtacataatattgatgagaatattattaattcaggtcttaaaggaataaaagcatctctcccctagttttttggcttcccattttatttccttattttaaaagtgatttccttgtgccatttcctgcccactcatattcttcattctggaaggtcgacaaaaagctaacagttttgtaaaatctgtcaagttacttaaccttcctgagcattgatttttttcatctgtacctttgggcttataatgtgtggcactggaatcagatgagaaatgtttgtaagaagtctagcccagtgtctcataatgttcattaatgctaggctttatatatttgtgaaacaaatagtcttatcgtgttttaattttgttttgggcaaaatatcaaattttaatatttgaaatctcttatagttccattgtaattgttttttaaaaacaatatatttataattaaatcaaaaatgccttgaaatgcattttcaataatgctgataataatacttggcagacagtcataaaatagaggctcagccagcaaaagttactatggttttttccatttctttaacaagatttttaatgaaaatttttttctttttaaaatatattatagatcctttaaattattcaattcaaattatttaaatatgtgatgcctaaatttaacacctagacagttagaatgaaccacaatacatgtcactaagtacaattcccacctatttttaatggcaaaaatttcacagcataagaaatagacaaaatccatttacacttatttagagaaattttattaaaaagaattttttcttccaaggtgagcaaaacacaatgtaaggagaaatgataaaaatcaaagtgtatagaaaggaaaaaatgcttaatttgaaaagtcaaaatatgataaacaataatttcatttccccttattttagcaattaaagaaacaataatataaaacttaccaaacaggagtaagagtaaattatgaagtagtaaacgtttatgttatttcctcagtttgttttcattttgaaaataaaatacaacaaatctaaaaataatgtgtccataaacctctaattaaggctcaaatgaattagaatttcagtgtgcaacctgtctgggctataacctgaattcttcagatcatctatccaaacccctcttttgtaggaaagtctgatttatctaacaagttttagcttccttccttccagatattatggcttcggaaagatattgttttgttcctccttaatacttgtcaattcgctcagattcagtttccgagtttcaatacagtttctaaacaatttcgaaagcccctagaagatgctttggccaaatacaaagtacgtaaattcagaagaaaatattagttgaatcatcatctagcaccatcacttggaggatacgtggggcacagctgagtgggacaatgtggcctagcctaagagagtctgacctcattaagcacattctgatcttatgcaacctcttcattcttcattctgactactatatttctatttcttctgtgcctttgtttgtgctgtgctcttcgcttggaatgttctcccagccaaacacttcctagctttgaccccacttagcatggaagacacatattcaactcatgcgttatttgttagctactctctaggggtactaactttccaccttaaatggtattgaatgcttcctttttttgtgcctttgtggtacattctttttattgtagcacctgtaacactgatttgaacctgttcttatgagtgtcatggccataccttcagtttctaatgacaaaaattggaatgaactgattttatatactagagttcttaaaatcctttacattccatatctaacgaaatgccaagttttgtcaatttctcttcctaaacttgccttgcaagactgtatgtgatttagcccctagctacttttcctacagcagttcatttctctctcttcttgtttactgtactccatactggcttcctgtgcttctcaaacttgcccagttgctcttgactcagagcctttgaatttgcttttttttttttttttttttttttttttgagacggagtctttctctgtcgcccaggctggagtgcagtggtacgatttcggctcactgcaatctcggcctcccgggttcaagcaattcttctacctcagcctcccgagtagctgggactacaggccacgctgccatgcccagttaattttttgtattttagcagagatggagtttcaccgtgttgcccggctgttcgagaactcctgagctcaggcaagccgcccgccttggcctctcaaagtgctgggattataggcgtgagccaccgcgcctgccccgcatttacttttatatctgcctggtacactcttttcctaaatattcttaagtcatgctttcttctttctggtctacgctaaaatgtaacagcagttctatttctattttgttaccctgaattactttttcatgggtttgagggtgtaaaattctcatccttctaggaaagaattgattgttcactccttgcattaacaatcaaacgagtaacaatcaaaactagtattaaacctgcttaatcaatcaatgattgattacaaaagtacacacactctgaaagacaattggaaacatcttctttacatgatttctgaaaatcagataatcagcaatagctttagtccagtgaatagattcctaagggtcagccagtcagtgaacatatttacatagctaaagtcaatactccagcatttaaactccacactttcccaaaaccttatataatttaccttctttgcttataaattgtgtcttgcaaaaccagttctcccttgcctgaacaagtaataagttcagcttattgttttagatattgagtggtagattccttgtcaatatttgtggttatctatggtaaccttaacgtgttgttatctgttggtttattatcaactctattctatgtaagctccacaaaggcaggaaccttgttgcttttgtttactgttataacttaatgctgacattgatgcctagtgcagtgtatgcattccagaaatatttgttgaagagagtttagagcagggacaatgtaccattgaatataatatccccagtgcctaatatggagcctagtacatagaagtggtttcaaaaatattagctaaataagtgaatgaataagaaaaagttcaagagtgactatagttaataacaatgttttgtattcttgaagattgctagtagtagattttaagtgttctcagcacaaaacaaagtgagataatgcctatgttaattagctcaagttagccattctacaatgtatagatatatttcaatacatcatgttgtacatgataaatattacacttttattggtcaattatacaataaataaaaatgaaaaaatgattaattgtccatgtattatttaacacatttttaggaacatccttgaagtaaaccagaaattattcagatcttaatgggtccacatctagttctcttaaactcacttctctttttagaaatattctagttgaaaagatacccactttccttttttgacatctctttttgaaagacttaaaggcattacaatttcaatgactaaaactgaacctatgctcttcccctaaaccagatcctcttttaatatttcctctgtcagtaaatggcataggccagaaatcctttctccctcacagagagtaggtaggaagaaactagacaggtagtcagttagggtgggtcctgggttgaattctttcaaacaaaagaacagcctgcaggcataaataagggaacttgcataggagggcttgcctaagacatggcctcactgcatagataagacaggccacacagctgacttgcccagacatgtctgcaatggaaaattccatcccctgacacatgtgcagtaaggggaacaaagcaatatggagtaactcaaggtaagggcctgcatgcacactaggaggacagagtggagctaccagaaatttgtactttatgcaaattagatgcccagccctcattggtttcttaaaaaagcctctgtattcaactgtaaaatggcaactcttttctgggacccttctctgtggcagagagctttctctctttcttttgcttattaaactgctgctctaacctcacccttggcatgtcgccttcttgattttctcagctgtgagacaaagaacttcggaaaaatttagtttgtagtttaaaagagaatagcccttaccagaacaaaactgtctctataaatctaatgaaaggccaccaggttaaaaggatgaaaggggcctgaactctgctaagatgtaggtgtaattaaatgattaccaaccattatactgcaggtcacaagatttacaactttcccaattactcctgtaaataccattactattgtagaaactaagattggctttttgagatgtcttttcaggcttttgcatttcaaataaccgaatggtcctgcctagaccagcaactcctctgtggcttccacccagaagtggactcagtgcatgaagaccattttccacacccctacgtttgtatccccaaccaatcagcagcacccattccctagccccctgcttgccaaatgattcttgaaaaaccctagccttcaaatgttcagggaggctgatttgagtgctaattaaatccagcatcactccctccttctctgaccaagtcaaattgccatatcttagcatcttgtccctctccattaaacacttctcatatctgaaacgtaatctgtgttcttgtcattattggattaaaagctatctcttcaactaaactgttaccactgtaagagaagggtctacttattggcatgtaagagcaagtaaataaatatttatttaaatgaatgaatgaatgagagttgtgtgaatctggtcaagtttttcccagtaaacacagtaaacagagttggagtaaacagagttggagcctgtattctggggttgtcctggggacaagaggcagtagtgcactaggaaacactgttgtacaagtatcagtcctggtctagagctgcatgcttttcactaaaaatcataaggtctggctagtctctcatggacttatgtttggtggaaaagggaaaagtagagcatgaaagagataagaagatcaattttacctttaataagaaaggagagacagaatgggtctcagtttattgtactatgccaacttggaagcaaagcgctacatcaggtttttatttaaatgcagccaatttttaaatgagtgatatattctaagaaggattttaatctttagtgagtctccctttggtgtaagtgttgaatagctctgtccaatattttagggttcatttaatattaaaaaaagtctccaaagcagtttatcatggtaaaatgcagcacttacaaatgataatttctttttcccatttttgccccatggtgaaaatctcagctgttgctgctatgacatcagttataaaaatcttatattttagaaaccaaaagtaaaggacaagagaagataggaaagcaagattatctttaggaagaaaattgggacatgaagcaggagtgctgggtgggaaggggggaagacaatttcccaggcagtcatcctcatactgactgattttcctttgttatcatttcgttaccctaccagaaatttatataaagcatggtgcctggcatgttatttgtcctccattttattagttaatgagcatcagctttaaaagtgtaatttactttagctgattataagaaaaccataaatcccatatatttgaaatgcagtagattgagaggaaagggaaggaatgctaagctcttcttcatcatcaccagagttcttcaaggtaatatgagaatctcaaggagatccccaaagatcacagtttaaggttgcagcactggcaaacagcaaaattagattccaggttatgtctattgcataaaaggtttttgttcccttctatgactgcattgcttccagaatgaaggtgataccagttacactgaaaaaataaatggtatgactgggagaaaggtcgcacgtgattttaaaatatagttattttttggtagttaattcctaaactactctgcctcaggtacaagatatgttatggtcgattgaggcaatgtatattctttgcatgccaaaggagggggttatcagaaaatgttaaggtgtaaataaggaaaaagaaactgaagaatactgaaccagagtatgggggagagaagcttttcatttttatgttatacagcataaagcccttactccagagcctagaactaaattgatatttgtgtgttctctggggaacttactaccacccataatattatttctaggaaatgatcatctcctaatttcaaatgactctaacttgactaacttagtaacagatgtttagcatacattctctttttctaagtgaagaatcgcctggaatttcttgaaacacccttatacatgcataaaactgtaggtggtatttgtgtaagtctaaaatagagcctacatggcttcatggtaccttgcttaaaagaaatctgttccatttggaagaaggagagaataattattgtcattcataacaaattttccttttgtgtaggttttggagatatgttgataactagtggatagtaatcaggaaaactccataaatgttgaagtgaaatatattaatttaattgaatgtactggactcttttacttctgcatttgactcatggattaagattttatttatttggtttcctttgcttgtttttaagtccttgagttgtctatttttcagagccttagatcccttaattgattgaattttcactgcaaatagataaaattcctgctagacaacactgcaggtcttagaggtctatttatatgcttatttaaatctctggcatgagtaggtatttaaagcatgctttggtttgtaaatactagtttctttatggaatgtaactgtgcctcttaccactagaatgaattgataccatctatcttcctcttcatctttagatatattatttacccaacttttaacttttccagtgtaaagtaataatatctcactacaataagaaaattaataaacaaagtataaagggactacttttgaaaaaatgttttagaaactcagtccttttgattagtaactagccttagtaccagaaaaacttcaaaagtgttctctaaacattgaattttcatcagtgatgctgcaagccttagttctcatctttcatgcttaccattgcaataacttcaaaaggataaaaagaaagaatggtaatctctcaaagcaaccttgtgctcaggccagtaatcacgtatttagctatcatgcattcacaactagataattgcctcattaaactgttttaataaatataataattaacatttttttttaacaaaaaagcaaacattcaaaccattcagaaatgaaatccagagcccaagggatttctagaagaaaatgaaaaagagttagatagcgtcaaatatagacatcttcaaagggaaagagatcatttaaacttgctttttacttactgaaatatgttctgcatattttattgttttcattatcttggttattataatccagccagtgaatgttcaaagaacataaaatcctacaaataagtaaactgaatataagtgaatttacaaaaagacaacaattaagatcaaaagtttgacatgcaagctttgattatgtaaagcaattatatttccagtggtgttccagtattatgatttaacagaagaagaaaaatttaaaagtcttaagctttacaacattttattttcatgttgaattttcagagtataagtaacttagaaaccctatctgaatctgcatggtattgtcaaagtgttccagtattatatgatttatctggagaagaaaaatttaaaaattttaagcttcgtgactttttattttcatgttgaattttcagagtataagtaacttggaaactttatctaaatctgcatagtattgtcaaacttttgggtgataaaccctttgcagaattagactgtatgcattctgggtcagtgtaggaagttataatggatacgaatatttgaacaaaaattagatatattaccagagataatgtggtcagcaataggtggttatttgagggagtactgaaaactacaccagagagaactcaaagagtgagtggtgagtcggaggagtggtgggttgtgaagccgtatcttggaaccagaagagaccaaaaattagatttcatttgtgatttagatttgtatttaaatgaggaaataaccttataccagcagctttctaaagctttcgcctgaataaaatagaaacagcaattaaaaattaaaaacataattctttctataaaattatgtataaggaaagtaatttatcttggtaatacatgtaagaaatagttttataagctatattggctggcaaaaaaaggcaaatgttttacaatatgatggtaaaaagaaaaaaagagaaatgaatgggagtcattaactattctcagtgaacatttctcccttaaatgctggagtttaaaagttatccttttagatgattagggtattatctagatcagtgcttcttaaatttatagtgcatagaggaagcacctgggcatcttgttcaagtgcaggtcctgatgcatctggggtgggatctgagattctttgctttgagcgagcttctaggtggtgcagatgcttgcactttgcaccacactttgagtatgacctagatcaacctttacggaacctacatctcatcaatctctcaaagcatatggactaagaaatacatgctttttcaagaagaacatatgtttagagggtttctgaaacaataagaaaaactgataaggtttaaaatacagagaactgtagttccaattttggcagtacattttaactatcagcttgttatgtaaaataggtgagtagggcagattaaaaaggatctatttctaaatattaacgttaagtgtggggcttaatcagaaaggcctaatgaagatcttggggaaagggtgtgtgtgtggaggggttggtgttgaagtcagaatgatcaaagatgggaacagtaagcaaaggaagggtgacaagttaaaagcactgtccagtggatagaggagaatagggaagagatgacattaggcaacaggcaaggtggactaagctggttagatttgcagatgaaaatgggagttgagagtaagtgacaacttagtaagtttaaaaacctagcactctatagatattacttccatcttctaccaataataggagactggtaagttaaaataattcctctgaaatcctggagaaataatcctaatatacatacttgtatatgtatatgtatatgtatatatgcatatatatatacatatatatctatgtattaaattctgagtttcagtgaagtcatcagggaataatttttagttcatatattttccaaatatcattagaagagactcagtaaatagggcattaatgtaaacaatcagatttagcattctgaaaccccagaaaacaataaaacatgagaaggaatttaagctttataaaaatttcatgattaccaaaagtgcataacctgaatctaaccatgacacaaactgaaattaggccacagtttacaaaataattggcttatgcacttaaaaaatgccaatgtcggctgggcaaggtggctcacacctataatcccagcactttgggaggccaaagcgggtggatcacgaggtcagaagatcgagaccatcctggctaacacagtgaaaccccatctctactaaaaatacaaaaaaattagccgggtatggtggcacatgcctgtaatcccagctactcgggaggctgaggcaggagaatcgcttgaacctgggaggcagaggttgtggtgagccaagattgcgccactgcactccagcctgggtgacagagtgagactctatctcaaaaaatagaacaaaaaataaaacaaaaacaaaaatgccaatgtcatgagactcagggaaatgcacatgcatgtgcacatgttcatgcacacacatatacacacacacacaccccttaggaacagttccaggtgaaaagaaacaaatgagatgtgacaaaatggacatacttcatgatcttggattttctattgtcagaaaggacatcattatgcaaatcagtgcaaaccgaataaagtctgtagattagataatagcattgaatcagtgtttagtgcctgactttgacaatagtactgtgatgtgtaaaaaaattccttgtttttaggaaatgcacactaatataattaggggaaaaggcatcatgtctgcaacctactctcaactcttatgctgtttgttttaatcacttatgtgtgtgcctgtgtatacacatctttttcatgtatttatagaaaatacatgtgtttatatatcaacaaataaaaactccataagtttttatggctgcattgaaaatggtaggaaattaggtaaatattagagggaaaactaagaacaggatataggtcaagcattttgatacaggtattatttgacttctgttcttctatcaccaatctccatataccaaagaagaaaaggttttcaatataattgtaagttggaaagtaataacaagaacatagtatcttagaaataatggcaactggtacctattaactcatcaaatcatttcatgtgtctatgttcacactgagaaggcaacattcttaatatcatctagctcactattatgcaatgaaccagtctggaactttatccaggataaatcatgtgatatttatgtttgcatattttttagttcaagtgaaaataagccaaaaatctaaattgaacgtaaaagcaaggggaaactaggttttaaagaaatgatgaataggatgtgataacacttcaatctttgagaaaggggatatgagatcactgaagaggggctgcctaacagaaatgcagggttctaaattctaatttttgaagaacattggtcctaagctatccttctatgaataaaatatactctttgggggtaaaaactgtgtaaatgggataggctatattgtaattaacaagcaagagggagaataacaaatcactcatgctctcaaagcccatacttacaaagagaaaacaggcaccgatcattgctgctttgactgttacatctagatctgcaggaacatgaattccgaaattgtcagcatttgtgaagacatcatttacaaatcctgaccagtactttgaaatcttcccaattgtaagcttttcattaatggttttcacctttagaaagaaaataaggagtattaaatttgacagtgaaaaaagttggttttatacttctgagggtgtttacttcatgagagatttgaattattttatttgtcatcttcaaaatgacaattccatgttattcattccatcatataagcataggtttgtaaatttagcttttcagtttactttttagaaactttgcttttttgacagttttctagtccatcataattctttttcttttttgtatgcagatggagaatatcaggataaataattaaggctcagccaccacaagatggcagcaggtacatagttcaattgtatcatctaagcatgaaggcgatttctttacttgaggtccagattttaaacctgaattctccatcttaaaaatgtaaaagaagatatgtttgaaaaaatatttcagaaggaattaaattaatttctaggcataatttgtaaactttcaaatttcagttgctaaaattttataattattaaaacatttaaatattattggccattgttaaatcacatttttatattatactcagacatttattaggtcaatactttctaacaaatcctaaatcctatttttacattaaaaaaatcctcctggttaatgtaccatataggaagttaagaccaactagacatcaatcagtccttctcagctagaaggagttcacaaatcaactttatcagctatttgtttgtttattctgcttcccatcctgatgctgaaagtaattcaagagaaactatcacttttttcagggtagtaaaagatagagaatagagagggttacttaggacatttctatagcatgaatgctaaaactcttatgtttaaagtcctcctcaatcatattactcgtaggaaagtcatgccaaatcctttggggatagggtgaagttggaacagctcagtttgcaaaatttgcattgtattctacgtgcatagtgtttcctgaagtcctgagaactaaatgcccttgctgagatatttatgtatgaatggatgaaaaataaatatacactttcaattaggctgtctcctctacctaagttgtatgtccaggacaacctgttaagatagtttatattgctacagatcaaatttacaactttctattttttaaatattcaatttatacaaatacgagaataaggtttttttttgttttttttttttgttttttttacaaaactaacttagcaagtcttagaaacacagcttttgagttaatgctgttttaatgtaacgtgctgctgaaatgagatctaaactgggatatgtgatctcaaggcccataggaaagaagatacataatttaggtgattctaaactgtatatattggctttattgccatgtgtcctgtgattctacataaataaaacatactgaaacaagaatgaagtgctaattttcaaaatcaggaaatattggttatcttaaaaaggcaaagctatgtgtccaaaaatttttgatgttcaaagtcttgcacacattaaaatagcaacacatttactattctaatcaaagagatatagtagctttgtccatagaacacatagaattatatttagctaaacatgcttttattatagtaaaatttattaatattactttggataatacttacactggtctatgacagatatgatggccaaggtgataaattttgtaatattatttttaaaaaatccttggactttatatctctggatttacatattcctattcttagcatgtacaatatgggctgattacattatattacaaatatgtcattttctgaacttattttaaatgaaattaatttgaacataaaaaaattgaattatgttgcaaaaaaaaatcaggacctaaatgaaaacttctttcattttgtcaattgtacctcaaaatccacatcgccaaaacagccacatgtcacacaaggaccaacaattttcaaaatatcttctttgtttgcattttggattgtgaatttaggcagaaaggggtcccacttctgcgtaacgtaaccaactatagtaccaggaggggcttggatttctaactgtaagaagagataatgataaaataagattttcttaggttatcatattttaattttactataatgtcaatttacctgtaaacaatatactgttataaaattattttgatattctacaaatcattctaaatacctgcttctaaggatacagattttataaaatattttacagaaaacaaagaaattcactgtataaacatacgtttagcactgtgcactaaaagtctatgtcttatttccctaaagagaatctaccccacgactatcttctgaccctaggacagtggcttctttgccattttatcccaagtacaaccattggtcaaccactgaagctgttcctatgtggttactcatatctactccttttaattgtagccacaacacacatctattttaagtctcctttatcaattattgagtattcatattttttctctaagattataagctccaagattatctatatttaattaaaaacaaatgcttcttgcagagttatagtcattaaacaccagtttgattgctggtttgtggcttccaaagtgttcgagactagtagttggatttttgcattatccggcattactttagcatttgactccattacctttacatatttatgtaacccaatcaaatattttgtaaaataaattgggggtgggtacaaattttttaaatgtttgcttttaaaccaagacatcgccatcatctgatctcattttgacttttcttatgaagttcatagtcttatgcatatgtctataatgttcttggatagataaaagtgatttcaactagactgcttagaattaatatagatttgctctgggatcacttttaaagttattaatttgctattgatcaaatttttttaaaagttactaatagttatcaagtaatatattatgtttaatttatgaccctggactaccattaaagaaaaagttaattatcaaaaattttaaaatgagcatatttctgtgatcataatgactacactctcttggggcatattaatattaaatatcctcagtagacggatggaaattcttgggctccatgcacgagcacttcaatcattttatcacttagtcagatgcttacctaaaaatagttggagaattagctttgatatatgttattagaaacttccctaaataaccatctttcatattaatattttcccatcaccctaaggccagtacttatccacaggttctaacagagaaggttgggcttaaattaggacacctggctcaagtcccatctataatatttcctgatttcttgaatgtatagtcataggtagtcacctccactctccttccttgactgccaaatgtagagagtaattatttctagctcctagagatttcatgattctgttcttgctcatgagtagaatatcatggtatcaaagccagtaaagtaagtaaaagttctgtgtcaatttaactgcataagtcaatgaaagttattattacaggtgtactaaataataacgtaaatctattatatattaaaataaaataattgaattattccctgtagaacaataacattgtcttgccaaaccttgggctttgtcataaatgggtaaatgcattgtgagattccatactaaataataatacctatccaagaggataccttagaggagtttaatatcacttagcatttcctggactttgctccagttggagaagacaaagggtgtatatgcccaatggtggaacctgtagacattacaattacatgactactatagagattccagaggtctatctcatttacatgatgcatgagctgtcttcaacagtttatatcatgaaagccaccatagtttttggttggaaagaaaaaagtttagtgaattaccaaatcctcaagctgatctgatcctaaaggagcaacatactattaataattaaaacaactggcaggttaattgcctcattgctccagatgaattccttttaaagaaacaaatgctaatcttaaaaatcaaaaaggacaaccagagccagtaactaacctcttgtaggtagcaagggcaccagcagctgttacatctcaagggcctgttcactgtaatgacctctcgacctgagttatctgtgatcctcagggtgcaagatcgcagagtggaacagaaagtacgattgaagcagatgctttcctccactgcaaagtaaattctttgtcccaagctgtttttaatctcatatttgttggaggtctcagtaccaagtatcactaatggaacaaaaaaaaaattataaaaacatttttttccttagtattgataactttaaataaaggggagatgttattaaaagaatacagtgtctgatcaattattaaatatatggtatcttcttcacacaaatttatttctatgctctaaatttttaggacttagccatggaaataaaagtaaatggtgagaataaagctatataattaattaatgtttattccagatatatgacctacttgagaacatgtagtgtaccttttcactaaaggacaaatgctttaaagaataatttatagctcaaaaaataattatattattgttatagaactattgggacaactcatggtgataatagtgattttgtctaaaatatttgtctggtaatatatctaaaggtgtacgctatcctgctatttcaatttttatatatatttaggcataatatagagcactaaacccagaaaatactcaagtaatttgaatccagttagtcatgcttgtaaatttgtagattcttaaataatttgcctatttggtaaatcactcatttagtcaaaaccttgacttccatttttgaaattattaggaaagttaaatgattagcatccacggaaatgatcaaataccttttactattttaaagtatatgtaatgtcagaatttgaatggcaatatcaccaaagattcagagttttatgcttctattttatctaaataagactaataattttactttcagcttttaattgaaaaaagacctagtactctttttgatctaattctattctacacatttaactttctcatttataacatatttagatgcaaagaaacttctgaaaactaaaatattttcaatagttttaataaatatgtaatatatataatgcacttacttccaagcagctccacctgctggtgtataattatcaggtctaactgtaaaggatgacataaaaggaaataaaaagtattaacatcacacggaaaacctttggagatactactagtaccctatttactatattacataaaattagtgattttcatgctttctattaggaaaacagttgaaaatatctcacattttacaatgcaaaagaacgtaattttttttttaatttaaagaagaatttagaagaaccttgaaaattccaaggcagcattgagcaagaataagaatagcaacggggctgggcgcagtggctcatgcctataaatccagtacttctggaggtcaaggtaggcagattgcttgagcccaggagttcgagaccagtctgtgcaaaatggcaaacccctgtctttacaaaaattagctggctgtagtggcgtgcgcctctagtcccagctacacaggagagaggtggaggtgggaggatagcttgatcctgggaggtcgaggttgtggtgcacagtacactccagcctagtccccagaggggagactctgtctcaattaaaaaaaaagaaaaagaaagaaaaaggagactgagacagaactaactctgtgttaactccgcaataatgagaaaattagagtagatcttgaaaacaagagtttgtgaagatttttaaacaatctctgaattataatgtttaagatgttttacaactcaatttttttagaagacatgaaacaacacaataatgatttgaatgcctggcctctcctcttaacctctgcctacgtctactatcactctgtcaaactgcaactcatatctttcagtgatggaatatatttgttaaacctgaaaggttattgtatacatttttctctcattcacactttcctttggactaaaaataaaaatgagttcctgtggatgccaacaaaataccaatttaagtcaaataaatgttatggcactaaatacattacaagatttgacttatgtaattaaaaataaagttaatttacagagataaagtatccacagataattgagaaatgatgattaaattaaaaaatctgtaatgcaaattgctttttaaaggaaatatgaaagttatgttcttataaagaaatttatttgcgtttattttatttttattttttgagacagagttcagctttgtggcccaggctggagtgcagtggcaccatcttggctcactgcaacctccacctcctaggttcaagcaattctcgtgcctcagccacctgagcagttgggattacaggtgcacgccaccatgctcggctaattttcgtatttttagtagacacacagggttttgccatgttggccatgctggtctcaaattcctggcctcaagtgatccacccatctcagcctcccaaagtgctggcattacaggtatgagccactgtgcctggcctatttgtgtttattttcaatctgatattcagtacttgaagatccagtaatgcaaaagcatgaacactaaatatgctgctgatcattgtattttctaacgcttcatttttcctttcaccttaaaattttcttcaccatattctcccttcgcattaataaactcaccagtaactattaaactaaccagtcattactaaaatttggtattgattggacatcacaatctcagaacatttgaagctacatgatttccctcattctccttgtatgtcctaaggtgaaggtaaaactaatatcattttctctatttaaaccttattattgataaaataatatgtgtggcctcttttttaagattcacaaaaaatatttttccaaaaataatttatgatctaagatattctaaaacctaaattaacaataataagaaagcttttattagaaaaaaaatactagaccaagtctttagtagtgtactgcattagttctgttatcttctgaggaaaacggagtggtaagcctcaacaaggatatatgttattatttagtagttgatctaagcaaaagtaacttagaaatggagatctgtgtgatcaagaataaagtgggagtttaggtactttgaatactgttgtcatgaatcaagttctagtattgaaatttagaaactattaattgaagtccacctgacaatgaaaaagtagtacctctctaatatccaacaataacagtttttttaattgaataactaccataaggtagtcactgtgctagatgtttagacagcatctgatttaatcctcacaaaaactcagagagataaatatcattaattttaaatgtgaggaagcaagcccacagagattaagtaatttgcccaccatcacagaacttgtaaatggacatcaattctgacatgcattctattctgtttctttacggacatcactacgctaaatttaagggaaataagtcttaagtgacgacatgaaacttgagtacctttcctattttctttactcttataccctccccatcctctgtaataacatttgatttgctctctctgtgaaaaaatctcctggatttaagggagttgtttgttttaggctgttcttgtagttttccttaaatagcacatagccacttacaaactatggcccaaaggggcattttccattctttttctattcattgatagactagcaattttggaaactttaaacagattgaattatacgtttaggtgtcatggcaagtaaaacttaactccttaagtatgaaagctgtagaaatgaaaatacaatgagaggattagatgtatggcttaataattaatttaaaaaaaatcaagttgacaggtatcaatgattccatttgatatatgtatttcaaaataaattggatatttacatgttttgtagactttaactcattactcttatgtataggtgactataataattattctttgacactatacagtaaaatgttattgactgtatgaacatgtaaatttaatttggaaagaatttattgattttactcttagatttaatgtacattatatagctaaacactcatatatgtatattttcaaattgttcatggaaacaagattctcaatagtaattggatggacttgattaaaagagaatagatgttaaaatattttatttaaatttttaaatttagaacatattaattgtatatttcctgtttattcattgattaatgtactatttccaaatgttcattattttgtttgatttttgtggcttttagggaaaagttggcatctaaaaattcattttatattgtgtctcttccagactcatggcataacagtttggaagtgctcattcatccttttatatgtgcactgctttaaagtaaagtaaataaatgttcttttagtataaagtgaggaaattacctttccctttagaagtagaatattcaacaattggtggcatatttttcttttcttggaatgattaacaaaggtatatttttggaaaatttattccattttagaaccaaagccaatgggctcatatctctacttattgaacacaacaaaaatgtattcatgtcaagcatctggctccgggtgtgtcatcattcatgaatggaagaagaatatgtgatgaccatatgtgatcatcaaacctcagccctctggcactggtatatcacttttatacttggcaaaaccttgtctgacaacattcccaaacagcttgcagcagttaatcaactctagtcagctattacagctgatcctttctgcagatggaagatggtaggtttgcgtttccagctcttttacatatctccctgagctctccagtctctaaagtacatttgtctgccagtgggtttctggagaagacatctgcaattataaacattttcccaggaacatatgctgcgtgcagcttaaaccctatcaggcataacagaaatctcttgtaccttaagggaattaacacagagatttgattttgataaaggagatagactttatagtttgaaagaatgccaaacaagctgaaaattgcagcagatgtgctgacatctcaatattagtgtaattgtacttctaatcctttttaggataaaatacaaaagcaacaataatatacatacatgaatagcaatagctgaattttatatgccataaaattcagatagtgatattttgattgatttattataaggcttgaatcctgcctactttacaatgactagaacagtgactatacccaatagcaatatgctcttttaagcaaattggcctggagatgcagtggtatcagcagacaatgttcactttataaccgctttgtcttggatttgtgtcctccttttgagattcagttgaagacattgaactcagctcattgttgaagtctctctagtactttgatccttaacaacctctctctcctctatacacctgcacaaattacaatagtgtgtttatcagtcatttgtacacaggcttgcactttgcattaacttttttttttttttttgtcttgccaattaggttgcagaacttttgggtaagaggggctaggtttcgtgctttttatatgtctctagtatagcaagcactcgacaaatattctttaaataaatagctgtagatgactagatatgttagaaaatttcttttcttttctttttttttttttttccaaggcaagtctcactctgtcacccagtctggagtgcaatggtgagatcacagctcattgtagccttgaccttcctgggctcaggtgatcctcccacctcagcatcccgagtagctaggaccacaggcaaatgtcaccatgccctgataatttttatagagacagggttgtatcatgttgcgcagcctggtctggaactcctggcttatccacatgccatgggctcccaaaatgctgggattacaggcgtgagccaccgtgcctggcatattagacaatttcttgagcaaaaatttactgacaccttgaacaatgaacaagtggataaatatgctaaacagctccatcaaaaatatttagtctcatcattctgtcaaataaataaggaagataaaagtagtaataagatacacttttaaaaatagtagaaataaataaagttaatattttataattttatgatttataatgcttttttcatttcagtaaattattggttaaattctttcaaccttgattgaaaagccagaaagaaagtttgtattaattttaagggtagaacatatctgtagtaatagaaagataaaaacacctggcttaaatattctagaccaggagggagactgactgttggcaggaaactgcttggcagagggagactcagctgccatgcttggttccctggattggaagaggcaggaaggctttggtctgggtctggagctccaggaagaaaaccaggcagacctcttctttggttctgggcatctgcaagagaatggaaatcccaatccatatttaaatttaggccattttatttagtccttcttaaagtatttgttacttcttgattgataggatagtttatctcctgcctctcattttaatgcccttttccttcttttcactactcactgccattattacttgtcccctaagttagaaaaaacgaaacgcagaagactgctggtagtagttgtgagaaaaagttgaatttagccaaaataaaagactttagaaaaaaatatgcatatgtgtatatgtatctgtatatatataattacttgcatatatatacttactgcatatatatttatatgcatacataaattatatattatatacatatatgaaccaaaatgtggagagtaattatcggttactttatacatatataaattatatattatataactatatataggtatatacatacaaatcgatgttacttgaatagatatgcagtaatacatgtctatatatttatatatatacttatttttatatatttatatttgtataagtctatatttatataaccaataatagtttgaagctatgcatccttttgtagctcacccaatattacaaaatataaaagatatcataatcaaagaattctataaagtttgactaaaatttttagagaagacatctgttttctatattattgccaggtaaatatgttaccattttaatcatcttttattttgaaatttgggggtttgttatttactttgcattactctgtgtaattttatgtataacccctaataaggtggtatatgcaaaagtcgttttgtttaaaaatataaatgatagcctttctactatttttttcttctcacataactaccacttggatatctctctcattagatataatttttttttcaaagaatatcagtgtttttacttctcatgtttagtaatcaacaaagtgttagagatttcacaagtgcattcagttagtttatccacattatgctgttttagattgggtatagatgtgaagcaaggtttgtgacaggtattttcaaatatgagaagggccgttatgaagacaagtaaatcagattgtcctaaagacatacaaaagagagggacaaggaaattgcttctgcattgacaacaagtaggaaatttataacagctacacaaagatttgaataagtattctcattactcatataccaaaattgaagcggaatccatataattagcagcaaattacaatgttctcacttcagcaatgactctcaaattcatgaatgtttgtgtgtggggcatgggggtggtgaagaaacatctttatcttttaaatctgtgaaaaataaattctaaaaatgaattgggtttcctttggtgatagtaaatttctcatcattaagaaaactcaagcatattctgcattcattcattcatttatttattcatgaagtaaattcattcatttatttatttaaccttaaggttgtacgaataaactgagttcattattattagtgtagggccattaagtttgtactggtctgtgatatttagaatgtagacatgctttatggttaggaccaaatggaataacttgtcaaatggccctactaaaatacagcttcctactgataatactatagcagtttggtttccgcaagtacccccaccctgaacttctcacacatctggggcagatacaaaggatataggctttagaccttcccctgctcttgagaatggctcctcaataggatcctaagaagtaaagccagagaaagactatgtaacactatgtcagatttgggagaagagctaatggccattaatataacaataatgatgcaaaaatattaaaaggcaataaacattatttctttagcgttagtgcaaaatgtaccattgtcactttcagaaaaacatagaagcaaaattatgatatagggaaaactagttcacaatgataaaatccagaatagtggtccatcttgggaaagggaggatgcatggctattggctagaaagagaacattatagaatctagaaatgtctatatcttgatcttggtggtggtcatgaatgggtccttattttaaaaatcatggagcctaggttttgtgctctatgtacttcactgcacatattatctctcaattaaaaaccatgtgtagggattaatttctaacaatagctagtataagatttttagattctctctcattgtaaacttaattgttaaagggattcacaaattaccccaattttatcttgtaaattatgtttgctgtaacaaaatgcagtaggttatggagggtttggcaagtagctgtacattcccgcccagtcctggagggccttagacttcacagcaagtccagaagcattaatgcacttggagctcagaggatattgtgtccaaagtctttatttaggagtagagtgtgagtgagtctctgcctgagactgttgagagacatcactattctgagatcactagctgcttcttctgggattttagttcacattgaagcaacctttggagacagctcttgctcagttcagatcaccgtgtttgagagcaacttgctcttaaattgtgttaatttctactaagccaggatgctccagctcacacaaatgtctcttcagttctaatggcacctggtatttagactgtcttttggtttagtagtgctgattgatctgcctatgaaatatgtgaaatgtacaattagtctgcattccctgggaaaatgctaattgccaatatagttactggacaagaaaacatgatgttataaataatgtgtttatatacagctgaagaaaactatccacaaaaatgttttacttagataatggtgataatttgacttgccctcttaaacaagatatctaattcacaagaaagcttcattatcacttatattctcctaggtagtatgaagtctctaataggtgttttatccttccatgcattaaatattttgagccggttgcagaaggagggtcagttttccacctgaagttttgcttctaagtttagacttgggtctttatcattatggaacatcactgcttcctgttagattaatcatattttgacataatattactttccagtcacaagtttcttcaaagactcagacaaccagatgaagaaggaactcctttgaatttcgtactggctttgaatttctatctactcttttaaaaatgtataactagcttataaatattttatacactctgcaactttttaccttacagtctacagtattgctgtaactcttattttataaagtgatgaagtattttggactaaatagtagtgtcagtcttaaatgaaaggaaatatttgtcaaggttttttgtttatttgtcttcagatagaaaaaaatgacacatatgttaaattcatgattttgctatttcacatctatgttttacaatttgtgtgagctttctcagtgattctgagggactgagggactggtctacattaaagattgataaaaaatggaaagattatctcatttgtttcatattaaatagtgaccaaaagtgtgttttgataaaggaagcaagtaagcatacacatttgtttgaatggatcactaatttaggatattacaaattgatgagccctattatcctatttgtaattaatttaaaaggttttcaccaattatactaattataattcttcatgctaaaacttttcattatagcctaggctttagtggttcattctgacaatgaaatgaaagcacattataattttatttcttacacagtttcacaagtgtttttagtgagattgcaacttactttaaaaacaactacatctcttgtctttttagaccttctttaaagtaagataacgtaatgatatttttgcagttttaggaatttgagaaaaaactcatcagtcctactccccaaaagtctgctaagtgatctgtgcgcttaaagcagatattttctgtttgttttctatctttaatttaccataaggaaatttcaagatatttttgctttataattcagaaatacttatttctagcccatcacatttaagaatcaataataacgcatgtcagattctttataataaatggctatatcacataatttgaataacaaatgggaaaataaaacttagagagtgtaactggattgtctgtaactcaaaggctgaatgcttgatgggatggatatcccattcccctttatgtccttaattcacattgcctgcttgtatgaagacatctcatgtatcccataagtatatatacctactatgtacccacataaatttttaatattttaattaaaaaaattattaaattgcactttaacactttctaacttatgtgtgaaaagttttcttcaaatccttttaaacttaaaatatcaccctgtccttgtgtttaacattgaagattcccattctaaactttgctatgcagcttttcttattaattcactatgtttgtattcatgataactaaaacatcgtttacatctgaacttttacagtctgtcagataaagtgtttttacatgtaactcaacatgctcctgggagttaagattttaaaatcacaatgttcaaaagtgacaaatgacagcttttaaagtaccaatctaactggttgtaacacatccacaattgtatatttttagtcttaatataagaaaaagttattagttggttatatttactcttacctttagaggccatgaagatgtctgagtcacttcttcaaaggttgccaggttggaaaacaaaggcttttcttgttgcagcaaggagagaaaacgcagcatgcacaaaacttcagaacgtgtttgtctgcctcttgtcagcttacatataacagaggaagggagtcccttgctgtttctagacttctggactttatcagtttggacaacagagtgagatgaaactgtcacaaaagtaaacgctgttcagaaaccatcatataactttggtggctgaaggaacaatttaaaaataataaaaaccagaaaggaaagcacacagcactcattttaagtgtcttttttttttttaccaagttgtttttgtatttcttagaatatacacatttgcattcagtcttatatcagaaatatcctgtatttctcaatttctagaagtctcctttccagattctgtgataaaacatcctattgtataaatttttgatagttctaaatacaattctttacatgttgaaaatgtttgaacattattattgttatttttctattggatttatctccatctcttcaactcaaaataaataagaagaggatatattccctactattatataaataaatctttattttcatttttaattgaatttgattaatcagaggcattggaatatacaaaccttcaatagccttgcaaagctaatcaaaatttacagatgatatttaactgcattgaattctaaggaaagaaaacaagtgctgtaaccttgactggacagctcctatttctaaatgcagctacccaggtgaccatggagattttgctcaccaagtcaattgccctacatggtatgattcacaaaggttgaacatgcaggatatattgcattatcagcaacactgtctttttctgaaaatagttaagaggcttcaggaggtataccttgtgatgaaaaattataaagtcaacctcacagtttgcagactgccaaaagtttgagttttccttatttgacaaagaggagtggttttgttgttgtagttttcttagtgtttggagttgaaaaaagctaccattatttaagttgtcgttttgcagaaaagatgtgtgaatatgattaatatttttaaattaaactgtatgtttcctaagttttttctaatgtttgtcgtgagcatttagaaaaactttaatacaaaaaattaagttattaacactatcaaagaagattaaaaaaattttttttattatactctaagttctacggtacatgtgcacaacgtgcaggtttgttacatatgtatacatctgccatgttggtgtgctgcacccattaactcatcatttacattaggtacatctcctaatgctatccctcccctctccccccaccccacaacaggccccggtgtgtgatgttccccttcctgtgtccatgtgttctcactgttcaattcccacctgtgagtgagaacatgcgatgtttggttttcggtccttgcgatagtttgctgagaatgatggtttccagcttcatccatatccctacaaaggacatgtactcatcattttttatggctgcatagtattccatggtgcatatgtgccacattttcttaatccagtctatcattgttggacatttgggttggttccaagtctttgtattgtgagtagtgcgcaataaacatacgtgtgcatgtgtctttgctcagcaaaaggaactaccatcagagtgaacaggcaacctacaggatgggagaaaatttttgcaatctactcatctgacaaagggctaatgtccagaatctacaaagaactcaaacaaatttacaagaaaaaaacaagcaaccccatcaaaaagtgggtgaaggatatgaacagacacttctcaaaagaagacatttacgcagccaacagacacatgaaaaaatgctcatcatcactggtcatcagagaaatgcaaattgaaaccacaatgagatatcatctcacaccagttagaatggtgatcattaaaaagtcaggaaacaacaggtgctggagaggatgtggagaaataagaacacttttacactgttggtgggactgtaaactagttcaaccattgtggaagacagtgtggcaattcctcagggatctagaactagaaataccatttgacccagccatcccattactgggtatatacctaaaggaatataaatcatgctgctatcaaacaagatgttttgaaatgtggtcagaattcaccagttaattttgactgccctacacagcacaaattttggaataaaaataaaaatcttagtgaattaaacatatttgtgaactctccaaagacaaccatatatgacttgggcatatgatgacatgggcatatgactgactgatgggatcttttaatatttaatctgcagtggaggcttttcagatcatcgaacctggtaatgctactggtgaggtatactcaatgcatttttcttcccttatgcactctccctgtcttgccaaagacaataccaatgttttttttctttttaaaggctaagtgtttgccaacctgagatctcccttttgttcattcctttctttttctcagcttttctcaaggagaggctcacaaaactctgtttaataggactctcacatgtttcaagtgtcctaacactgtgtgttcacgcagccaggagatgctgctccacaagctggcctctctcctgttgctattgctgctgccattcaacttcaccttcatagtactcagtgctcttctcctaacacctgctgccttcctagaagaacgatggtcataccatcctcttggctctgtgccatgaagcccttgaccttttcaagaagcatcagtttgactttgccaccagcctgcagtttttatggcccactcacttgattccaacccaaggtgggcatgtctaacacagtactgaagacttgagatcacatcgagggcattgctgtaagaaacaggaaacttgaacacgaatatcagaaaccatagggtgaatgggctttgcctcttcccaggaaactccctattggtcatcgctctctcctgagccactggtttgctgctctgctgcatgggcttgctcatttactcaggatgatctgcctttctggtcctgtacctcctgaaacaagaggagcctcatatatccccccttttcttccattccagccaaaaggaaatggaaacaaattgcaccataattgctgcacaattaccttctgcccatagactattttcaggacatatcacaggtgtttctaaagagttgtccattcaatattacagtgatgttcataactttactctttatttagtggctagtatttgacttacattttaatgtctgaaagacgcatcaaaatgctttctctcagtacaaggtgagagaaatgtcaattaaatctatatagtgacagaatagaaatgttgcctgttataaatcaaagcaaagactaatattctctagaatggaaaatggagtaagacataatcttacagttctggggcaaaaccaaggactgggatgaactggctttagaaatactttactggacttatggttattcttcctctggctttactataaaatgtatgtatcttaaaaattatatacatacatacatacatatacaaacatatacatacatacatatatatgcaaatatatggagtgagagataattacttgttttttgagttatataaatattattttaggtataattctaaaacaaattttattctcttaagattatattctttaaaaattcatgataatacataaaattacatttattttaaatcactgcatatgttatttcattttataaatataatgaacataattggtggccattgcccttttaatgggcatttaaattgtttctattatgtaaagcaattgtccttatgcacatttgtagcagccttttgaaggcatatattcagaaataaaatttctggtttatggggtaggaagatcttcatttttaccagctagcactgaattgatcttaaagtacttgtgccaatttacattccaaacgttagtggataagagttcctactgccacataccctttccaatactgggttcgtcagtgtagtagaggattaactaggggtctttcatttatgagaaggcagctttcagaggtcttgattacattataatctgggtaaccagcactttttaaaaaaatcttttcttatatttcatcgtgtaagaataatagcacattttgtgaataattggttataaaagaagtggggaatggtgtctaaatggtttatacgttagtgataaatagctcctttcattcagtgatgctactggcatgatctgctaaaatatgaatccacataagaattcaaccgtgcagcacctaaggcatgcatttctatgcttaagtcttattgtccctggatttataattttccatagtaaaaaattcaccgtggagcaagacactgtatgtgtaaataaaaaataatagaaataaaacaaatatgggaataaataaatattataaatagtttttccagagtcatgtgatttaaaactaccatcttaaatatgaaacacccagtttcttaatgcaaactggatgtttcttttctgggaatgtgtttttctattagccagttattcaccttttgtaaacctcctatcaatgtgcaatttttagtatctgatttaaacctgccctttttatggagtgcctcattcatttattcattcagcaaacatttactaactttttactatgtacatgacattgtggagcataccgatgtttaatgatgtgaactccactctggggaatatgtagtttagtggagtatcataatacaaggatgcaatattgcaattttttaatttttttaaattgtaagttaattactacctccagaaaataaaatgatataactcatcctctcttaaaagcaaatgaaattagaatgaataatgtatcattcacatgagaaattcattatttcacacatacatgtcagatttttccttaatctgttactttaaaacaagaaagtaataactattaagatattctttcttacataatgaggataataaactggatcacccttcttagcttctaataagagataatttttttaatcccctctttttctgcctacctaaaattatattgatccaatatccattctttagaatgaaagaaaaagaatcctggatacatggtagaatctgtccgaaactaagaaaaagataattctggagcagatatatctaggtctccatgtaccaagatgacatggaaaaaaactaatttggagtcctgtgcacagacacaacatgggacaaatggtatttcattatcagcagattgtaaagcccaaggcagaagcaaaagtttcatctatagaagttctttttaaatgttcagccttatacattttctttgagcaagactcgtgtctttgtcttctggcatttgcatgatttgttatgcacaatatgaacttttaacagttcataatggtactttcctctaaagagtctgaaaacaacagcaaatattctgagaggttcttgcatgtaaacattctaggctatattacaagaaaacgagatggaaattgcaagcagaaaatggccctctgcagagatatgaaatagcaacgactatttatctagatattgttcagagtatatgtttatgtatgtgtctgagagagagagatgaagggagggaggaaggggagaagagaagaatttggagctatactaagtagatggagggaagaattaagaagacattaacaattttcagagaccccaattctttccaccaagaattgctttactatttttaaaacctctttatttctaccattatttaaatgatatttacctttgccttcgttcttgggttttgctcaatgtagtcactttgtcttcccaacatctgtctgcatcttcagatatcaccaaaatactgcaacatgccctttggtggctgcagccgacagcccagcagtgctctgcatacaactgccttcattgacagcagccatatcatgcacggccagtgcagctgcaattcagtgccagcaagggtgtataaattgtttctgcagcacattttctttgcatttccagcaatgaaaataagcttctctgaggttgggtcccccaagagcaaagttttctagaaattgagataattattatgttaaatatacattaaatatataggcaaaacacattagagttaatttatgcttaatagtgtatgtttagtgtttacttctggtgctatttataggctaaatcactgagaaaatgttcctgcatttgaaagcatgctttgctaagcagtggctagaagtgtgggatgtgtcctatataccatgtagaaccttgcctccctgaatgaaaggttaaagtttggtggaaaaaggtctgtttgtgctatttgtgaatttttttttccttgttattgcttaatggagagaagctgctaatgcaggtcctggcccattatctgctttcctgaaatgctcattgaaagaatgatggaatagatgtcactctaagcatctggcttgagtcttcctccttaacaattctgatacaaatatatatatatgtgtgtatatatatgtgtgtgtgtatatatatatatttatatacatatatattcatatatatatttatatacatatatattcatatatatatatatattttgagacagggtctcactctgtcacttaggcttgagtgcagtggtatgatcaaaactcgctgcaacctcaacttcctggagtgactctcccacctcagccttctgagtagctggaactgcgagtgcacaccaccactcccaggtatttttttttttttttgagatggggtttcactatatttctcaggctggtctcaaactcttgggctcaagtaatcctccagcctcagcttcccagtgtgctgggattacagcatgagtcaccatgccctgaccttgaactttgaaaaatagataaaaactatggtcttgctcctgacttcaaattatagtcatgattttatatatacatattttatatgtatgcactactgcatttttggtatgaccaaaaatatagactgctataaattttggaaaacattattaagatactctttgcagaattaaataatgatcaaatggacatggcaaaaatttaggctttgagatttttagcttacctcagattcatattcctacttaccttatttatacacatgatttatatgaaatttctgaccaggcactttgacccatagctcttaagaggtatccatcaaatgtcaattcaaaaatatttattgaatcttttggaagtaccacgtactgtactatgttttgaggctaagaagatcaaataaaaaatgcaatgagtagtccagtgagaagcagctatacaaacaaattatgatgcaaagcagaacatgtaaaaagtcctataattaaagtatgtataatataaagaagaggataacactctctctggtattggggctttcgagacttcttacgggacgagatatcttacctcgattctgaatagtacgagtattgtgccaagtagagtaataaaacacgagcactccagtctgaatgaatggcatcgataataaatatagacatgaaactgcagtgggtttattgtacaaattaagcaaattcttaaaaagatgcatgtaaaaagatgcatgtaaatcaattaaaaatatattaaatactcaactaaattactgttgcctaccttatttataaaataattcataaattcctatttcactttctgtgaacactgttcaaattctgctttgtttcaagtgaagtacattcttgtatagttttttttaactgccttcatcatgcctttctcaatttactaaatagattccagtgcattgctgtcagtagaaatatactgtaagcaatgtaggcaatttaatattttctagaaatcacattgaaaataaaaagaaataggttaaattaatttaaataatatattttatttaaccaactatttaaaaaatacttttatttcatcatgtggccatcagcacatttgaagtgttcagtagccacatatgactattggctactgtattgaacactaaaatcctggtgtattgatccagcagcaaaagacttggctggtgacagataacatgttgtttagtaaccttatgagtttgtttaaatataagtgtttgaaaataattttgaacttcaatttttaatttatattttaaaaataaaagtaacacattgatatgaaaaactaactttaattatactgtaaaatgagaaataaaaattaaaaatattatctctccccctgccaccagttcttttcccccaaaataattactttaattattgtatatctattttgggtcaaaaatgtgcttataattatatatggaatatatatatattataatttctatgcatatgaaatattatacaaatttgtctgtacactgcccaattcaatagtagagataaattaaataagataccattaaatacttactggagaggcaaaaattaagaggacagacaatacaaagtgttagaagaacataaagcaatatcagctcttatatactcctggcaactgagtgtatttctacaatagtttggcaatatttagtatatctgaagagatacatactctgtgtcatagcaattccacttctaggtgtataggcttaaaaacttgcatagttttaccatgaacactacataaaattatttgtagaagtattggtcattattacctcaaatagaaaacaaccaaaatgtccatttaccaaacatgagatagttgcatacctatataatgaaatgctattcatcaatgaaaataaatgacctatggctatgtgcatataacatggatattatagtcatggtgtcaaatgtaaaaagcaattcacagaaaactgcttataagtatgattaaatttttatataatttgaaatggcctaaatcaatggcatgcctgtatactaaaactatactttaaaaaataaaacaggcatatgactaatacaaatatcagactgatatttagttaccttagtggggagagaatgatatatgaacagggtagggacctaaaattagattcttagttcctggaatattccaattcttaactggtgtggtttgtagattggtgttgccactttggagtgtaatctggcagtatttgtgtgtatacagagggtacgtacctcagtgaaattcttccatgggctcatagaggacactcatgatagctagaggtaatgagaagttgtaggcaactcaggtgttcataacaaaaaaaaattgataaaagtaaaatgtgatggaggcccactgtagaatagcatacaaatattagaaataatgaagtacatgtgcatacaattacctaagtagatattgacaaaagtgtttagtaaaaaagtaagaattcaacaaagttcattctgttgctggtatctgacattcccttttacttcttaatgatttgagatcctggctttctgtcaccatttgcaacacaagaataccttgttttactgttgtttgtagatacagtggttttttgttggtttgtttttgttttttgtttttcacaaattaaaggtttgtaaccctgcatctggagcaagctcatcagtgccatttttctaatagcatgtgttcacttcgtatccctttttggaaattttggcaacattgcaacattgcaaacattttcattactatggtatcttttttgacaatatgtgatcagtgatcattgatgtgactattgtaattgtttttgttgaaacacacgaaccatcaacttataaaatggcaaacaataaatgtgtgtattctgactgctccaccgattgagtgttctcccatctctctccacatcctcaggccttcctattctcggggacacaagctgaaaacaggccaattaataactctgtaatggcctctaagtgttcaagtgaaagtaagagtcacatgtctctcacgtccaatcaaactcagagatgattaagtatactgaacaaggcatgtcaaaagccatgataggtcgaatgctagcaccggttagccaagttgtgaatgccaagaaaaattcttgaagaaaattaagtgaaacagcattattgctgatatggagaaagttttagtggtctgaatagatcaaatcagccacaatatttctttaaatccaagcctaatccagtacaaggtcctaactcttcaatcctgcaaagggtgagagataaggaagctgtaaataaaaagtttgaagctagcagaagttggttgatgatgtttaatgaaaatagccatctccatagtttaatgaaaatagccatctccataacataagagtgcaaggtgaagcaacaagtgctgctgtagaagctgcagcaagttttcccaaagatgtagctaaaataatagatgaaggtggctacatcaaaaaatagattttcattgtatatgaaacagcttttgactggaagaagacactagatagaaatttcatacctaaagaggagaagtcaattcttagcttctgatctgggcaaagtaaattgaaagccttttgcaaaaggttcaccattctataacagatgccattgagagcatgatttatgggagaaggtcaaaatatcaacattcgcagttgaagtaaagaactctcatggataactttgaggggttcaacactttggtggaggaagtgattaccaattctcttgtggtggaaataacaagagaactagaattagaagtgaagactgaagatgggactgaattgctccaatctcacaataaaatctgatgaatgaggagttgcttcttatggataagcaaaggaagaggttttttgagatgcaatttactcctggtgaagatgctgtgaacattgttgaaaagacataaacatttagaatgttacataaaagttggttgataaagcagctgggattgagaagattgacttcacttttgaaaattctaccatgggtaaaatgctatcaaacaatattgcatgctacagataactcttttgaaaaaggaagagtcaattgatgtggcaacatttattgttgcattattttaagaaattactacagccaccctaactttcagcaaatagcaccctgaccagttagcagccatcaacatcaaggcaagaacctccaccagcaaaaaggttttgactggccaaatgctcagatgattgttagtattatttagcaataaaatatttttaagttatgtacattgttttctagacataatgctattacatactttatagactagagtatagtgtaaacatgacttttatatgcattgagaaaccaaaattatttgtgtgacttgctttattgcagtggtctagaactgaaccagtgatacctctaaggtaggcctgtatcacccttatcttaattgttagaaaactccatgtacatacaaatgattccaacattttcatgtcctgttacttttctccaatgatcttgtctcttcttctacctcggcctgttttaaataaacataattttatagctataatttagatttgttgtgacttgtaaatgcagtcctaccataatatcaaattcatgtatcctattgccctattttcttcctctacttctggcccactccctctggtactcccactgaaataagcttttgatgcaccaaggtctttgatctcacttatcttttgcctccttgatgtcctcatcctctttgtcacccagcctaaattccagaaagaatttttataatttcactccgaatataagcatatcttgttagatagtacttacttgatcaaagaaaaaaagaaaaatcctggtttattctgacttttctccttttccaagcttgtgcctaaacacatataaagcaagcaaaagaatacttattggtctcacttccatatttgtaaacctgaaaatcaagtgggccctcaatacttaagatgtccatgtcacccagtctcctagatgactatttcaaacttctttcacaagaacccaacacctcctatcctacgcttgttctcaactggtgactttacataaattgagaaatggaagctatcagaggatgacttttaaaaacttcccccaccatatctccccaccagtgtccaagcccacccacatgtagtccgctttcccccgtgtttcccaggatgatacagcagcctcctccctccacgtgtgcgctaggtctcatcctctcttttacactcaaggacagtgcaccagcagttctctcttctctcctacttcatcaagttttcactttccacatgatcatgtccatagtaggtgtacatatttattgggtacatgagatgtttggatacaggcatgaaatgtgaaataatcacatcatggagaatggggtgtctattccctgaagcatttatcctttgagttacaatccaattacactctttaacttatttaaaaatgtacaattaccttattattgattatagtcaccctgctgtgctatcaaattagcaggtactactcatttttttctattttttgtacccattagccatatccacctctctcccttcttaaatatgttttttcttgactgactccccctacttgttgctgtccctttctttgctccactttgcagcaaaactcttcagaagagttttgtacttgcagcccctgatttctttcctcccatactccctcaacccactccactcaagcttctgccttcactattccacaaattgcatttgttaaagttaataataatctccctgtccttgagtccaatgattaatttttgtgtctcctcttgtttgacctactgacaacacctgacacagttgatcacaacctccttcttgacacactttcctcaataggcttttagcatgccacatattattggttttactgatcattctttctcagtctgttttgctggcaacgcctcttctttcagacatctattttgtagtgcctcagtcttcttccttaatccctttatctatatattcacttcctgggttatctcgtctagtctcgtggctttaaataaactatacatgttgactgttccaatttatatctctagctcaggcttctgttttgcattctttacttgtataataacacttcaaactcaacaggatgaaaactgaactcctaatctgctttacccaccaagtccatgccaactgtatctctccagttaggccaaatcttgtggccattggtgactcccctctttatctcataccttatatttttacttctctgcagagttcatagaaaaaaaaatcatataccatatattttacatacagaatcccttggctcttccttcaaaatacataaagactccaaccagttctcagcactctacgacttccatcctagtccagtcgtaatattttgttgcctgtgttattgcagtcatctcataaacaaacttctcatttctgcccctgttccctacagttaattctcaagatgacaacaaaatagttgaaacacacaacataaaacaatcttaaagctatttcaagatacacaccaatacatgcatcaagtacattagtgtaaagcaatacctaaataagagatggttctgataatgttgaattaaacaggtttgtgattaactcaatttctagatcatatgccccccaaaattttaaatgtaaaataaatatagctgatttttaaaaaaccatccaatctggtaatatacatattccagtagacaagtatataatatgtatattacttttatatttatttcaatttctgatttatttgggcttatttctaccatcttattttatatgttgcatattattttcctgattcatttaaaaaagtcacattgtctccttttgaattgataaagttttattaattcttcctccttattttctttttctttcttggcttggaagctaaatgttttatttgtattcttttagagcctcaaccttacaaactgatcatgcatatttaataaagtcaaaagttgttttccacaatcatatttcttaacaacatttaagtctaagtcttacatatagaatttttagagtttatcattagccttttaaccacaacattaccatatcattggtggttatatttgtcatgatgctgtgttttcatgaagggttcatgggttcatattttcttaattcaggtgtatctgaaaatttctgttgcctttatacttgcttggcagattggttgagtatagcattctttgtttacatttcatgtcctgttacactgtagactgttctatagtctctgaatatttatgtggatgtctgaagacaatatgcattctccacctcataaatgtcttgcttttactgcttacatgactgaagaagtctatctttacccttgaatctcaagaggtggactactatatgttagatttttttcttaagaaacttttttgtcccatcgattgtgttctctacttagcatacaaggttattctggattttaggttttacttttattccctgctctttgtctatagttttttttttttctagttactttaatcacttggtcttgtttctctgcattcactttatggccgcaaggctgtgttatctgttctacttatgttatttaatattatctaggttacttactttacctgttattttccaattattttttagttctttaatactgttatttccccttcagttttgctcttagctctgtattttcactttaatctgctattttattattgtaaacttagtatactgataccttgaatgtgttttctgtaagttctttgccaagaaacagtgcaatatttttctttatttcattaggtaatatttttcttctagagttgattttttatttcatttttgtagtccattattccttcctacctccttggtcattcgtcttcctctttccttcctctctttcttttatctgtttctttctttcttttttattccttccttttataatggtatatttgcagtattgacatgctgctttcttttttctatatcatggtcttctaattgttatgatgcagtgtgggtaaatttttcaacctaatttaaaattcacagagcttcagtttaacactgctatttcacattgcattacttttacgtagcctaagaccacaaagtttcaagaggagaattcaacctaggttctgtgatattttatataaaggatgtgttttctgtgcttctttttccatttttttgtgaaatatattgtatcaagtctcaatatactaagttggctgtgcagctgcttctgttctgtggtgggcgctcttgcattcaaaataaagtggaccctggagcccacctttgctcctgaggcggttagcctaggtaattctctcatcacttcttcccgtagccatttccacactgtctcctcacactggaatgaaacacaagtagaaactgttgcttttgatcacaaaatttcaagaatgactgatctattgactatgaggttagaatttgaaggtttaaggcactgcatagtagaggggactgaggttggcgttacgatcccagctaaatcaatggcctttagtgcactcatttcaccttcttcccctctctcagaggatttgcatttttttttttttaatgcttagtcttcaattgctttgcttttccaagttaactctgggaaagatcgttcaatccttcttcttcttcttcttctttttcttttgaacattcttccttctgagaaaaagccctgaagattgttgaatatttttcctgagtcttctgaggcttgggggactaaagtatatagagctttgtccacaatttttacctggactgtctacgcatctcttcaagtttatgtttcaagttgaaagaaaatgttttaaaatcatgggattcaaggcatgcaggacattattaaaatcatgcagaatagtgtttcctaatcagtagcttaggtagtttttcagtttttgtgttatttttgatagtgcgtactgctagttacttggtgagaagaaaagcaatttgcaactaaaatgatgtacctaaattatgcaactagctacagagatacacccaactctagttttctaaatgctcttcttactatgctttctattacaacatagttttttgtctattaaactccataaaataatacagaaatttaaaaaatatgtattttagtctgggttcattcacaaggtaagttaagtaatagatttttaagctaatatttaaagtagattataaacaatctaatatactttagctagttaatcaggagcaagaatttttgtctgcagattcatactgttaaaaatggagatattctacccaatattttaatgaagaagcaaaagtttcattaattttcaaaggtctgtcttgtgtccaaccatcaatatgctattattacttccaatgtctcattcctcatgagaaaaatatgttttctttttttaatcctctgtcactttccaaatcatcatttttgagaatataccaatcaaaggaaattgtgattctttgagtctttcagtgtactctttgtaaccatggaaaccaagccaaactgttaccaaggttacctttctgaagctgtgatttcattctcattatcagtttttcctaggattaataaattcattgaaagtttaacataaataatgctatatttgtgtataatatattgatgactatatgattatttttaattatcttccatttaaaattatatataactagatttgcagttcaaggtggagaaacaagcacactcatgattttgagcaattgattatctgaaaacagaattaatttgaccttaatgctgagaatattttccctttagtggcttatatttagtagcttaagcttacttgtacttttttctttcatgcaactttgttctgaagtattgtatgccattatattataaatactgttattggtcttcactttttgtaatccacctatgaataaaacccaaaggtcttggttatacataaataatagaagataaattatataaaccttgaaaacataacagcagttgtgtatgtgtacacacacacacacacacacacacacatttatatatatggagaaagaaagcgtgatttccttaggtagctaacctatattgagaataaatagatactgttaaattgataaatcaggaatttgaagcattatgttaggttaatcttataagtgtttctatgtatttataatatttagagagttgaatatttttagagtattttaagattattttctgacatctatcccaagaaaaatgagtaaattgttaaaaaatacaatggaaccagagtttggagaatggaatataaaactcatattttaaaacttttatatggtttgatatcatgttttgagcattaggcactttaaacaaatttaaaatcaaaatatttctttttttttttgcaattatcatttattagttgtgtaatcacagataggcaactttaactttttgaaagcatatacttttaggttaattaaatgaaagaatggacatggaagtagtttaaaaacaatatagcattaataaatacaaagtgggaaaaacacaactagagtgacactttgttaaaaaaatcaaaatatttcttgttctgcaatctgtagtggcatttctcacagaaaaagggagtgtctaggaatttttatttctctcctaattgaagatgaacataagcatatctgctagattttctactgtacttttatttatttatttatttatttatttatttatttatttatttattttaagacggagtctcgctctgtcgcccaggctggagtgcagtggcgccatctcggctcactgcaagctccacctcccgggttcacaccattctcctgcctcagcctctggagtagctgggactacaggcgcccgcccccacgcccggctaattttttgtactttttttagtagatacggggtttcactgcgttaaccagggtggtcttgatctccttacctcgtgatccgaccgcctcggcctcccaaagtgctgagattataggcgtgagccaccgcgcccggcctctatacttctttttagattgtccccttgcttcctttttcctgttagggagatgcagaggcatatatcagtggaactgagattctgaatgtggagcatgagcacaaggaagggctagtcatgcaatgcctgagtgtgcatgaggaagggacctcctacagtcagggtaccaatagaaactcgatgacaccttcaaaacggaagaagatccagaatgctcatttgcaaaggcattatttataaatctgtgagtgtgggacaaaagacaaataccccttagtctattagtcagtcctaaagagaaatatatgaattaaaacaagaatccagaagaatagagtcacagaggttggctgtcttgagagggattgagacagggaaatagctactctgacctcactgtcctcccaccttcccaatctcccggctcttcactgactaaatgccaacaagaagacagaggacatgaaaattttgttttgtaggacaaagaagtcaacttccctgggcagagagcagggtggggatgggtggagacggacagagagtgggtgtctggggctaaaataaagatctgtcatggaatccctacattgagacccttttctggttttgttagaactgagatgttacttttgtctgtcataaaaatcactggaatcaatgatttttgccctgtgtgcaattgagtggccttctcatagataatatgacgttgtatactgcacaacttacaaagccatgcctcatgtgtgagcaaaaattcagaattaggaacatagcatgactccatgagtgatgtcttttgcttaaaatgccccctctaaccagtaaaatggagctactgtgattttaaaatttattacatcaccagggtcacactgatagaattcagaagtgggaaaccagtcccatcaaagtgtagcaggtcctaaaagccattattgggaaattccttcaaattcattccattttctacagcccttgtttagaatatgtatacccatggtttgggaaacacaacaaaataattcttattagagaataatgactttaaataatatttttttcttaaaaaataagcctagggtgtatctctacatcccttgtttcatgtgagaaagggaatacttgaagaaggaaaacggaaggaagaaaattcacatacgcttcacatattttgcatcagatgctacaataagggattgcgtgcacacacacacacacacacagagacacacacacagatttaattacagcgaattgatatggtgagtaattttctcttaatttcacaaatgctgtgtatgttttctacaaaatttggttccagccatgtttgttgattgtttttcagttgaaggtgattatgagccataaaataacccaaattagaaaaggaaagaaaggtgataaagtaacaaaccagatcaatgaattttaaaatgtgtcttgagaaaacctcaggtcccaagaagaggtctcttggacagctgtgtgtatgagggtcagtacaagattgggggcttcggtgaggctgagcaggtgggattctggtttcccatttcctcttttttaatcaggaagttttgattttatctcaaaattttctttaaaacaattggcctagaaagtctaaaaattttgtgatcaattacttcatgttcactcaaaattcctctaatataccagtggaataaggctttcaaatattacacttaagtagaaataaagtaatattcaggttgctattcacaaaaaactcagtattacctattttgctccacaaacaaaggtccattaagtcattgaaagccagatagtttattaaacaaatatgcgatcccacatgagcagttccttcagaaagtgaaagtgagaaaaggagtaccatgtgacctctcaggctaaagattattttcatgttcttgtttaaaatctggcatttatctgttttagggagttctcttattgtcttcttactcttatcaagataatattcaattagtaagcaagcataatttgtccatttactgtataaatattgcattttcatgttgatactgaatctagaagcaatctgtaattttttccaggcaggcggaggtatgaaacctgcctatcaagtaacacagaatgccttaagtggctctgccaccaagatatcttgataaaagagtgagggaattatagtccctctgttgtgctatcacacaccaggtcttattctttctattttttttgtacacatatagagtgtacaaaagagtataattggattgtttgtaacacaaaggaggtaatggatattgcatcgcatgcctgtatcaaatatcttatataactcataaatatataagcctactatgtacccacaaaaattaaaaacaaaaatttaaaaataaaagagaaataagacatcaaaaaatttttaaaaaaagagtgagaggaaaataattcaagatagatttatctttcatttataactgaaataggatttccaaagcaggagaccatagggaatctcccagaagcccaccacactcctcctccttattggcatgctagaggaaagcaaagggtccgatgatcttccagtttaaatcaatgaagaaaaacaaactatatctgagagttttccattttaaaaattattatatataggaaaaaaggaatacataaattttcatctaattcatttggactgtttcaatttatttacatttggatatattagtgtacaaaagaactcaagaagaaaacccattgtttagtcaagtaaaacaaacaaaacaatggcaaggaagaaatgtgaagattatagtaggatctggctaggatttggttgcaagtatttgtagataaggaaattgaagcaagggcttacacatcatctctatttaatttttcccttatattttaccttctttataaccaagaagaatctgagaaatgttacattagctttggaagtggttccacagaagactaattaaaatagaagaagtagatagtgctacggagttttaagggaggtccagggcttatctgctatatctcattaacctcagacacattttataagtaatttggacagataaacatagaggaagggtggttccataaactatttctagtaattcattgtaatgttttcttgacctcccgttcccggcacgaagatcataaatctgtgtggaattctttgctcaggatttacatattatatggcagaaaatgtgaaggaatattttcctattttgcagctctgcaatgtcaaaccctttgtttctttcatttgagtagaagcttcctaaaacgtgtcaatatttgccttgtcaactttctctccccacccaccacccaccattctctactgacacaagtgcaatctgcttccgctcgctgtttcaaaggcctatcgcatctctgaaactgctgtttccaaggtaacatatggccctctggttgccaaacctaaatatgctttgaaatccttactcacttgacctctcttggcattgatggttaacaactcccttgtttcaaaacactttccctctttggcttatttgatagtgtttccccctagttttgcttttatgacactgagggctttcttgtttttacctaacttttaattttggtgttatctgtgcttcatccttgatcctcttttttaattttctcattctatacccccccctgaacaattgtatctacatgctggctctaatctctgtcaactcaaaaatctataatattacctcatacgtctcttctggtcttcagatttctataaaaatttttataaaatgtaaaaataattatccatattgattattcaaaaaactcggatggtctataaatcgtacacacacatacacacacacacacacacacaccatcaccaccaccaattccattgttaatcggatttttaacaataatacatctctgttatagcctttctatggacctgtcatggtcctggacaaagtacttagaatcaaatgaaatacacacatgaccttttaggagctctaagtccagagaccctcagctctctcttagatctatttctcagaggctaccaggccaatttgtccttccccagcaaagcttttgttatgctatgctatatccaactatttccttatgttagtttctgtcaaaaggacagaaatttcccctatcttgtttctttcattctaactcaataaaggtttttgaatgaattttcccaagtgccacatactcactgtcttagtgtgtttgggttgccaaaacaaataccataaactcggaagctgataaacaacaaaaatttatttctcacagttctggaggctgagatatccaagatcagggcactggaagatttgatgtctggacactaatcccatccatgagaccttcatcctcatgacctaatcatctcccagagatccttcctccaaataccatcatcttgggggttaggatgttaatatatgaatttggaagacagaggactcaaacattcggatcatagcacccatgtgactattatatacacttgatgtaaaaggaaaattcttgctatccctcaatgaaatgagttttatatttatactttggcaattgttctctgagcaggccaagaacattctatttagccattcatagtatgtgcttgatatttatgaaccaaatcaagggactcatgtaatgcaggtgacttgataaacatgtggcctatatgaccacagacttttaaatgtagcttcagatgttaaagaattactaacttcggaaatcatctggaatttgtgtgtgtgtgtgtgtgtgtgtgtgtgtgattctagctaggatataaaagaaatgatatagattttattgaatccttttatttaaaaattcttaccatgtatttttattgaccttagtattacaatgaaaagccttgtttattgatattagcttatgcatcatagtgaaaatattgatcataagatttttaattatgctaaagtaaggatattttgtgaaaactctgaaattatatagaaatattggtgtatgtatataatttttttttttttttggttaatgctcagtagcttttatcagattctcaaaggggtctgtgtttcccaaatgttaagaaccaaagccacaatacacttttgctctgtattatattttacaattattactgagaaagaagaattttcagagaaaatgccaaatgaataagccaaaatatcttttttgttctttaaatttacactacacagaaatgcaagctctcttgatgttgaccctacaagggcatttctatttgtatctgaatagatttatatccaaatttggagagaagcccatgttccattaccatgcaaaccacaacatgcttgagattgctaattagggtacaaattgtggtggtatttctggtgacctggacatgtgttcaatagaaacagaaatgagcccctcaactcatttcacataggccagaaaacatctgccagatggttatagctttcagtaactattaaacaggatcacatttgaacaaatgacttagatatatagtgtttgagagcttactctaaaatttctaacatatccatagagattagtcttaatgaaaaactacattaatctacctcatacattgtaactagcctaaaatgaataattccttctcattttagccaaaatcaaactaaaaatgcctttatacatttttgtataatgctgacaaaacatctgggagatttattgatgtaagggtatctattaggacatcaaaattaatttcaattccctgaggtatctcattttaattaacaaatccgtgatcctgttctattaattagcatgttgaaggaataagtttgagatgaatttaattctaacaaagcatttatcttctataataataaaaaggacattaacaatctcagtctaatttgttttatacttttaataacagtcttgaaattccattcagaaaagcaatataagtaatatctattatttttaatttaaagctttattttgggtgtgcatactttttaaaaccatcattattaggggcaccatagttctaacattatacattttaaatattactaatgtgaatacaagttcattaagcatgttatattattaaattctcaattgtgtataacctatatatttatttcactctgagatagttttttttttttgatgtgccactgagtatgacagaaaacaggtagaatctatgaataattccctggtctgaccaaacatttaatttctgcatacttatatattttatcctagattactgttattggtatgtccttgtatttgtcttaaatacagctaaaacattttaggcagtaacataataacaaattaaattaatagtgcatctgatagcatattgaaagttctaatataatggaaaatattgaacaatttcaaataactttgtcttatgtcaagccacaaacaatggcttcagatggtattagagtattagaggaactgggctatataaacctaaatggcataattctgaaactactcattgaacttttccattctcatatctgttttgttgccagtaggatgcctttaaataaaaaggcatcatagagttgctctcaaaaaaaaacctctgatattcaattaatatacaatacaaaaaatcaagatttttatatggtttcaatttttgactctgtcatagttataacctatactgtatgttgtcacagttaaagagactgataacaaatattttaggttttgtgggccagccaagaggcaaaatcaagaatgttttatgggtctttttgtaacaaatgggaaaataggtttctacaaatcttatttatgaaattataaaacataaaaattggagataattttggggaatccaaggctactaattaggaagatgggattatcttttagaaatactatgtcatttaattggggttcaaaattagagttttctatgatcaaattaaattgcaagtgttcaactgttaatgctgatctgtaatgagattttctatatttaatctttgaaaatatcttcacacagacaggtactgccaaatactgatattaactcaacagcatatagaaagcacttaaagaattatgatatattcttctctagatactgccttttagtatgtcaccgcatttcagattatttacttaaaattgaaggttagatagaacctccttccattttaaaatatggaaatatcccttgaacttagaatgcaagtcaggatattcagcttttatttcttatccaagttcacgaaattaatgatgattgtatccacgagagccaatgaggatcactgttgacactcttggtagtggcttacctaatataaaaccttttattctcgttgtgtttattgacagtaagtcactgagttagttcgggtcctctaagaagcagacactaagatagaatttgacatgcaagaaatgtattggggaaaatatttgtaagggacaagtgtaaaagagctggaggagatggggaattctttggacaatacacaatgctgttctgacccacatgaataaaagaagaaatgagtgtctgcagtgtagtttgtaaaaagttttggtcaagccaatggggagcccttgagccaaagccacccatcagaggcatttctgctgtgctcaagtgtggcctcagcataataatgttggcagatttgggtgcaacagttatggctgtcagtcaattacagtccctttagcaagaggtctgagtggtacattttcatggctgccatagtccaccatttcctccaaatagatttacttctccgccctggtttgggagaagttgcatctttgtttccaggggtctttcctcctacagccccagtcactgcaggggatcttgggctgcaattggtgcttacttgtttctatctacaaaatccattctaaatccctgtgctcagctatcacatcagtaaatattgattgattccctggtggtgtgattcaaactttcattcctgaggatctgaatgcttgatgaatataccctactcaggcctgggttgctgcatgttcaatgggcaagggagtaccaggaggtgctcatgtgaataatttgagttccatgtgtttctccttgtccccattgcagaacaaacaaactaataaacaaacacacccctatcttcacctgttgctcagggtcaattatttttgttagtacgttgattactattctcattatttagtccctggatataaggagccttggaagacatggtgttctggggcagttgtagcttataatttaataagacccttgctgttttactaggtaagaggatactctttttggattgcatgacccccattcctgtacagcccagtattgtagagatgagcaacacaaaattccccagtgagtaattgggagcgatgataagtagggtcactgttgtgtatgtcctttagttcttgaatccatgtatttttactattgaggacaaaataccataccaagttctctgttttaattcatataaaacataccaaagaatgacatctcatcttttcagagaattacctttgggctggtactaaatctctgcctttaaaaagttgttccagcctttgataaaaccagctgcttctggatgttaggtgtgtgatttaacctgtagattccatggtcataggctcactcttatacctctgctctgtagaacccctgctcagatgctatgctatgtgaaattcttgctatgtgaaattcttgcttttagattagaaattccataaattcttataaagtgactgattgaaacggtgtgggtaaaaatggcaaaatcaaacctagaacaggcatatatccctctaagagaaatgtactgatgacctttccagtatgggaggggccaagtggttggttgctctccccaactaataaggacatattgatgtcaagaactgtgaaggatctgacattttacctaatttgtcagtaattaatttgtctgccatcgtttcattgattttggaagaaaaaatgagactcttggataggagacaatgtgccagttaatacttaaaggaaatgcattagtcagaggatcattttttaaaaattaatattattttcaactgacaaatcataattgtattacatttatggagtaccatgtgatgttttgatacatgtatacaatgtggaatgattaaactgaactaattaacatatccatcatctcatttaagatttcttgtgttgatatatttgaaatttactctcttagctattttgaaatatacaatattttactactgagtatagatacccaactgtgcaataaatctcaaaacttatccctccagtatagcagaaacattgcaccctttgaccaacaactccccattcccttgttcaccacctgaacccccagcctctggtaaatctcgtcttctaaaagtaatcatcatttttgttctggtttccccagctccaaatcccaaagaggtttgtgaaaaggaatacatatgcagtaagctaaactaaggggcaattttagggaacacagatattttatatgacaagtaacttgcattttttccctagagggaggagtaattattttactagtgaacaaacctgccctttcctccaatgaaagacaagatctgtctttcaaggttgtttgctataaaaacacccttgaaaagatggttctgaagaaaaccagagccactgcagacatgcagacatgtgagagacacatggagaattgtttttcaacaatcaggtgcacaattggtctctgttgttgaacgagttacacattcagaaacaggaatagctttgcagaacttgataagtggacgtccatgctcatgggtccctatgtagtgtccgtctttgctattatgactattactttaatgtaccctctgtgacagatctggggttgttgatgatgacatacgctaaagtcaattagtcaagtaattttgactacttgtttttccagtccctttccatggtgtatgatttgtggtgggcattaaagttgccacaaaaatatacatactttctgcccactccatatagccagacatgtaactctgccccataactttttgtctcagtcctttccttctagttccttgaccagaagcccaggccactggctactgccaaggaatctgtttatattctctccaccagaagtggactctgtgtcacttcttcacaaaatagatgaacaggaacactgcttgcagctcagcatgttggaaagttttccatctgtaatatcttcaaggctgcacctgaatatgactgcaatgtagtacatgttcattttatgttgatatcctaagctaacccattaataaaccaaatcccagcttttttctcctccttcagctggtcatatgccaccacactgtgcagccatagtgtacttatggagatatacacagatactgtggacaatgaaattagccacagtagctactgaagattagtaggaagataaataaaagacttgggtctcagccaaatcatatcagaggttctgaaaaactaaataatttttagcggtctaattgaccacaaaatgattttagatttatatctttgtatacatatagaaattactctgcatatttcttaaacagcttataacttatatagaacttttgatatgctctaaatatattagataaatatatgtatttggattaggcaatatattataatatcaaagtttattttgagcttttattcttggaaacctattttgaagtatcttacaaactttgtgtatatcaatctgctctcctaggaaatgatttcaaattgtaggcttcaggataagcaaagaacatacttcaaaaataaaaattatcttcctaccagacaactgcttttgcaattcgtgcaatagccaccttcctggtcctcttttcttcagttcacacagacctaggcaaaattacaccatgtcagttttctgcttggaactcttcaatggcttatggatgcccttggaccatcattctcagcaaactatcgcaaggacaaaaaaccaaacaccacatgttcccactcataggtgggaattgagcaatgagaacacatggacacaggacagggaacatcacacaacggggcttgttgtggggtggggggggtggggtgaggggggagggatagcattaggagatatacctaatgctaaaagacaagttaatgggtgcagcacaccaacatgcacatgtatacatatgtaacaaacctgcacattgtgcacatgtaacctaaaacttaaagtataataaattaaaaaaaagacgtggaaaaaaaaatgtcaaaactttttactgaccttctaagccttataagttttgttccattcttagctcccaggctcatcttcctcccttctccaagtttctgtcttaactccaacaactattggtaatggcaaaaactggaaataaccaaatatacatcaacaaggaataatttgaattaattatggtatatccacacaatggagttctatggaaaacttcaccactttgtctgtatgtgtgtgtgtatatatataatatttgtatatataatatgttatatataatatatgtatatataacatgctgtatataatatatgtatatataatatgctatatataatatatgcatatattatatacttatatatactatatattatatcaagtacatatatgtgtattacatatgtatatataacatactatatatttatattatatatacgtatattatatatgtacatacaacatactatatatgtatatatcatatatgatatatgtatatatcatatatgatatatgtatatatcatatactatatgtgtatatatatcatatattatatatgtatatatcatatactatatatattctacatatactatatatgtataaattgtatattatatatacatatataacatactttgtatgtataaattgtatattatatatacataataacatactatatatgtataaattgtatattatatatacatatataatatactatatatgtataaattgtatattatatatacatataatatactatatatgtataaattgtatattatatatatataatatactatatatgtataaattgtatattatatatacatatataatatatatttaataatatatacatatttaattatatatacatatataatatacaatatatgaatatattatatatacacatataatatacaatatatgaatatattatatatacacatataatatacaatatatgaatatattatatatacacacatatggatatgcattatgtgtgtaaatattatatgtcatatatattatgggtgtgtattcaaatgcaaccacaaaataatagttacctataggagaagaggaaacagagtgcaggagcaggacagaagggacaggatatcagctagatgtcattgaatatattttgttttgtagatttggcttttcaatcatctacttgtttccatgactgtaacactaatttaaatttaaaagattcaatgctgaaaagccaaactcaaaatacaataagtctaactaaatattattggttgcataaccacacagaaaatagaaaagttattctattcctgatgacttagactctccttgaattcatttattttataataggtcaaacttctttttgctttctgctggatcctttttgcaaacatttcatgtcccgctacttggggacctccctgggtcaatgtggcttataaggagtatacatacacatgcttgcccatctcacacccatcatttatatatcaagatgcctcctgttgcatttttaattttcacacatttccagttgagaatcaggcactgactctagcaacccatgaactcccagaatctgagatcaagttttccaagtgatagggttgaagctctcttgttgttttgaggtgactaggaagcacatttcccccctttctatagagctggaaaatagcaggggtctctgacaattctctccaaaaacctgttctctcaaagtcatccaagaatcactctcccctctgcctcttatacagccttgtggtaggtggtgggctaaggtgtctgactattttagggtcatcatttagcaagtccaacacagcttctctgatctctcttttaaacatgggaagaagtatcctcttttgttctcagctttggagtttcaactgatagtaaaggtgcaggaattgcaggcctgatggttgaacagctctggacaaatttcgacagccatcacagcagactagaccacagacctttggtaaactaccagactgccagcacttgaccactcagccacctttaagaataagcatccaaaagagtacttcatgcatttgaatggtgataaagccagatgttctccttatgtaaaagaaccaatgaaaggtaatacagatttgagcagaatgacatggagactttccttattgtacgtgaaacacacatcctagagttaacagagtagagagagatggaaaatgcctgatcgtcaatttaactattgatgggaaatacataatgtctataacttaaaaaagtcaagactttatatacccttgtggtatgtatgaaaaagcacataaattaaaaatgcaaagtaaattacaacaaaatggtaaaaaattaaaaatcactctcactggggattagaaaataggagttctttgataattcagcagagtaagtaatttaatttgtagaataagcatccttctctttttaaaataatttgtatagcattttttcttttgtgaagtgatcagcatcatcttgatcttaaatttgcataatgaaataaatctaaaacaactgaaaaaaatgtaattagaatatgaatctgctctaagtgtaatcatgactgtgataagtaaatatttgatttaaaaactttagttaactatttttgaggcaaatattatgtgaagaaatagtagatgcaatggaagaataaaaaaaattaaaacagcatgaccagtgttcattacatgcaaatgtctgaacctgttggacctcaaaccctgtatacaatgcccctcaaaatgcatgtttacctcaagtgggctctttattatctttaaatgcactgttagaaactagccttattcgacacagtctagggtaaggcacaagaaagtttaactagaataggtaattgattttatgtctaaattatcagaaagtacataatgtatgtatacgctatgtatcaaaaaatacatagtgtacacatataccagagctaagaatatttgctactttgaaagtgaaatattttcttcatgttcattttttcaaagggatgtggattttagctatgtctatattataaaaaagtatgctcaggagttgaaggtaactttttgttgcggaaaaaaacaaaccctcaaaagacttcaaagggaagtctttttaaaacgaaacaaaaacatattgactcagagttgggatggtaaatattaggtatgaatgttaagtaatttaggttggatggtgtatttattcagtgagggagttgagattgtggttgacttcccaacatctgtgcattcctcacatacatgtaggtgtcatgcgacttaccaaattgtccccaaatccaacaggagatacttgagggttcccaggaaatcctgaaattcctgctcctcttgtcagttttcagaaacttaggtatatggcagccagtgcattgcattcccctggtgacattactgggcatataaccaaattggccaagttagtccaatagaatgaaattttggtgtgttgttagggcagaggtgttttctttctcttgaactagttaggaacaagaaaatatgtggctttggttggtgctggtaactatcttaaagccatgcggcttggaactgccttaaactgaagctgctaatggcagaatggtgacaccaaaagagctggtacttaatgacagagtagaacagacagattattcaaccctagactatctaatatataggccccaaatttcctttttgtttaggccattttgaactgacttctgtgtaaaatgtagctgaaattatcctaacagatctataattagggcaaaagttcggatccctgatatgtaagtgtccaagaacaggtagctaatatttattacactaaaataaatacttaaattattttttacttacttttttttgctttttctttagatacactaataaagcatttagttaagtgcctagcacaatgtaaatgtgtgtttaataaaaagtatctatacaattaaaaacagaaactataaatattcataattttaaaattaagaggagaaattttcagaacagagccacctagtgggaagaagaatgtgctatgaggacaaaaacatttgttttgatatttcagagaagttctgtggaataaaattaaagatgcaagtaataactatttttataagatataaatagtataaaatactttgctagtaacttgtcattaacatttcatcttttacagttaaatggtaaatgaaataatttaatccataattatttctatacccatatatattattagtaaaggatgagaatacccatgtttgtgtgtatgagcttcttattgccaagaaacaaaattcccctgtacaaaatttttacaatccttttcccctcttctctctacaacaagtcagcaggacacaacttactccttggcttttttacatctcagtcgtcctgcgtgtaaattacggttactaatgattcctcagatcactgatctatggaacaacactgatcaagcatcctaaaattcttggttagctgtaaattaaaagaaaatttctaatgacacatttttttcttatgaaataaatgtatttttagaaatattctgtaacatcagtgaaacaagaaaatatatctttattttgtaaatatatatagcagtattctatcaagtttgaatttctgtactataacggcttcatctgctttgggggtgcacaggttttgggatcttgagtacaagtggaatcagtgtacaaaaatgtttatgaataactcagtatattttctttcatctttgctctgtaatatcaaatatatatatttatacacacacacaaacacacacatctatatatatgactatgatgttcagagtacctgttacttgttatgtggttaatcatttttcatgtctaactgatttccttgaaatgcatatttattattacgtcctcttgaacgttagtcatgcaaactgtaatgtagtcctaattttatgtatttgtgtgtgtgtgtgtgtgtgtgtgtgtgtgtgtattttatactcattgctttccaactgatttctgaatgatggaacatgttttttttttagccaaaatattgctattggttagtttttgaaatgtggtgtgaggctttctctttcagtagtggtgggtttgtaaaaagaacttagaatttgtcttgaatgaatttcctcatgatgcagggtacccatatgtgagagggctgagaccttgccctctgatcgcagaatgatacaatgacataagttaatttctaagaagatagcatctttgatctggattgtatgctaatatgtagagaagttatcacccttatcaccttataagtcagtgaatgaataaatagtgcatatatgagaatacttcagaaaatgagttaactttcactacatataaagttacagatataacatgaagatattacatggtagaaaaatagtcacttgcttttatctttatcacagtaattaatcaaatattacctcttggttctttcaaatgttgtggacccaattgtttaattgtcatcaatatcatagacaattgaagattctcttagaaagccactttgggcccagctgtcaggagaatgagaatgtcttatttccccactctaggcatttccattaaaggataatcagattcccacaaaccctagggctatttgccatttggatggcaggaacagctgtggagtccagaaggtgtgtgtcgggttctcctactaggaaggggtttgggggactgattgagggagaggccttaggtttggaatagattagggaggtagctcaggtctgcaacatagtattcaataatacataactgttctgagggggagggtcatcatattcctcacatattgaaaatttaaatttaatagaatgttttaaaaggttgaaataatgtatgcattgcatgtagagtagattatatgtgaaaattaacatagccaccaaataaaattgtaaagggcatattgattcatactaaaatggagatagttggtaggggtttaggtaatatttacttcagaagatagacctttatttacttcatattttaagcactttctttaactcaaggagattctcactctcaaatgctggtttatctgcatctacatggtgaaatattgccatcatgtggctagtccgtctatcacacctgctttcctctgggagagattgtattttggggtatttttatatggtgcttgaatgtttgggttatgttatatgatacccattttatatgggcatgtatggtgtctgttggggtaattattttcataagatagaaaatatttaagcatattaattcaaaatacacattaaattaaattttctgttactgtcactcaattgggttttactttgtatcttctggagctcttagaaattttccttttcagtgggcaaattattcaagttgtaaatcttaaactctttggaagtgccctcttaagaacccagtttcttttttttttttttaatgtttgtgtctactctgaaagtcaccactagttaccaaaatgtccatttatttgtatacaatttggaaactatttctgatgcataccccattataaacaatagggggcgatatgatgtcatgtttttggtttctctatgaaagtatttttcatagtataagccctgtttatttttttcttgataacaatgcttccctaaaatgaaaagcacatttgttttattatgacagtactggcaataaatatcagcctccttatacatacttgggagatgtaatttcttagagaaaaaattctatgccagtttattagtatttcaatacatgtatgtatttctaaattgatataaatatccaataaacttatatttaatccagagataatagtttccaaatatacgttggcttggtttctcattaaattcagaaattttaccttttcaagtgtttttcattaatctttttcattatatattaccatgaatgcaaaaatgtagagttatacttcaattttaggttaaaatcatgaaactatgtacctggccttttaaaagtttgaaatctttagacaacaaggatacaaagtattaaaacaaaaattttttcaaagttacatgattttcttaaatcaactaagaagttctttcaatgtagggtatttggatattttatattttcaaagtttatatgggatttaaggttcagaaagaatataggataaaatagtaatttataagttaaatatttaagttcaaaattgacagtttgggatagaaaaatatatgtatttcaatgggaagcatgttttccctgtttcttcaagtagatacaagtaaactaaggataatacaactcccatgtgagattataatttctgtctccctctcaaatagaatcacagttgtcagtgcttttaaatttttgttaaaattgtatatatacacacataatgtatatatatatatgcacacgtaactattacattattgtactctctttatctcttcataaaaaataaaacattaaataatattctaaagtcaacttttaatttttttccagctcgcagttcccttatcagataaagttaatctttactatgaatttgttatatatgctaactttttaatgatttaagtaaaagtgactataatatatttttcaaacatgttttttggcattaggagccctaattttacaccaaaaaaaggaatttttaaaaatactttatatccatttttaaaaaatttcaggttggttgcctgaaattagccataatgcgagaatttacaccatgaaaattagcaaactgtacacatcttggctctttttcctttttctggagagctcgcgtatttcttagctggagcaactattggcattttggttagaaaatgtcttcttgggccgggcgctgtggctcacacctgtaatcccagcatttgggaggctgaggtgggcagatcacaaggtcaagagatggagaccatcctggccaacatggtgaaaccctgtctctacaaaaattagccaggcgtggtggcatgtgcttgcagtcccagctactcgggaggctgaggcaggagaatcgcttgaacccatgaggcagaggttgcagtgagtggagatcatgcaactgcactccagcactccagcctggcgacagagcaagactccactgaaaaaaaaaaaaaaaaaaaaaaaaggttttcctatccttgacaggatatttagcatctctgttccttgcccattaaatgacaatagcaaactcaagtcagcaagtcagtaaaaatgcccccgcaagtttctaaatgttccctgggagaatatcaccccttccaaatgacacccagtcctgcagggttgactaagcaacatgcggcagtgcagtaatgaaaactctcaggctgggtcagaacttagacactaagttgaaaactaaattgagacaaactgataaaaagatttaaattatagtctgtattgcttaacttgttggtcatatggttggtcttactgatatgatcagaatgttcaaagacagaaaacagggaaaccatttaggaagccatagtgtgttgtcttgtgaactaatggcgtttatttttcttccgataacattacatttcaagtgccttccagactccagagttctgctgtccaatattgtggccactaggcacatatgacattaaacagttgacataaggtgcaattgaggaacagaatttctaattgaattatgatgtgacgaaagtgtatatacactgaattttgaaaacttactttaaatataaagaaaatgcaaaatatctcatttattaataattatctatattaaaaagattgaaaagatactattttggatatactgggttacataaaatatatatatatatatatatatatatatatatatatatatatatatataatttttttttttttttcttttcgagacggagtctcgctctgtcgcccaggctagagtgcagtggcacaatctcagctcactgccagctccgcttccctggttcacaccattctcctgcctcagcctcccgagtagctgggactacaggtgcccgccagcacgcccagctaattttttgtatttttagtagagatggggtttcaccgtgttagccaggatgatctccttctcctgaccttgtgatctgcccgcctcggcctcccaaagtgctgggattacaggcgtgagccaacgcgcctggccaaaatatattttaattaatttattaattttacctaattcttcttgcctttttgacgtggctactaaaatatttaaaattacatatgcagctcacattatatttctactagacagtgctgctttagaaggaatcacgtatttttctttctgagccccttgcagttctggtggtgttgattccattccaactctggaggtaggcagtgatttacgcctggccaatggaaagactgtgtctttttagggaaagttatgtgactcaatttcaaccaaagccagcttggagtaggctttaagtagatattatattgtagcagcataacggattataactgaagacagagagacattgtttgtaattccatctcagccactaattagtacaaattacttaaggtctttgagccacagtcttcatctgacaaattgggatacaaaatatttgttttatttggttgttacggggattaagtcagatactgtatgcaaagcatttacgagtactcccgacactgtgttcaatatatagcagagtttaaacgtcattatgacattagcaaccatttgtttttttttttaaggcagacattgaaagtgaaattcgaacgagattgaaaatgtcctacatcctaaatctcaggtactcttctctgaaatattatacaaaagcattttaatatcagtcaaaggagcatcattttaaacaacaattttgtagggtttattattgttttaccaaattaataagctaaaacagcttgaattttctagtgtttttgaaattatttttctcctatgtaaaagttaatgtaattttagtgaaaacataaacctaaagggataagcctcttaaaatataataatgcattgttagatttttgtggacttgtcataattctgggtgttctttcctgcatacttattaagaaatctgggaagtataaataatattgacgtattgatgccatctgatcattaactgattggaatgaatgataaataggagttttattagcatgtgatattgaatttgttttgaaatttagtctcttctaatgatatgctaagttcaaatccttaataacctggttgttggcattcttagccaggcatagtggctcatgcctgtaatcctagcactttgggaggcctaggtgggaagaccactcgaggtcaggagtttgagactagcctggctgacatggcgaaactccatatctaccaaaaatacacaaattagccaggtgtggtggtgggcacctgtaattccagctactcaggaggctgaggcaggagaattgaatgaacccggaaggcggaggttgcagtgagccaagatgacatcgctgcactctagcctgggcaacagagtaagactctgtctcaaaaaacaaaacaaaacaaaataataaaaaatttttaaaaagttaaaaaaagtgactcttcttagttttccatgtgaccttcaatttagtctttatttaaccttgggaaatgaatgctagtgtataattagtaaaattagaaattaagatttgtatttaggatctaaactagaaatacattgctagccattaatatacatgtcagtgttactgaaaacagttttatataaccacccacccacccaactttgctccttttgtaaaagtgacccgtaaattcatggttcaggcaccatacgcaactgttgctgagtatctgagtcaagtaaaaaacatttatctttttgattacatgccttctgttatatgtaaatttttacaaggtttcattttttttttggcaagtcataatttgttttatataatctaagtttcaatgaaatctccatccctcaatgatcttaacaaatttccatttttaaaggttacctctagatttttaaaatctgtgttttaaattacaacggtaacagacaaaatatttaatgactgtgtttacacttttacttctgtcctctgatctacttatgatactgaaagattatgcagaatgtttgatattatctacattccatgttgacaaaatacaagggtgcaacagagtcgattactgggaagaaatttttaaaaattatttaataagttagctggaataagataagctttcttattatgatagaattttttcaaatttttaaaacatgattttaaaaatgaactgcttgtaatgtaccagttatattcaactcagacacaaacaaccgaacatgtacagatagctcagtgctcttgacaccaacaaaaacattgcctaatgcaagaaagaaagacaggtccttctaattgtataacagtggaaggatacttgcataattacagggctacagtaacagctgtgtacaacgtccactatcctgcactgcaggcggtaatttacccatgtacttcccattcatatgaatggaaaacagtcgggggtgcctcttttgaatcctatgtgtatagcagacattttaagcaactatcattgaaaatttcttgttttaatattgcataaaaatatggctttttaaaaatactggactttcctacccaacagagcttttaagtgctatgcttaaagtatttgtcactttgcttttcatctgaaattattactttattattttcatattctaaggcacatgtgaagggtaacagcaacaaaatcttcttggttgagatgtaggtctaatgaaaatatttgattaaaccttgtcttcccgttaacatttctaaatgtagtaagtacagtagcattaaaaaagctagatgtcaaatacacttttagatcagttgcatattgtaaaattgacttcagtagtcattttacttgaaaatattttcaaaatgtttttagtatctatttacttacatagaagtttctgcctttctaatctcaacctgagaagagatttgaggactaggaaataaacaaaatggcttctgcacaactgaagcttctggcttaaatcttcacagcaaaaaaccatacattgtcttcaggagagatccttagcttttggtcagaagccactttctcttacttagcacacaattattattaacaaataaacaaagtaagagatttatttcttaacatggaggcaattagaaacagcaaaggagtgaagactggataggaaaaaaggtttatttttgtctcccaccaactcaactcacatttcaactgccttctacaggtgacccaagtctccagcactgggatcaatcacctcatcatctggtatccagaacacttataaaaaacaaatttacatcatgttcagttttggtgctgggatatttaaaaattgctatgaatgttggtcaagtgtaggagcaaaggcttggaactcctcacctgtgctggttactacctcattaagttgctggattctgggggaattccagagcatcccagcaccttggctgctggggtaacagggaagcactcagagaacaaaggcagtagttatttgccagcaatatggaaatacgtggtatttcaacaaccaataagtaagtatgggtgaagatctatttcttaatcattttaacatccccaactgacagaagaccagacaagttgttggaaactgaataagtagtctttggaacattagattacaaagagcatttaccaagaatctgttcttgcagtgaaacagagatgctaaagaaatgaagaaagctgataaaagtaaaattcattatgttaagagatgtggagtcctgtaatgaattaaattaaaaaggggcattttggtttcagattttattttttttctctttggaaaaagctcatgttttcttttagtcaacctttcatttacctctcgtctacttgccagttggtgtcctatttggtgaaagagatacatgaaagtttgtggaagaaactaagatttgagtgagaaaacacttccaattatgacaaagtccatagaataccaaagattgttttcttactttaatttataatttataatcaatacagaaagtaatctccaaaaacaatcatgtgtcacttaatgacaaggatacattctgtgaaatgtgtccttaggtgacttcatccttgtgcaaaaatcatacagggtacccacataaaccaagatggtatagcctactacacacttaagctatagtatagcttattgcgtctaggctaaaaacctgtatagcatgttactgtgccgaatactgtagatgactataatacaatggtaagtatttgtgtctacacatatctaaagatagaaaaggtacagtaaaaatatagtactttaatcttattggcccactgtctcatatgtggttgtttatatataactggccacatgtaatatgcaatagggattatttcgcatacattttcaagaagctgtatcataccatgaggcatgttttagactacttagaattgagggtgagataaatatactgaatgtttatatttaattgtaatcatggtaggtaagttgccttttatgtacattacattaagttaatgaagctggtgagcagtacttgaacaaatcatcagattcactccaatttcttataaaatgtagagcccattaatgtagatttctattttgttttccttaaataaagagcaaacaaagcttacttctactatcagcccaatttgtttctccatcatgtacacggtcgtcttgaagtctcaaactatagtaaacatgcaatttggcattttattattttcatatctaatccaatttggtgtgcatgtggattgactttatgcagtaaacagaatagcataaatacaattcaatcaaatgtatgtaagctaaacacaaaaaagtcaaaataaaataaatatgctatttcataatggtagtagctattctataactatgaaaaactagtgttttatattgaatgtctttaagtaactactcagaaacatatattctgggctcggcacggtggctcacacctgtaatctcaacactttgggaggccaaggcaggtggatcacgtgagatcaggtgttcgagaccagcctggccaatgtggtgaaacctcatctctactgaaaatacagaaaaaaatagctgtgtgtggtggcaaatgcatgtaataacagctacttgggaggttgaagcaggggaatcagtttactccctgggaggtggaggttacaatgagccgagattgcgccactgctctccaacctgggtgacaaagtgagacttcatctcaaaaaaaaaagaaaagaaaaagaaagaaagaaaagaaacatatattctggccattatattttcccacgttaaataggctatgaataagaccaacatttccagtattatattaagacatttatttgtagagaggggcaaaatggacagaaaaactaaaagacataacctgggtctagaatttgttgttattaactattaaagaattcccatagttggtttagagtaccctttattttttaacattcttttctctttctcttcctttctgtactttgtgatttgagtcaaaaggtgaaaacaagtacattatggtgtgtattttaatcattgcactatgcattgcatgcttttttgtaagaggccaggggctgagcagcccatttatgtccaagtcatgggagtgtgggaattaggattcctgtgtgtctctgtgtctatgtgtttgtgaagaaatataattagaatagaaatagaataatattgccggacatcttctgtttctatatctgtaaaattaaaataataacttaaaagttttattaagaaagagagaataagtataaaagaaatctggcacttggaattttagctattattattaaagactttttaaatagtatttgaatcaaaatgtacacatatctctcattcccagtctaccgacctacttgctctttcgaaaatgaccattgattttttgaactctggaagctatagctgtacctggtcaagaaaatctcttggattggcaggctattgagttagctgccagaaaacagccgtaagagggtcaattctgattagaactgacatctaagactttttaaaatgagttctttcccagcttgctcatgtactccactttattgtttatagaattgcaaaccctgttacttaaaatagcaaagacactacatttactttctgctgacaattaatgcaattaagaataattaaaagttcaggcactactaatttcctcagaaagtgtcttggaaactaatacagctaagaggatttaaaatgatgctaattccacatggtctggggactggtgccccatccttaaattgtttctcttccagaataagtacagaagttgagagtgccgtgaaatgaaagttcatggtgcaaatattttacaaaattattgccctggtggggactgggagtgagaattcttggttcttgactacagtaattcccaaagcactgatttaagggaaatctctgtgcataagcaggtaacaattgatgtggtctgacctcttaagacatgttgccaccagatctgtccccaagcacctgttatgaaatctgattttataattagaattttatttcttagggttgtaggcttgaaaatagtgtttcagatccttttatgatagtgcaaatatttctgtaaagagaggtaggagctatcatttactgaacgactattatctgagttgcttgtgcatttattactattattttgcataatgctggcctaatgccctaaaagagtttagttaccatggaggccaatttggaagtgtgttgagcaatgttagcaaagaatagaaagatcctgaatgtgtgtgtgtgtttgatgggggtggggtattagagaattccaaatcaaaattaaagtagcttcccgatttgccctgtatgctatttgccactttgagttcacatggtatatcacatctttgggtatattcttgctaatccacaagcccagtggaaaaggcaagaaaggggatgaagtgtgtatctaaatccagtgcatatgcaggacagttgaaccttcttccccactgatctttaccagtcattcattctgtgaagctttgtatcctcctttattctgtgacattcttatttcctccatgttttagggtgtgaactctatgtggaaatgtactgagctatcagaatagcaaaaggagtcatgtattctgaagtggctattttagttcaaatgttacatatttcctattttctcttgagaattgttttgctgtttcaggcagaatttcaaaatgaatagacaaaacaaacaaagcttcaagattctctaagcaaggatttctcctaataggattttaaaatattttacagttttttctcatctattttatacacttagactttctagctaggtcaaattattcttttacattttattgccattgacttacaattataatattcactattatgttggctttgccaggaatattttagtaatttaatattgaacgttaatagaatctctggtacaaatatcaaggcgtctgaccttaaggatgagaattaaagttacctggttggaagtattgacatctatgctctgtgagggtcttatgtacactgtattactgaggtgttcagtagctagcttagactgagtggcatattctccctacaataactgaatgttctgctccttctcctttaattgacaaataattacacttaattcacacatttattagtacactgaaggtttgctttggaagaaatatatgttataacgatactaaatcactgaattgaataaggagtaacagctttttaaaaacagctttcccactttgggaggctgaggtgggcagcttgcctgagctcaggagttcgagaccagcctgggaaacacggtgaaaccttgtctctactaaaatacaaaaaattagctgggcttggcggcatgagcctatagttccagctgctggggatgctgaggcaggagaattgcttgaaccctggaggtggaagttgcagtgagccaagatcgggccactgcactccactctagcccaggcgacagagcgagactctgtcttaaaaagcaaaaacaaaaaaacatgcaaacaaaaaaacagctttcttacaaaagtaatttggattcggtacttacatttgtgctcgtgcattttgcgctcattccagtgtagaaatagagataagtgctctttgtgatatagcctttcggtcatagacataaggactgaagccataaacaacttataaactagagaaatgaaaactatatgcactaagttgaaattgagttttctctaattaaaatgttaataagatttaatggcttagagtcccctaagacctaaaggagcccataattaaaataaagtgattttaaagaaattatgataaatattaaaatatccaaaattgttttgctgtaaattcttaaacttaggccgtatttcctttactgctctttgcttttcttttctctaagtatttttttcttttttagatatatgtgtataagattgttgactctttactatgccgatactaggttaaactaaaataatacacattctcatttaattctcacaatagtcctctgtggtaacagcttttcttctcatgttactggataaagaatttcaagcatgatattctgatttacctacacaaataaggaaaaaaaattccaactttcatatttaaatttattatttacttattacctatctgacactacattcagcatcagataagtgaatgtcttgtgtgtggttagttgtagtgagcacagagcccacccatattcccagcttccctgtggttaggtgtggccagatgactgtcctggatgagggaatgtgagaggattaatgatgtgtctgttctgagtggtggcttttaacaatggatgtgcctacttcgtgttcttttccacttttgccaaaagagtgaagattacaacaaggcctttcaagatactggagccacaggatagagggagactttttttttgcctaattcacccatggagaaaatctgccagtggttcaggaactccggcaggggatgactacatgatttaggagtacacgtctattgcaatttagctattgcttaattttagatttatttgtgaaagcacctaatactatattaatgcaagcttgtttttatgttttccttgttttctttccccaaattgcataatgtattctataagagacacctgattcttttcctgctgatgtaaattagaagctatagttttctatttgctattacagtaaatgttgatcttattatcttccatccaataaactttctgcaatttctggcacatgcctgttatactgattatgaaataaaagtaattggtggttatcactatgttaaaaaaaagagagatgaaaagcttcgtgaaaagggtgttgatggccttttcagtactcaccattaaaaatgcaaaataaagattcagaccaagaaatatatattataaaattactgtatgtatatgttattagtctactacttggtcatttagagaaaatgtggctattttcaagaattccatggatgtgaaacggacactgcttatgagtgggggaaaactgtgggttaattccttaagtgagactagttgtataaccttgaccaagtcactcatttcagtggaacttggcctcacctcatattcataacaacaatttctaatatttacagagtcttttctctgtatcaaaaaatggcctaggttttttccacatattaattcatttaatccccacaatattatgggacagtactattttgccccattttatagaacaataagttaaagtatcttgactaaagtcattcagctaactggtagcaaagttaagcttgaactgccagtctggctccggagtaagtactattaaccagtttcctaatgattctcaaactacagagtgcaccagaatcacctggagagcttgttaaaatacaaattggtgtgtctcaaacccagagtttctgatgcactaggtcgggggtggtgcctgagaatttgcatttctaaccagtttccgagtgttgctgatgccactggttcagggaccacctggtgagaagcactatggtatactatactgcctttcttctccaggattttgattatgtataatttcttttacatgtgtgttcattcaaattaattaaattacattttaagaaactgttttaagtactcagcttttatatttcaaaaatacagcataaggtctatcaaaatgaattcttcttgcctttttctttagattatttaagcacgttaaatgaataataaatgaaagaattgtcttatttgagctaaaaggtacgatatcaatgaaaatcattttcttagctatttgattaccattatttaattgatactagcactttcacattttatgttcctccttagaaacgctttaattcccagtttatatgctaatttatgtggtcaaattttaatccttgctatgtttttccattttcaaaagtttccttgaagtcacttttccccccatagcacattttccacaattacctgataagttctatttatagtctctaaatttttaaacattgtgtttaatcttccttgtatatcctttataaaatcaaagatatatattttggacagtttgaaagaagatagaaaatggagataaaaaacaacattagaatagtataagaaaattatgaaaatataaattaatgaaagaacctaaaaaaagaaaaaagcaaaaatacaaatgtatatatttaagtaattctgaattatgtataatttttatttatataaaatatatatttgtgtatatatataaaatgactgcctagatatgcagtgatttagtatacaatgtgttttcatgtattcaggagctgtcatataaatagtagaacataagagtatttttcatagattccgctgtaaatttagtttatgtttaagtgagaaactttgatccagatagcctcaaaatataagtaaaatacataactttcaatcaaaatgtatgaaatggaaacaataaagagcatgttggttttgctgatgttaagggtttttgtctgtcttgagatttgagtaggaatatctccctcaggatcatttgccttctaaagcatctaggggtttggaatcatgaccagggagagagattccgaaatgcgagaagatactgtaagaaaaaaaaaaaaaaggaaagaagcaaaaagtaaaataagtgaagggaacatgtcctaattaaaaacacttttctatcttttagaagccccaaaatgcacacagatgaaagcagcactgcttgttttattagttgcctaaccaatcaataccatcctggaagcaacaactgtataaacacaaagcctccagcaaatgctttgtagagccacctgcactctgatctaaaatgaaccggagtgacatttcaaacattctcatgagaagttttctactttctcaggatacaacattccacattgtccataagactattggaatatgttcagcagcattttcattccagtatgcacagtacaatgttttcaaatcgtagaagatgtgtttgtccttgatgttgagcacataaagctgatattttgctgttactatttcaaaaagattattaaagtagttacaacatgttcctgttaagtactattgcatgtattcctgattcatatttttttatttgtttttctttccatgttagagctgcaactaaccgagttgtgttttctttaaaaatttatcttcttttgtaccaccagggttatgtaaaataggtctttgtataaacctaaaccaaaatgtacttaaaatatttagttaaatttgtaaatatgatttttcctttacaataaaacaaagacattatttattcattactgcaaaatagcttagtctggaaattttagttagcattgatttataagtagtttttaaaataaaaataggtaaccataaatgtcagtttatgctaaatattgtggtaaaattttgttcatttacttagttgatatttatcacaacaatgtgtgtggtaaatactctcaatatttcatgagaaaagtagaagttagaaaaactaagcgacttttcctaaacaaccagtaggtgtttaagcataaacttgaacacaattctaactccaaagcttaagtccaaagaggaattcttttacctcattgctattctcaatagcaacacactgaaaattgagttgattacctatttactgcgttttggcccttttgtgtataagaattatgtggtaatttgtagaaataaaaagttcacagtcattaatgaaaataaaatccacaagagaattctatggtgataattgcatatgtttaaatttttcctgggaaggcaagttgaggggatggcagaggaaatatggggatggttaatgggtataaaaaaaaaatagaaagaatgaataacacataccattgtgatactatttgatcacacaaccaaatgactatagtcaatgtttagttgtacatttaaaaataactgaaaaaagttaagatgataaatattatgttatgtatatctaccattaaaaataaaaataacaacaatctacatttttcatccttatgcatagactttcatatgaggcgtctaagattttgtcgaatataaaagaaaataagcctatcagcttaacaatacattttagttgtaattttaatactattaactataattttacttgtatattagttaagtagttatatattaataaaaataggttatttatctgtacttcctggatgccagatattaattcattgattactaatacattagtaatcaattcattaactcattgacattaatcaatttataggtttaggaaacatgataaacatgatggatgtagaactttcttgcagagtttatactctagcaaaggatatatacatgaaagaaacaaattatagaaataattatttaactataattttgataaacgtcagcaagcggaagtgcagggtgcttagagaacactgaacctcacacatgcttttgggtggaggtgagatttggaaaactttcctaagggaataatagtaagctaatatatgaatgataaggagaagttagttggtaaagtgtgaagaataatggagatcagaaaaaattattttattctaattctcttcagaagcatgtacatttattgttagcatcgttgaaggaccagatttttagggagagacacgaagcatataaaattttggaaaggagactctttaataaaaagagtgcagtttgtacttggttcaagatggctggctaaagacaaggatgctagttctcctcaaaagtagtcaaaatgacagataattattaactcaaatagaatattaaagagaaaatactagaactccacagagaaatcatgggaaaaaactgcagcacagaataaaagaggaggcaagagagcaactctactggcaaagatcacctaggagcctcaagggagttggtattgcacggaaagggtaagtgggagtattttggttgccctcatctctactgcagactgctggtacccaaactgtgggggagcctctctgcccttgcattcctggactctagtgtgagtggtgacttggggatttcttgagggtattacacctgactgtggacccttgccaggttgctcaccctcctttcagactcgagcagctgcagcagggcatcattttgggggcatgagaattgagagactatgtcctacccagggaacctcagatattgtgtctccatatccaaaaagatctcacgaacatttcttactgtctgttctgaggcaagcattggcacagtgctggttggagccaaggaagctgcagggttcccagtattgtagccttctgggactgctactcctactggaagggaaagtgcagagcaccaagaaggtagcccatggaacaaaagacgccaaagggcacactttccagtgcattagagctccctgcttggggttgtgaggggacagattagcttccagcaggggcacaatatctgcgcttagctctgcaagagaggcgtgaaattatatcttattgaccaaaggacctctgtgctagatcccaagcatagagacagggacttttcttcccactccacccactgatgcagacacagccagttactgctcgcatgggaaactggcacaggtgagccacagtacagcctgtctgaggctgtgagggacaactgtcttcccactgtcagtgtagcctcccatggagtttgtgtgaaaagcaagcctgccaccccgctatccctgccccccacccctctctgcatagagctgcagtgtttcggcagtagaatgccacagagctatgtgttttgcgggggctgcggaggaggatcccccactgcagacacaaagagatagcatggaagcttgttgttgagctgcccagctggctggctgctacagctcttggctacattgtagtctgaaaataaatagcagttgtgaataaactgaataacctgagtgccacacagggcatgacagggaaagagatcacattccacctgctgagacaggggttatgaaacagcccttcccctcaatatagagacctctgtgcatttcaccagggccctgatgactcctctgccaccccattaatgctgaccattataaggagggcctggagtatgggcttgtcctgtccagctcagcccagctttgtctcccacctccatttgatcatggagcccagactgctacatattccatagcccagaccatttcttgaggcactgaagagcttagctcctggtaaacaaagatcaagcataaacctactgataccaccacagccggctcttatctgcaagtgctgcctccgggcctggaggtggaactgcacttcccaaggcaaaatttactgtcacaaggacacagcacttgggaatgagacctctgccaccccagctacacagggggccatgagcctgttcaacacacccagtataccactactactggtgtttgagaaaattaccacactaaagctatctataaccaaggaattaatatagtcttcactaatgaaagcacccagaagcaaagccaaacaattctactcaacatatattatagtgacatcctaaataatttaaaaagtcccatctaaatgaaagcagattcaaaaataagaagtgacagttcctctagttgagaaggaatcagcataacaattctggaagtatggaaaaatagagttctaagacacctccaaaggatcacactaactctccagctatgaatcctaaaatttgtgaaatgccagaaatcaaaacattgatttaaataaagctcaataagctccaagacaaatttgcaaaccaaagaaataacatagaaataagaaaatcaacttaggatataaattataaatttaccaaagagatcaatttaaaaacaaatagagcttctggaaataaaaaaatgtattgaaggaattataaaatccagttgaaagcttcagcaatagactagacaaagcagaagaaaaaagtctcagaacttgaagacaggtcttttgaattaattcagtcagaaaaaaaaaagaaaaagaactaaaagaataaacaaagccttcaagaagtatggaattacctaaaacaactgaacctacaaatcatagatattctgaaggagaacaagcaaaaagtttgaaaaacctgcttgagaaaataattgagggaaacttccctaatctagcaaggtatttagatatccatatacaagaggttcaacaagcaccaggataatcattgcaagaaggcctttaccacaacatagagttatcacactgtctaaggtgaacatgaaagaaaaaattctaaaatcatcaagagaaaggtgtgtagaaacctgtaaaaaaaacttcatcagactaacagtggacttctcagcagaaaccttccagggcagaggagattaggattctatttccaaagtgcttagagcacaaaatcaatcacaaattgtatgtcctgctggaataagcttcataaatagaggagaaataaagttttttccagacaagcaaaccctgagggaattctttaccattaaaccagccctacaaaaaattctcaaaggagttctaaacatggaaacaaaaggttggtactagccatcataaaaacacatgaaaacataaaacttgcaggtcttaaaaaacaattacacaagtgggggaaaaaaaagaaatcaaatggcaacatgacagaacttcaccaaaccacaaagacaaacagactgaggggaaaaaaaagaaaaaagaaaataaattcgctgagcaactagataacaattaacgttatgaggggaacaaaaccttatatatcaatattaaccttgaacataaattgattaaaacttcaattaaaatatacagattgacaaaataaatttaaaaaaatatgaaccaactgtttcctacttatgagaaactcactttaccggtaaagacacatgtagattgaaggtaaagggctgataaatgatattccacacacaaaaacagaaatcaatagccatcatgaatagctatgcttatgtcaggtaaaacaggccttgactcaacaataatataaaacagcaatgaagattattgtataacaataatgggatcaattcagcaagaataacaatcctaaatgtatatgctccaaacagcaaataaaccagattcacaaaataagtattactatacctaaaaacagagatagacagtaatacaataataatggaggatgtcaacactccactgacagcactggacagataattgagcagaaaatcaacaaagaaacactggaattaaattggactctagaacaaatggacttaccatagatttacagaaaattctaccaacaactgcagaatttacattttcttcatcactgcatggaacattttcaaaatagaccacgttaggccccaaaataattatggtaattaaaaaaaataaattgtaccgagtatcttctaagaccacaaggaataagactagaaatcacttccaggaggaattcttaaaactatacagatatatggaaattgaaaaattaacttttttttttgagacagagtctttctctgtcacccagggtggagtgcactggcacgaccccggctcactgcaacctccgcctcccaggttcaaggattcttctgattcaatctcccgagtcgctgggattacaggtgcccaccaccacacctggcaaatttttgtatttttagtagagacggggtttcaccatgttggccaggctggtcttgaactcctgatttcaagtgatccacccgcctcagcctcccaaagtgccgggattacaggcatgagccaccgcacccagactttaagaagaaactcctgaatgatcactgagtcaatgatgaaattaagacagaaattttaaaaaattttaaaataaatgaatatgtaaatgcagcatgccaaatcccttgatctacaataaaagtagtgctcaatggtacgcttatagcattagaatgtttgtatcaaaagaatagaaagatcacaaattaatctcatcatttacctccaggtactaaaaaaaaaaacaccaaaaaacaaaaaaacaaacaaccaacaacaaccagaaaaaaaaaaaccaacccaaagctagcagaagaaaagaaataacaaaatcaatcagagcagaactaaatgaaattgagaacctaagaatacaaagaatcaacaaaatgaaaagttgtcccttgaaaagatgagcaaaattgatagactgctggctacagtaaacaagaaaaaagaaagaagatacaaaaaaaagaaagaagacacaaaaaaaagagatactactatgaacaaccaaatgcccctaatctagaaaatctataagaaatggattaattcctagaaacatacaaccccccacatttgaactagaaacaatttaaatcttgaagagtaatagcaactagtgagattacatcacagagataaaatatatctcccaaaacaacaacaaaaatatcccaggaccagatggattctaccaaatctgcaaagaagaactggtaccattcctcccacaacttttctaaaaaaatccaggtgaagggaatcctccctaattatttctacaaagccagtcaccccaataccaaagccaggcattgacataacaaaaaaaaaaaaaaaagagagagagagaaaaacaactataaaccaatacctctgataaactaagctgcaaaaatcctcaacaaaatactagaaaaccaaatccaatactacattaaaggataattcacctaaatcaagtgggcttcattctagggatgcaaagatggttcaacatatataaatcaatccatgtaattccacataaatacaattaaaaacaaaaaccatatgatcatcttaattaatgaagaaaaaacatttgataaaatttagtatcctgtcatgataaaaacattcaacaaactaggtataaaaggaaaatatctcaaaataataagagccgtctgtgacaaacccacagcaaacatcatactgaatgggcaaaagctgggtgcattccccttaaaaactggatcaagacaaagaaatggaagaaacttccaggctggcagatcagaactgatattattaagatcaccatactagcacaaacaatctacagtttcaatgtaattcctatcaaaataccaacattatttttcacagaatttgacaaataatcctaaaattcacatggaaccaaaaaagagcccaaatagccaaagcattcctaagcagaaagaacaatggtggaggcatcacattatctgacctcaaagtatactaccaggtaatagtaacccaaatagcatagtactgtataaaaatagacacatagatcaatggaacagaacccagaagtaaaggcatacacctaccaccaactaaaatttgacaacattgacaaaaatactgggaaaaggacagccttttcaataaatgttgctgggaaaattgaattgccatatgcagaagagtgaaactggatccctatctcaccctatgtacaaaaattaactccagaaggattacagacttaaatgtaagacatgaaactataaaaatacaggaagaaaacatcagaaaactttcctggacatttgcctaggcaaagaatttatgataaagactccaaaagcaaatgcagcaaaaacgaaaatagaaaaatggcatttgattaaactgaaaagcttctgcacagcaaaagaaataattaacaagtgaatagacaacatgcagaatggaagaaaatatttaaatactatgcatctgacaaaggattaatatccagaatctataaggagctcaaataactcaacatgaaaaaacaacccaaaagaaattattatatcaaaaatataattctacctgcatgtttatcacatcactgttcacaacagcaacaatatgaaatcaacttaaatcttcatcaatagatacctggaaaaagcaaatttggcatatatatatatacaattgaatgctactcagccataaaaattaatgaaatcctgtgttttgcaacaacatggatgaaactggaggccattatcttaagtgaaacggctcagaaacagaaagtcaaatagcacatgttgccacttataagtaagaggtaaataaggtacacgaacggaaatagagtgtggaacaacagacactggagatttggaaggatgagaggagatcaggagggggtgagaaatagtatgtaccatgcacattattcagatgatgactaccctaaaatctcagactttaccattatgcaatatatccatgtaacaaaactgcacttgtaccccttaaatctacacaaatttttaaaaaagaaaaaaagtaaaaaaaaagtcttacttttagttttcaaaacctgaaggccttatgaacatactgcaaaacttaagcttcataacctttttggtaagtttgcttcaggtgatcctgtttgtttcatgggtgaggaaacttaagacagtgcaaatgatgaaatcaatattcaaatataggtctttctgattgcaaaatcaatgtttccaacaactctgttataccttgtcaaggcagttcattagcaaaatcagaaatcatgtaacaagcttaggcttggcactggttaatcacgccttatttattcctatgttcaccttaacacaattcaaacaactgaaatatgtgtgttaaactcaatggctttttaaaaatatatgctataagatacaacaaaggtcaccaaagagttaatgagaagcagaaaaaatggagcttagagtgaagggatccgtgaagcaaggggttgtggattcaaggagggtctagggaaaggaattctgctggatgaacatggcctagggcagcagaaattcttcaaattcacagaaaccaagaaacaccttcctgcgttttttaacaacactggtaagtggatcaaacaaaaatagctaggaaattttgctatccatctttttttgagaaactcgtgatgaacaggaagacaggtcatgagcctgtgttattatactccccgttattaattcgccctgaaaagactaaatagtaattacccccacacatttatatgtatacttagtgatatactccatttgcaaaaaggaacttcaagaaattcccgtatacatgaaaatacaatgtacttttcacttctttcatgtagtccctaattttccttacctgtctgcccatggctgaaatttctttaactggtgtcaagtgttttattcaactaagagacatgtcttaaaatgtaaatgctagaatgctagctcttaaaaatattttaagtgaaactcatttaccctaatcaaaagtaatcattcctttctagattaaattgatccagaaagctcctgcaagaaaaaggaccaaagttggctgatcctgaagcttgagacaagatagggcctcaaaagatgagtgtaatgtaaacatatcttgcattccacaactcacaactgtagttggagttttcatgttaacttacacatgtgtgtatacaaataatctgtacagaaagatattattgacaagcttgaaaatagatgtgcattgttaggttgaaatgcttttgagtctcactcatgaatatagctagtctgcttcaagtttacttatggagttcttccattctgcccacccgctaccgtttttaaagcagtcaaccgtgtttagaggaacatttattcccaaaggatatatttgaaaaataacaatctttggattcaggataactaacaaattcaatatagaataaataaataatgaacccacacttagacgagtgctagtaaatttacagaatgtcaaggaaataagattatcaaaaataccagacaaaaaaagaaaaatcaccttccccaaatcagttgcaatgaagaatgatttaccaataacaacactggaagctagaagacagaggaataatatcttcaagaagatgagagaaaataactttaagcctagatttccagcaaaagtatctttcaagaatatgaacaaaatcaagatatttttagaaaaataagaactgaatttactaccaatagagtctgtctttaaaaatattaaaagacatttctagaaagaagagactgagtttagatgcaaaaaaaaaaaaaagaagtagtgagcaaagataactaatactgactgagaaaatcataataatgactttttaaatatagtgtgtatttataatacatagttaaaattctgattctatcaaattgttcactcccactgggactttcagtccattcaccctgacactttcctatttccctcttcttcttacttccacagattaagcattatatacacccccactatatacacaagactctatacccccgtgtatatacccttctctattttgcctttactgactttgcttttcatggcagagccagcatatagtcttgcttaccaccgatccatatctgcatctctataggtgaattgcaggagtaagacaaactaccatgctgcttaattttgctttcaaattaatgacaccaaaatttaagtgatacttcaatattgcctggcaataacactctatttctacagactattctttctaccactgtcttagctgaccattgcttacttttctctctcttcatacctttatcacctcctgcatagcctctttctctgttgttgacattgcattctatttcactgggaaagccaatgtattttaaagaattcttttacatgcctctgttattcttaaactgcctttcacttattaccatccataactatccacgttcctacctaaaaccactctcttctcttctgtgtatgatcttttctcacctccaccaaaacatctatgtcttcaaccagttttttttctctttctcctatatagttaatttttttcctttttaactgtattgtcccaatgacaaagaaacatcctatttcctccacaaataaaacaaaaacaaaatcagaacaaacaacaaaaccaaagcttgcttccatttccctatgagctaccacttaatttatttgcttccattcacaaccagtttctttaaagagctttctatatttatgtctccagttattgtttatattttcttgattttaaaaaggaaaagtggacatatcataagtgtatagcttgaggattttttacaaattgaacacacgcatgaaaatagtactcagaacataacattaccagcatcccaaagatctctcttttatctggttccaagaacgactgcctcacattgtcaatttttctgggtcctaacaccatagattgctggtgtgtgtttgttttatttgttgttgttttgtttttgttttttttttacataaaaggagtcatatagtatgtactccatttgtatgcattccttgaatcaacattatcttactgagttacacattttattttataaaatagtgtatccatttccttttaaacacactctttgtcaggctttttttcccatccctccacgagtactactattatcaagtcaaaataatcccacattgctcaactcactgacccaatatgatcctactggacctacttgatctcgtttatttacttttttaatacacaatctttaatttgccatcagagcacttccatcttgtagttttctatttttctcatttagtcttttctgtctcttttgctagttccttttcttctgtccaactgcctcttcaagttaaggtgttccagttttttgccatttttttttttctaataaaaaaattttgagaaactttttagtgggttttatggttctaagtaacattgcaatgattatcactccaatatttatatctcaggcccagatttcttttttgaaatccagatttgtatatgcaattatgtattcaacagcttttcttgaatttatgtcttctcaacagacataaattcaacagctgcaaaatgaagttcctaattgtactcctcaaaacctgcttcacttaaagcatattccatctcagttgacatcaacttcattcttctaagtgctcaaagtcaaatacttgaaattatccttgaattctcgttttccctcacactgcatccaatttatcagcaaattcactttctcttgaaagcatattcagaatcagacctctgatgtaggagccagcatcattcagtgcttacattactgccacagcctcctttctcatcaccatcattccatccttcatctatcctcccatctattttcaaaagagccatcattgtaaaatgtgtatttttaaagaataattttactttagattcaggggacacatgtgcaggtttgtcacatggcatgggtgtattgtgtgaggctgaggtttggggtgtgaatgaataccccaagatagtgagcatattacccaataggtagttttcaggatttggccacctccctctctccttttggagttaccagtgtctattgttcccctctttacaatcatatgtattcaattcttagctctcacttataagtgagatcatgcagtatttggttttctgttcctgtgatgttttgcttaggaatatggccgtcacacacatgcatgtttctgcaaaaggacgtaattttgttctcttttatggctgtgcagtactccatggtgtctatgtaccacatttttttaaatctgccattgatggtcacctaggttgattctatatctttgatatcgtgaatagtgctgtaatgaacacactagtgcatgtgtctttttggtattacaattttttttttttggacatatacccagtaacgggatttctgaatcaaatggtagtttaactctcagttctttgatgaatatccagactgctttccacagttgctgaaataatttacattcccatcaaaagtgtgcaagtgttcatttttcgccccagtctcaccagcatctgttatttttttacttcttaataatggccattctgactggtgctagagaatatctcattgtggttttgatttgtatttctctgataactagtgatactggtcattttttcattttttttggtccacttgtgtgtcttcttttgactttgttaggaagtgtcttttgcccactttttaatggggttatgtgttttttgtttgttgaattaagtttcttatagattctgaatattatacctttgttagacacatagtttgtgaatattttctcctagtctgttggttgcctgtttactctattgatagtttcttttgctgtgcggaagctctttaggccccacttgtcaaattttggttttgttgtaggcttagtcataaactccttcctaaggtcaatgtccagagaggggttccgaggttttcttctaggattcatataacttgatgtcttacatttaaatccttaatccattttgagttaatttctgtgtatagtgaaaggtagggatccaatttcactcttctgcatatgactagccagctttctcagcaccatttattgaatgtggaatcctttccccattgcttatttttgttgactctgtcaaagatcaggtggctgcaggtgtgctgctttatttctgggttctctattctgttccattgctctgtgtgtctggtttttttttttttttttcagcactaccatgctgttttggttattgaagcctgatagcattgtttgaagttgggtaatgtgacacctatggctttgttctttttgtttaggactgcgttggcatttgtgctttcttttgtttctgtatgtattttaaaatagccttttctaattctgtgaaaaaatgacattggtagtttgataggaatagcaatgaatctgtaaattgttttggacagtatggtcattttcatgatatgaattcaaccaatccatgagcatcagatatttttccattaatttgtgacatctgtgatttctttcagcattgttttctaattctccttgtagagattcttcacctccttagtattcttaggtaccttttttttttttttttggtatgtgtggctattgtaaatcgggttttgcacttgagttggccctcagcctggacattgttggtgtatagaaatgttactgatttggggacattgattttgtataccaaaactttactaaagttgtttcacagtttcaggagccttttgctagcatcattaaggttttttaggtatagaattatatcattagcaaagataaataatttcacctattatttttctacttggatgcactttatttctttctttagcctgattgctctagaatagttaagtcatcttgtcaaattgagcactttatcattatgtaatgtctttctttgttcttttttattgttgttggtttacagtttgttttatctgatataaaatactgatctctgctcttttttgccttccatttgtgtggtagatctttctcaaatgtattcttttgagcctgtggatgtcattatgtgtgagatgggtctcttgaagacagtagatagatggatcttgtttactcattcaaacttgccactcagttcttttgaaatggaccctttggaccatttggattcacggttaatgttgatatgtgagatctttattctatcatgaaattgttagctgactgctttgtagtttctattgtgtggttgttttatacttttggtgagctatgtatttaagtgggttttataatagcaggtatcattcttttgtttccatgttggatttccttaaggatctctggtaaggctagtctaatgataatgaattctcttagcacttgcttttcttgagaaaaactttatatcttcttggcttacgcaacttgatttagaaagatatgaaattcttggctggaatttcttttcttaaaaacgctgaaaataggaccccaatctctcttggcttgtaaggtttctgctaagaagtccactgttagtctgatgggattcccttttagtatctttcaggtcttctctgcatttcttatatctgaatatctacctcaccagaaagataagacaaatattattaaattgtttcctcaaatatgtttccaggttgactattttttctccttctctctcagtaatgtcagtaatttgtaggttaggtcacatgacctataatcccatattttttgaagcctttgttcattttaaagattcttttttctttttttttttctgattgagttagtaaaaagaccactcttcaaactctgaaattctttcttctcctctgtgtagtctttcaagtgtattttgaatttccttaagttaatttttcaattccagaagcagtgattgatttcaagatgtttatttcttccttcatttactggattcctttagatgtttctttgtgttgatttgcaccttgtattgaatcttgttgaacttccttgaaattcatgttttgatttctttatctgtcattcctgagtttccattttagttagaaacccttgctggagagctaatgtgatcctttggtgtcattcctttcagatttttcatggtgtcagaatccttgcactgcttctttctcatctggagatgctgacacatctaatttttgtaatttttttccatgtagataggattgttttatctttcttttttccccctatattattattattatttccttccctttcccccaccccttagagggtgtgacagtagggaatgttgactagggtctttttggctttgcttctataaccctatgttcttctgtcggcaagttttatattagggtgtacagttaagtgtacaagcctgtaaatgacactcatgggtaaaagccagctgcggccaacacagttgggtgtatttgtgatccttgtttatagggagaagctctcttttccctcaagcaatggctgctccatagagtgcagagtggtctgagctccctcttcaactttggcaggatgtgggagcaagatggatggggccaggacaggcaggccctccttcaggtcccctagtgaaaggcacaagcaccaatgcagagaaagaatccactgggtggccacaaagtggccaggggctggcatgtgtagacatggagctgggaaacctctttggccccaagttttttgcatgagggtggggggttttctaaacttttaatccaggagactgggtactccagacatctgtagatctgcccgggcgtggagtgaagaaggccccactgcatcacagtctctgcatgggttgctcaggctgcaatccagctaagcaggtgctttgaatgcctggagatctacctggtgtggaggaaagagggccccactcatcattatctatgtgcaaaagggaggggtggctcaggctgctgaaccaggcgagtgagtgcactgaatgcctggagttctgtctgggagtgaagcaaagagggctacagcacaccaaaatcccaggggagcaggctagggcaccaagcaatgatgcttgcagactagttccaagtcacaaaactggcactgtctgcaagtctcatcacccatgataaaccatggctgtagcagctctcctcctgccccagcactataatgggggagaacacctactgcacctactgctgagctgctttccacaattctatctgtgtaggcccctatcccactctagagcgggaactccagtctctgccctgacacaaaaatgcctgtgtggccatgctgctgtgtcaccaaagattgactgactttgtacctgcatggattaaaaatggtatcccactcttggtcccaagtctgtgaaaatgcctgcagtttttgccagtgtctttccctttctacgtctcaaagcctccccaaaagttagctccagggcttgggagaaacaaagcagtctctcttctctcttggcctgggttgctcagatccccagtgtgaaggagggtcagagagggaagttttctgccccactcatgtactgggacttctctcacttttatcagtcagatgccataatgagggccatttgcccacattctttctcttccttgggttctgggatgtccatcacaatttttgtggatttccattttccttcttgaattaaagttcacagagttgatcttcatgtatatttttcttcttgaattaaagctcacagagtcgatattatgcaaaatatattttgctatttccaagtggctgaggcacactaaaagcctgtaatctgacatcctggggggaagaaactaaaaatgaaaatgtgtatttttaagtgagcttttttttgttttttgacttataacatagatttgtgtactttacaaaaagtaaacatatctctgtaatattcctagaaaagacatagattcatgcgagactcctccattttactgcatttactagtagtttgtttatccttattgcagaatactattccattatataaacatatctagtttatttatcaattctgctatcaacaaacgtgattgttctttttgccctttgactatgatgaggagttcctgctatgaacattcttgtactttttttgtacaaacaaatatatttttctcatgggtatataactagaaataaaattgctaaattactagatcgtaggttatctgtatgttcaactttaatacataatacataatattaaatattttaaaattgttctaccaatttacattcctatcagaatatgaaaaagttcaaatattgtttcatactctctggccaatattaatgattgttagattttttttttcgtttcagccatcccaaagttttaccttttattcctctactgatatgtttattagtcgtgtaattattcactgctataaagtgccggttcaaatatttggcctcttttttgttatgttgtctttctcttatgaattcataggatttttgtgtattctggataagtgttcgtatcatatataagtttaaaaaattttatactattcggagaattaccttttttacactcaatcatagttatgataagtttcaattttaatgcagtctagtttatcccttttttcccaataaacttgcatttattaatcttatttgtgctctgtttaaaaaatctttttccatccagtagtcatgaaggttttctagattttctccaagaagatttttatgtttagaaaccacctggattcaatttacatgtatgtgtgaattacaggtcaagattctttttttctcatgcaaataaccaatgactctttttctcaatgtacttcagtaatatctttctcataatttaaataatgtatatttgtgtacatctttctcataattcacataatgtactgtttctggattctattttattttaatgtttgttgttgttgttgttgttgttttgttttgtttttgagacaggttctcaccctgtctctcagtctaaagtacagcggcacaatttcggctcactgaagccttgacctcctgggctcatgcaacgctcccacctctgcctcccaagtagctggggctacaggtgtatgtcaccacacccagctaatttttaaaattttttttgtagagatgagttctcaccatgttgcccaggctggtcttgaactcctgtactcaatcaatcctcctgccttggcctcccaaattgctgtgattatagacaggagtcgtcacacctggcctacattaatgattaatttttaaaatctttttgcaaatacaaagctaccttaattaatgtagatataataagtctttatttttggaagtgttagtttctgtttcctttttatcttcaagattatcctggcttttttggctttttcagttctcaaaagtattttatatatacacacacacaccctcatggggttttgtttgacatttctgtaaatatttcatatacacttgaaaaaatgtatatttctgttgttactgtcatataagtcaatttggttaatatcattcaaatattctataactgcttgttctatcaggggctatcaggtattataaaatatagttatagtctcctctacttctgtttttaattttgttagtttttgcttcacatgttttaaggccacgctattatgtgtatgcagatttagaattttatacctttctgttgaattgattcttatgattataaaatgtcccctttattctccaataatacactttgtcttaaagtctttttctgatattttatatattttaatgttattatatttggttactgtctacatagtatatatttttatattctttattgtcattagttatgtgattttatgcaaaagatatacctcataagcaatatatgtgtgtttttgtacatatgtttggatgtatatatgtattgtatatacatatacataatacacataaatacacacacacacacacacacacacacacacacacacatatatatatatatttttactactctgataaccatagacttttgttggggtacctcttccactcacatttaaggtaatttttaatatatttgcctttaaatctaccatgtaactatttgtgttttttgtccattgttatgtttgttctttgttgttttctctcttttcttgtctcatttttgataaagcatgtttaaaaaattattttatttcttattagcttgttaataactctattattttatattctctttttaattattttagagcaccgttcaatacagtaactgctagccacatggagctatttaaattaaacttaagtaaaggtaaaaattcagtttcttagtcacactggccacatttcaagtgctcaatagccacatgtggctaagggttattgtttagaagagcgtggattatggaatatgtccattattgcaaaaattctatttaatagtgccaccctaaggattacaacatgtgtttttgatccattacagtatactttaaattagtattctttctatttcttggacaatgcaagatcaacacaactttatttaattccttcttgctttttgaaaggctcatgaaatttaatcatttaaat

SEQ ID NO: 392 - DNA, 31143 bp, Homo sapiens
aggaggcatccttcagaagagatcagcctgggctcctgtttgttattcattcctcgcatctaatttttcagcaatcgtcttagctttaccttcacaatatgccagaattggatcagttctcactacctccacattctccctagtggaagccttcatcctctctttcttggattattgaacatctcctgactagtcttcctgctccccactccctgcttgcttccctgaaatctattctcttctaagaagtgtcagtaagcttttaaaattataaggaaaaccatgccatttctctgctccaaattctccaaagcccacctgtctcctaacagtgtacgagctaaatccacaatcaaagcctgtgaggttgcacacagcctgctcctgccctctttccactgcctactcgcccttacctcatctcctcccactctgccctgctcactctgctctgaccacactggtccctggctgttctccatacactctttgcacactcttttcttcaaccttctgcacttgcttctctggcagcacccttcctacagatatccatatagctgactgcctccttcaccaccttcaagtctttgcacaatgtctcattacaagaagctgtgcctgaatatcctaggaaaatctcaaccctctccttccactcctgtacaactctgcttcatttttactcataatattccttactctgacatgatatatattataaatgtatgtttctattgtctatttcccagtagaacataaacttcattaaggtaaaaaagggattctttgcatggtttggttaggttggttttgtttggttttctgtttcatttccaatgcctcaaaaagttctggctaataacacacctttaataaatattgattaaataaatgagtggataaacgagtaagtgaatgaatgaattaaaatataaggagagtctctaacttaatttcctagtgaggtaccttccccacggtgtctccctttgcgcattttctagatcttacttgactagataaaaagaaaaacgaaaagacctgtcctgctttcttaaaggactagaaagcggaccaggcgtaagatccacaaagagaatctccaggaccctttgaagctcacatttagcatatgacaactccataggtcagtgaggacactggctggcttgaatattgtggaagacaggaagaacacatttatatgcttccaaagaagttattgctctatgtctgggtaatgccaaaataaatttgaaaacaaaagatcacctcgttcattttgggcactgtgcacgtaaaacacttgattaacttttcctgctggcttttttgatagctattgttgtggatgtatacacaagcctaaggagatagcctctactattcatattattactacacccaaattacaatggtcttcagtgacacttagcacttgtacacaatctctgaaaagtcaccgtttcaagctgtgtcatgtcagcgttttgtatgtaaaatcccatcctagaattgatcacaccccaaattattatccttgattgctcagctttctctcagtagctctggagttgcccctgatatggatgtccaaagggcactgatgtggactgccaaatgtttgcagtgcactttaattacttctctgcgaacgaaagctttcctgtagttagcagaaccccttgttctaactgtcgtttgggaagatttgagagtctaagcaacctcgtttatgtcttatctttgcattttcctgtattcagctattttcttaaaggaaggcccaggtctgtattatcctactgccacataggaagtaaaatgagtactcacagccttgcgcctaatcactgaacacagcttttagtaatgttttacacaagaacaggatattggcaactcaactgttaagcctttctgtgattattcttccttgagatcactctgatgtcaccagtgtaatttgagcctggagcttttgttcacactttaaatagcagtcccagaatgatttcactacagactctctggaaagcctgggagctgaattccggaagatccccacatcgatgaaagcaaagcgaagccaccaagccgtcatcatgtccacgtcgctacgagtcagcccatccatccatggctaccacttcgacacagcctctcgtaagaaagccgtgggcaacatctttgaaaacacagaccaagaatcactagaaaggctcttcagaaactctggagacaagaaagcagaggagagagccaagatcatttttgccatagatcaagatgtggaggagaaaacgcgtgccctgatggccttgaagaagaggacaaaagacaagcttttccagtttctgaaactgcggaaatattccatcaaagttcactgaagagaagaggatggataaggacgttatccaagaatggacattcaaagaccaagtgagtttgtgagattctaacagatgcagcattttgctgctaccttacaagcttctcttctgtcaggactccagaggctggaaagggaccgggactggaaagggaccaggactgaacagactggttacaaagactccaaacaatttcatgccctgtgctgttacagaggagaacaaaatgctttcagcaaggatttgaaaactcttccgtccctgcaggaaaggattgatgctgatagaagagcctggacagatgtaatgagaactaaagaaaacagatggctggagatgacatttatccagggtcactttgtcaggccctaggacttaaatcgaagttgaacttttttttttttttttaaccaaatagataggggaagggaggagggagagggaggacagggagagaaaataccatgcataaattgtttactgaatttttatatctgagtgttcaaaatatttccaagcctgagtattgtctattggtatagatttttagaaatcaataattgattatttatttgcacttattacaatgcctgaaaaagtgcaccacatggatgttaagtagaaattcaagaaagtaagatgtcttcagcaactcagtaaaaccttacgccaccttttggtttgtaaaaggttttttatacatttcaaacaggttgcacaaaagttaaaataatggggtcttttataaatccaaagtactgtgaaaacattttacatattttttaaatcttctgactaatgctaaaacgtaatctaattaaatttcatacagttactgcagtaagcattaggaagtgaatatgatatacaaaatagtttataaagactctatagtttctataatttattttactggcaaatgtcatgcaacaataataaattattgtaaactttgtggcttttggtctgtgatgcttggtctcaaaggaaaaaataagatggtaaatgttgatatttacaaacttttctaaagatgtgtctctaacaataaaagttaattttagagtagttttatattaattaccaaactttttcaaaacaaattcttacgtcaaatatctgggaagtttctctgtcccaatcttaaaatataaaatatagatatagaagttcatagattgactccttggcatttctatttatgtatccattaaggatgagttttaaaaggctttctcttcatacttttgaaaaatttcttctatgattacagtagctatgtacatgtgtacatctatttttcccaagcaatatgttttgggtttagagtctgagtgatgaccaagattctgtgtgttactactgtttgtttaataggaacaaatatagaaataatattatctctttgcttatttcccgttaaaactataataaaatgtttctaggacagcatacgtaaatgcctgctatgctttcctaacaaaaatgaaatttttccacaagttaagcattttagaaacacctaaagtgtttttcaaaatgctgatcacagtaagtcaaaacaagtgaattacctcacatctgctgggagggttacaagtcaggattataaatactatgtttttaaaaagaaaatcaaatggcaaattctattttcaaatagtaatttactcgttcactgaagataatgcaaagcactttattaaaaatgagttctttccaagagagcattccggaagataacacattaatatgcaaaattgtgtgtgtgtgtgtgtgtgtgtgtgtgtgtgcatttttctaagaggaatattgataattttcacgagatttgtagagacagctataactccaaaaaaagttataaacagaaaaagggtttgcggagtagcaggagaattggaggaagcctaacccaggctggggacatactagacaattccatagaaattttccctgtttcattttcactgtgctgtgttacgggagtatgaaagagaaggctgtaaagaggccctcggctccataaccctactttcccatccttatgaactgagctttcttaatgttcactgcgtgtgctagaaataacttccttctcctgatagggcccatcagtgaaaatctttattttctattcaaaaattgaagcacacttggatgctaaatgtagttcaagagttaagtgtattatacatactcataactatttactctgccactgttgttttcaatagggtacaaagtatatcttctcctcttttcacattagcatgtattaagttgttttcttgcagtatattacgttattttctgatttcaaggctgtaacatgggagacaaattaaaaagcaatttggatgcactccacaatggtatggagaataataacacatccagtagattatcacaaacgtgtcatctttaccattcatggagaacaaaagttggaatcaatttaattgcataaggatgatttttagcttcataatacattcattacttaatgtgaggtgaaaataaacatcagtagaacagggaggattggttcagtttagaaatttatggcacaaggataaacaaatatatctcaggacatctcactgtaattgaagaaatgaaagcagcaaagattaaatagctcgttaatcatatttgtatcatgagatcacagtaataactttcactgagtgtttactctcagtcagacaattttctaagtgttttttttgtgtattactaatacatcacttaattagtgccatgacataaatgctaagggcatgtgcgtgtgtaatatagtaataaaactgaagcacagagaggtgcagtaacttggtcaatgacacgcagctaataactccagaaatcaaatccaggaactctggccttcattcccagccactagactataccggttctttaggagaaaccaagcttctctttttcttttaagtaacgatacttctatgttagtcagtcatgaagacaggaaggcctggcctctgaagcatcacttttatctgacctgggtatgtttgtctatttatttgttacacgtgctacatggggaaagcgtcttagtttaatagttttaattgtatcaaggatgtgcttagatacaggctttcaagcctgcagttaaaataacacttgtattagcatcctggaacacaaggccacacgtaagctttgggtcttagtttgttcattgaaggaactcagaaaccatggattcaatattttattcactcagttcatcccctggcccacagcaaagggggatttgtccagcagataggattttctgagaaaggggtccagggtgtatggttgactatatttttctcatcatcggagggtaaccagggtacgcaattgacattcccttagaaagtttcatctgctagtaaactaataatgaagccatggcctgaggattgcatgttttttcagagtatttagttgacctttctatactccacatgagggtttctcagaacagcctgtatggattcccagcagaacagatgtggggggcagggcagcatttgtatcttacccattcaacaaaaatacagtaagcacccatatgtgggagcctccatggccagaatggatcctggttctccatatcagaagaacaggaaaggtttttaaaaggggtatcacacggtgagaagtgtgatgggagtttagacagaatgctctggaagcataaggcaggaattatgtgtgtgtgtgtgtgcgcgcacgcgcgtgtgtttgtgtttgtgtgtgcgtgtgtgcttgtgcatgtgtgtgtgtgcttgtgtgtgtctgtgtctgtatgtctgcgtgtttggggagtagcaggagaattggaggaggcctaatccagttggaggagaccctagcaaattccacagagaattttccctgttttaaagtaggagttgggggagtagagagaaaaatttttatttcagcctatgcctatagtatttgccaagacaaggaggcaggaaagagtatttgaaaatctccaggcagttcagtctgactaggggcctaagcattcccagctaataattaggaaggcagccagggccgggtgccgtggctcactcctgtaagcccaacactttgggaggccgaggcaggcagatcacttgcggtcaagagttccagaccagcctggccaacatggtgaaacgctgtctctactaaaaaatacaaaaattagcagggtgtggtggtgcgtgcccgtaatcccagctacttgagaggctgaggcgtgagaatcacttgaacctgggaggcggaggttgcagtgagcccagatcaccccactgtactccagcttgggctgcagagcgagactccatcttgaaaaaaagaaaggcagctgggttttaaatgacaagtgtaagtattaattttatatattctggaggtaatagagaaacattaaaagtaacatttactgtctagctactgtgtattgggtcctaggaaaagatacggttaatagcttgaaaaataatccaccatctagcagttgaacttggtcagattctgcagaactctgtagcttcacactgaatgaaaagctatagaggacctttgcagttcaataacagtgggcagcaatgtggcagctgaagataaaacagaagtaaaagattatgaagaaaagcattgtgaggcccgattgtggaaacagcaaactaatatattgcccaattaaatatttaagaaattgtgactacacctgatccttataatgagtcttattatttaacaagtattataaataaatggttataagctctttttttttgtcttgaaaaactcttctgcaaacagtttccagatattttaagtgattatcatgggtaatgcaaatgtgttctatttcaatgtctatacacattgacagtggatatggttcagcaaagtactggcaaaactatgttacagagctttggaaataagcatcctgtgccagtaagatttagcagtgttgttgtcgttgttgttgtttaaattaaaagtggatgagtaatcagaagacttttagtgtagctgctttctcccctctgtactccttacacacaagcatgcacacacacatacacacacatgtgcacacagacacatgcacacacatgtgcacgcacacagtacagacacataatcctactagaagcatatcagcttttttccctgagcttttgtttcctcatctgtggacaatagcatcgtgttgagcaaacaaccccagactgagcctggaattctggggtttttcccgaccctgccttagacaaattccttttttatctctgggtttcatctgtaagaaaaaaaacagctagaccagacggatgatgtctgtgacctttatcagctcttatattctacatcaatgggaaatagcaactgtgccaccttacgtgataggatttttttctggaccagttggtattccatatatgataagaatttctcttaagtatgataaaggcctagtttaaaagttttcatctttagccaatggttgctgaaggcacaatgtgaggaaaatcagtttttgtatgtatatctctgctttttaatagcctgcctccgttctggttggttggtgcctgtgccagggctggctggctggcaatattttgactatctcttccatagccaagcaatgacagagtcactgagacaatctccactgttggtgagaattgcattcatatgtaaagttttcaaaatagagattcttggtcccaaactctccaggcattgtttttaggactaggtatttgtacaaagctctacagtcagctataaagaacatgagatatatggaaccatttcttatgttacattggctcttctgttggtagcacttcataatataaagaccaagaaagagggtttgatttcatggcattagttagaatttgttttaccatattaattctgtcattaattgaaaatgatactgatagggtttggctcagtgtcccctcccaaatctcctcttgaattgtaatccccacaggttgagggagggacctggtggaaggtgattggatcatggagacagtttccccaatgctgttcttgtgatagtgagagagttttcatgagagctgatggtttaaaagtggcagtttcccctgacctccctctctcctgccaccatgtaagacgtgccttgcttccctttcaccttccgccatgattgcaagtttcctgaggccccccccagccatgtggaactgtgagtcaattaaacctctttttttataaattacctagtctcaggtagtatctttataatagcgtaaaaacagactaatacagataccctccaaaaataaatatattttgaagagaataattacagtatgtatttatgttaattaattcattctgggttttttctttcttgaatttcggtctgatatttatctaccttgatacatgtatatttgaccaaaaagaaatcttctgtttcttaccactacctatcctttaaatttttttgcaatttgtctatgtttattatttatgcccaggttttatcatctgaaagattccagagaagcccagtgatcctgaagggtactggcagccacagtatctgaaatgctgtgtctgaggaccatcttcccctgacattgcagaatacctaggacagagcaactgtttccaggcctactcttatcacagtctccttggggacttttaaaaatccaggcctttggacttaatgattcagagtttctggggctggacacctgctagctccgtgcttcagtcactccccaggtgattttgctgctcagtcatattgagaagcactgacctagattaaaatcacaaactgtgcatggtgtgaggacacggctcatttcagttcatccatgtatccccaggcatattgcaggcctcaatacctttcggaccgaacaactgcagcaaaatgtgactaggactttattgtggaatactttattcctactatctctaattcaaataataccatcattttgattttgctctaaattttatttgttttaagaaatcctaccaactcacaatgatcacatcattatctaactcccatcaggctcccataaagcatacagttgcagcaatgaaaacacatttttccaaagaatgtaagggctgtctccccctaaatatatttaccacttgcctgctattatggagattcatttcttagtccagagaagtttgtcttttcaaaagtaagaattaggctgggcgtgatgactcacgcctgtaatcccagcgctttgggaggccgaggcaggaggatctcttgagctcacgagttcaagaccagcaagggcaacatgacaaaaccctgcctacaaaaaaatacaaacatggtgaggctgaggtgggaggattcctcgagcctaggcagtcgaggctgcagtgagctgtgattgcaccgctgcactccagcctgggcaacagagtgagaccctgtcaaaaaaaaaaaaaagaatgagtagcacttatcactagcagtcacttctataaactagaatattagcatttaacaaagcacttccttcctaacagcaaatatcttccactgagatcgtgtggttttaatcatacaaggagagtggcagaagaacagaaagattgaaaccaaggacagagaacacctgaaattggtaaggaagaaaacaaccaaaggtagtatttcactaagaaaaacatcttaatttttcctagccctggtcttggctgttacatagtgggatagctcgatgtgcatacagcgtggttggcagtagaaagatcaatagaggagtttatagggtttacgaagacctggattctaatcctgcctcagctatttatgaggtatgtgtaaatttttagtaaattacttaatgtctcataacctcactttaacatttataaaatagggacaataataccttctgtattagtttactaaggcttctgtaacaaggtaccgccaactgggtggcttaaacaacagaaacttacctcttcacagttctggagggggaaagtctgagatcaagctgtcaactgggttggtttcttcttggccatcttctccctgtgtcttacatggtcttccctctgtgtgtgtccatatcctaatctcctcttcttataaggacattagttatattgaattagggcccactttaaatactttagtctaacttaccaacctctttcaaggccctgtctctaaatgcagttgcattctgaagtactggggattaagaccgcaacacgtaaattttggttggggaaacagagttcagctcataacatctttgtatttctttctcttgcttgttgtaagcataacataaggcaacatatgtgaaaacacccacaagttaagtatgatatctgtgaaggtaaggtccttggggaccaggacaacactttgctcatggttgaattctacaaagcttcttgcacaggctctggcgtggggtgggttcctcataagtgttttctgaacatgaacacacaaatatcccttaaaaatgaggtatttgtttattaacctctgaagtcaacatctgtaccctttttgtctcttaagcatctccaaggagggctaagtcaacagtgttccattagcattaaatagctgaacctggggatgaaccacagttcatgctgaaagagccatgtcgaaatggcattgtgcaatggtgcatttctgccactaaaaactttgtttgcttttcattatacaggaatggcttcaaatgttcagtggaagtgaacaagttcttgtattgttttctcctattctccttccagcttcagggtcatatgtcacagcgctgggcatttcatttgggtgagtgaaaggagggaagggagcaacgctgggaaggtttaaaatctccaagtgatatacgaggaaaaaggctgtgctcatcacaaaagtaattctatctatcttaccttatatagtaagaatttcagcatgaatagaatgagtttagagggcttcataatctgtgctcaagaagtgtgggaatcttggtggaatagagccctgcacgatgttgttggagatcaaatgccattggctactatctaatttcaatttgagaagaaaattactaaatgtatatcatatcaactctgaagaccctattactttgacacagaaaaataacttcataaaatcaattgactaaaataaattagccaagcaagggtgggataccttgtggccaaagtaacaatctgaatatctggtttttaacttttcattgttaatgatcacatgatcgcgctgagtagacataagccagtgttgtcatttcattctacatatatttggaagatgaagatacctacatcctcaccttgtttacaggatcaaagaggcctgggattcttcaatgattatctagcctggcatgtggactctctgtcatccttgagggacgtcaagaccaggattctgtatatattggatagatttcatatgtatttcagttactattcctttatacctttaaaaaaatttaaattgatataagaaagtgattaaatttttctctttcaattttaggggctcatttttgctgttagagaggtttgtaaaaattcaacacaaataagacagagctggttacttgggcaggacaagtgcatgccagaggcataaccacttaaaactctgctcttcagctaagaaacaccagaaattcaatactctaggcaccatggttgagagatgggaagacttacttatgccaactaaactctcagcctgcaatatgaacaaggaccaggcttggtggctcacacttgtaacctcaatactttgggaggccaaagtgggaggatttcttgagcctaggagtttaaggccatcccgggtaacatagcaagacttcatctctacaaaaaattttataattagctgagtgtggtgccatgtgcctgtggtcccagctacttgggggcctggctgaggtgggaggattgcttgagcccaggaatttgaggctgcagtgagccaggaccatgccactgcactccagcctgggtgacagagtgagaccctgtctcaaaacataattaatacataaataaattaataaacagataatgtaggaccattaatttattcatccatgggaaaaatttaagtgccaaggaggaggaaaaattataagtgaaagcaaagcaagatcaagagtcttgaaggcaatttctccctggttttggcaaggtttgaaggattagcttcacagcagagacctcttagctactgaccactacaacatttaccttttgctgcataacaagctgccccagtgcttagcaacttaaaatgacaagcattcaatttaactcatgattctgtgggtcagcttgggttcttctggcctgggccaactcagctcttgtctgctgagctctctcaggcatccgtggtcagttggtagctgggtgatataggatgacttcactcacctgtccgattggcaggtcgttggccacggcatcttgactctcttccaccattttttgcaatctgccatattagcacttaggggctttcatcataacagtgctggataagtatttgtcaaattctatctttctctttgctctgtttgtagacaccatgctcaccatcttctttctttgtgacattatcttttctggaagagggtgcactataaatgaccacattttaccttattcatcagagtcaccctccaggccttcttccctgaaccgagattcagattagttcatgaaactcagtcactcatttagaaatatatttttattgactcccatggctaacaaatttgattcaccaaactcagtcactcattcagaaatactgtttactcactcccatcactaactaattttttctataatgtgtgaatgttaccaatgtaatattcagaggatattcactgtggtttttctgtaatttcttgatggtgcagagatggcagagacatctctcttatcctcaggtacccatggcagtgccaaagcagttgaagggcatgagcagatttctgaaaaatcataactgccgtaaaccaccctttcttagtgccagcttccttatgaaatatatagatgcataccactgaatatctgagcttgttcctctcgttaacctcactttgtggaaaggtttttaaatcaactgctaaaaatgcctgttcttttctctggacagtggacatggagagacatgagctgagggagacagactgactcagggaaaagaattaatggaagcacatggctcccgcgggcaggaaatgctttgatagaccttttcctctttttgttaccaggaggaccttgacaatagactccaccttggagcagctgctctgtcccccgtaggatgatcacagcacattttccttgtcagacttggagtctgcaccagggagtgctcaggaagggaccagtacaatgttggggatctgcccttgagcctccaagctgtgcgatgggtggagacgtcaccccaatacactcacaaatccttttggcacacgcttcaggaagaccatctgctttcgttgttcctctgaccttttgttagcacccaccctaaattggaaataaattgccagaagaaatctgaagcctaaagcagttttagaccctgttgtcaaagcaagtcaaattagtaagtgttggtttagcacctaacatgtatcccaaattgtgctagatgttggcagtggaaggaatattttttcaatgtctaaatagcttcaggactatataggatcttgaataatttaatttaatcttttcaaaatttctacaaggcaagtattactatatgcatctgatagatcaggaaactgaagctctggaggttcaccaacttttctggtgccagtctaacttcgtaagataggagagtataaagtcagacttctatctcgatttcatatatgattttatgtcagctctgatgtattctcaagtctgacgcttaactgctttttttcccgtagtcttatataccatgtctaataggctctatgaaacattggcaaagaagagacctggttctagccccattctgataggtgacatgggataaggcactgaaaattctgggtttcatcttcttctggaacataagagactaaatgagatgacagaccttctaattcctaaatttataactatgttacaaaatgtggtatgggctccacattcattaagatggcaagtaaaaaaaatggaaaagaagtattgaagagaaggtggagaaattagatccattgtgcactgctggcaagattgtaaaatggcacacccattgtggaaaatagttcagcagctcctcaaaacatgaagcgtagaattgtcacagaaatcctgtaattccacttctggtaatatataaaaaaaaatgaaattaggaacatgagtagatacacctgtgttcatagcagcattatttacaatagtctaaatgtgagaacaacacccatgttcatcaacacatgaatggataaacaaaaaatggtatatacatacaatggaatatgatccatccttaaaaaggaagagaattctaacacaaactacaacatgggtcaaccttgaagacattattgcaaagtgaaataagtcaatcataaaagaacaaatactgtatgattccacttatatgagatacctagagtagccaaattcatagaggctgggctcaggagaggagaaattaggggttaatgtttagtgggtgcagcatttcagtttgggaaaagaaaagagctctggagttagatgatagtttctcagcatttaaatgtactttatgcccctaaactatttacctaaatgtagttgaagtggtaaataaagctataatttaaaaaaggaagttaaaaaaatgtggtttgaatttcagtaacaaaacacaataattcaaaaaagaattcactttttttttagaaatgttcacatcattcaatttccaaattatttagtgacctttaaaatattgcagatttacaggcttacaggaggactaagattacactcatctgcattataagccacagtgaaaaggatgagaagttatcctggcaaaagatggagaaaggagcattttaaagaggggaactagtttaaaacaagattctattttggaaaaagcataacatgttcgataaaattagagcaattttctggagcaatgttgcttaaactcagagagcaggagaaagaatagcatgagctggaaatggagataggcagggccaaagcacttgaggctgggttagagtttacattgtgttataggtaatgctaatagagccattgtagactttcaagctagagaatatcaatatttttattcgtgcttttaaaaggtcaagctggcagcattttggggaagaaccagagggtagagagcataacatgctttaggcagctactgtagttgtctagattagagcatatgaagaagagatggaaagtagttgagtgtcagaggtaattagggagaaagcatcaccagaatttgaagatgcattggcttcatcctctgcattatgatttcccaattaatcatttccccccggggtcatagtcaccttcactgggcatcttccactagagtgctgcaatagctgaaggagttcactgccttctgctcttacccttcagtgggtcttttatattacagctagatttagctttctaaaatgccactctacacacataacttccctgctcagcactttcaaagtctacccattgcctacagtattaagtccagcttccttagctgggcattcaaggcccattgtaacctggtctctctaaatctacctagcacattgctttaacatggactggccagccacagtggctcatgcctgtaatcccagcactttcccaaactacctcccaggccgaggtaggtgggtcacctgagcccaggagttcaaggccagcatgggcaacgtggcaaaaccctgtctctacaaaaatacaaaaattagctgggtgtggtggtgtgcacctgtagtcccagctactcgggaggctaaggtgggaggatcaagatcgcttgagcccgggaggttgaggctggagtgagcatgattacgccctcactgcaaaagagcaagaccctgtcgcaaaagcacaaattaaataaataaataaatgtggactcagttaataaaaaaaaaagtttcttcagcatctatcagaggccagattaactaacttgttacaaagcattcctgctgcttcattttctttttctgtcttatttatatttgatttttagaaatatatagaatataccatacatataaaggagaaatataaaatgcaggtgcaggttaaagactactgtaaaaaacactacctagcttaagactagacgctttttaatatatttgaagatctgtgtgctctgatccctcttcccacactcccctaaacattatcttggattttatatttattcccattctatcttcctggaatgcccttgcccttcttttttttttttttttttttttttttttgagacagagtttcgctctttttgcccaggctggagtgcagtggcgcggtctcggctcactgcaccctctgcctcccaggttcaacccattctcctgcctcagcctccagagtaactgggactacaggcgcatgccaccacacctggctaatttttgtatttttaatagagacggggtttcatcatgttggccaagatgttctggatctcctgaccttgtgatccacctgccttggcctcccaaagtgctgggattacaggcgtaagccaccgctcccagctgccgttgcccttcttgttgctttaataccattcttcctctgacctggcccagaatttagaaagatttttctgaagattttagctcttactaagtacagctagtgttgtctccatcacccatgggcactggcatcttctgtcattaatgctagtaatctttttatgtgtcagtggaagcagaaatctcattttctattgagaaggtgcttggtatgcagagcttgctgctgctgatgggatcaatactcatgtgctttattcagagtggtcagatggtctgagggaccagggtgctgagaggtggtggcagggagacattctcaggaaccagacggggaaggtagaaagtgcctggcatgccatgaatagttgttgaactagtgaattaatgaatgattgacaactctttctggtctacaatactgaactataagcaacgtgaggatgggctactgtgtgactcagtgattcatagtcacaactcagttcagttgagttatttcttgagtaccaggttcaagagatgcaacgacaaataggtctgttttaaaatatcagcagtggggtcaggggaaagtgggaggagggaggaaggcagacacatagatcaatcattgtaacagggcagcaagcacaaccaaagaaaaatacgatcatcaatcagaggaggaagcggttaatgtttccaggagaaagtattgattgcctagagtttactcccacccagtctgaagaatcctacttggattccactgcagcattttctccctctgattctccagcctcctccttgcaccctgcctgggattctgtgctccaaccacattggcccaggttaccatcttccaacaggccccgacttttcatcctctgtgttctacccagtgcgtctcaaattttaaagcatctacaaaccacctggggatcttgctaaaatgcaaattctgacttggtctgggaagtgtgccctgaggcctgaggatctgcatttccaacaagctcccaggtgatgccaaagctgctgctctgcaaaccaaagcttagaactgcaaggctactctctccgccatgaaatactgttctcttcccacactcttactcaaatcctctacatttctatgagctaagtcaaatgtcttccctgtgatgacatctcctcagtttcaggatggggcatcagtgccgtttttctctccactgcctggcaaatctttctctccaagtctttttcctcaatgaactgaaggctccttgagggaaggacttggtcacgttcatccaaacccctggatggtgtctgttatagagttgggccttaaatacttgctccattgaatttgaattgaacttaaaatattatggcagtcctggtaaagtggcttgcacctgcaatcccagcattttggaagtctaaggtgggtggatcacctgaggtcaggagttcaagaccagcctggccaacatggcaaaaccctgtctctactaaaaatacaaaaattaactgggcatggtggcagacgcctgtaatccaagttactcaggaagctgaggcaggagaatcacttgaacccaagaggtggaggttgcagtgagccgagatcgtgccattgcactctagcctgggcaacaagagtgaaactccatctcaaaaaaaaaaaaaaaccatatatatatatatatatatatatatatatatatatatatatatagcatatggattaaatgtgtatttgtgtggttatataagtgtgtttgtgcatgtgtcctattcaatgtactatgtactatacaatatactatacatataatgtatatatacaatgtactatataatgactagatcagaatacatagacaaaccaggtcattttagcattgtgtcaccaagaattataataaaatataaattaacatagatgataatgatcagggtggcagaaataacctccaatataaatttgatgaaggcaaaacactttttttctagtaggtcactgggtccccctgagtctaggcccgtgtcatgtatgttgtaataatcagtaaatatttgtggaattctaaatgaataaagggagaaggtactgaactttagttctatgaataaacacaattgtaacccctggaaaaggaagtggttaaagctatgttaagatctaagacaaaaacagaaataaacaataataaagacaagccaaaaaaaatctgaaaatcttcccctatagtgaatgcacattacattttttttcactaagaatatcttcttacatggcagcaaaactaaattgaagacatttttccatgtgaattgttttttcctaaaatatcaaattgttgtagatcaacaaaaactttgtttttcttactattgaatatcaaaaaagacccagttaattgcaaacataaacgctttttccttgcctctccttcagttttgctgatgagggagattttgcagctttacttggtaccaaaatagctctgttttgcagaccattatcatcttcaaagggcggggcaattataatgaactagaacacaggaagtttaccatttctcagtattaaaatagaattccttattacacagatgcttctcccaaaaaggaaaagcaactagaatttttactttcttcaatctgttgatattactgtgctgtattaatatagtaaggcattcgtgtcattaatacttgggaaatgctgcttcattctctatttttatttgaatgatgtttcaaaaaataattcaaaaacgtttattgcctaagaaacattttagtcagcactgcttagctgaagccagcactaaaaacacaacctttttagaactccactttttttatgtaaagcattaagtggtaacctagtagcaggatttggaatcaagaataacatttgccgagtggctactgtaagactgattcagtataaacacaatctcacttgattctcataataatctttgcaggtatctatcatcattcccattctgcaatgaggaaatgctgtcagagtgattaagtaatttgcccatggtctcacatagtaagtactgcaggtgaaactctgacttctcttctcgttgccaaagcctacaaacatccttctctatcaagaggcccttataaagctaccatctattttattaaaatgtcatgtctgtgtaagaagcttaacacacaaggctgtctgtatcttagataacagaatctcattttgctcatttcttctataaacgtttcctgggtttttcctacgtacttggtaatgtgctgagtgctaaaaccagagataaaatacagtagaatcaggagagacagccaattcaaagacaaatgtaatttcaaattgccaatgtttcactgcttttgagttacaaaaatgccaactttatatgatttatactaaaatatgttatccaataaagagaatggcacattttgttccaattattccaactcaatattttagaaaagtaaacagatttctgtgtgatttcccagcattttgattatactggctatgtatataaatgtttcttttggtttataggaagcctgtcttctccagggaacacagcactcagaatcgtctcggcccctgcataagcctgcatgagcctgggctctggggacccatcctggtgcatcattcgttggctctgtgacaatgggcacatcgtttaacctctcttggcttcattctccttactggaatgatggagagagttttgcctatttcagaggcttgctcttctatacgtgagcctataagtaacttgtcttaagaatttccactccttctgtactctgatttaaatttgaaggcatcaaaacaaaaacaatcaagatttcagattccaaatactttcattttcattttttattttgattagaatttcttctgaatgaatttctgttttgtaattttagcattgccctgagggggggaaaaggcagtttatcaccatgcagtatatttttcagacagcctctctttgacaaactgatttttgtcagtctcaactgactcaccaattccaaatcccagggcttccctgggaaacttccttggatcatggctctgccacacaggaccgacatcccagaggccaaagcaacctgctataaactgagatcattgctcagcaagctggtaccacatgcaaggagtctcaagagctaacaggaaatgattcaagaccagaattacccagaacaagtgtgttagcttcctctgcgcatgggataataaggagcttgcatcaccaaccttccgtgaatagcctactcagtgattcaacaggtttcaaaattgtgaaataagggatgtctcttgcatggtgtactttagaagtctctacctgaggatgaaggaagtacccaggagtaggcatcattccacttttgtaccatcttccactatgtttatatgggtcctcactgagaaaaaggtattaaaagtgagatggaaagaataggtcagctaggtgaaaaatgggaggaagagacagaaggatctgggttacaaaaggctgagaccaggccgggcacggtggttcactcctgtaatcccagcactttgggaggccgaagcaggtggatcacgaggccaggagatcgagaccatcctggctaacacggtgaaaccctatctctactaaaaatacaaaaaattaaaattaaccgggcgtagtggcaggcacctgtagtcccagctactcaggaggctgaggcaagagaatcgcttgaacctgggaggcagaggttgcagtgagctgagactgcaccactgcactgcactctaacctgggcaacagagtgagactctgtctcaaaaaaaaaaaaaaatgctgagaccaaagtagcctggtggctttgggaatggaagtcaaacctggtgcgtggggtggagttcctgtagtttttattatactctcagagtaaggcaaggtcagtgaagcattttgaagggaaagatggcaaagtgggtccatatttttaaaagctcatttgaattgccatgtggcaattcaaataggataggataaagaataaaagcagaaatggagagaataagagaaatgtggccgggtgcagtgtctcacacttgtaatcccagcactttgggaagcccagagagcagcatctcttgagtccaagagtacaagaccagcctgagcaacatttcaagaccctgtctatacaaaaattacaaaaattatcctgtggttgtgcacctgtagtcccagctacccagaaggatgacgtgggaggatcacttgggcctgggagatcgaggctgcagtgaaccaagatcatgccactgtactccagcctgggtgagagtgagaccctgtctcaaaaaagagagagaaatgtggtctcaacaagcattaaggggatggtgggaaaggatgaaattaatggaaggagtagagggaagtgcaaaggatgaaattaatggaaggagtagagggcagtgcaaatgggcaaagaatctgtctgagggtgaggctgtgcacaaagtccttgggatatagcaaaacaggtcagtgaggcatgaaatcagagaggcaggctttatacagacttgtggtagttgcaggacgagggttggggggaagtggtttgcagactgctgtgaactacagacattttttaaggatatcaagaagagccccctcattttcttccttacccccgctgccccactcctgattcatgggcaggtgaacctagcccatgaagcaatgctgacccaaccatcaaaacatgacaccagcttgctgcccaatcctctgtggaccaaactgcagtcagtcaccatgtacaatacaatcaagcagtaacactctgaggttctcgaacgcccctttacagagggaacttggcagggagtagccatgtgtgaacaacagggactccccattgttctgcactgatgattgaatagacttccttggtggcccatggagacagctgtttttactgaggaacattttgccctttgaatgtgattagtaagacagagatgactctattctttaaaggtctccaatgaccaaatttggcctctgagaactggaccgaaacattttgtgtgagtcacgtctgtttgcctcattttctgtcactagttgttatggaaactacatagcacagcctgagggttcagaattcctgaagttggcctcaaacttatgcatagtttgtacagcaaacaagtttgcttactttgttaatctttagctacttcccatcctgctcagattggaagcggaagaggtcaatactgcctagcgtccactctggtcttttcacatgaatcaaaataatagacttgaccttgtgtcctgccctgaggatggtacagatatttaaaagaattccaaatcacttcctgggttatctgattgtaggatcaaagtggcccccttgctaacataaaaatgatacacatgtgaaaagaatttaagacttcttcatgctgtcttttttgggttcatcccaatcttttggcaaaatctccagccagatcttaatggccactgggtttactctgggaaatatgcactttagagagatgtttgacatatttttgttacttgaacttctttgagatatctatagatctttgaaactcagacacaagaaagttttatgtccatggtgcctcccgattattcaaagaaaggtgatgagttttatggcttcttcagaaaggaatctaaatcagacagacctggagtcatagtctggttctaccatttaataattgcttgactgagtaagtaaattacctttgtgagcctctgttatccatctacaagacaatgctattaacaactatcccatgggttgttatgaagactaagcaaatttaacatgcaaattgcctagaacaggtttttatacatagtaggcacttagcaaatgttaatttcctttccttttccattgcactacctgctttgtggccatgttgttgaccaatagcacttccagttgcagatgagcaggaatagacaaagaatgtggaatttttataaagttccaattaagagagcctgaaagccatccaggtgttccttctaaacttagatgtgtgatttaacatgaggaagccatgtaacttttgtgctgtgaccataaactgagaaggctggagcatgtaatcctgaagccaggcattttaactgatgtaacggaagcaatgtgtatttttactattaactaaaaagtgactggggcaggtctcaatccatagagaggtattttgccaaggttaaagacatgcctggggaaattttaagtcccaagagtatctgtgacttgtgtttttttccaaaaggtggtaaaccaaaaataaaattctaagctccacagccatcagaatgaacccctcctctcagccaagggcattccaaagttaacctgaaaaactggttcaggccgtgatgttcctatcatgggagtcagacatgcctcattataccttcctcccttttggaattcaggcacagctgactagcattaacatcaacacagagaccttagaactggtaaaacagactctttacgtctgataagaaacatttacaatctgttctttctgaagcctcctacccggaggcttcatctgcatggtaaaaccttgctctccacaacccattatcatagcccagacatttctttctattgattccagatctttagataataatacaaccaatcagaaaatgtttgaatccacctatgacttggaagcccccactttcggttgtcttggctttctggaccaaaccaatgtacatcttacatgtattgattgatgccttatgactccctaaaatgtataaaaccaagctgtagctggccacctggggtacaggttgtcaggatctcctgggaatgtgtcagaggccattggtaactcatatttagctcagaataaatctcttcaaatattttacagtttgactctttttgtcgacagggagcttttggaacgtcagtaataaaggaaaaaagcaagcaggaagggaaaaaagagagggaggataggcagtgaggcagatggtgacattcttgtgaggctctgattagcttcagtaaatctacattttacataagaagaagagggagtaggggaaaaagtcaatgacgcattgtcctgtgctcagtcaactacatttgacatagctaaagtaaccgcatgaaaagagggagcagaggaaatggggctatggcacagggttgtgaaattacagctatttgggaacaaaaggaaaacagtgtccgttcccaagcttaactttctcttgtcatagtgtgtttggggccccaagattctattttctttcacactactaaccccaatgaatatatgctttatcttttagaaactgcacaaaagaaagaaaaatgcaagttggagaagagaccaacatggagcttgtgcttgctctcattaagaactcaatctcttgaaaaatcacattctaatatttctatgggtgagcacggatttcacatcagctccccatagccttcttgggtccatcagttcatcacttctagaagttggccacctgtgaagccacttaggggaggtcactcatcactgctggtgacagtggtgctctgtgtgtgaatactcatgttcatacccatggcaggggattttctctccaggttaaacagtgttgctgtgtttccctctctcttccagtctcacacgttcaggaaaattaatccccaaagtcctcattcattatttagcaaatatgttcaaataggagagaatatcagcttaagtttaagctaaggccctctgctaaggaaatacaaaatatatatgtgaaaaggaaattctagttgaagaacagtatgaaaactcccaaaatgggctggagaatttgtgattacagtcttgagagatcatttaaaaatagaatcagattagcaaatgcgttcagtgctaggtaggggagttagtcataaatctaacaggctctatgtagagccactgaagacagacatagttaaaactcaagttgatttctgtatattatttttaatgacttagaattcaatccaaaatttgcttagtgttattgtgtacctttatgcaaataatgtacactttctaagcatcagttattcttctgtgaaattgggataattttacttttgtcaagggctgccctgaggagtgaatcagatgctatacgtaagctcagtgggtacaaggcctaatagtagtggcttaatgcgtgtactcttcttctttttccttaatagaagaataaggtgaaattaaaaacaaggttgataattacatgtatattttaatgattcatcaatcaataaatgataacattaacaataattttactgtcagtacttagaagttaaaaggagaatggtaaaatcagtctgttgatcctaaaagttttattttttctttcatcctttcataaattatatctgaatctagattactgaaatgcaacaaataaaaatatttacaaagctatcttctcttttagtgaatataatgttattagaaaataacggttacttcattattcaacattcaatgtgtcttctgactttcttactccaatttatataaaaaatttttagaatttttaaataacaatgttattgacataaaattcacataccctgcaatttgctgatttaaaatgtaaatgaaattatttttagtatatgcacagagtgatacagccaccatcgcaataaattcaagaacattttatcgcctatcaaaaaaccctcatctccctatagtcactcagcttccctgcctcacttccacaactctaggcaaccactaatctaattcctgtttctataggtttctctattctggactttcacatataaggaatcatataatatgtggtcttttgtctctggcttcttttacttagcatcatgttttcaaggttcatccatgctgaagcatgggtcaggacttcattctttgtattgccaaataatattccattgtatggatgcaccacattctatttacccattcaggatttaatgtacatttgagttggtttccaaattttggctattgtgaataatgctgctatagaattacagaattttagaaggtgccatatggcttatgtggcccgttcctctccatttacagatatgctaatgaagcatcacaaaagtggggtgaatagcctatgtctcagtgcttctcagtagcaaaacattaactagaacccagttcttgtaattattttataactgccattcccatctctaccaatagtttgcaaggttttagagggacggccttgcactaacagttaaaatggattaagtagcagatatgagccagtctctgtatccccagcaatatacagtgtagtggaatatacaacacgacttggtgattgggtctgattctattaatctctgaaagacttatcctagtgcagagcacgtagtgagcatataataggaaattgtgtaactagtatgttggaagagctgaagtcatggggtataagcatgcaagcaacttaatgtttgatttttattttccctttaagccattcattgtggtagtttttttgaaataatcctagataaaaatttggataggccccaataaattaaaagccctagaatcacattatgtcacaaaacagctttaattcagtacttagaatagtaaacctatgtaagaatgaaaggtttcatcttcactgaagtagagtcttctctcgtgcctaaggctcacagccagccagcaacatgcaagggctggggagataaggtacaagaggagctggtgaggcctaataaaatggatgctgtgacaagatgggcctgtgttctctagacctggccagttgttacaacctgtttctttcatggctgcttttatgggttctttagagtttatctcccccgtcactgggtggctacaattctcttgacacgaatgatttacacctttctggtttgtcactttatccctccttagcttctaggaatacagcaacccttcagccagatcacccctcctggtggccctactggaaagttctagatattcctttgtatgaatggtccacatctggttccctggaaattctcatgcaccctttgccctccaagggccaaatccagtgtagccttgcttctactcatctttcagcagcagggaaatatccttattccacccttcctctttgttaaaccagtcaagtctgtccctcttcccaccctgctaaatacttcagaccacacatattctgtcctctgatcagtttccttcaagttcctctcttgacttgagatggtgagaaatatgtcctcccacttggagtgttgatgtgtttaggggaggggacagaactcacatcacagctctctctccaagtaaatattcctgaacattctttctgaagcttttgtactttagatatagaagaggagttcagcagtcagggaactgctttttattaaaaacaaacaaacaaaacctaaaacatttgacactttgcattttggtctgtagccttactttagaatatcatatctattatatcttggtctctcaaatgtaatttacaatttaatgtctggttatactttgaaattgtctagaaggcagggtattacaataaaaggaacattgacttagagtgatactagctatcatgtgtggaactctataccagacaccatgctaatttatttatttatttatttatttatttaagatagtgtctcactctgtcgctgggctggagtgcagtggtgtgatctcagctcactgcaacctctgcctcctgggttcaagcgattctcctgcctcagcctcccaagtagctgggattacaggcacctgccacccctggctaatttttgtattttttagtagagacggggtttcaccatgttggccaggctggtcttgaactcctggcctcaagtcatctgccctccttggcctcttaaagtgctgggattacatgcatgagccaccacacctggcccaaataatttattaacattatctcattaatctctttcaacaactcaatgatagagctattttgatcttcattcaataaagcagggacttaaaccttcaaaaggtatcatctagaatggtgtactaaaggtgtagtttatttgggtgctttcaacaggaagaaacagagcaatcgcacacccttaaatggcttcaacaacagaaagcagcactattttacatagtagttaacccagagataggggccatgccagtgctagttaatctgacggctcaaggatgcgtcaagcacctgggttctttcaatcttttggttatgcatccttggtatttaagcctgtcctaggctagttccttttgctatcacatgatggttgccacatttctagaaatcagatctagatgagacaatgcttagaataattgtttctcccttttagtaaaactcttcctaaatctcaccatgagtgcctgaacaaaatggaattctgcaacaaggaagaaaaaggaggatatactctaggtgtagagttgacgactggttacaggggtttaagtaactggacttaagtggttaaaggagtcttaccttctcagttccttagttccttcacctgtaaaatcagagttttgtgtcctggtgattgtctatttgcttttttattacagcaaagctgatggtactttatggtatcctttaaaagaagtaaatatttaagagtatgacttttaggtcattaacaagactggatcattgtcttgaaagtaaaaacacccacatttcaattattgttagttttttgttctttcagtgataaatcaccatataatgttatggaagagttactcaggagcttcgaatacttatctctagaggcagcagatgtttgtttgttgtagatgaaataaatctccaaagtagacagatttatctgtcaatcaatatgggcatatagagagtgaggagacagtggacctaggcaggctcacactggctgaccatcacccaggtcagttgccacactcgttctgcaactttgaaaggaacacacaaagcacagcctcatgcacagccagtgaacaactgggctcagattatctgcggacgctatagtttatttatttatgtattttctcttttttagacaagggctttccctgttgtccaggctggaatgcagaggtgtgatcctagctcattgcagcctcaacctcctggactcaagtgatcctcccacctcggcctcccaagtagctgggaccacaggggtgtaccaccaagcccggctaaactcattatgttgcccaggctggtctcaaacttctggcctcaagtgatcctcccacctcggcatcccacagtgctagaatcacagatgtaagccaccacactggtccaagtgcagtttagattgttgctcatgctgttagtcatttctggttttggttaacttttatttgttttagacagtgtcttgctctgtcacctggactggagtgcagtggtgtgatctcagctcactgcaacctctgcctccggggtacaagcgattctcctgcctcagcctcccaagtagctgggattacaggtacctgccaccacacatggctaattttgtatttttagtagagacagggtttttactatgttggccaggctggtcttgaactcccctgacctcaagtgattggcctgtcttggccttccaaagtgctggaatttacaggcgtgagccaccatgcatggcctcaaatagtattttctaatagtattttgcacctttaaaatatt

SEQ ID NO: 393 - DNA, 377033 bp, Homo sapiens
taggttgcctgttcactctgatggtagtttcttttgctgtgcagaagctgtttagtttaattagaacccatttgtcaattttggcttctgttgccattgcttttggtgttttagacatgaagtccttgcccatgcctatgtcctgaatggtattgcctaggttttcttctagggtttttatggttttgtgtctaacatttaagtctttaatccatcttgaattaatttttgtatacgttttaaggaagggatccagtttcagttttctacatatggctagccagttttcccagcaccatttgttaaatagggaatcctttccccattgcttgtttttgtctggtttgtcaaagatcagatagttgtagatgtgtggtattatttctgagggctctgttctgttccattagtctgtatctctgttttggcactagtaccatgctgttttggttactgtagccttgtagtatagtttgaagtcaggtagcatgatgcctccagctttgttcttttggcttaggattgacttgtcaatgcaggctcttttttggttccatatgaactttaaagtagttttttccaattctgtgaagaaagtcattggtagcttgatggggggggatggcattgagtctataaattaccttgggcagtatggtcattttcacgagattagttcttcctatctatgagcatggaatgttcttccatttgtttgtgtcctcttttgtttcattgagcagtggtttgtagttctccttgaagaggtccttcacatcccttgtaagttggattcctaggtattttattctctttgaagcaattgtgaatgagagttcactcatgatttggctctcagtttgtctgttattggtgtataagaatgcttgtgatttttgcacgttgattttatatcctgagactttgctgaagttgcttattagcttaaggagattttgggctgagacgatggggttttctagatatgcaatcatgtcatctgcaaacagggacaattcaacttcctcttttcctaattgaataccctttatttccttctcctgcctgattgccctggccagaacttctaactcctattctatgttgaataggagtggtgagagagggcatccctgtcttgtgccagttttcaaagggaatgcttccagtttttgcccattcagtatgacattggctgtgggtttgttatagatagctcttattattttgagatacatcccatcaatacctaatttattgagagtttttagcacaaaaggctattgaattttgtcaaaggccttttctgcatctattaaaataatcatatggtttttgtctttggttctgtttatatgctggattatgtttattgatttgcatatgttgaaccagcatttcatcctattttcaactaatagtataacaactattccagtttgcctaggattgaggggatttcccaggacatgggactttcagtgcccaaactagaaaattctgggcacactgagattgtagccacactaggtaacaatgcatgctgtggcagagatggctcatgtcccccacacattgtaccacattcttttcccagactcccttgtatctaagtgtgaccatgtggctggttcttgtcaatggctatgatgtgagccgttatggagaagcaagctcttctttttctttgtgacctggacgtcaacacccaaggcagtcttggaaatagcatgtattgaagatgtcagagcctctgtggacccacgtttgtgagtgactgcctgtggccaaggacctcatcatctgccctaccaccatcatcatggggcttcgcaaaaacaagaaacaagcttttattgggttaaaccactgatatgtcaacagatgtttcaacagttggtgctgtcataattaatacatgtatccatccttttaatccatatttttactattttgattttatattattaaaagacagggagtttcaacataaaaaaatgaactaagtttatattagttaataaattcaattgatactatgaaagaacttcacctccatctgagagatgagaaaagtatgtctgttcaccccatttctcctacctattttagtctgggtcatcaccattttagtcctggtttattttcacagctgaagtcttctctatgtcggtacagccaacttactgcttccagaagtattcttctgaacactaccatttatctgcttagaatattttattctgtatcctatcacccacaggataaagaataaactcgttagtttctgttgaaagcaatgtacaagccatctgtatttttcactaccaccaataaaacatattggctagctctttgcactcccctaaactggctatttttcctccctgcagattacatgtcctcatacaagttggtgctttggtctgcgatgtgatctacatcttcatgtcatgtgactaacatttttctcatggactgactctccagcaacaccctgggcacacttctctcatgggatatgccacattacattgagcttatttacctataggggcagaacctatatcatattcttcttggttattcagttctgggcatatatatttgattgaactgaacttatagttcatgctatttctccctttggaatcttcttaagtctctcctccagccattcctctcccaaccctgctgtattctgtgactggtgagctactttttatctttcaagaacctacttatacaacaactcttttgtgaaaccttacttacctctcttctcccattttacttcgttgcaagcagttggagggaaacggccaggctattcacaattgtgccccatgatccaagcccagtctcaatgtatgcttgtgtgataaatgttattaactttcatttctagggccctctaaattttataaaattcatttatgtcaagtatcccttttgataaaacaagaccattataaaagtagggcaggtaggccaggcgtggtggctcacatctgtaattccagcactttgagaggccaaggagggtagatcacctgaggtcaggagtttgaaagcagcctggccaacatggtgaaacctcatctctgctacaaatacaaaaattagccaagtgtggtggcaggtgcctgtaatcccagctacacaggagcctgaggcaggagaattgcttgaacccgggatgtggaggttgcagtgagtggagatcttgccactgcacttcagcctaggtgacagagcaagactccatctagaaaaaaaaaaaattagccgggtgtggtggcaggtgcctgtaatcccagctatttgggaggctgaggcaggaaaattgcttgaacctgggaggcggaggttgcaatgagccgagatcgcgccactgcactccagcctgggcaaaagagcaagactctgtctcaaaaaaaaaaaaaaaaaaaaaaaagtagagcaggtaatattaaccttttttcaatgcataaagggattgagatttataaaaatagagctagccacgatcaagtttaaaagaaaggaatgtgggattcaaaacattattttttacttaaacggtattattattacttttttttactgtttacatagtgagacaattgccagagttccctggcaatggactttagaaatcctacctacctatgtgagatcacctcaagagttcagtattgtgtttcttacctccccaagcctatgctgatctgtaacttctctgtctgttggcagggacaggtgtttgatatgtatgaaaagaaagagctgtcatttgttaagttcctgggtactagagattttatgcttgttatgtaattcctacaaaaacaccttgctgtacttatcatctttcattaattcatgtggcatgttttgtaaattcttcagtagagagtgcacgtcttcagtcattatttgcattgaactgtaaataagagaaaatttttatttctgactctggtttcatatttggtattttaatcaaccacactacctaatacaagagagttttatggcctcttggacgtgagttatcacattcttgataatacacgtttgaaaaatttcttttattctcttcaccttttagaattcccattcttctcctagggaactaataagtaaccaaccaaatacagaaatgaaagaacatctggcccaatttgctcttcataaaagcagaaaagtattacttctctatcacaaagtgcaattattttttattcctgtgcacacttctatttcaaaagtgacgtttctttgcaggaagagtacttttggtataaacactgtattctcaggtaaaaaccaagctctaccaggggcaaaatgataaggggggaaaagcattctcctggaaatacataatcaatacgttgttcttgagtgtaccttctgccaagaggcagtttttgttttgggaagttgaggtactagggaaaagtagattttcactaacaacaacgaaaaaggcagaaaatttgaaataaaaaagcaagggcatttcaaagctattcaacattaggtaactaacggacgtcagtagacaggatgcaatagaagtaatgtgtgctgtgatcaaaattaccctataggtgaatcttttctggatatggaaggtcactttcactgtccatatgatgacgaaaggcccgacttcaaacaaagattaagtagaggactacttgcttggaaaatcttgagagatgagaggaattttagagtgacggaatcattgcattaaaaggctgcgaaaagccctagagagtatcccctagaattttgcttttcaaaccaataatggtcataagcccttagttagtcatgaaatccattcaacaacaacattaaaacatagaacagtaccaatatagcaaggtgcattgcatgaaataagattagatattgtttcatgaatattctctctctctgctctctttctctctctctctctctctctctctctctcacacacacacacacacacacacacacgattatttgatttaaaatgtatttctcacaatgagtcatattaggatgtttaaaaactactaccatagacctaaagcttcttaaaaataaggaagtatctgttttattaccactaaatgtcctatgccctagcacagtgcctcacccaaacaaggtattcaataagtatttgttgaatgactgctcttgttcacccctattatcttacagtcataatgtccagagaggtaaaatgtattttctaaagttataatttgggttaataatcaaatcagggattcttggtcctgagtcattttaaaatgctttcttctccacgcttcaaaaaattactggtataattgtcattgcattatcgacttaaacaattttcccttgattcgatcatttccagttccccctgggtctactcaccattgctgttccccttcgccttggaataactggctcagaacttgatatctgtcctcagaccacttgtcatcattcttttcatagtatccttcattttggcccctgtcgtgttgtcctaaacttctaactccacaacctagacatgcttatcattaactcataatttttctattcattttactcagttatgatcgtaccacactgatcattttgcattccgcttttttctactaatattttgaatgatggtgtgtttaatgacaatgaaatgcctgtagaaaaaagactcaaaaatagagtggcttttcagaagaccagtttggtaaaagaaattgagttgtagaaatcactatttttttttttttttgcaagagcaaagcagatggttgttgatatcagggtattgaaacccagtggctgttatatgtcagagtaacttacagtgaatgccaacaatcttcttttcctaattgctgctgctcaacatgatggcattgttcagtctggaatccctctccactccctctccagggataagcagctgacagctctaagggggcaggatggattcccatcagatagcaaggtggagtagttatgtgtgctggtgggggaaatgcactctctgctttgtatttgggtcttgttttggggactggtaacttcttcctgttttgataaatatataaataactctaagtatcaggagagacagtaacttaggcttcttaaagaacggagggtttttcataagaattaaacattttttaaaaaagaataaaggatttttactcagagatgaaaaatgtttgtttctcaaatgaaatgtcacattataattttaataaagggcatcagattagaagtaaggggttttgagtttaactcctggctctatctcctgtggatttgggacccatcactttctatgtttaaacctcagctttcatatctgcaaaatgaacgtttgacaagaccattggttctgaaccctgaataaacatcagaatcacctagataatttgcaagaataagctgatgcatgcgctccacttagagatattctgatttaattagattagaatggggtccagcatttggtatcaacactaagttgttcaggttattgcaatgtacagtaagggctagatgacctctagaggcctttgaagctctaatatactatgataattacagtgaaagcactattaggtattaggcagagcactttttagttgtggcagaaatacaatgcaaactagaataaggggaaaaatgaaatttagtggctcctaacttcagggctcccttttctccccagtttgaacttcgttttcttctgtggtttgatctgttttctccttgatgcagttcggatactgcatgtgctaaggaaagttggcagccctggattcacctccttcagattttccagtggaaaaaggagctggttcctgctaatatctgcatatcaactctagagaaatgctttgattggccttgcttggatagttccctttctttgtgaattgggttgtatgactgacagtcccattatacagcagtggtggaagtgtaccatccagatatccctttcagagaatctgctgtagggagcatagctgattgacagccttcagctgccacacttagggacccactctgtctttcacaccaggccatgttttcattgggctgctcccagccaatgactaagcacagtggggatactcaaacccagccattccagcctgatgtgggattccttagtgaattctcatgagttcaaggactttcccactggcctagctgagacactcttataacttcactgtagtctaaggtccttcctatccaatccctcctcccctttctgcttttacagatgtcaaactcacattgtagtctaaatgaagcttctccctgccttattcctgctctctttcttaacattcagaggtattttctccaataaataccttgttttctataactggcttgatgtctgcttcatagaggacctgagctggtgctgactaaaaccctatggcatggggatgagacagtttacctaaggaagggatgttaggtgtttaaaagaaaatacatgtccactataggctgcatctttgggtctctgcccagtatggatcattctgtagagaggatacagagcaagtaccaaggtatcgagcaactaggcaggtttcaagccttcagatgatttcttggagatgactgatacactcaagagtctgtgaggccactaagggtcaagacaagacatcaggtcttggtttgctgaagagtttattaagcagaattaatagtagctgcacagccagagttactacatgtgtcgctctgagctctccacagcatcagccatagagccacttgttttattaatattgtgctgtctatttgatgttttcacagaacattttatttattttttaactaaaaaatataggcttctactcacaatttggaattgataaaagctactatatataatcttaaaaataaatatatatattatataataaagaaatatatataataaatatatatgtatatacatacataagatgtattttttgattgttgtttaaagattctaatttttaagggcaactttatcaggatcaagaaatgagaggcttttagtggagaattcttcttaattctacttaagatttagcctcaaaatagcaaccctatgatcccattgatttttttggaggtgatccatttggcattcattcattctttttttcttttggtaaagttatttaaaagcctattgctaaagtactagtattcatgagaggagtttttaatttgattgtcttttataagctctacagtgcaagctacttatcagctcagacttccagctggcaacttgctgagagcgggatgaaaagggggtagtaccaagtcagtgaatttatgggtgaggaacagagatgtctggggcacatagtgattatctccacaggctagtttgggaggtcactagagtcaggggtgtggcccatcaggggccactggacatctctgcaaagtcactatgagttgaggaaatgggaatactgaagaaaaaattaggaagaatgaaggcagaagttttttattttgtgatttttccaagggcctggcttggactttgtctgccagtgtaggaaaatgtgcaagaggtacagtgacattctgagagaacaggtggtcacaaccccccactgcttctctctagccagaaggaggctaacatccagcccctggtgaggcccactcaattcactaggcagagtgtgatgatctgaggatctgtgccaatcctcctgcctggccaagctgtgagaccaactgttccttattttctaagctgcttctggactttgcttctttgtttaggaaatggatccaaatcgctctcctctggacttgcttgatccccaagcctgaagtcaagccagtattggctactatctattctctcagccacacattgaacaaccataataaccacaccacacatttatgggttcacgccttgttttcaaggggcttctacatactccacctgatttgatactagaaacaaagctctacattggattgggcaagtgtcatcacctatttgacaggcattaggcctgaagaaactgatataaagctagtgtcaaaaccaggagcccaacttcagcctcttcatctatggtccttctgtgatgcattcaaaggtgcattaacgcttggggagaaaaagtacattcccatctcctattgggcaaagcctaaactcctgtatgacttttatcttcaatcttcattctcaagtagccaaatgaaggaaagggtgccttaataaggtggggcccaagacccccaacttgttaggacaaatatatgaacttgtagtaggagcagatggccatgactgtgatttaacaggaggaacataagaaataggaataagaaaacctgaaggttaatcctgacttgttaattagctcttcaatatttattaacctcacttaacctctctgagctttgttctcttcttcctttaagcaggaaaaatgctactctgccacgtgtgccccatcaagttttaacaattgtttaaaattgtttaaaacaattaaatgaaactataaaataaaactgcctttaaaatgataaagcataattcaaatagaaaggtgttttttcagcattttaaattatttgcacataaaggggctaaacaaatatatggtaaaagatgaatgatttggctttttgaatactctacatcttcatgacttcttacaatcttttaccccctccaatcctttcttctttccagtttctcactgtttgatggtagattatcttctttatcttcaactgaatgccagatggacaggcacaatcttcaccctagaggtatgtgtatgtcgccaaaccctattcatagactctaatattaacaatcacaaccccctaccaagcactaaaacattgagagagtatttctgaaccaagtcccctgctgccttcattcttccccctacctaccagttgctaagaagttgttaccaagtttggtgaataattaaactcttggacatgacaggggaggagaattattgattcaaaggaccttagagctcaaaaggtcctgagagaccatcataaccaccctctttattttacagatacagcttctgaggatcacggggatgaaaggcatgaactgggctcacacagctagtaagtaaaagaatcgctaaaatctaaggtgctggatttaccagggcagtggtctttccagttgataattctgagagaaagctgtggggaaagaaagctgaaggagcccccgggattgtctgtacttgtggctttccatagatgggagagtgaatttcaaaaggtctgtctctggtatcctgccttcccagttatgaagatatgcctttgaaaacttcctcatcttagcagtgccttctagtgctatatcccattgaagttaactattccaggccttattatttttccgatttaaactttaggggattcagcatttagtgctcacctttttgttgttcatacactttttatgtgcaatttcattaaaaggtgaattccattgatgacttacctagcaagcttattgaggaaaatcctagactgttgatcccaactatgttgagtgatgtggaaacaatgagggtttctttaggtttgatcaacatggggcaggctgggagaaagctcagtggtcatatttctggtttctaagaatttgagtttttgagtgtgcaagttatcccagggaacatcttaaattgttttttggggagcttggacctctaatagcaattgtacttgcaaaatgtttctaaaagtacaggtgccgagcagacattcattcagaagtggccaggtatggtcaagaggtcaagggcagtccttttctcttgtgttcagggtgacttagtcaagattttctattacttattagataactttgatttctttttttgcaacataattcctagctcattgtagtacataaattgcacgaagaagaatcttcagacagaataagtggttgctttggaaatggggtaaatttagggtccaaaagaagattccaagtcataatcagatactttcccttagtcatggaaaagtgtaattttactgtaattccatgtttatggagtataatataaatgacaatatgattttatatttgtaatctcttttaagcatcctttgttttattaatttatatgaaagatatacttgagttcccattatgtccctgacattgttggtaaggattttatagatccagtgagggctacttagctaaatagggatgaacaaaagcttgaactcacagattcaatgatctttctgatctatcatgtgccaggtcttctaacttctgctataggcttcattcatcgggatttgtactacttactcatagcataaaacagtcaaatagatgcaaaaggaccaacttggatttgaatattatggagtaagcatgtggataattgcttatttttttcactttttaagcacttgtgtccatgctaagtatttgaacatcatatttcaggctattttgtctttttcctgaactggctgctcagctttgggaacaatgttgaccagagctattccagaccctccttagctcagatgtagtttattgattgactcctttatttgagtgtaccctggggcccagccccatgctaggccctggagatgggtcagagggctggtgtgagaaagcagtgcacaaacctcagttttcttttctctaaaattctaaaccctcatttccaaataataaagtttatttcacagagttcttctgtggatcaatcaatataaggctagcagatgcaccctaataaatgataacacatgagataaatcaaaggcagcattatgggtaattatgggtatattacaggataatataaaagacagtgcatgtagcatcctataatacatgcacactgatctctaagcttctgttgtgcaggagctgggtgttattcattgttgtattcttggcctcttcaacaggatctgacacatgaaatttgagaaaaaaatttagtgaagtgataaaaccaggaagtgtatagattttaaaggaaaagtacagaatataagttttatgaaactgcacagaaatggggaaattcagttccatggagagagatgcaattacttttgtgtagtattaatttaagaaagaactttctgaaactagaactaataaccatggaatgaattactacaagattgtcacaaatagaagtaagttttctactcgaaggtattcaaaagagaactggtgaatctacctatcagaaatgttttctactacatataacaaacctatgtgtgttctaccagatctcagaaaaataaaactaaacatgtgggtacttgaaaaagtttgtggaaaaatgaaattaaaagataaacttatttctcaaaataaattccatcaaggtcaagacacttttgtaagcaataatactggtcatttagttcatccctaaagaactgagagtcctgggaatttaaccaggccaatgcagtctttttcacattgttaactgaataaaaatgggtgccttccatagatttttttaagattcggaaacaaacagaagtcagaaggagccaaatcaggacggtaaggtggatacctaaaaatttcccatcaaaactctcctcatatttcccttgtttgatgagaagaatgagcaggagcattgtcctgatggagaaggactctctgggaaatctttcctgggtttttttctattaaagtttttgctaactttttcaaaacactctcataagtggatgttatcattgtttggctctccagaaagtcaacaagcaaaattccttgagtattcaaaaaaaaattgttgctatgatctttgcccttgaccaatctacttttattttgactagaccaattccatcttttggtagccattgctttgattgtcctttgtcttcaggattgtattggtaatgacatgtttcatcttctgttataactcttcaaagaaatgctttaggatcttgatcccacttatttaaaatttccattgaaagttctgctcttgtttgcagctgatctgagtgcaatgattttggcactcattgactggaaagtttctcacctttaatttttcagttacagtggtataagcagaatcaattgaggtgtctatggtgttggctattgtttctgctgtcaaatgtcagtcagttgggtcagggacaagattaattttttccttgaaaattgatgtgggtggtctgctgctgcaggcttcatcttcaacattgtcttcagcacagcttgtaagtggcagaaccaggatttgaagatatgccatgaaagccagcatctgtgtactcttaaccattacactatgtggtagagaagcaaactctcatgcttatctatcccttttctgagacatacgtgactgatgtgagcaaaccagagagtgtgtgcgccatccaaagaaggcaacagaccctcaattccaggcacttcttgccatgttggaatatatgtctagtgttgccagatcttctgaattttatatagcatcactcggttttaaatatgtcaattaagtagatatgttctttaactcatgtatgtatatgtgcatgcacacaaatatacatgtatatgtacattaaagcaaagttcacactgaaccaacatgtaagctatgtttggtttacctactctgcatttgtgaattctaactttactgaaaccaaataacaatctacattttctaacacacacatatacacacacacacacacatacagattagatgacttgttcaaggtgataacaattggttaactctgggcataagaagggcatagcttttgatctcactaccgtatctattctatacagtgtttatgtaaagaccaggtgaaaaaagcagcagctaacgagggagttgccagcccttcacatagaatgcatctcgacaaacctgtggtacattaaactggtaacagattcttttctgttcttgtcattgagagagggagtctaattcttctttcttggtgatttgcttgaccaacagaatgtggcagaataaaattctggcatttctgagattagtcgtaggaagtcttgtagcatcttgcctgaccaagtgtcagctctccacctgacagccacagctgagatcccagccatcagaaagactcaacagtcaggcatcccagcccaggcttcagggaagtaattgaagataccatattaaatgtgcatcctcctgcttcagctgtcccagccccttcaaccacccagttgaaccttttctaaattcctgacccacacaagtgtgagtcaaatcaaaattaaattttaaacaaatacagtttgggttagtttgttatacagtaatagataactagaccaattcctttaagcaatttacccaggaaaatgctccaaagccatcccctttaccttcgagttcttccagaggaatttcatttactgctgggacctcacataagtgtgggtgtgcagagaagtcatttttataaaagatgacttgggaggttccattttcatattgaatgcatttgtcaattggacacagctagcaggtagaaaccttcagacaaaggaggtgagtgacatatgagtgtatgtccttgcccataggatttatcactccctctctgtggacctttggaagacaagtagagttggaaggatgaaaggagtctctgtaatgactctgggccttcttaggattccacctggattcacagtgttgattagaagtgatgcctgtggaaaaagagagcaaagtgtgggccctgggttgctgtgtctgatggctgagacttgtgtatgctccaggtagtgacatttctggccttagagacggcttttcatcttcatctcattgcaagtgggtgccagaggctgaggatattaaaatgaacaaatatgctctattcctcaaaaagctacagactatatacttttataaatacaaatgtatacaattaatttattacttgggctgagccttacagagtataaacaggaaatggctttatttttctctgattatttccttcaatgtgctttatctcttttcattttctttccttgcagtttgatgacatcttgggcagattccataagtgttcaatccttttaaccactttttgacaatatagagtccattccaggtttaaaaagccaaattctgactttttttaaaccctcaagctcatgtttaatttaaagcttttttccttccttcagattgcacctcggagaccagagtggggtccaatatggtctgtcctcaatcttccttcactttctcccacttctgcttcatattcctttaagttctgccctgtgggaggtgggaaggggtgtgaggaaacagacattggaagaataaaggaaacaatgactcacatggctaatggcttgtaatacaggcatctgtgttcctggctctagcaagtgttcagatactatggtaagctgttcatagggttttcctgcacaacaccctaccctcaacatgtggatttctgaagtgcagtttcctgacacaggtggcacattttcttgctgatccttttgaatctccttctagcccctgcccctctgagatcaatccgagacacggagccctcttgggtaggatctcatttagttgtcttaagcttagccattctctacccattgagccatgcactgggtccagaggaaattcacatatattcttcaagcccaacactgctcttctgcttcctgctgctcctccctgccatcttggagtgctctggcaaccctatgctgccagagtcttgccagtgggaagcaggctccattctttctgtcacatatacccccaaattcaagctctcccacaatcacttactgtatgcttcactggaatgccgagctgccatggggcctgtggttcatggcataataaacattcctctgggggctgggcctccagcctccctttcttgcagacatccccaggatctacaaaggatgctcttcaagcttcttccccagctttttggttgagaaaagccaagaactttcaattcctccctgagcctcctctcacatttctagtgtctttcacacagcctggaggatgtagtggtcttcagcttctctttctttagaatgtgtgaggactctattgccctcagtttttgcccagattctaggacaatttcattaaatacaaatgattttgaaccatgttggtaattgttgaaatggagccatgccactgaacagattcagccggagaaagagcaggaatacctcaggcagccaggcatggcagagactgggctctaggagaacaaatggaggttcatcaggaaggagagtgagggagaacactgggcagagacatgagaacatgcttgatgacaaaaaagggcttggtgaactcaaagcacagcacagtggccggtcatctgcagggagaagggagtcaagactgcagaggcagcttggaggcagaacagggaagtagggctgctgaagagcttcttggaggggaagggggtgaagttgttttctagtcagaaggggccaagggagagaatcaggaacaacaattaagaggcactgggtcccccaggtaatctcatttacctttaaaatgttaccctcttacatattccttaggttactcagttgtcttgtgttcccaaatctctttgccttctggaaggttaacagccactggtaaatggatggcaaaggatttatttgatagtcgtggaacagggtcacatggccacagtctatttttagccacctcagtaagactgaatgaagtaagatgtatgaaagtgttctataacattctaaccttagaaaacatagggaacacttattgttaagcagttaatgtttgtgcaagtcatttggcaattaattatgaattacctgtgacatttcttctctagttttctggaattgttatttaagtctataaatccacttgcctcatccctcagggctctgcttctctgtttccaaggtgacagctagctagcaggtggattaacccatgctaatctgttagttgctaccaaaggaggcaatgctgagtgatggcatgcattttaagcctagtaatgttcagatttctttttaaataaaaaaaattatttcagatccaaagtattgacctggataattattaattataatattaattatataggtatgtagaccatttgggtgtgtcagatatgtaccattactttgtgtactttcattcagattgaataagattgagacttcatcctctcatcaggctcgcaggaatattaatctagttatttgagggttccctgaatctcagctgacacatccactaaaggttgtccaaaggtcttgggaggggggtctggggcagtgccaaagcatgtaggccattggcgcgttaattatcagtgacacaaccttatccacgcttcagggcaacttaaagtctgctattctgatctctttaggacatgcttgaggctcaggaattgaaatctaaaatctctaggatccagtttcctaaggtgaagtaagcagcactttatccatctcctaagcttgtcctgagagggagtaggatgtggaggcaccctcagatattctcctttgagacctgggtaaatctgccatccctttctctacttcttctcttactagcaacaatcattgcctttttttctctctttttggtgtacttagcatatatcctccatcagcgaagcattcacaaaaagccctgtgtgatatgttcctccagtagttttggttgtgaccgtacaaattctcctgatattagagaacataggtaactgactacctactggaatgaaagaggggaatgatgcagaccccaaattcatcctaacatctcaatcaattctcctacccatatatagacataaaagtggatataacttttcaaatgactctaaatcttcacagaacaataaacataatcattattcattaaataaaaatatacaacccaataaaatttatattaacaatattactcacatgtgatgatgatatttgtgaaggaaaatcattgttccttacatcaatatagctctgattattattgcatggcccttttgaggtaagcatgggtgtactattatgaattgtgtgatgatgacttgattttcccacagttcttctgcttcagctactttgacctttttttatatgtaccatcacctgtgatgcggtttagattttacattgtgccaaagtcattattttcacaataaacatactgtactctatttaaattattctgggacaattaaggtagtactaattggtataggatccatcaccaatacaaacataggcttggacatggaaattgtgggctattgtttgaattaagacaagtccatatacactcatcttttctataataccgttgaaatgcaaatggaaaagtaagaattttttgggttgaatgtttggaacctcaggcatgtatttttggaactccagggcccatggaagccagtttggaaacactgcttcagttgcttaagtatgacctctggagtcagatggagctaaatttgaactccacctcagtttctacatttgtagcataaatatggtaatattatcttcagtattagtttcctattgcttctataagaaattgctacaaactgggtggcttagaacaagaaacaattattacctcacacttccagaggctaaaagtctaaaaattaggagttggtagggccatgctctctctgaagtcactgggaaagaatctgctcaggcatctcctagcttctggtagcctcaggcattccttggcttgcagatgcatcactctgatcctctgtcttcaactggtggtcttcctgtgtcttcatatcatcttttctctatgtgtgtctgtctctgtatcaaatttccccttttaataagggcaccagttatattggattagagcccacactaatgacttcatttcatcttgattacctttataaagactcttatttcctaataaggccagattctgggatactaggggttaggacttcaaaatatctttgttgggaggaggcacaattcaatccataacacctttctttggtgttctgagcaatagagataatggatcaaaattgccaggctcattttaaatgctcagtaaggagtcatcagtatgttcataacagaatggttcattgcccctttcagatacatatgtcatggtcatatttacatttggcattccaactgtagttcagaatttctggcattgcaatgtgtcaatgagagaaaggccctttgctgtagaccaaattccactaaaatgtttacgtacgctcaaggctaaggctgtcagatttctttgtttactgtgttaattttcaaaaatcactttggaccagactctgagtcttttgatcacatttactgctttatcttctttgtctaacagctgcttagtgcatactcagcccctcagtccttccaagtttaggctgagtttcttttgtttgaaagaagcaggctgctatgtattttttctttctctttacttttttttcagttgaattttggggctgagcctgactctcccacaatgaagaaaattaatgccaagctagaggcagtgataaagaggaacatctcagagagaggactttgaagggaaggggatgtgtgtgatgtgctgtcatgggcatggctaactgcatgaaaagaccttaaaagtctctgcattccaatactgagttatcatattccatgcagattagattgccaaagagaatctgaacggtggcttttgcctcatggacataaaaggtttgtttttttttttttgagtctcacgtccattagagcaaggaatggaacctggctcatcaggctggctgaggttttttatgtggtggagggagagcgggagaccagctttatagagtgccctatcaggtagatacacatttgacacaagaacgctgagttatcaagttttctccaagggcaatcatatatcttgggaatccagagccaaattatatttgacatttcatttaaagcctgagacatcttgatgttaaaccagagtctaagagtgctaaagcaggagtccattcaatttgacagagcggatgtttctattcctatctcacctgcatgggtaatagacaaatcctgatacttcttccttatttcatccagatgaaaatcactgagttagctccctgccgaaatgatactagctcaaagttattttctcttcacatccctgtgcaatgtgaaaagagtgtatcaggagtcatttggaagttgaatggtggctggtcttatttatgcagtgggtaacaaagttatgtttacttggcttatgttccagattgaagaggtatgggaagcttgtgtgtgggtggaagatacgtaggcacaatactcatcaagtgacatacccttcagatgtattgggtggggctgggggcttggaaaactgcctttaactcaggttgctgcaatttccatctctttccttttcatgagaattttatacttgtccatgaggatgtaggaaggaggacagggaggaaaaaaacaggcaaaaggaaggctagtttagcccagtattttccagagactgtgcaaataaatatcgtctaaaaataagaaaaaattatattatgttagcataatggtatatgtatataattcatagagaatgaaacgtacatatgtttagaagcaatgctcaatttgtatttattttctttttttacttaggagagtacatgactaaaaatgtctggagataaccagtccatggtttttactggttagtatgtttaattagtcccttaggaagttacaaaaacagtgagtccaccttatagtcagtaattattttatgaatttttaatatgtaaatagttctgtgctaaactttgcaatagaaacaaagaagtgtaaatgatggcccttgtcttcaaggcactcccataatggggaagaataagaagactgttgaattccaagttagttgatgtgggctgggatcatgcatccgtattttcatgccaagttgagatgtgtcgagcttcaccaagtagcgtgggatacttagcgaagggatggagaacaattggtggagtaaaggaataagggactgagtgaaaaaaaaaacaatgaaaaagtgctctggcagacttcaagctgaaggagaactcacaatggattgggctgtagtggtcgcagaggaatgaaaagaaagaagaaaaccatacaagctgtgagttcctactttatttgcaaacttctataagtgcagccagtttctctttcaggggtcccaaataggtcctctggccaaaaaaggcccctccaaggatacaacagatgcattgaaccccagacactatctattagcgtacctccctgctccaaaatatatgttttgcctcattatcatctctctttaaaaaatatcaccataatattacaaccaaatgttatagcattggtggaggtgccttagaaaattttagataaatgaaaaaaaagcatattctcatattctcaacatccagaagctgccaccattagcaccttgttgaatatccaccttagcatatttacaacattttacatcaaaatggagcatactatgcacactgtttcgtaacctgctcctttttctagtaatgatggctacctttccatttaattatattgtaaactcatcaaatattctcccagatgacattcacatgacttgtgcagttggtttctcctgtatcaatctaggaccacattgagccaggttgtaatgtcacttaagcagtgacatgttgcagctggcttatacctcatacaagactcagttgttaagctttcaggaattttaggagtgggttgaggtcacattggcagcttgaaagtgccacggtggaagtatttacaatatggaaatcagcaaatattgcaaatcaaagcctcgtcatcactccaaattggttgtgaaacattactaacacatctttgcccctatttgccactagtctcttttaatccagaagagcagaagaacacccccttgcttctttgttccttttttttttttttttttttttgagatggagtctcgctctgttgcccaggctggagtgcagtggtgcaatctcagctcactgcaacctctgccgcccaggttcaagcgactcttgtgccttagcctccagagtagctgggactactagcacgcgacaccatgcccagctaattttttgtattttttagtagagagagggttttgccatgttggccaggctggtctcaaattcctggccataagtgatctgcctaccttggcctcccaaactgctaggattataggtgtgagccacagtgcccagcctcatttttttcttttatggcactgacttgttaatgagaatagatcagttgtcctatgaatgtactatcttctgtatctggcttgtggtgtcatttagctcataagtttcttatattttacatgtgtcccatatcctagaaattatgtcgaaaggcttaatgcattcaaattaaacatttctggctgattttaattgattttagatatatgggattgtagtacactggaagacacataatatttcattgacccatcattaatgatactaacattgaccttggattactgtaatgacaattcactcctccattgaagaataacacttttcttttgggaccagaaagtaatctgtgtagtattaatttgcactatatcaaagtattactgtgcaaaccagtcacctagttgttgtgacaccaattgattatccttgcttgaagcagttaatttaattagagtttctaaaatgttttaaaatcccaccactctttcttcatttatcggccaggatttctatgtaaaaaaggtttcttcaccaggtgggcaaatttgttaccctgaaacccagttactagcagaaaggcagaaaataaaagatcagttctttcactttatttcccagttttcaaagagttgttttaatacccacctcaaatggtgacgaatgaggtttctatgactttcttttaaaaatatcattatggactcattgacttttcattgattcaatctgtttcaatccactaaactcattattctttttgaggttcagattgtcacaactttgacctatggtcggctccacactggctcctggtctgtttgtcacagccccatttgtctttgcaggcttccttgctttccagtgcgagaagtcctaagcttacattgctcttattctgccccagacttgaaattaaccatttctctgaggagccttgtgtgtgtgtgtttttcttttcccccatgggaatggtaatagggccatacctggatatgaagaatattaattgctattgaggttacattgcttcaaggacattccaggctctttaaatatatatttgaaaaatcatgacatcatatttataatttaactaaaatattaacatttgagtgtttttactttttaaaattttatgtttctatcccattttttgcactgaaagttttgatacctaatatcattaaaataattatttgttttcatatttattattaaaaatattttgaaaatgttaatattaattttacaacaagcaatacaattactgaggcagtttaattgtttctgtgtgtggttatttttgccttagaatatctcataccacatactgacaatcaaattactgcatttttgagttctttgaatgaaataattttgctgttaccaatttgatatacagttaggttcttttagttcaatttgttttcaacttgagaagttattttcctaatataattttcttgaaaaagttaatatatttacataatcaaaaggtcaaaacaatacaaaatgcatgcacataaatattttgctttcattatttcccccttgccaatttgtggaacaattcaataattactttcttgtttatcattctagtcttttgtttacataaatatagtttttcatatcctatgtatactattctgtgtcttgctgttggttattttaagatagctattgtgattttgctgtatcagtacataaatattattctcactttaaaaatctttgcaaacactctttcttgagggtgcaccgtaactatttaacctgtctcatcttgctggataattagattcttcccagtattcccttattacagtgaacaatcatgtataaatgccatttcaccttttttgcaggtgtatatgtggtatagtgtcctagaagtggaattgcagggtgaaaaaaaatccacttgtcattttgttaggtattgctaaattctcttcctcagaagtggtatcattgtccaacctcaccagcgatataaaaccatgcactgcagtatctataatctagtacttcaactacagaatgtattgtgaaattttaggtaaaaaaatagtatcttgttagagctttcatttgcatttcttttagtgtatgtgtgatattgaaagtcttctcctatttttaagggaaacttgtaatttgctgttgctatctgttgcctcttctctattggatggttggtttctctcctctagatttctaggaactttgtataattatcttagctctttgtctacaatgtaggctgcactttttttctgtctgtcatttctcttggctgtcagtgatgctttttaccaaacaaaagtttttatttttatgtgttcacatttgtcattcttttctcttgtggcatctgggttttcagttatagttagagaaaccttctctgctctaaagttttacaggcattttctgttttttcctggtatttacataatttcatttcatttgcatttagatatttgattcatttagcttgttattttccatctgttttcaaagcccttgacactttcctctcacagtgatatttttcactgatttttatggtaccctaagttatggctcactcttttatactttagttcctctatacctctgcttacatagttctcctctagtacaccccttttctctgtgcctttcaaaatcctactttttcttggctctaagcaagtcatgtcttcattgatgatgtcgttgactgctataaccaacgtttgcctctgtatcctctgaagtttctataacatttacccactggcatccatggcatgatggaagatttactgctttgtatttttagttgatgcctatatgagatacctaacaattaaatggtaagccagctgaaatcaggaatcacattttatttttctatgcacccccttcacctcctgaaaagccacctgcctctgtgtcctatccaagacctctggccatttgaagcatctcattccaaaaaagcaaagacattctctctcaggcctttctagttggctgagaagttaactgtcactcctactttgtgtagaggaaaattttactaaataaatatttggtgccatttattattgtgaacagaaaaggatataaacataatgcgtgaaaaatcacaaccagtagttctgatttccccatgaaggccattgctgctggacaaaccatgggaccaagatctctcctctgagacagaaaaacacaaggccagaccagattttctgctgattgggcaactccagaatgtacttcctcaaaaaaatgactccatacaaaggtattcatttttactctatttagagcccatcactgtctagtacctcagacagcaacccaagcagggaagcagtcagctgtttattggctgtggttggtagacttgggtctatcacaggtggagagagaataaaagcagaaggggagttgggaaagcaaaaacccaccctattgcttgggagaaatcacaacagagccagagacaaggcaaaggggaaaaggccagatttatgccaggtggtaagaagggcacgtttggggctggataatgtttgctcagcttacactggatagctgccttccttcttaggggctacaattttcttcaacaactgactcttccttactcagcatgacaaggtgcagacctgtctgtgctgtagtgagcctgcaaatgagaaagaccagccttccttagacaatttcagggacttctccaaaggggtctgatgacccaggaggggatgatgagttcaggctttgtatcctgtatagaaggaggctgatgattgctatcactgaagttgttgcttatgattgggtcctgaagagttttgttcttaattggtgaaaatttgctcttacatggtagaagaatacaaagttcatagctgtttttatttataacttcattcattcatttattcaatatacaattatggactgtctactactttctagcaacttagtctcgaatatgtaaagcaaaagaagatataatcttttttcaaggatctttttgtatagagcaatggtccaccagttgctatttttttttaaatctcacgcatgagcactaaacactttccaatgcatatcctaattattctcagtttgtctttttatgagacaagttcttgctgttttccaggctgatcttgaactcccaggtccatgcaatccttccacctcatgctttcaagtagctgatattacaggcacatgccactgcaccctgctcttcttagttatttacaacaacatattttactatcctaatataaatgttataaaacttacacaaaagcaaacattacaaaggggttataaaaatacaaattgaagttttaatatctttctctcttagaatggttttgtgaaaattactaaagacaacacaaatacaatatggactattaaaacctgttgcacatccaagcataaattaggccagttaaaacagaatttgtcaagggtctcgttacttgttttaccctacctaggcaccagaaaatcatgcttccaatgtcaccatggggttgtctagctcaaccaaaccaaagggaccttttctttttaaaaataagacttatgagggcaataaaatattctttgggagagaaaggagtgataatatgcaacgtataccacctagttaaaggaaaaaagtcctgaaactggaccccagttcattcaccataaagaactggggctgactgaagtgatgtggctaaggggccagtttggatcccggcttcattttcttctggttgctccacagggttcttttctctaaagttggatgctaactatcttactcttgggtaatggcactattactaaggtatagtctatgcttaaacatttacccaaaacaaaggcgttatatatctaacttctattagctgttatttgtgtaagagtttctgccactccagtggtctctgagcttagctgcttctagctatgtgaaattgcgacattctgtgacctgggtcttcttggtgaagtcatttctgtatgaattgtggtggttgagggttcaggtggtgtgatcaactccattttgtagaaagacttacttcccttttgaagtcctggttgaaaatgagttccctcattgtgcaaaacataagcaacgtgacattccctgcaaacatttaaaaaattcattattttttacatttaattttaaaattgatacataatagatgtacatatttactatcagggtcctgtagaaattattaaacatctccatgggaatagtgaattacaacgctacattcatcacacatgttcaatattttgtaggcaacaataagataatagtatcagtgctgaatgtgacatgtaaactattttaccttcaggcttactaccctaagttcaaaggaaaatttaaatgaaatatttttcaagtgttccacaggaaactcattttagaagatgcttgcaaatcatttacaaatattttaaaaatatctcactccagttctcagcattttactttgcaatatcaatatacttagcaaaactcccctcacagacagcttagaaaaagacctcagcctgagtcagaattattcaggtttcaaatggtacagtccaaattactgatgcctcagttcactttaagactggtttaaggttaagttaaaccaagaggaagtcatgtttggtggtgagacccttctgtgggcaagagatagcctctgatggagagtgttggcaggtgctctgttctctctttatggtcctacttagctcgctctgtgtgatttcccatttgcaatattaacataatatcatgcacatacatatatttatagagtgcctcctttccaaggaggaaatacattaagattaagccaaatattttcatttccccaaccacattgtaaacaaaacaattgatttccttacctctggggtggaaagcctcagttgtctccaagctaccaaactatactgaagataaaagtgactgaaattatggcattgttttgaacaacagataaactgacacagccttaatacaacttttggcattactgaaaacgaatttggaaacttgatgttttattagggagcatttggtcatccatatggtattaaacagcagagaagcagtgccttcattgagatgatcctcatgactcattctttgcagcagtgtccaagaatacttattggttattaattgggtattgtgtgatgcatatatatgtcctgaacactctgcacctgcatcttcccttatagtcctttaatatttgcactttatgtttgagtgattattttattaatgtctatattccctcaggctaccatgaatgcttcatgaatgcagagagtacttctgatttataccctgtctctgtacaaggactggcaaatagtaatgctaaatccatatttgtagaaggaaggaaggaatgagggagggagaaggaaggaaggaaagaaggaaggaagggaggaaggaaggaacaaaggaaggaagggagggaggaaggaaggaacaaaggaaggaaggaagaaaggaaggaaggaagatgagatagaaatgagagagagagagagacagagtgggggggggagagagagagagagagagagagatgggatttggaaatagcccaaatgttctgatgtttcattgtttatctgattattttctcaccatatatagctagtagtcatctggcttcatacttccttgggaaggacagcagggccagacctgccaaatgtttaattgcagctcactgtaaaaagaattaacactccagtaaaaatggacccacaagcaagctgctcagatcattgtagatcctgaatttcagatctgtgaggaacttggatgcttatcgcatcctcattttggccttgaggaaattgaagctcataaaggctaggtaacttgctgaaggtcacacagctggtggcaggacagtgttacctctatttcatgctgcttcttggatagactgcagacaaaacatgtaccaaactttaatttctattgctctcagtgctggggggatgccagagttcttgcttcacaacaagtgttcagaagcagaataattgaggaacatcacagcaggctctgggaggaatttgtggccagtcatatgaaatttgagtgtctggctgaaactgactctagtcaatcactggctgtgtctctggctattgagaaggaggtagtggatttttggggtattgctttagttgctattacagggtgatattttgaacaaagacaccttttttttttttcaaatctctatttctggtaaagttaaattcagcacttgatttgtagtattcagcaccagggaaagattagtaacttctcccttaaaacctagatgtggttcccagccctagtatttaatatactgcaggccatgtaggccattcatcttaattatgtaattattaaaaagattctgatattgtctacttatcaaagatctctagaatacataccacacccctctgattaggggtgattagagaaatacctgagaccaaactattttcacatttccttctctattgattgtccaaaaggtgattattgtggctgctcagcaggctgttctcattagggctccattgattgtgagctggttatggttccaaatgccaggccaagtgtgttgctttgaatttgtagtgtgaggcactccgataagataaagaaaaattaaggccagcattttagtctccaagttctggttaaattgttacaccttcatacagctttcccagattcctgccccaaagaaacaacattaattagtcttttcagctatgcagtctttggaagcaatactcttgatttattgaaggctgcattattaaaattatctgctgtgtctgtccttaataaggtcaaagaaggaatctatgaacgctgattcatcacaaaggctctggggatgcacatcattgagaaagccaattttattttccctactgcaagacaaaaccggatcgcaactttccttgcttatcgggaaggcaaagcccgaatccactattaatttggagaaagacctaatcagtacatctggccttctttgtggaggattcctcatgaccaggctgcatatatagtatggagtggtgagggagggttttaactgtctaagtgaatgataattcctctcaggagatgcttgttggaatagatttccctccatgatctcagcctacatttctttaatagttattaatgccactgtatcagcaatcctgttctcttgccatgataaaatctccccgaagagaattgctattgtgtacatttagtaggattgaggaagacaagatgcaggggaagagaactgattttccctctttcagtagaaggcattgatggggacatcagtgtgtcgtgtatcacacaatctgtaaattacttcaaaattgcatgggatgttctccataataccctcacaacgtaaagtctcccagcttgacctatttggcttaatttgtgctttctgcaaaagagtttattttttctttccagtgaaaaattgtagttctggaattttgggggcagccagcataagaaaataaaatcgtgtttggccttgtattgcaccaaacatatagtaagtcacctgtgaatatttgctgaattgtggatacaatgacaagataaaaaggtacaatttcccatgagttcatttcaatacagttcccatttacaaaaagcaattagagctttgtcttcaacataatatatttattaaataaatgtaactgtgtaatcatggaatctaagcacaggaggatttccaagcttcacctcacatcaaatgcaggcatcatatagcctctaggccttgggttatgtcagggatttttgcttttcacttagacttgcagttgtctttcttagaagatatgaaacatgttggtcccacctctagccaagtaaaaacaggtatgtgaataaaatgactatcaaaacaggttcttttcaaagcgttggaaatattggatttctcttggctgtgaatgtagtgggagtcttgatgtcttcgtcatattggggagctttttattcagcatactaaaaacatgtatctagcaatttctagagggtgccaggacttttcttggggttagagtaatgaagatgattatacaatggcctctatccagttgacgcaactgattagattagctaaatgttacagggcacggtggtataaaaaaattcctggaagacggaagattttattcaccacataagcagtcatggggtaggtgttccacaactagttggatgtgtcaaggcacagcatcctacaaaaacatagtctgttttgaaaaattcagtctgcctgaaggtgggtggctggagaaaaacttgagaagttaggagggaccacatcacccaatacctggttaaccaactaggagagatttaatgactacctgtatagccagcaggaacatttaatgtggggtacaagatcacctttgttctttaggaagtttgtagtcattcataaatccaaaggaaaaagcaaaaattcaggccatgttatgcctcacatgtaaaatagcctgctatccagccctgggcattgcattattccagtaagggctaatgttgtatattcttctcaactatttcaataaaaaatgtggaggatacattccagttgaaagatcacttatttgaattttaccttttagtgccaagattgcagggaaaaatatcatttgtgagcctctcggaaggttggctgatctgcagataggataaaatatcctgcatgtactctccatttgatttgtaatttacatagcatctctttgttcatcaaggaacaccctgcatgacttcctgacactgacctggattttacttatggctgccctaaattgtgttatcatggtgtaccggttgttcagtattcagccttgctcctctgtaacttaatattatgatttatttctgacttggcttttctttatcgaatgctgactttttctaagaggttcatgtggaaatgtgctacatgaaaaaaaaaaaaggagcacagtttggcctcagggcaaaaacatgaatactgacccagggacatgaatacagggcagaagagagagtggcacaggcaacaaaattaactcatttctttgccttttgtgtgttcctaagtgtgtggagtgactcaaattttagcacagaaagtaaagttagaaagcaactgctatttgccaacaacccattctttaattctcaaagatcaaaaatttgcttgaaaactgacattttcattttctcctggcccagtgaacaaagttttaaggttatgtggtcgctctgataccacctaagaagcaaatatttcttgcagtctacttctagatgtgaatgaactgaaagtaaatgactcagagatggagtaaatgtcccttgaaatacacccaaacttaataattaggagaagagtgcttgaataaacacatttagagtgttattgagcatatacaagcttagatggtccatatttctaaaagacagtgagtctatagcacattcttcggagatgagaaaattatgccataaataaaatttgtagtggaggcatttgttttatcattcagttaagtagcaggaattctttcatacctagagggacttaggtaaaactaataaacagacatacttaacaacaagaacaacaacaacaaaaataaagcattaccattcaagagtgtgaaatcacttctctgagagcctttttggattgaatattctttttgggctggtaatgtcaaactaaaactttacctaaacacagataactaggtggctcttagcatacctttcagggcttatggtctccaattattccactcacatccccctatacatttccaaatcacctctttcagtgtctccagtgtttaaacatgaactggatagagtgttgcatggtagtattaaataaaatttagcttaaagctgtttccttacatattataagttctgtctaaaggtttctacgtgcatagtatacatgtcattgaaagtgtaaatggactataacctactctgataccaatcactgagttgtggccaatcaaaggtggccaactgctcaaaccacattcaaatatggcaaatgctgagctgtaaccaatcccgttgtttctgtacctcatttctgttttctctctgtcacttttctttttctttccataaatcttcttcaaccacctggcagtgccagagtttctctgaacccattctggcttgggggatgcctgattcatgaatcattctttgctcaattaaactctgtttaatttaatttgtctaaggtttttcttttaacagtagagataggagtacaacacactttgaggtgtacaggagtgagttcaaatcctagctctgttattggcttgatttctcatcttgagcaaggtacttagtttctctgagccttagtttctgcacttgtaaatgtggagaagtgaaacaccagacttgagaggatgctctgctatctgaacgaggtaatgggaaaatgctcggccagtgttgtaactcaatcttcttatccaacagtgagccccttgggcacccagacccagactcgcccttctagtctcacgtcttgcactctctggcacatctcatgtaggctctgttgcctgtcatgttttccagtccacaaatacccttggcatgctctcatgtctgtacttggtccacattattctaacgtgaatacatgaaacttctaatgacagtgcaatctttctagacaatctctgaaggagaaatgttactagtctgtggtgaatataaaaataggctcatagggaaaaaaaactgtgattgaaggtataattctgcattttcttgggatatacataaatagcaagtagtcattttttacttaaaaaaaaaaaaagaaatctacagaaagaaaatttagctgtctttctgttgctaaccttccaggaggccttggttctcctttaaggttgaagttcgtttgtgacaggttagtgctgctcatttttgtggctttccagaagccaccgtggaaaaggcagaagtcttcccctcccattatgctgagtcagacatggcatctacatgactcatcaccaagtggttctccagaattcactttgcttgcttttccccaatccagataatcctcgggactggtagccacccaactcactcctgcacactgttcttcctctttggaggcacccaccatgcctgtctgatgctgcccctcaaggtcacatcggagtctcctgtacctaccttgtctgtggctacccaactctatacaatttctgaagctttcataacacccagatggtctataatgtaatatgtgtttagataatcctcaggccaaaacatctttccaaaatttaactgtaaatctgtcacttccatgggttatgttagtcttttccatgttcaaatggctatctgagctcctggggagggggaagtcactcccggagttctctttccatcattcatagtgtgaatctcaccttgggctgggaggaatttgtgatgggcatacaagtgagaaaaagggtgcaaaggggtgagatggtatgttagtcagggttctctagagggacagaattaataggatagatgtatatacaaaggggaatgtattaaggagtattaactcacgagatcacaaggtaaggttgcataataggccatctgcaacctgaggagcaaggaagccagtccaagtcccaaagctgaaggaccttgagtccaatgtttgagggcaggaagcatccagcatatgggagaaagatgtaggcttggaggctaagccagtctaatctttttttttttttttgagatggagttgccctctgtcacccaggctggagtgcagtggcgtgatctcagctcactgcaacctccgcctccgcctcgcagtacctgagattacaggtgcatgccaacacggctaattcttgtatttttagtagatacagggtttcaccatgttggccagttggtctggaacgaactcctgacctcaagtgatccgcccacctcagcctccgaaagttctgcgattacaggtgtgagccactgtgcctggccaagcctaatctttccacgttcttctgcttgcttttattctagttacactgtcagctggttagatggtgccctcccagattgaaggtagatctgcgtttcccagtccactgactcaaatgttaatctcctttggcaacgccttcacagacacacccagaatcaatacattgcacccttcaatccaatcaagttgacatccagtagtaaccatcacagatggctaatacgggagatattcatgaagggtctgggaaggggatttggaagagatatggacacaaaggaaggaggaaagaaaaggggaagtgagacgggaaccaaaccaaacaccctgtattgcacaattgagcctggagttggcctgctcgccacagagcagtcacaggttttcaggatgctttagtgatagcagccatcagtacctctcattaggagcaaaagccctgattggtaatagtatattctacttatttagagaataaaagttccctgttagaaccagccttctcagaatggcattcagcttttcagaaaagcacagcaccagcatatttcttatctgccttgaaggttataataaatcccttcttctgttaattcataaatccttcagccacatgccattttggggccatatgctttctttcctccctctaacccttggaaagatctttcatatccaatctctgtagataatctgaatgtgaaatcaggtatggttatctaatccctctaatcagaaggtcagcagttacctgcagcttttccatctgtcctccagctgaatgctgccatttagtaaatcaaaaattggttacaaattagcaaagctgactggctcaatgaaatctagcctggagtctttgctggaaggggggaagtttaaatatggtttgaagggagatttgaggtgaactctatttatcaaagccgtggagtagcagcataaaagatgagagatgttctcctgggtaaaaatgtcaaatcacatgggaaatgggaatatttcacatggtgattactgaattttacaattgttcgcaaattgattcagcccagaaatcaactgggaagtctcccacaggtgtctagcactctgcaggtattagcgtgatacagggtaagtctcaaagtacaaaaaaaaacacacatgtgaaacaatttgcaaacaatgaagtgctaacctgtgtggtgtgaattacagatgcattaggacaccagaaaaggaagaaaagacagtggcagctgaagacatttcaggaatgcttcactgagaacctaagtcttgttctgggccataaagaaaaggggagggtgtggtttctataccagagataagaaaggagaaaattggacgtggaggaaagatatgagtaccaatccgagcgaacaaggaagagtgagtaaatctgtccagctggagttggaggtacattctggaaaatggtgagagaggctgtgtagggtagggggacacggaaagatgggccaagacatttggagctgatatttgatatggtttggctgtgcccccacccaaatctcatcttaaattgtaatccccataatccccacgtgtcgagggagggacccggtgggaagtgattggatcatgggggcagttttccccatggaattctcgtgatagtgagtgagttctcacgagatctcatggttttacaagcgtctggtatttcacctgattgcacttctctcttctgcctcctagtgaaaaaggtgcctgcttctccttctgccatgattataagtttcctgaggcttccccagccatgcgtaactgtaagtcaattaaacctcctttgtttataaattacccagtctcagatagtatccttatcgcagtgtgagaatggactaatacaatatttaaatcaaagggactcactgatgtttctcaaaaataatataagaggaaaatataggtggtggtttagtgtccatctacctggcccctagggttgagcctgggaagccaggccaggaagggttagcataaccatctaggcatgatttaatgggactgacctgtgatagtgaggtggagagaataggcaatgtgacagtgaaaaatataaatgaaaaccaacaggactccatcacaacagaaagaggactttccaacctgcaggggagaaaaaggttgtgcctctggccatcaggagcattaattgtaatgtctccatttcagccaaactgctgtgcacacacatgaagcctgggccccctttaacagcaaggggtctgttgttcccctccttgtgcaggtgggttcagctagtcaaatcgaggtcttgatgtagcctggggctgccactctctgtggagccggatgggcctgacgggtagacaggtgctggtggtgatataggagcctcggtggtctgagatttaacagtcctggctttctgtgtttcagactttggggctccctggccacttgcactaggtttaaggcacaaatttgaattgtatgtgctgagagccaggtgtaaaagttctggcagtgatgagcttgagtgtggacctagctgaccacctagcatttgcatctcagaatagctgagggtttcctttcttatcattttactgtacatagtaactcttattgaaggtctgaaggggcactgaatttttttcttttagaattttctgtattttatgtcagaaacgatatgctaaactatgatttgtaaatctaggtaataataaacatctctgaacatattcatgaatatgaaagaagcagtagaatcatgttggggcctgagcctgttcagtctaggtgttgccaagatgtgtgggaggggagatgtgggaagaggcagggcagatggcagtcagggatgcaaggtcaggaattctactaagctggagagtgggcaggcagcttaggagaatggtaaatcaagaggaagagagtttctttgcctgcagctgtaggtctagagctaccttttatggcagcgttcactcatataggtaagataagtgaggggccagcaacggctcctttggagccaagattgggcccctgccattgatgagttttctgagctagtgacagaggcagttcttctttctcaatgtggcctggggtttttgaggctgtcagagagaaactgaattcttaaatccccagggccatcactgtcttatttggtccctgcagctggggctgaaggctctgaaatggggcatgtaactagggctcctattccccttagcagtcattttcacacttgcaaaaaatgatgtattttctcaggcgggtatgtggctgccagtagcagccttcagctaaatgaaagcattttcttggtctctggggaaccagatgctgacagatggacttccaggatttaaaatttcctaggtttgttatttgaacctaacaaaagagaaaaatccatcctggatacaattagagcatttttttctttgtcttaccctcccacccccagtgaaatagagaaacatgaaggacatactttttagtgctgttattggtcattttaagctcagtgtgggtgaaatgatatctgataacaaataagaagtttgtgtgtgtcctttcagctctccgaaaaggttataatgtcatgagtatactctgtgcaagaaggaaattctcagtatattcaaataaaggacaattttactgtgatacatcatgcagttaggcttctgtgcaggctagaagctcccagaggaaagcagtttccgagcaactaccactgactgggaagggcactttgaccctgaggggtatagcagaagagtgtacacattttcattatacagcttcataaacagggtgtctttcctataggtatgtggtaatcagttgtgagctgtgtcctcccaatcttgttactaataaaaactggtatacttttaaaattaactttgttgacttatatttgcctacagtaaaatttactaattttataagtgcaattcgatgagttttgacaaatgtgtacagtcttgtaatctctaccataaccaagatttagactatttccatcaccctaaaatgttcccctttgccattttataatcaatctcctccattccctctactctgtggcaaccactgttctgatttctatcaccatagttttgtctttgtttcccctttactgtgtttctgaacttaccttctaggtaattaccacactgtttctataactatactgatattacttatcccgtttttgccaagtctttgactttagaaccactaagtctctttaaagtaacttgtaggtttccactttgatccataacatgtgatccatacatgattgtagtttaattctcatttcctccccactccccagtttcttagttgagggtacctcattgtcacctttatttatacttcaaaagttgtgaaaggagatcatacatatgctgggaggcagggtggggtcaagaggaggggaaaactagcaagaggctgagtggagaagtaagtgtggcctcacaagaggggcgagcatcactgatggagcagatcctggaggaaggaagatggaatatgctattggcctgttgacaattggtgggtgggtaagggatgtgataaagacacatcttcctagacagcaactcaggatagatagatattgtcaacaggttaacctggaggtgaagaaaatgccagcaagtcatgtgatgacaatgactagaatggatagtcagggatgctaaggagtgtgctggaggtttacagatactggagtagatgtagcacagcaatggcttagtttaaagaaataaattgctaaggggtatagcagatcagtcagagttgtgggagaagctatagggaaaggaacaggccttctgaaaggttggaaggctctgcatagctttagaggagaataagctgaaggcagctgttctctgaccttgatgcagagggtgaagaaataggtacaagggtgtgtaggggaatttatcttaaataggcttgtttacttatgttgtctggaaactgacgtttgatcatctgcatgcgtgactgctccctgaaagggggaacaataatgttaattacctgcagattgtgtttgctccaggctttagacattatgtctgtactgaataaaagcaagcagctccagctgttcaggacgactcactcttctgccactagtgctgggcagtcccctagctgctcttacactgcatacctgtgtctgagtactcctttcatccctcacttggccagggtctatgggacagacctggcaaaggggcattcaggggacagttgctcctttaggtaccacttgggtaccattttctgtgggtgcttctttggtcaggtggatccttagtcctgctcaaataaattttttattaaaattttttcacacctaaggaaaagtttccagaatattacattgtactcccatattccttcacttaaatgcaatccgttgttaacatcttgccacatttgctttatctctttctcttttacataaaacatccacaatatttattctcataactattataatcttgatgattattatattattatcatcttgctctaccatttgagagtaatttgcagaggtcacgactcttcatcccttcagcatacagctcataagaacacaaaccttttcttttttttttttgcttacataaccacacagtaaaattcatcaaattaaaaaaattaacattgatacaatggtactacctaacacatagttcatattcaattttgtccaattaaaggggcttgcattttaaatgattttcttagagaccaaaatagattaatgactcaagaaatgatgcttttgtggccaagaaacaggaaaaaatgctcacatcaccaatcatcagaaaaatgcaaatcaaaactaaagtgaaatatcatctcacactagtgagaatgctatcattaaaaagtcaaaaaacaaggctgtgctcagtggctcacgcctgtaatcccagcacttcgggaggccgaggtgggtggatcacttgaggccaggagttctaaaccagcttggccaacatggcaaaacctcatctttacaaaaaaatatacaaattacctgggtgtggtgatgcatgcctgtaatcctaggtacttgggaggctgaggagggagaatcacttgaacatttgaacctggcagaggtttcagtgagccaagatcacaccactgcactccagcccaggcaacagagcaagactctgtctcaaaataaataaataaatacaaataaataaaatggaaagtcaaaaaacagcagatgttggcgaggctgtggagaaatgggaatgcttatacactgttggtgggaatgcaaactagttcagtcaccatggaaagagtttagagatttctcaaagaacttaaaataaaactatcattccagccagcaatcccagtactgggtacatacccaaaggaaaataatttattctatcaaaaagacacgtgcattcgtatgttcattgcagcattatccacaatagggaagacatggaatcaacctaggtgcctaccaacaagggattggataaagaaaatgtggaacatattcaccatggaatactgtgtagatttaaagaagaaaatcgtaatatgcagcaacatggatagagctggaggtcattatacgaagtaaactaacacaggaacagaaaaccaaataccacgtgttctcacttataagcagtagctaaacactggatacacatgaacataaagatgggaacattagacactggggaccactagaagtcaagggaagagagagaggcatgggctaaagaactatctgttgggtactgtgcttactgcctgggtgactggattacggggactccaagccttagcatcacacaatttaaccccatgtaacctgtgtgtgtgcccgttaatcaataataaaagttgaaattaacttaaaaaaagaataaaaacacaaaacaaatcaatgtatttgtaactatttgtaataaacagttcattgctctattaaaaataatgctttggggagcactaattgatgggggttgctatttgagagcagaggggtagctattgaccacatttgaactagtcttgtagaaagtgtgcaaaatgtgtttaggtgacctgaagtatttgtatattggttaaaaaatcatttgcctatttttcattttttattttcagctttagggaccctgctggtactgagtgaacaagcccaggccattagctatttggagcacttcatctcagcaccatttctctggcgacttgtaacaggcagggctatacaaaagaaaatcctttttactaccccaattcatatcaatcaaagaccaaggaaaggctcctaatatctttttaaaatgttttcatttatcttggagtttacttgtcataaaaaccgcatgtttaaagtgtccattgggtgtaaatggtcccataaactcttgtaactgagtgacacgtgataatgaaagtagcttcacaaagaacaacaaaatagatctcttttttattgtaatcatcaaatagtgtgccccaaggtattgattgaattatacataaagctgatatggagctataaaaaggatgatagcatgctgcttcaaaacaaaccacaaacagattagcctttgagaaataaccttaattccaacaacattcacaacctttgctggatgaatcacaaaacaaaaatatttctggaagaagatatttcctgtatatatgtaaactaaaagtgcactctgagaaattttatcagccaaaaggtagaattgtgtattcaaacaaggaagagacatatttacttatgaggcaagactaaatacacaggagaatatctggtatctaatagtccaggtgaaatccagagtttcactttttgtggtttctgaagtcaaccacaatctaaaaacatatggaaaattccagaaataaacaatacatacgttttaaattgggcgccattctgaatagcatgatgaaatttcccattctgcccagcacatgaatcatccctttgtccagcatgcaggctgtagacactcactgcccattaatcacttaggaactgtctgggttatcagatcagctgtcatggtactgcagtttctgtgttcaagtaacctttatttgacctaatgatagccccaagccacagtagtagtgatgctgtaatattattataattattagttattgttgttaatctcttattgtgtgtaatttataaattacattttattataggtgtgtaagtatagtaaaaaagtagtatatacaggattcattacaagctgtagtttcaggcatccacttggggtcttggaatgtatccctcttggataagagggaactactgtatcttgataagatgctgtaatgaagttgttagtattcagagaagctcaagttctggaaaaatctagggaagactttgtggagaaaggtggtttgacctgggtatctgcttttatatattttctacctgaaatgttaaactgttttaaagaaataaattatttattttctttgaattttccagtttaaattgattgaatggtggactgggcaagatattggaatttggaattctgttttttgtgtttttttttgtttttgtattttttttttactggttcatttccctccagataaggtaactctttaaacatccttatctgcaaggaatattgtggaatggaaaacatactattactcacatttttcttcagtttacattttattcttgtgatgtgccccgtgtttttttgtcttcatgcctctgctcatgtattttattcctgctggaattcactttttctcacttctatgtgtgcaaatcctacccttctgtcctcttcagtgagaaggctcccctgaataccctaactgggaatttttttagaaaattcttttctaattctttcacctttcttaatgtctctgaatacttttaactgtccctctcttatcgcccttaccagcttctatttggtatggtgggtatgaattaaatatgcttcctattccttctggcctatagacctctcaaagaaagaacttgaacatattctttgatgaacaaatttttggtgccaaacttgtgaaattattaatgagcattgcagattcagattcaaagcataacagtcatgtcaactcatcttttcaatgaattattctacaatacattaaaaaaaatgctgtcctatctgatattttcacaatctgttctataattttaaaggtaccttagggtttttctttgaaggcagatccacatgtatatggttaatttattttttacagaggtgccaaagaaattcaatggggaaaggataatttttttcaacaaatagtgctgaaataattggatagctatctgtaaaagaaaaaaaaaggaacctcaatccttgtctcacaccgtatggaaaaattaacttgaaatatgttttattcttaaatatgagctaaaggtataaaacattaaaaataaaacacaggaaaacatcttagtgacttacagtttagtaaatatttcttaaagacaatacaaaggcacaatctacaaaaattattgatgtattggacttcatcaaaattaaaaacatttgctgttcaaaatacactgtcataaaaaggataatacaaaggcccactttgggaaaaacatagtaaaacatatatagaaaaaagaacttgcatctagaatatataaagtgctcatacaactaaataagaggaagacaaaacacccaatttaaaaaaatgggtgaagaattttagagacacttcaccatagaagatgttcaaatggcaaatagtcataatattattagtcactaggaaaatacacattaaaagccatagtgagataccactacactctgttgtaataactaaaataagaagactgagagtaccaagtgttaacaacaatgtggaacaactggaactctcctatattgctggttggaacgtaagatggtataactattttgaaaagcagtgtgagagttttttaaaaagttaaaaatctacctctcgtaagacctattattctactcttgagtatttaaccataaaaaaaaagaacatagattcatacaaagctttcatattaatttttatatagctttgttttcagtaaccctaaattggaaacatcctaaatatccgtcaacagttgaatgcataaacatattgtggtatagtcatacaaaggaataatctttagcaacgaaaatgagtagactattgatacattcaacaacattgctaaatcttaaaataactatgttgcatggaagatgtcagatttaaaaatgcatacatattgtatgactccatttatatgatgttctaggaaatgagcactaattagaaaaaaacagatcagtgattgcctgcaggtgggatgaaaaacaggagaaaagaatttcaaataattacaaggaaactttggaggtgaggattttgggttgcttattttttttattgtgatggtgatttcacagtgatgaatgtatgttaaaattaatcaaattgtatactttagacataatgctttttttgtgtgtggggatgtcaattttacttcaataaagatgttaagaagattgctcccaaactgatatttttgcaatctgttttggagagtcaaagtgatcttttggtttcttttggaaggcagatatgatataaagcaaatggactgctgagttatggagatatgaacttgttacattggtgtgcatttcccagatgaatttagagacttagctccttctcttctagaattctacaggaaggctccagagaaggcactgtgtaagctcaagtgtgcacaggcctgtcttagtttatattgagctttgaaacttacttccttctcttctggaaaacaagcatgataataactactacatatgaatgatgagaagattacacaatgtagccaaagcacacagcacaatgatacagggtccttccctttctttttcctttgtttttctctcttctgcacaaagccaagcacaggttgcctgtgtaacaagtgttcaataaatcttgaatcactcaccattgactgttccaattcagctggttaaggcatctaaaagaataaagaattttccaatctatatttttaggtcttggaataaaacaacaaaaattttgagtatgagcaattacagcacttgggacaaatttgacaactgatataatattcactaaggtagttatagaaatttgaacccctgtttcacacaaagcaactagtcaagatttaatgaattattgcctttgaaaaacttaaataattattttgaaagtccagttacctgacttggtcaaaattatgcaatgcatatttctttaatttagaaaacagggcaaacacagtggcttaagcctgtaatcccagcactttgggaagctgaggcgggtggatcacctgaggtcaggagttcaagaccagcctggccaacatggtgaaaacctgtctctactaaaataaataaataaataaataattagctgcgcaaaaaattagctgtggcaggtgcctgtaatcccggctactcaggaggctgatacagggaactcacttgaatggggaaggaggaggttgtggtgagccaagattgtgccactgcactctagcctggacaacagagtgagactcagtctcaaaaaaaaaaaaaaaaaaaaggtttgactaatcaagcagacattcaggaatgcaaacaacaaatgctttctttagactttaagagactctctatatggaatatgccacactgatggaatttctttcaagcagtttcttattgcctcctcagtctgttatgaaagcccaggaaggtactgggaaagaaggacaagtattctatttttaaatatcttcaataaggtcatagaaaaagtttcctgttagcctcaggcattctgaaactgtggttggcagttaaaggcagcttgttttccaggattgatcagatcagatggaaagtcctttatatactattaggtagccaggaaggagttacagaaagctgcattctgggcagagacaatttctgaaaagctgcattatcagtttgaaaaatataaaacaactaaatttctgtgagctactgtgcagtgaccacttaaaaagttactgtcatatagaaaagcagcagaccaaccaacaaaatcctttacaaattcgatcttggttagctagtatttgaggtgttcaaatagcacttgggctgaagtttgcatttgtttagaaaattcttttgtcaaagattgctaatcagattatgttgtgattataatgaagatccataaactattcaagcatattaacctcttcaagaatctatatatagtttaaaatttctcactgttaggaggctcttaggtttattacaaaccatgcaatacgattttatctcactaaatgtacgtttgtgagattcaaatcactttttaaggaagcaggtaattcatgaataaatcaatgagaaataggaccttttagctgacattgtcaattccctacctacatccctgtggcaatgatgcttcatacatgacttccaaacttcagtctacctgcacctgcagctctgcctgagtgttatctggctgttgaagccactgagcaagccaacattgcccatatattctccatttccctttgggtgggtagtaaatacccacattcctgtcctcatgaagtgggatagctttgaggcccatgttctaaactattttctagttcccaagataaattaagctccagttgtctacagtggcaactttcttgaggacacaccctttgttagccctttattacttcacctccctactctcctaccagttttctagaattgcctttcaaataaattctttatcttcatctcaggattctcttctgttggaatataaactaagacagaactgtgcacacaggagcttacacgttgccttctctggagcattcttgtagaattcacaggcttctaggaaggggaattactcccgaaaaactttgtgtgagtccatgctcaaggagtaaagccttatgctattaaatggggcacttctgaagaaagagaaagttaagaaggagggttatttccaaaagccatatttccccttttcacaactctttgggtggggaagactgactatggacattaggaaaccccttcactaaatgtgggaagggcttttgaaaggggcacgtctgctttctgtcttggcaagtgttgcttgtagcatatttcctgacatttcagtagagaatgcggctctgtgtaaattcagaagcagccccagaaccaccaattatagagataataatttctgctcaataatatgtaaaaatgctacttaaagctaaccctcaattatagcctataaatgatgacaaacgtatttctctgttgtggcagaaattaaaggcttgcttactgcttaagacatgatttatctgatgggaaaacaaatgaatgacaatatgtggtcttcctttagtaactgtatttgctgtggggttagcatcagaaaagtggggaaggaggcagggtaaagaaatatgcgtatgctgtatggtgaaggcaaggcacaaggtctgtccgtgggtgaacatggggctgatgaatccatggccaggaagtcaatttctacttggataggtgaatttcatggcaagagaaaaacagcggtcctggaataacaggtaggaatcagaattccagcttgtcatgccatgcaatgcaaataacctctatcttcatcttcttgtaaaaatatgaattgtcagacggatactttaatttccagtaacaccatggggtgttcgcctgcttcacccccaactctaattataggctagaactcttatgtgtggatgtattagtctgttcaggttgccataataaaataccataggaatgggtgcttaaacaacagaaatttattttctcatagttctggaacctagaaggccaacatcaaggtgtggtcagggttggtttttggtgagggggctgttgctggcttgcagatgaccactttctggctttatctccttacatggcctttcacctgtgcttccgatgtttcctcctcctcttatagagacatcagttctattgcattagaacccttgtgatttcacttaacctttgttacttccttacaggctccatccccaaatacagtcacactgggggttagggctttaacatataaattttaggggaggacacagttcagtccataacagtgggaattaacggcttaatggtcacggttctaaaaaaaaaacttctgttctttcttcctccaccatccccagagtactagggtcacacaaaaatgccttgtactctgcaatctagagactaaagaaataaaatttcatttagtgaatatttattctgtggcaggctatttggtataatattttaattctcacaccaactaggtcctatgcaacaggtacttttttattttctaaaccagaaaatttaggcacagaaaaagttaggtacataagccagggtccacacagaaagctcttgtgttttctgtttcattactctgatttttctcaatgcagaattgttttgataattgattatggttttaactttctgtactcttccctgatatttagtttttttcaattgttaaaacttaatggtgaagctttcagacagacatatagttaaagggttataggttattaaaggttattttccatttgagattaattgcacataaatgaatgaaagccttttgaaatgtatcatagaaatcaatgaaaaaatagcatttatttaacaaatgttaacttataagaagaattcttcagaaagaaaatttatgaaggtaataaaggctatttattaaacatgatggacttatatttcattccacttatggaaatcgaggatagctgctgtcctaccatttcattcactcatctatcttatatgtatgcatggtattctttttttatgcaaaattttatgctggaccctgttctggctgtacatagtaaagaatgtacttgaggtactttttactctagtaaaggcaataaagatacctaaaaaactattcagaaagaaggtgcaagataaaagagccaaataatccagattaaaagcaataacaacaacaattcaatttctgtatcttgttatgtcaagttttaccaaacccctaccccaaacttcatttatatgaagacagcttggtataacttaaaataaatgtgactataatatatagtcacatttattgtgattatatgtgataacatatctttttcagaagagtaatacaactaaaaatacgcaaatcattgaattcttgatattgaggtttgaagccttcttcaagtttatgtgagcccatctcttgccctttgcaggaattttttctcttgcaataggtacttcagcttctatgtgaagacctctaatgatagatttttaaaaatattctgttgatgcccaccttgagaccatgaagaagtattaatacaagtaaaattgaccttccaactggaagtctcatgtattgattgtagaggtttttttttccctctctcagcaatgtgctatttcaatttttttttttttaatacactcttgtgctcacatggctcttaagatcctggtcacactctttaattttcacaagatattctcaggcccactgcattctttttccattacatttcacaaaaatcttccttagagggtaattaagttttacactggtgactgatatcttgaatttttagcattctgctaaccattcatatacaaacacaaatgtgcacacacaccagcacacacaaaccaccctacattgacccattttatagtttgcagtttaagctaggcagtaatcgataacaatgacttctactataagctcactgcctaggaagatagtcttctttcttagaaaggattgttgtgatctaccattccaagtgttgatttatggttctttatgccaaaaggaataatatgagtctacttcaagatggcagccctatgattatattttgtttctctccatttcaaaccatcaccgatttcttcaattgctttttctatggtatggtttccaaattctttaccattgtgtctgcttttctggttttattgcttattgatgtatcttctcaaaaatggcttctacatatgaccctaaccctgacattttgtgatccctgagtgtggttgtgatattgttatctgctttcaaaatatgacacttctactaatataggctaagactacagaaactgcaacaaattagcatcacataattggttgataattgggcttttagtcaacctgaaattttcacttgaactctggctaaattaggtattggtcattattgactatattgtctttggtgaattccctaaccatcctttagcctcagtttcctgaatatatctatcttactaattgttacaaaagatgaaggaaaaatgcatgtaaagtgtcaactcttgcctgaaacttagtgtttattaattaaataattgttgttatatttattctagctatcaatttccaaataatggtggaatatagtttaaggataaaaatctccccattgtatgaattttaaattaaactttcaacatctaggtctatcaaattctatttttaacacataattgataagcaattttatatgcattgactcacttgagtggtataaaaccagtgagatagaagtgacaggtattatcatatccattttgtaaaggaggaaataaaagttcagaaaggttaagtgacttgtccattattctatactttctaagtatttaagcaaaatatctttgattttgttatattttagtgtggcaaaataaaatatattttgttgtttatggaatttgcaataatgtccaaaagctaattgtccagttaaatatatttttattgcccagagttaaatgaattttaaaaatacataaattatcccaatttataagtctaagagaatagctaacttcattttagcatattgttttctttccattttcattggtatacaatcatattgtatgtaattatagaaattgtacatttctgaatctaaatttttagttaataatgttataaatatttttccttgtagttacatagagttcattgctattgttttttaaaacctacataatattttattgattttaatagtttacttaattttttcaaaaaatataggttagataatgctgcaatgactattttaaagaatatattattttcttaatataaattacctggaatgattaggtcaaaaagtaggaatattgatcaaattgatatggatcaagttacatgtatttatgttgcatttcaaagtctttatatgccaacaatgtagacatggcctaagttagactgagttctaataaattgttttgtaataattttgctaattttgatatgaaatgctattatatttttatttttaattagtggtaaactgaaatatttttccatattttggacatttcttcagaactccctcataacctttgtcaatttactttttaataaattgcctgccagacatttctgaatcccagtgatggataaagctgagggtgcaacttggactcctgatgacactgtaattagagataagattgagtatcactaaaggagatagttctccatatctgttacactggttgtttttttttttggaggcctcttgtgggtagggctcaggtgaacgccagcagtgtccctggtgtggtgggccctccttcctcttggcagtgggaaacatctcagccatgcacactgggcatgggctctagaagagggacctcaccctcttttgctttcctttacttttatttaattttattaatttatttgttgagacaaagtcttgctctgtcgcccaggctggaatgcagtggcaggatcttggctcactgaaacctccacctcccaggctcaagtgattttcaagccttagcctccagagtaactgtgattacagtcatgcaccaccacgcctggctaatttttgtatttttagtagagacagagtatcgccatattggccagactggtcttgaactcctgacctcgcctcaggtgatcgcctgccttggccccccaaagtgctgggattacaggcatgagttaccatgctgaccttactttctttttaaataggagattgttagaacaggccttgcaccaggggacaaatagactgcctcagccccaagcacttggacctcacatgtcagctcttagcacctgctgatcttgtgggaaactgggtttgtgcacagcctgtcctgcttggaaagagtgcctggacacagtttagttttattaggtgcccagggaaagtttccaaggtggggttgaggatgttcattggataacaggcttgtaggtacacaggactcaaatgagataaggcacttagagccattatgaaataaaagttgctagacaaggtcaaggtctgagtgattcccaacatgagcacttctctagtaacaagggtatgggaatggtagtttctaaagtcttttctaaattaaccagtgatatggtttggctgtgtcctcacccaaatctcatcttgaattttagctcccataagtcccatgtgttgtgggagggaccaggtgggagataactgaatcatgggagtgggttcccccacactgttcttatggtaatgaataagtctcatgaaatctgatggttttataaggggaaactccttccccttggttctcatttctctcttatctgccaccttgtaagacgtgcctttcaccttcagccatgattgtgaagcctccccagccatgtggaattgtgagtccattaaacctctttttctttataaattatccagacttgtatatgtctttatcagcaatgtgagaatagattaatacagtaagttggtactagtagggtggggtgctgctgtaaaaatattaaaaaatgtggaagcagctttggaactgggtaacaggtagaggttggaacagtttggaggactcagaagaagacaggaaaatgtgggaaagtttggaactcactagagacttgctgaatggctttgaccaaaattctgataatgatatggacaatgaaatccaagctgaggtggtttcagatggagatgaggaacttcttgggagctggagtaaaggtgactcttgctatattttagcaaagagactggtggcattttgcccctgccctagagatttgtcgaactttgcacttgagggagatgatttagggtatctggcagaagaaatttctaagcagcaaaacattcaagaggtgacatatacgctgttaaaagcattcagtttcaaaagggaaacagggcataaaagttcagaaaatttgcagcctgacaatgccatagaaaagaaaagcccattttctgaggagaaattcaagccagctgcagaaatctgtataagcaaggagaagccagatgttactcaacaagacaatggggaaaatgtctccagaacatgtcagagacctttgtgacagcccctcccaccacaggttgagaggcctagggaaaaaaaatggttttgtgggctgggccaagggcccccctgctgtgtgcagcctagggacttggttccctgcatcccagctgctctagccatggctaaaaggggccaaggtacagcttgggtcatggcttcagagggtgcaagccccaagccttggcagcttccacatggtgttgagcctgtgagtgtacagaagtcaagaattgaagtttggaaacctctgacgagatttcagaggatgtattgaaatgcctgaatgtccaggcagaagtttgctgcaggggcgatgccctcatagagaacctctgctggggcagtgcagaagggaaatgtggggttgaagcccccacacagagtcaccactggggcactgcctactggagctgtgagaagagggccaccgccctccagacttcagaatgatggatccactgacagcttgcagtgtgcatctggaaaagccacagacactcaacaccagcccaagaaagaggctgtaccctgcaaatccacaggggtggagctgcccatgaccatgggaacccacctcttgcatcagcgtaacctggctgtgagacagggtgtcaaaggagatcattttggagatttaagatttgactgccctgctggattttggacttatatgtggcctgtatcccctttggccaatttctcccatttagaatggctgtatttacccaattcctgtaaccccattatatctaggaagtgacaacttgccgttgatttacaggttcattggtggaagaaacttgccttgtctcacatgagactttggactgtggactttagagttaatgctgaaatgagctaagactttgggagacttttgggaaggcatgattcattttgaaatgtgagaatgtgggatttgggaggggccaggatgatactgtttggctgtgtccccacccaaatatcatcttgaattgtggctcccataatttcatgtgttgtgagagggaccaggtgggaggtaattgaatcatgggagtaggttaccccataccattatcatggtagtgaataagcttcacaagatctaatggttttataaagtatttcccctttatcttggttctcatttctctcttgcctgccaccatgtaagaggtggcttttgccttccaccatgattgtgaggcctccccagccacgtggaactgtgagtacattacaccttttcttcttcataaaaaaaagactttacccagtctcaagtatgacttgatacatacttataaattacccagtctcaagtatgtctcaagacatacttatacccagacatacttaaaaattagacagtctctagtatgtcttgagacataaattacccactatcgagtatcagcagcatgagaacagactaatacaaccagtgagtatataaagccttttggttttgagagagagaacagtcaccttagagatagcaaggtcagaagtctaataaatcacattttaattaaagaaaaagcaaatattacctattccaattgtatcagtatgttagataattgcatgattttttaaaaaattaaattaaattttattattattatactttaagttttagggtacatgtgtacaatgtgcaggtttgttacctatgtatacatgtgccatgttggtgtgctgcaccccattaacttgtcatttagcattaggtatatctcctaatgctatccctcccccttctccccaccctgcaacagtccccggtgtgtgatgttcgccttcctgtgtccatgtattctcattgttcaattcccacctatgagtgagaacatgcagtgtttggttttttatccttgcaatagtttgctgagaatgatggtttccagcttcatccatgtccctacaaaggacatgaactcatcattttttatggctgcatagtatcccatggtgtatatgtgccacattttcttaatccagtctatcgttgttggacatttgggttggttccaagtctttgctattgtgaataacactgcaataaacatacgtgtgcaggtgtctttatagcagcatgatttataatcctttgggtatatacccagtaatgggatggctgggtcaaatggtatttttagttctagatccctgaggaatcgccacactgacttccacaatggttgaactagtttacagtcccaccaacagtgtaaaagtattcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgtataaatgtcttcttttgagaagtgtctgttcatatcctttgcccagtttttgatggggttgtttgtttttttcttgtaaatgtgtttgagttcattgtagattctggatattagccctttgtcagatgagcatgattgtttttaaagattgaaaacttgagttttaacacggcaataattactcctcctaacttaatactttttcatttcaattattactcaactgctgtggtgtgacacttattctcttctttatttttatactcatatttcttttctatgaatagaatgaggttagaatcagtagactaaaactttaaaataaaactgttttcttctgaagcgttttacttgaaagacaattagttttgtttctaagtttcaaaggtaacatttctattgaagtttaatattaatgcagaaaagtacacaaatgtgtgcatttccaatttccacaaaatgaacacacagatgtaattagcaacagataaagaaatcaaagttaactagttcccaataaaggtcaccaccatcctctagcaccctggatttgttctgcctgtttgtgaaatttatgtaatgggatagtgcaatatgtactctttggtgtttggtttcaaaaggtgttttataaggaaatctccatatgtactgagaatgtacttgactatttcttttcccaataaagttcttttgcaattgtgtaagccatgcatgatgattacagtaaacttaaaacatacagaacagtagagaaaaacaacaaggatttataatcctatcactcaaagacaaccatttgggcatattgccttctagtattttatttatacattcattaactgataagtgtatgcatcaaatatttatggaacatctacaacatgtagacattgtgctaggcacaagaaaaacacaggcaaacataatagtttttacatagttataatgaaactctttgtaaactcttatatcgtgcctttttcttaacctcatattacaggtcccatgcattttcatgctggctgtttaaaacaaaggcaagagggaggagatctcacagtttggggtagctctcaggtcttcaatatgttatatttggatctcatcatctttcagaaagaacagaagatttcttgagaccctcctgaggcagggagtggaaggagatgtgatggaagggaataagggacaggttccagtgacagagtgacagcttcttgcaccatcatggtgggcaaaaagaaaggggttggtctggtgactgagaaataagtgaatacaaacttaggggctttaaagttaggggaaatccgggattgggaaatctggaaattagggtaacaactagggagcagctaagtagtgaaaaacagtgagtcaaagaaggtagtcaactattcttggaagtagatgcaaggagagtgagtattcataagggcaggaaaagtaagaaacaacggaagaaaatttaagtggcatggtctgaatgtgtccccttaaaatttgtatgtgaaaaccaatccctaataggaggtgattaggacatgagggcaaagccctcatcaatgggagtaatgctcttattaaaaagacccaaaaagcttgtttgccccttctgccatgtgaagacagcaagaaggcagcaccggtgagggacatggcccttctcagacactgaatcatctggcaccttgatcttggacttcccagcctcaagaactgtgagcaataaatttatgttgtttataaattacccattctaaggtattttgttatagtagtccgaatagacttagacagttagaaaagtgaggtgggtgaggtggccctgaatcagaagctttctaactggatgtgaaggtcatgggaggagcctgctgcttaaaggataggttataagcttcagatgtaccaattcagcccacttcaggaaaaaaaggagagccaatattacagggaggtttttctggtctcatcccattaggtcataaggggtgaggaggagaaagggaaagaaactagtgataaactcacctgaggttttcaggcctaaaggagagaattacagagcccattgctttgatgtgaaaattgtcacatttatttacacacacattatcttgtgactctatcaatccaggtaaaaatagaacttttgaggctagttaaaactttaaatgatacttttaacaatttagtccaagaaacatttataataactatcatttttattggttaaaatatattgaagactttgcagtgttcctaatgaaccttattctcatgaatctttacaaagaccatatgacatatgtaagtctattcccattttagagatgaggaaacagtttcaatatggtttagcactttgtccaacagactcagcaaatacatggcagagggaatctatatgccatctgacctttctactaagtattatgaaaaaaagagcttctttcttcaaggagatcgagagactcctccataggcaatcacccttgcctacataaggggaggtgacagcgggtagccttccctcactccctgactcatggggtggcccatattcacaagggcttatgtgtaactaggacccccaggctcagtgggcagctgcagaatacttgttcctttgtgtttttttttttttttttctaaagggatagccagggtagtagatgctgtagatgtgtagcaaaattctaggaaggcaaggattttatagttggaataaaaacaaatgcctcttccccagtataactgccaggtacttgcatgtgctttgcaaggatcttcaaagagaggttttgtcaggctccaggcagcctacctggcctgtcaagttcaaaacctgattccctctgctcagttgagtttaccttttaatctggtgagaagttatcactttaaaaatgtcttcatgggcatgataaatattttaaaacatttagaaaggcaggtggactttaaagctttctgttcttccttgggtgattttgcaagctcctgttgtatcttctcttccacaaaccccaggaaaagcatgagaatatttgtatggcattctgggatatgctgaggggatttaggaaattcttacaggacttggctaaaatggtcgttaccttttctttatattatgtaagaacagtaaatacaaaaaatgaaagaacatagtaagtattaaatatttacaaaatttcagatgaatttctatttattttattatgaaaactaggatttcttccatgaatatacctttttaatgtgaaggttagtgcttgaaatgattacatacaatttctgaaaagagtttttaatgatgtcttcaaatgcttcattgtctttgtagacaaagaagttttatttcacaatggttttacaaaaaacttaaaacgttttttgtgattattttacaatttacaacagttgacattacgttgaaggatctaacagcccttccttttctttcatggactaaaatttcctgtgataatgtgaaaagattcaaatctaattggactttttctatcaagtatttagaaataatgatggagttctaatttgtagaatgtgcatgcattgttagagctgtcacgctgcagatagtttggattctattaaaagggcacattggctgcaaattgatagaagttttgacatctatgaaggcagggagtcagggtgctgcctggcacttagcatactaggcacttgtgcctggcccctcgtctcccctcacgcccccaccaccactcccaactggccacatcttggcctggatagcactccttgaccattcacaacatgacattttctagaagtgttgttggctgtttcctccatttccacagcaaggctgtgcgttgcagctggcttctgaggtgtaatgccaagtagtacagcacctccctgtctgcatccagcctaactgggcacacagcaacaatgacagacatcactcatcttgtcagtggcctggaggtatgtagaacctcagaccctgcttctctccaaaacgctccaaggagcctggaagcggcagattggggttgcaactgacctggctttggctaccctagaccccatctggctgccccagggccaaaggcatcaatatctcctggaacctgttgcagcattcatgttttggaaagctctcatttacagggacaaatttcttgttttccctgaatccttaggaaattgaagggtatatgtgtgtctgtgtttgtgtttgtgtgtgtgtgtgcacgcgcgtgtgtgtgcatgctagtcctgttattttgcttaccatcttactcaatattcttgcaaacagcctatctggcaatataagaggcagcaaagtgtaattcctcagaagatagattctggagccaggctggcaggtttcaattttagctcagccagttgctggcttcctgtcctgtgttcctctcctaatctatataaaatagagctaataatagtgctgtttttctagagctgttaattaattaaattaactcatgcatgttaatttcttgcagtaatgcctagaatagagtaagtgtccaatagtagtcgatgatattatcatcgactactattgtcggtgataatgttattggtgttgttaaaaagttgactgttattccagtagagagttctttgtttttaccagacaatagtcattgctttgggtttctaatattttccattaacattgcactctttgtaaccagaatggatattatctattcattttaaccacttgcaacaagacaacaagccaggagtaggggtagggtttgaggcatggaatagtatcaagctacttacctcaaggaagactgaatcctacattcagtgtcactgagttggctagagtaacctgtaagctaatgcaaaaactcatcttaaacaatgacataagttttaaaaactatattatgctccttggtacccagaataatcttgatttttaacattctttgaaccttggactcaaagactagccacaataatcaggagaccacttaaaattttagtcttaactgaagacataagttggcttcacaattgaaatggaaagtctacagagggaacagacttatgtctttcgcctgttacaggttttgtcacagaaaagtggattaatatagtaacacttcattgtaaatggacattaatgaatgcttaattaccaccaaattcctatggaactgcacataatggctactttcacattcaaagagtttttcatgattaatgttattgtaatgaataccaaagaaattaataaccatttgtcactttaagaagtattgccgattaattttatgctattttttattctcatttgttgtaggagtgaggacctagaattttaatgtctaatatgcggtgtgaattaaagaagcggccttgctatgctgaccttttcaatattctaatctttgctttgctgacctctcaggcctcttcctggcaacagttaggcttttgagaggagagagagctgagactgttgggtaagtgaacagagtgaggaaatcttttaagacacactttcataattcactgactgtattggaaattcaaattttcagactattcattatcttgacaaacattgtaatgtgtgcagaatatggcaccacataaatccattctagtgacaaagagtgtagtgagaatgggaaatagtagaaacccaaaagcaatcactttacaatctggaaactggttagagttaaactcccatcaggtttcacagcagttcttttttggccctcataacaattgctttttacagaaagcacaacatggtaccaccacagccaagtactcataatgggagattgtctatttgtgctttttagactttttgatgcaggcatttcaggctatgaactttcctcttagcaccacctttgctgtatcccagaagttttgatagattgtgtcactattattgttcagttcaaataatttttaaattccatgttgatttcattgtgggcccaataatcattcaggagcaggttatttattttccatgtatttacgtggttttgagtgatgctttttggagttgatttccaactttattctactgtgatcaagaaagtacttgatataatttaaatttttaaaaaatttattgagacttgttttgtggcctatcatatggtctatcttggaaaatgttccatgtgctgatgaatagaatgtatattctgcagttgttgggtacaatattctgttaagtccatttgttctagggtatactttaaatccattgtttctttattgaccttctgccttgatgacctatctattgctgtcagtggagagttgaagtcccccactgttattgtgttgttgtccatcttatttcttaggtctagtagtagttgtttaataaatttgggagctccagtgttaggtgcatatatatttaggattgtgatattttcctgttggacaagtccttttatcattacatgatgtttttctttgtcttttttaactattgttgctttaaagtttgttttgtcttgtataagaagagctattcctcctcacttttggtgtccatttgcatgttatatcctttttcacccctttaccttaagtttatgtgagtcttaatgtgctaggtgagtctcttgaatatagcagacacttggttggtgaattcttatccattctgccattctgtatcttttaagtggagcatttaagccctttacattccttgttaatattgggatgtgagagactattctattcattatgctatttgttgcctgaataccttgttgttgtttttaatttattgtgtttttgtttcataggtcctgtgacatctatgctttcaggaggttctattttggtgtattttgaggatttgtttcaagatttagagctccgtttaggagttcttgtagtgctagcttggtagtgtcaaattctctcagcatttgtttgtctgaaaaagactgtatcttcccttcatttatgaagtgtagtttcacaggatacaaaattcttggctgatcattgttttgtttaaggaggctgaagatagggccccagtcccttctagcttgtagggtttctgctgagaaatctgctgttaatctgataggttttcctttataggttacctggtgcttttgcttcacagctcttaagattctttccttcatcttgactttatataacctgatgactatcttcctaagcgatgatccttttgcaataaatttcccaggtgttctttgagactcttgtatttggatgtttacgtccctagcaaggtaagggatgttcttctcgattagtcctcaaataaagttttgtttattatactagttttgtgctgattggcctcctgccaggaggtggcacttacaagttttccagacttctaggtttctcttctttctcagcaacaccagttatccttaggtttggtcatttaataaaatcccaaacttcttggaggctttgtacatttttttggattctttttgtctgtattggatggggttagtttgaaaactttgtctttgagctctgaagttctttcttctgcttgtataattttattgctgggactttccagtacattttgcatttctctaagtgtgttctttatttctagaagttgtgattgttttttcttcatgctatctatgtcactgaagattttcccttcatatcttgtatcatttttttgatatcattaagttgtacgtcacctttctctgatgcctccttgattagtttaataaccgaccttctgaattctttttctggcaattcagggatttcttcttggttgggatccattgttggtgagctagtgtgattttttagggggtgttaaggaactttgttctgttatattatcagaattatttttctgattccttctcatttgggtagactatgtcagagggaagatctggagctcaagggctgcagttcagattattttgtcacacaatgtgctcccttgatgtagtgctctccctttttccctagggatgtggcttcctgagagccaaacgtcagagattgtcatttctcttctggacatagccaccaagtggagctactgggctccagactagtactgggaggtatctgcacagagtcctgtgatgtgaaccaccttcaggtctctcaggcatggatagcagtacctcctctggtggaggtggcaggggagtgaaatgaaccctgtgaggatccttagttgtattaatagttttgtttattgcactagtcttgtgctgtttggcctcctgccaggagatggcacttataagacagtatcagctgtggtggtataaggagaatcaagtggtagatgggtccctagagctcccaagagaatatatcctgtcttcagcaaccagggtgggtgaaaaaagaccatcaggtggccggcagggttaggcatcactgaactcagaccctctttgggtggaacttgctgcagctgctgttggagatggtggtgtcattcccaggccaatggagttatgttctcagggggattacggctgcctctgctctgtcatgcaggtctccagggaagtgggggaaagctggcaattacaggcctcacccagttcccacgcagccccagaggccagtctcacttccaccatgtgccccctcaacagcaccaagtttgtttccaggcagcaagtgagcagggctgagaacttgccccaggctgccagcctcctggctgtgaaagtaagcagggcttttcaggttcagcacctccctacctgccatggcttcagtgctgtgtctgcactccagattcacctctttccctaagttctgtatgggaaacttcacacgtggtcaaaattgttacaaagttcagctggaagttttcttctcccggtagtcttttccatttatctggcagcccttcccagggacctctgtgacagaaagtcagaaatggcttccctaggatctgagaaagaccacacagctcatcctgctgctgcttctatccctgtatttcgctcggatatccaaaattgtctcagctccaggaaagatcaaattcttctcctgtgattcggaccttcaggttcctcagtgaagggtgtgtgtttggggtggacgatccctctttcacacttttacacttcaggtgctcacagtttttggactgtctcccagggccttcagaagcaatctgcttccttcaaagggtctgtggatttactcggctttcctggtatgttcctgtgatagttcttggagagaaagttcacaatgtgagtctccatatgctgctctgtccatccaagtgggagctgcaatttagtcctgcctcctatctgccattttcctaacctcctgttgtggctaatttattcttgattccattgcacaagtccttggatgtctgaggagagaggctaactgacatatactggtaaaggcatcttctccacttggttatttgaacctcttttgcaaatgatgatttatttggggcattaaattcaacatcaaaattctcacactttgtatccactaccctaagtctaacatttgcctctttccaagatattcttgtactagctttccaatgttgtaacctaaaggcctctgagcaggtaggcaagtcatctgccacctcacatagtacacgtatcatcttcccattctacccaaagtgtacctcacatagtacacggatcatttcacattctacccaaagtgaatggcaagtttcttcacccaaatctctgccattgagaggacttctaatctttttcttgcaaaaccactcctgagtggggctgtcatgaagcagcagtctatttttggtttctacctatatttcaagctgattcatccatgaaccaaggttgaacgtctttcttttccattaaatggtcatagtgaatgtctcataagaccataggtatgagccccatggatttgctcaaacctaacttctgatgtagcatttccactttttgatttattgttactggacttgcccaatctcatgatttgatgcatctaatagtttggagtatacagtgggcagttatgatcttagggccccttgatttttttttttgtcttaggaagtatcactagtcacatttttttcttccccagaatacaatactgttttgaagaaattactatcttcactgaagggacaaattttagatgctttccatttgacttttcctacatattagcttttacttttcaggtcaaggagacaatatgagttttcttaactgcaatgtatgtcccttctggttatatggtttttaactaagaaacaactaccaggtgggcttatggagttatcaaacccattgtgagatagctctgggccaatactgcatttattactggagacctatactctaacagggtaccataaggacttctgtggatagctggttctcggcattaacttcatatcctatatacaactgtcttggaaataatctagttattcatctttctccagggcatgtttatcgaagtaaagagcaataaatcccatttcaaaaagtctgtgaagaacactattgtgcctactttctgtggtgttacagaatccttctttatcaagacctggcctcttcttcagttggtggattctgagtctgagaattgacttaggtctggaaactggccaaatccattaagtggataatctcagctctgttcatccattgtttatcttttctcatcatgatttgttgagcaatggttttaatggttgtccatcttgttcctaggcatactatattttcttatcattttcagtgaatagctctgccctagctgctattccaaccttgctgcctattatggtaatttttaccacttggcttatgattattaagtgctgccagccacctggcctctactattcccagctctatcattcccatgaacataagttcaagatattttctaattctccttgtgatttatttctttgactcctgggatcccactttggtaaaaacatctactagctgctgattttttttaagactgtgtttttggccaggcatggtggctcatgcctgtaatcccagcactttgataggctgagatgggagatcacttgagcccaggagttgaagaccagcctgggcagcaaagtgagaccctgtctctacaaaaaatcaaaaagttatctggggatggtggtgtgcacctgtagtctcagctacaggggaggctgaggcagaggatcacttgaacccaggaggctgaggccatactgagctgtgtttgcactccagcactccagcatgggtgacagagaaagactctgtctcaaaacaaaacaaagcaaaacaaaaaacaaacaaaacatacaaagtttttggagttcttttcttagtagttaccagaaattacagtatacacctcaatttatctcaatctatttcaagtaaatactgacctaattccagaaaaatatagcagctatgttctaaaatagctcagtttcttccaatctccctgtaagctataaacccctagtacagtactattcttattgccctatacaattttatttttattataaaaattagaaagaaaatatatttatatactcttttacttacctatgtttttaccatttttgtgactcttcatttcttcctgtgaatttaaattgccatctggtatttcccttcagcctgaaggacttcctttagtgtttcttgtcatacagatctgttaacaatgatttctctcgatctttgtatatctgggaatgttttatttttgccttccttttttaagaagagactttttggttagataattgtttgttgacagcactttgcatatgtccttccgctgcctttttgcttctattgtttctgatcaaagtcaactttaaatagtaccagtgattcctgtgcacaatgagtcttgctgctttcaagattttcttttgtctttgttttactgcactttgcctatgatgtgttgaggtgtttatctctttgtttttagtctatttgggtttcattatcttggatctgtagattaatgtttttaatcaaattaggaagcttcaatgattacttctttaaatgttcttgttcaaataaactttatttttagaacagttttagatttacagagaattgtgaaattaacacagagagttcctatatacttgataccaaatatttcctattattaacatcttacattattatttgttacaattaatgatcttatatggagacattattgactgaagtccgtacatttttcagattttcatagtttttacctaatgttctttttctgtttcatgattctttccagaatatcacattacatttaatcaccatgtctccttaggctcttcctagcaattacagcttcttagactttccttgttttcgatgatcttgatagctttcagagttaatgcacaggtattttgtagaatgttcctgtattgggatttgtctgctgtttttcttatgattagactgagattatgtgtttttggaaaaaagatcattgaaataaagtgccattttatcaaagtatatcaaccaatataacttatcactgttggtgttgaccttgatcacatggctaacaagtttgtcagacttcactgtaaagttatttttttcctccttttctgtattatattatttaaaagaaagtcattaggtatatcctatatttgaagagaggtaaagttattctctacaacctgagggaggagtatcaatagaaattacttggaattctgcaggaaaaatttgtctattttaccccaattatttaggtattcaatatttttttaaatcaatatggacttatttattttatactttgggttataatttgatattattttcttgctcaaatttttccagttgtggccatcagaagctttcagttgttcctgtgtccctttgataatattccaccattgtggttttgtttatatttattttcttcttgttgttgctcttatttggtaagaacattctcttattttctggcactgcaattgctccaagttcatcttacatatgtcctgccccagtcctagaatcagccatttctctgagaagctctggttccccttttttggagaatgctatccgaaaccaatgtctggacattaagagtgctggttgctattttggtgtcattgtttttaggccctctcagctaacagagaaaggaaatatatatgggtatactgtcccatgagtatacatatatacctggaaatatttccatatgtaaccatctgtatctatattaaaataatcacgggtccatgctgatgtctccaattctaattcattaccacatggatcattctagcctcttccatgtgctgatttgtaaactctgattataatattaggaaacctagctcccaccatccacaattcatttgcttaattgtccaattctagcatgtatgtatcagaatcattagttcatacgtccattaggtatgtgttgtttttcaagtatagtgcttatgaacagccatattttttaaaattaatattgtgtatatttaaaggatacaccatgaggttatgggatatacagagatagaaaaaaagtatctaactatagtatttaactatagtgaagcaaattaataaattcatcatctcatatgtttactatctttttttttcttggtaaggtaactaaaatctattcatttgtcatgaatcccaaatacagtatgattttatcacctatagtcctcatgatatatattagttctctagactttttgcctattgtttgacagactactctaatttccagagttgctcaggtcagcctcctttccccagctttatttgaggttgtattaaatagtatacatttgtaatatagttagattgtaatatagttaggaatcccattccatcctgggattcctctaacatctgaattattttttaagttgcatacattaaggtttactcttaatgaataaggttactccaaagagtaaggtctactcctttgtgtaaagttcagtgggttttgacaaatgcataataccatgtgttaacagttacctatcatatggaatagtttaccaccctagaaattccctatgtttcacctattcaacccttcctctcatctgtctggacccctgacaaatactgatcttttcactgtttctatagtttttcctttcctagaatgtcatctaattgaaattataatctttttagattcttttcaaaatatttcactaagcaatatgcaatttgtaattcatccatgccttttcatagcttggtagctcatttctttttatcactgaataatatttcattgtgtgaataaaccacagttctattatctacacaacttttggaggacatcttggttgcttctggtttttgtctattacaaataaagttgctataaacattcacatgcaggcttttgtgtggatgtgttcacctcaaattattctagtgcatacgtaggagtaaaattggtggattgtaggataagcctattgttagcctcataaggactgccaaattggcttccaaagtacttgtaccattttgcattcccaccagcaaatggaagagtttcttttgttttgcatccttgccatcaactggttttatgaattttcagattttagccattttaataagtgtatagtaacattttattttgttttactcttttattttgttttattgttttaatttgtatttccctagtaacaaatagtgttgtgcttctttttcatgtgcttatttgtcatttatgtatgagatgtctatttgaatctttattttttttaactgggttttttgttttgtttttgcagagttttaagagttctttctatgttttggatacaaatcatttattagataagtgttttgtgaatattttatcctagtttataacttgtcttttaattcttcttattctcttaacagtgtctttcatggaacagaggttctcaattttaattaaatccaacttaacaattttttttctttcatcaatcatatttttgatgttgaatctgaaaactcattgccaaaccaaggtctcctagattttctgtcatgttttcttctgtaagttttatagtttcatgttttacatttaggtctaagattcactcgttctcattaatttttttgaaagatgtaagtttttttttgaaagatgtatgatttttttttttcatgtggatgtctacttgtttcaggactatttgttgaaagactgtcttttcttcattgaatttctcttgttcctttgtcaaagattaatcgacaatatgtgtgggggtctatttctgagctctctattctatttcatccatgtatgtgtctattcttttttgaacaccttgttatcttgattactgtagctttatagtaagccttgaagttgagtagtgtgagttctctaattatcttcttttttagtactgtgctggtgattctaggtcttgtgcttctccttatgtactttagaatcagtttgttgatatctagaaaataacttacggagattttccagctttaggtgagtctcaagggctagacaggcctgtagttagggaaatagttttctcccaggtagggataaggctctggtagcctttctcccttgaaagcatagatctgtgttatggagagcactttgggtgtatttcacaatagttacttttaccctcttcctgccaaagctacaagagaatttttgttgctgcttcactgtgaaagtataatcagattcctagtggttaaaaaaaaaaaaaaaaaaaagaatgtatgtatccctaagactgcaacccttaggatattctcactctcaagttagtttcctggctccagcaattaatcaaaattaccatttaaatatttctaccagttcattactccagcagctcttcctccaaggcagcaggtattggctgtaactctttggttgaagttgtcttgccagattcggtgtggcagtttgcctttagatttcagttctctaacaggtctaagaaaagtcatcatttttcagtatgttcaacttttttcttgttgaaaggatgggagtaatgacttctattattttttggtattagagctggaaacagaagttcacgtcaaatatatttgtctgccattttctttctttcctctttctgggactctcattacatgtatgtttatatcatgggaaaggaaaaaatgctttcatctgccttgctaggctctgccaccaggcctgagaatttggcctgaaaatgaaacagacataagacaaattaacaggagaaaagcatatacattttatgtaatgtttttatatgtatttggcagccttcatagaaaaaataaagatgtgaagaagcagttaggactgagagcttataaatctatttaccaaaaaaataataattttgtgaagaagtgataagacaaaggaaaagggatttaaacttctgtggtggtaaattgtgggaaactgactatgaaatatatacatgaaaataatagaaaataagaattattttagtaggttttatagatacattttcatgttgactcccagtgtgcagtgagtagaatattcttctctgtgttaaagggaaaacgactttctaatgggaaattttatgacctgcttttagataagaggaggtcagaaagcccctcctgcatttgctgtttctcaagtgccttcagttcaaaacaatcaatacaccaaagcggaatattttggggtggcacattctgaatcccttcagtacgtgtataattttctgacaagtctctgagtctccgcttatttttctgtaactattttctttctaatcttaaggtaaattaatttctatttttttcgtcaaaatcattgatgattttttctgccatcacaaatttgctattaaatccatctagtaaatttttcatttttgttattacatttttcaacgtaaagatttccatttagatatttttagctttctatttctttactgagatcccctatttgttgaatcattgtcctcaaatcttttttaattctatgcaatatattcagaatagctataatgaaatttttgctgcaaaatcctacttcttagtctacttacagttagttctattcagtggttttttttttttttttctaaatctggtctatactttctctaaatatggtttcacacttagtattttttgtatactctaatctttggctgtacactggacatatgaggtaatatagtaattttgtgttctgattttactttttctttcttttttcttttttgcaactcacttgaactttaactgtgtaattgatctcccctgtagcatatggccatttgtatatatgctaagattttttatttttgttatttagcctggcttcctaggggtcatcccagtgtctacatagcttagtggtcatccagtgatttggaataggctatattcaaattccatgcgcccataattcttcctccctctgctgactggtctttgggtgtgggcacaaagttgtcagttttcaagtcttctgtgactttcactttaaactcaaactttcttggtcttgccccacacacatgtatagcttcctagtcagccaggtgttcatgaagagcttctctcatctcttctatggccctcttattcctaagagctctccactaagtttatgcctggtttaccatttgccccaaccagtaccacaaatttaggctagtagacttgtcagtcacccatttattttctactgacaatgctgcctgttgtaggtttttgtcctatgcctgaaattgagcccacctggtctggcatcaaagttataggtttcctggccagctgcacaatagcaatgctgtcattattattgaccaagctgggatgggtggtgaatattggctccagacaagattacagacgctattgtttgtagctgaaggactaccagtttttcataaatatgtatttctcaaattgttctttgcatttagtcaatttttagagttccaagatggttgtttttgacaattgtgtccagttttatccttttcttgtggaggtaagaagatttgttggtctctccactcctctgtagctgtaaggcttcctccctatttttcccttttttgtttgttttagtagaaaattatgcttatagatcatcatctggttgctagggagaagtcattgctaccagttttggtgctttttaaatgtatatgataaaatacatcgcaaattcacctgataaaaaacttcagatttaaatttaggattacaaggttttttttaaatgtaatctctttgatcttacatatgtatctttttttcttatatgccaaaactcctggttcttaataatatcaatgtaattattaattttgtctaacaatatacatgcatcagcctcagaataatagcgtcaacattaccacaaatatagttacttaaaatgatttgatggtttttgtgggggtgtgtgtgtgtttttacactgcactgtatgttttataatataatggtgatgatctcttctgctgtaatatatttatatattttccacaggtacgagagtatgtctgcttgtcctggggaaaaaaaaatctgtacattctctcttgccaaatccgtaaacatgctgtgctttatatccatgatcaatgatacaacacatttcaatgaaattcaaagctatttcactgtccagttctgctgcatgtttttattacaccataattctgctcacaacctgattcattttacattccaactttatctcagatgtactaacgtgcttttaaaataaggaatattaaagattttcaaaaatagttgtaaaattgagtattttctgccatttcacagctccttcccatttatgagagagccacatgacatcagcccatagactgtggagagtattccagatctatcacattctgcgattctgcgattcccagaaggctggtcatgaaaaaattccctcttcagtttacatatatggcagtggtaagtggaggcacctagatagaaaattttactctggtgaattatatcttgtatattcttcaaattcaaaagaataaaaacaaactaaatgctagaaaactaatgaacaaacaaaaccttccaaataccccttctcaccattacatttatttggaaaaatacatttttaaagtatcatgaaatttttcaatcatatgcagatgtagaaataataataaagtaaaactccatgcactcactacccagtttcagaaattatacaatcatgacaaatattgtttcatcaatacctccattcacttacactcattgagtattttttgaagcaagtcccagaagtcaaattatttcctttgaaaacaatttcagagtgtatttccaaaacataatactttaaaaaagaactacagttgcagtcacaagtaaaaataataatttaatatcatcaaatacctagccattattcaaatttcaaattttcttacaaatactatatttttgtagcaatttgtgtgaatcaagtccaaaaatttttaattctttccattgttgaaggaaccaggttatttatcctgtagagttttctgccatctggattttgataattatattaccatggtgttgcttaacatcttcctatagtctctgctgttcctgtaaattgagcattggtgctagtggtttaatcagatacaggtaggtttatttgtagcaattctacttgataaaggttgctgtgcttttccttattaagcatttactgtctggttgcctctcttttagcaggtgatgatgatcaataactagatacatcagttcattaaaggttgcaaaaggaggctgttctaactctattattcttactttatacatctattacatgtatatataggtgtatctatgggtatatttctgaaatatgtttaccaatagaaattttataaaccatgtaacacagtttgtataggaaaggcaggataaatgcaaaatgttacatctcacaaatgagccataagcataaaagcatgtggttcaatgccataggagaaggtagtatctccaaaaggtttctatcttcctcagattctaaaaagccctttgcagtttttcactcaaaagttctaattacatatattcctaatatttaaaaaataatgtttataattgttttctgtctaaagagttatgcatgcttattttagaaaatatagatcgatctgaagaagaaggggaaatcttccctaatttcattgcctggagaaaactactgtccaagagatttcaaagatgactattccataagggtcccagaacctattaaagaatcaagtcagtaaacagtgataatacttgagctgcagaatgaaaacacaaatgatgttaaaaagtacttcagtgggatttttttctggaattttatattgtggtaaaatacacacaacataaaatttgctacagtaaccattctaaacaattcagtagcactaagtacagaacccatgttgtgaaaccaccaccagtactatttaaacccagaacattcttattttcccaattgaagatcttgtgataggtctacaattctatgaatatactaaaaataattaaattgtatattttaagttgttgaatttaataatataacaattatatctcaataaatctgctttttttaaaaaaaaaataagggatagcggagaataaaatagaaaaaagtcccttgccttcagggaatttgccttctagtgacagccattaccattataattctctaatacatttagcagaaacacaaagtgatagccattaccattataattgtctaatacctttaacaaaaacacaacaaatgagacagattgcctgtagaagataaagactggatatgctattcttatagatacccttggatttcctgaatataacctcaagtttactgtatctgaccctagttcccatgaacagatggccaaccaaggatgcaatggggcaactaatcctgtattttcctaaactcctaagttaaaatttgcaagataccttatagaaagtttaaaacagtatcttacagagtgatgctgagtggacttttagatctggaagtagccttaagagatgattaattttagcataattattttacaagtaggcaactgacacccatgtagatgaaggatttagccacaaccaatcaagcacgatctgactctacaaagcagttgtatctgagggcagtgctgttctgttctgttttgttttattttctctgtgtgtttttcagaagcgttatctgcttgacagctcactgctgtatttgtaaaaatagactttactttgctatcccagaaaagacggaggttgggttaatacagtgtatcaaataagcacttttagtttagattttctgatgtcaattaataatggtgaaccgcaaagctgcagaagaatgagaggcagaattaggaataatactgaatttttcctgtctcatgcatgactgtcctggggtatggtgggttcccacatgagcctgaagaaaaaacttagtgtgaaaagtcttcattttgtccagttgtctcagaaaaatgtgtacatacagagaaagtgatgtccctgagaggtgaacctcttccttttgttcttagttggtggcagagtcaaaacagatcttcaggcacccagttgtgtagactctttggttttgatgctttgataatttccaaatgactaacactctctcatgcctcaattaatctaacctagtgaacacaagtgaagctttccacagcgccctgtttctgagatttttgtttttgtttgtttgtttgtttttgttttttgagatggagtctctccctgtcacctaggctggagtgcagtggtgcgatcttggctccctgcaacctctgcctcccaggttccagcaattctcgtgcctcagcctcctgagtagctgggattacaggcgtgtgccaccatgcccagctaatttttgtatttttagtagagatggggtttcaccatgttggccaggctggtctcaaactcctgactttaggtgatccgcctgcctcagcatcccaaagtgttgggattacaggcatgagccaccacaccaggtcaggactctgtttctaaatgtgagtactcattcaccttgtgaagtgtggattgtggatggagagaaaaaaggataaggagattagactgaagctatcaatacttaaagtgagacttttcaagctccaatgggaccactggcatgactttcaatatggcttccatattgctttggtgacaggatgagaagaaggcaatactgagcttggcctgctcctcagaggttgtgggatctcttaatcaattttctgttgcttacaacagaatacctgaaactaggtaatttataaagaaaaggaatttctttcagtcctggaggctgagaagttccaggctgaggtgatacatctggtgaaaaccttcttgctggtaggggctttctgcagtcccagggtgctacagggcatcacatagtgggtggctgagagcactgacatgctagctcaggtttctcttcctcttcttacaaagccactagttaaccacatgataatcattaatccatgaatggattaatctattcaagagggcagagtcttcatgaatgatccaatcaactattaaaggacccatttttaatgctgccacattggggattgagttttcaacacatgaaatttgggagatacattcaaactatagcatgaggtaaaggaagcatgagtatttccttggactgaatgtggagcccaggaaagggtggcactgaggcctttgtttttgaggggtgaggagatctcagcagaaagaggcagatgaacatggctagcagcctacaggctaagcacagattggcagtgcatcaattagaacagaaaggaacctgccaaaactcatgtaggatctcagattttagtcctctaatggggtggtgcgataaaaatgtaaactatacgttgaaaaacaaaattgcattttgtttccattcactgcagagcttttcaacatacagtttaatgtgaagttatgctgcaagcttaggaatggggaggaagaggaaaagtaggggtggtagtaaatgaagggtccacaattgttgctgagagcaggcttgctctttcaatgggtgcaggctgtgtggtgtctgagtggctggcatgatttaataggaacaatttggagtcatacatatatatttctatttaaaaattaagcatcataacagctatgatagatagattaggcacatattattaccttcattttaggtgaggtggtccaaaaacaaggtgattagctgtcccaagatcatagatttgtttatttaggggtgtgagttagttgaagtggagcaagcagtcagatctaagggtgagctaggtggccttccttctaccatttctgtttatcattcttcctttatcatgtccattacagaaccatgtttcttctaaggaccctcagattgctagggcagatcctgtaattcaaatatcttgtttttgcctgctgccttagcatcagtctgagaatttgcttgaaggcatctatcatgctgatggttagaacataaacctgttttgggggaaaagatttgaattgcctacaacaatttgtggttaatgaattgtcctaaaggttttatgtgtccctctcccactgttttgcatggtagttgtctcatccccattaaaagacttttctcatttgaactgtttttatgaataaagggctctttcattttccacagctgatttccttttattgtctttattgcattttaacagggagacaaatgacaccacaaacagacgcaagggagactgactcctcccgccttgcctttatgtgtttttattaaccttttttcatcccttagctcaggctgtgggatgtagacctttaatgcaggtcataaatgaacagccagatttgaaacttgatggaaaagctctctaatgggacagaggattcactgaaacaatatttgtttttaaaaattgtgtttgaagttacaatgacaatgatagaaatatcaattatagtaataaacattgtaacactgagtattgaggtatataggcagaaagaaatatttagtatcctttatatgctaggcattctatatatttttctgctatataaataatatatgaatacatttatatgacacaaactttaaaagatatgggagtatatgtgataaatgatcaaaattatctttcttttttccctcaaataccactagtttcatcatatgtatctattaacaacttcatctgcatatacatatacacattcatatcttaatgttttgttttgtcatgcatgagttcaaaacctctgcatattattcaatgacattctaatttgcttaacaaaatctactctgcatatttttcaatgacattttaatttgcttaattttaaaaggcttactatttgcactttatataaatcttccttactctttgttttttgttgttagcagcatttccctcttagagatttaatttttttggttgttgttaatacagtgaaagcttcagtaaacatccttgaacatacatatcttcccataggatacatttctagaaatggaatgcatgtgtggaaggatttgtacatctcatggtttggtagatagtgaccaattccctgtagtggctatgccacttcaagcatccaccatattgtatgagtgtgactcccgcctctttgtgtgttcttttattcctcagaataccctgacaaaggaaaactctaatccttatttttatcaatagagaataacaagcttcagaaatgttaagtaaaattgcctgaggttacacaactatcatgtggaagatgagctttattccccacaaaggcccatactctttctgcattcaggacatttttggcatgaagtccataatagctagctttgctactaagttggctttatgtgtttgggaagtcacatcacctctctggttcgattttccttttctgtaaaatgaagtagttggactaggtgccttagactcctttgactttgaattgtaaacctgttttggggagtattttataaatgctagtgccagtataattttggctggattttgaacatatttcttctacttgggatttcacttttcaaaagggaaaaggacttgaattgggattaacattaggaatattaataaggttaatattcatcatcataagtaaaattgttaagcttggcctgtgtgctaaatactgttcgcttttccaagtgctttacatgcattattttgtaccatcctccctgcattctggtgagccaggtatggttattgtcttaattttacagatgagtaaaaggatgagggaggacaaaactcttgtctaagatcacacagcatgtgatgagcatttgaactcagactttcagagactgagctgagaagcaaatttttttgtgagtgtgggagggggaggcattttgtggaggaaaaatacagtaattcttccttggactatgattaggaaaggaagggtcaaaaaacaatgaattttctagataactaaaacttaccctctttaggttcaaaagttaacttttaacaacttgggataaaaatccttttataatgtgttacatactcttctgtttacatttaatttgtttaaccatttcttttggggacagcgtcattgtataggtatttgttagttccttaatagattcctgctcttgggaataattaaactgaataaaccattctccttttctctgaatggtctcgaattggcatgcattttgagtgtttcaggttcttttttacagttatgcttctcttgcctcagtgtcaaggtgtcagctttgaaggccactcttgtgtggagacggtgctaccaactgactggagacaggatgtgccctttggataggggaccgcataactcaacatccaaactgggacactgttattatttaagcaggacaacaggaataagatgagactgcttattcaaactgggatttacagtcactttacttagggccaggtccacatcctgccttgcttgcttgttaaggaatcttgtcacaaattatttagtttctctgaaccacagtttcctcagttgtaaattgggcacaataatgccaacttgtaagaattagagagaatgtacatagtaggtgccttatgatagagctgccacatgggttgttgagaggaatgaaagtcaagggcataacacagtaactactttttgcctgttaactttgctattgtttaggctatgattattttgctttgtgttgctgtaattgtgtctacatctggttgctccctccagcattctcttcttagctacttccaatatgatgtgggctgggaaacaagataactgaagtgttagtactccagaaaataactcatctctgagttaggtgcaagtttttcggttttgtttgtgttttgtacaagttttcaccttaactgcttaaagtattagtctttgaccttgtcattggcctaaacaataaatgttgtgtgataattcatcactatataggtaatgcttcttggtgattttctgtatttgaatattatcgtttgtcagcatggtactgttataaaaataggcaggtataaaaatacaaatatgttttattatgtaaaaatataaatcaatagaacagaatagagaacctaaaaataaagccaaattcttacagccaactgaacttcaacaaagcaaacaaaaacataaagtgggggaaataacagacacactattcaacaaatggtgctgagataactggccagccatatgtagaggaatgaaactgtatccttatctctcaccttatacaaaaatcaacacaaaatggatcaaagacttaaatctaagacctgaagccataaaaattctagaagataacatcagaaaagccctcaagacattggctcaggcaaagacttcatgaccaagaacccataagcaaatacaacaaaaacaaagataaataaataggacttaataaacctaaaaagcttctgcatagcaaagacacaatcagcaaagtaaacagacaacccagagtgggagaaaaccttttcaatctatacatctgacaaaggaatccagaatctacaaggaactcaaatcagaaaaaaacaaaacaaaacaaacgacaaacaaaaacaccaaacagtcccaacaaaaagtgggctaaggacatgaacagacaattcttaaaaaaagatatacaaatggtaaagaaacatatgaaaatatgctcaacttcactaatggtcagggaaatacaaatcaaaaccacaatgtgataccaccttactcctacaagaatggctataatcaaaaaatcaaaatataatagatgttggcgtggatgtggtgaaaagagaatacttttaaactgctggttggtggggctataaactagtacaaccactgtggaaaactaaaagtagaactacagtgtgatccagcaatcccatcactgggtatctgcccagaggaaaagaagtcattatacaaaaaaagatacctgcacatgcatgtttatagcagcacaatttgcaattggaaaaatatggaaccagtccaaatgcccatcaatcaacaagggatgaagaaaatatgttgtatatataccatggaatactattcagctataaaaagaaacaaaataatggcatttggagcaacctggatggaattggagaccattattctatgtgaagtaactcaggaatggaaaaccaagcactgtatgttctcacgcataagtgggagctaagctatgaggatgtgaagccataagaatgatacaatggactttggagactcaagggaaaggttcagtgtcgggtgagggataaaagactatacgttgggtacagtgtacactgctcgggtgatgggtgcaccaaaatctcagatttttgggtttggcatgtggtcagactgcacagccagccagcctctcctctgccttctccctctccccgaccttcctttctctcctcctgcccccacctttaattcccactcttttaaatttttgatgatccttttgttggtcatgtatttagccaccatttgctgagccccagcttgtggtaaccactgcgtcagggtctatggctctaaatgtggtttctaagctttagaaagctaacagtccagagaggaagatagatacaaaaataaatagccatgtgaatatgtttaattaaacatttgtgagaagaattatgaaacccctgaggaggggttgattgtgccatctaggaagtaggaaatggcttcatagaggcagtcaagagtggacatcaggggctatgtcatttccaggaccagtctcaggccatgtgttaggatatttaggctcatttcaagtattctaaagagttgtgtgagttaaagaaaatatgttaactttttggtgcttcagttttcttatcactagcagtggatcagaatcttcactgctgtgaagacagagtaaaacaatgtttgagaaagctctatgataagttttaggcaattccaaatgttatcttcattttgctgttataagaaatagcctgggccattgaactgatggttcttcctagccagttcctctctctacatctttctggaagaatctatgcaagaccaggctcctttcctgaaagatacaacaaaatgagacataagggcttgaattctagcccttcaaaaagctggaagttttaaaaatgatggtagtgatggcattgccttattctcttggaacgcttagagcgtatcccagcacttacccagctaggatctcatatgtcatttaggttagaacaggtgtcaccatctttgctttatagacatgtttaccatgggacaaaaaacaaggaggattgatttgtgctaacaccagggtagagtaattgagtgtcaggattctaaaaggcaagagatcttgaaaatagcagtgtaaccacatataaagaaaacaatacaggcatagatttaataacatttccagggtcacataattaattagggaatagaagcagacctctaaccccaggctcttgtgactgttgttgaaacatactggaccacatcttcatcttgaattcatcttcagtggttgagcttttcgacctttgcctttaaatttgatgatgcacactcttgcttcctacttcacagctttcctgtcaattgactgataatcttaaaaactaggacttagttgtattaaggacacttactagatgcagtaatccaacattttgcagatgaaataacacaattattttacattataggtcttcctccattttaccaattagcttattttgtaaagttgaatattctgctctggaatttacctaaagcactctcggcatgtcaggacttgctgcaggctctgtggacttcagactgagcccttgactccatcttgtgctctgaaggacataaggagggcagtacatctgcagagcttcaagtgttaactctacctgcatccctaaaccaatcttggcaaaattgaccctaggctctatctaccctaccagtaaatatgccagacaaaaatagattcaattaatttcctctcatttagatcactgaactgacacttaagaagataccagtgttgctttagatggcttttagtcctgtgttcatgttctgagattctttggcatagatagtaaatggctaggtcttgggtaatcctcatttctggggaaacagatatttccccttacttccgtctttctgcaacaaccgatcacagaaaagaggggactaaaaactatttgttagatattgataaaggatgtaatatcaataaaatagagtgaagaccattaacatattagatagaatggccctgcaagagggatgaagtttatcgtataagtttactgcaaaggaagagctcgtattcctcttcctcaagtgcaagcccctcttaatgaaactgacggtatggaatcttccagtcattgaggacctgctgcaagcctggccctgaatacaatattagaggctgaagattttaaagaaaaataacatccaagtcccagcaaccaagatgcctatagtgtaattggaagaaaaaagcaaaagacaaaaaagagttgaggaagtttcttggaggaggtgacactggaatatagccctggaaaaggcagaaagaaagagacatgaggtggaggggaagaactaattgtgtttgagaaaacattgatgagatagtcaatgattaagaacaaattgtgggataaaactttccaggtaatctgtgtgcattttaactaaaacactttttagtgtaactgcctccctcattatttttttggctaaccaaatatattttaacataagaattgtgaaaagttaatttatagaagagaataaataaattattaagtataaaaaattaatttactagtaattaaaaatacaaaataaaaaagagataactagtttttgcctatcaattggcatagatttaaataacaataaaatatactgctggtgaagataaagaaagacaagcaatcccatacatggcaggtgagaaatttggtacaattattgggaaacaatttggcaatatgtgtcaaagccttaaacacatttataccttccaagacactaatcatgtttaaagaaagagtgtttttatagcagtaaataaaaacatatattcaaggaaattcattgcaatgttcctttatttaaaataaggaatattagaaaaaaatacctacatttgataacagatggttaaatgtgttacatacttaggatattattctcgcattaaaataatattttagcagtactatgtagcaatagctaccacgtattgaggatttactatatattaggcactatgctagtaacattgactataaatcttaatcattaatacaatagattgatttctcattgaattttatttacttagtatttttataaatttatggggtacaagtataattttattacatgcatagatttcataatggtgaagtcaggacttttagggtatccgtcactcagttaatatgcattgtacccattaagcaatctttcatcattctcctcctcccaccccttcacccttccaagtctccattgtctatccttctatacgctacatctatgtgtacatattctttagctcccacttataagtgagaacatgcagtatttgtctttctgtgtctgacttgtttcacttaagataatgacacctagtttcatctagttttcattttttatggctgaatagtattccattgtgcatgtagatcacattttctttatccaatcatctgttggtagacatttagtttgtttccatatctttgctattgtaaatattgttgtgataaacatacaggtgcaggtgtctttttgatatagaaagtattttccttcctcattgaattttattattgttttagaggaaatgttcaatgagagttgagcattaagatgtttctaaaactggccctgacctaccttgctaagctccagattttcttactttagagatgggaaccatgaggcccagaaaattatttaaagtcaaagaacaagtcagaggcaaagtcaagagtgaaacctccagatattgatgccatgtcaatgaacttttcattctgtatgttcttctggaataattacatctcacattacaaacatttatggaaaatctatcatgtgccaggcactggtctaggaattaagcacacaataaacgtaaatcctgtgctctcagtttacaacccatggggaagacagactcactaaaataaataaaataaataaataaataaataactaagctggctaggcgtggtggctcacgcctgtaatcccagcactttgggaggccgaggcaggtggatcatgaggtcaagagattgagaccatcctggctagcagggtaaaacccccatctctactaaaaatacaaaaattcgctgggcgtggtggcgcgcacctgtagtcccagctactcgggaggctgaagcaggagaatcgcttgaactgggaaggaggaggttgcagtgagccgagactgcaccactgcactccagcctggtgacacagtgagactccatctcaataaatacaagcaagctagcgactgaaccacaaatcaagtcctttttggatgaaaacagggtatcaaatgacaaaaaactctccagtgtgacagatgtgataacaaatggacatattgagcccagtggtggcagagagcaggagcttattgacctaccatgagtgggttagcagagacacctcagactgatgactaacatttgttcagaacttatcaaatcccatgcactcttccaaatgcgctatgtaggttaacttaggtaaccctcccagcaatcctgtgagggtaatactatgattagtattatttcccactttgcagaggattaaatcaaggcaatgagaggctgagtgactggcccagccagtcagtcaacaggagccagagtttgagctccagtctctattgcccgcttgcctctctctacccagtatgatgcttggattggcaatcaaaggatgtagagaagaagctaattctaggaagagagaatgaggtgtttgccgcagggtgctgaatttatttagaaaactttaggaaattcacttttgggaggtggaggtgatctttgcgcggtgggggtgaggtgtgctccgccatgaggcatgagccttaccaggccttactgaggagcttggctcttctccattaggcaactggaagccattgaaagtttaagcagggaagaaacacgatgcagcttgcctctttgaacaacttcgcattcatcagtccaccaagtgactgagatgggttcagccagcttctagatccctgatcctgtgaccagggttcggccacactcttcttccagtaaaaaaggaatggcctcaaatggaaaccattgctacagggggttaataaaatctcccagggccaagaaagctaaaccacaatttaaaaaccttcctgcatagctggcggctgcagtgcgtggcttgtaggggtgggtgatctgtgtcatcttccttgacagtatattgctttgcatcctcctcataaacatttctgtttattttgtgggagggtaaagtgccgacagaagttatccaggaggaaaacaaagaaacagcaggccttaaatcttcatcaagtttcagaaagcttcaaaccaacacaagaaactctcagatttgggacttggaaaactgggggctttacctgcctcctgcctccctcccattcctcgctcctgattgcatgacaccctttccctttctcaagtcttatctctgaattccacctcctaacagaccaatgttctcatagtgccaaagcctcatgctgcagttccccagggcaagcttgccctttccagaactgcccacctttcaaaattacttccttacatttctagttacagctattacactcctcctggggctgagctcaatcaaatatgtgttagaagcagagtaatttaattaaattgcatcccactaaggtataaataacgtatagccccaaacccatccctacaatcatctcaggtatgtggaggtcacatttcaggatcccttagcacatgcctcctttctagacgcccttgccagaagctgaggcagacttgctccttgtgtactctagcctctatcctgcagtttttgaaacatttgtattcacctacttaggaccagctgctgtcccttcccccaaacttggggtgccctggcctgttccctacaaatctgtgaatgtttgtctttgctgtgtggatcatattcagtctcagagcttggaaacaggaagggtagacaaatgattaggagacaggggccacgtgtggtggctcacgcctataatcccaacactttgagaagccgaggcaagcagatcacctgaggtcaggagtttgataccagcctggccaacatggtgaaatcctgtctctactaaaaatacaaaaaaatcaggcagatgtggtggcagatgcctataatcccagctacttgggaagctgaggcaggagaatcgcttgaacccaggaggtggaggttgccgtgagctgagattacaccactgcactaaagcctgggcagcaagagagagactctgtctcaaaaaaaaaaaaaaaaaaaaaaaagagaaaaggagagagaggtgtcgctaaggatgaattatgtacatctaaaagagaaatgcagttttcttgaaaaaacaagtttatcagatgtgattagaggagtttgcagtgacaatcgaatgatgtgacaaaatatccggcaagtttatggttgggtgatgagtttggactaggagatgggggactctctaactccaactttgtttaagttacctaccatctttgggtctaagtgtcattatctgtaaaatgagtaggttgggccagagagcttcagctccttttagatctaattgtaattatcaagtattggatatcacatgaagactttggacctgtgtgctgtaacactgacctcctgttctgtggactactaatttctctgctatagcgcatatgaaaggccacactcacagagagacatggtagaaaggacactgaacttggaaccaaaagacctgggttccagtctgggttggcctagtaatgtaaacaagtggtgtttcagtttctttgtctataaactagggttagctattcctctcctgtttttttttttttctcatattggaaaccacacagctacatgcttgctgactctttttattgttttcagaaatgtctctgagctgtgtgtggtgtctgacgtgtgtaattccagtgctttgggaggccaaggtcagaagatcaaatgagcttaggagtttgaggccagcctgggcgacatatagagaccgtgtcagaaggattgcttgagcccaggagtttgaggctgcagtgagctatgatcatgccactacacaccagcttgggtgatagaacaagaccctacctctaaacataataaaaacaaattaaaaattgaaaaaaaaataaaaaattaaaaagaagccacagatatgtatttaaaaaaaacatggctttggttctgaaagtcatgtgtaagtagaatttgtattacctcgtggctgctgaaggcagggagaggtgcaggggtgaagatagagtttcctgacttgtgtttaatagacctttgtgccccagttacatgtaactggattactcttttgtaagccacacaatggaaaatcatcatttacattcctgaaaatgaagaacactaataattaaataacatgatagcatagaataatgacatttcaattgtatgagataaacaatttaaatgttttcttgccttaaatctccaagtgaaatactgaggaaaaacaagaagacaaaagatctcccaactctaaaagggaacactttcaaaagcaagctcaggtcctggactatcaactctgtcaacaagaggagaatagaggtgaggttaatggcatttttcttaattccatctgtttcaggcatggatgatctttgatctttctgagttttatctatcactgaaaagattctcttggactacatgggttttagtgtcttctctgattggaacacatgattgacaagcatatactccccatcatagctaaaggtgctggttacaggcaagaatgaaaggagtttcgacctcagcctccgtcaagggcaggaccccaagggaggtcatgtttgctttgcatggttgggaattgcttaccagagcttctgcttcctttgtgcttcacattacacagttggaacgtcatcttgatgttataaaagtcactcaggttaggactctcgctgccctcattcacactgtgtgccctcccccgtttactcatcttggcagaaaatgatttgtaatctcatattgtcatcttttcgtgtggctatgccaaatatgctgaaagaaattataagctcttttggatctggagctctattttgtacctctttatcccttaactgttgcatttctgagtcagaacatatacctctcctgggtttaaatttcttctttcatctttgtaccctcagtacagttcagttggacacagtaggcactttataaattcttctagtgaaacaatatatattttttaatttaatgaaagtcctttatcagtaagattatgactcaatgataattcagtcagcagcaaatagggaacctctttgatttgagaagtgcaaagagattgaggatatcttcagaagctatgcctccctaaagttagcctcctagtaagataagactgtatttctacatctcttgcaagaacccaggaaggacagaggagggaagaaaccaaaaagtcagcttggtggtactgaagatatcggcttgtggccaaccactcatttactgcagggaacattaaactacaacaatcccagatccctgcaattggtgcttcttggcagatccttagaaatgatcgaattcaattttcttattttacaaataaggacattgaggccaaagaacttgggagatgactaatttagaaaatattgttttgggaagtaattgtattaaaaaaataactccacagcttaacaaaagtggtttctatgttcaagttcagtgtttgtgtgaaacccttgaaattaagttataacagcagaacacaacaatgtatttctgtggctgagacctctaactatcctccaaagatttcttctttccttccatgtcacagggttgtttctaggaagtggatgctcagctagggacattttttttctagctgtcttcgcatttactttggacctagtatctagcctggaccatgagatgcaggtaaaattcttatatttcacctgcagaattcacctccaggaagtcacaccatcctccacaatctctttcctgcatggtcttacttcatcataagttaccatcattgataaactgggagttaagacaattaagaaataaagatctaacctcagctgaaatttgcatatcagattaagtacctgtaggatagtattgccttgcctgtatccacataagctcagggaatcttttttttcccatctgtcagattatcaaactcaaagtttgaaatgttctttgctggtgaaactgtggtgaaataggctctttgatatattgctgataagagtatgaacaggtacagcccttgtggagagcaggaaatatgtatcaaaattagttatggggccggacatggttgctcacgcctataatcccagcagtttgggaggccaaggcaggagaattacctgaggtcaggagttcgagaccagcctggccaacatggtgaaaccctgtctctactaaaaatacaaaaattagctgggcgtcgtggcagatgcctgtaatcatagctacttgagaggctgaggcaggagaattgcttgaacctgggaggcagaggttgcagtgagctgagatcacaccattgcactccagcctgggagacaagagcgaaactccatcttaagaaaaaaaaaattatacactcatttaacctttaacttagtaaacccatatctggaatttattctttacacacacctgcacatattttaaatggcatgtgggaagagttatccattttagcattatttgtaatgttaacctgtgagaaacagtccaagtatccatcattagagggctggttacataaactgtgtgtattagtctgttttcacgttgctgataaagacataccccagactgggcaatttaaaaaagaaagaggtttcatggacatacagttccacatggctggggaaaccttgcaatcatggtggtaggcaaggaggagcaagtcatgtcttacgtggatgacagcaggcaaagagagaacttgtgcagggaaactctgctttttaaaaccatcagatctcatgaaacccactcgctatcatgagaaccgtatgggagaaactgcccccatgattcaattatctccaaccaggtccctctcacaatatgtgggaattatgggagatacaagataacatttgggtggggacacagagccaaaccgtatcaccattgcacatccacacagtgcaatacggcacagctggatgaaagaacaaggaagattactatttatgggtatggaaaagtccccaggatattctgggaagtgtaaaaagcaaagttcagaacagtgtatgtagtatgctaccatttgtttaaaaaaggagaaaagggataagatatattttcacatgtactctcaactgcatgaagaaattctgtgtttgaggagagctgaaaaaggagaagataggcacagaagtgagaggagggtttcttaacctataccttattatatcattattttaatctgttaattaattgcttattaaaatacaattaaatcaaaaataaaatggaaaaaactacagagcctatccccattgggttttacacaaaatggcagagaagcaggaattactagctaaatcaatgttaaaaaactatttgttattaaagaaaagacaaacttctctttggaatgattgctgtagaattacagctatgcttctgtctgttccagctgggtcagtttattgcattcattgacttttgttttcaactctaatcatttacttgattgaatgttgctttcctgccttccttacatcactgatgcgtttcaataaataataaattttgctcccataaccttatttgtttaaacttctttccctttgtagttcctaagaactataaagtctcccacctgtcagatgctatgtttggagctggagatacaaagacaataagacatggccctaagagatcataattacaggagagtgagagataaatatctttttatgggcgaaattgtgttcccccaaaattgatatgttgaaatcctaactcctagtaaatcagaatgtgatttactgtatttggagagagcatctttgaaaagataattaaggttaaatgaggtcattagggtaggcccaatccaataggactggtgtctttataagaagagacgattaagacacagacatgcggggaggaaagaccatgtgaagaaaaagggagaagactatctttgaaaaagctgaggacaggtgcctcaggatgaaacaaattctgctaacaccttgatcttggatttcctgcttccagaactgtgatgaaataaattactgttgttaaaatcactcaacttgtggtacttagcaaactaataacatctctaatgcatttcagttagaggtgtgatgagggataaagaagcacagaatggggaccactactttaacagttcggacaagcagaaagttggcacctgaacagaatctatgaggcaactctgttgccatcctactttacaggcgaggaaactgaagcacagaactgttatgtaaattgcccaagattacaagactaagaagtaatagggccttcattcgcattaaggcaaattcctctgaattcgtgctattatggctatactatgctgtgcctgataaaataagatatcaggaaaagtgatgaatggaggagggagagcacatagagtgttcatggagttacatgtatgtggcttgaatataaagcaaaaggttaaatggcagcaggtatgttgggatgggtcctatgggccttatatgtgatactaattctgcatttttaaaaatccccaatgcattaaatctagaaatcagtgaagccccatttttgcatttcgaagtagaaatttaagcccctgtgcccaaaccgtaactattcaactcagtgaattttcacaaactgacacacccatgtaactggcacctagatcaaaaagcaaagcattataagcccctccaaagttttctcctgttcctttcatttaccttctccaattataactactatactgacttccatgtgcatggattcgttctccctcattttgatcttttatataagtgaaatcatccagaaggtactcttttgtatctggcttcctttgttcactcttatattatgagattcatcctgttgcatatagttatagtgatttcattctctttgctatatagtattccagggtgtatttgcctcagtttacttatccattctattgttggttgacatttaagtggtttccagcttgaggctattttgaataatgctgctataatcattcttataaatatagtgaacatatgcacctaggggtggaatcgctggttgataggatatgcatatgttcagctctactagatactgctaaataacacatatacctaattgtgaaatactgaaagcttgccatgttgactttctatttactggcgacacataggaaacaaaattttttaatgacacaattatccatagcttcttaaagcatcaattaagaattagttgattaaaagatatgcattatttttgtactgaaaattacaaaacatcattaagaagaatctatagaagaatattccatatttctgggatagaggagtcaattctataaagagatctatttcaacttccataaacttccatttctgtaaactcataccatgcagactctacatgaatgaatgcactttcttttcttttgtggaatgcttgtgatgacagcaaccaccaaataacttgatagaattttaaaaaattgacaagaacaaatttagttcagtcacctgaattctgtgcagcggtgcattttgaaaggactaggaaggtgccatattggaagcaggtacgccatttcttgataaatccagtgctgcttatttttttcttccagctttgtagcatacagttatttctatagttgagtattagatgaagtggtcagcttgcacttagtgcatattgtaaaagctgtgtctgttctcattaggttttcacttaagggaactagaaccagacttagaaacagcagattgatagctcccacctcaagcgcactctgaggcatatgctcagtggaggagaatagctggttgggtcgcccacactatttaaattgttggttctttttctcacccttttttttggtttgtttgccaaacatatgtgggtaaattgcagacgttaaatgcctgtgtgctgagattgccttatatctgattacatattctttcttcaacccttcctactttattatgattgctagcacctcaacattccctgactacaggggtttatgattcattttggtttacaatttgcacgggtaagtgtcccatttttggataacaatatagttatttctttaaaattgaagaaaataagatgctggtaaaaaaaggaaataactcactatttcttttcatgaaaataacaggttgtttccttgttaaacacttttagtaatttgtcaaaaaaattacagtattttccatcctcatctaacaggtttttacatgctacagttacaaaggctgagattcaccaacagaagcccatgaagttgttggcatatccttaagtgtgtttctcattttagtgctgggatatttgaaacaggccatcacattttccataaatctcatcttttctaattcacgtccactaattctaattctatctgaaacaatgaggcttctaggttgccttgcatgtctgagcaggacaaaaaaattaaagaggaaacagttaatggggctgaaaaaaactgaaggaagtaagaaaagtaaaatcttgtgttggagaaagaagaagtgagtgagaaaaagattagatgcagctacctttgatagcttaagacacagaggaattatagaacttaattactgtatgagaacttcaccatcatttacaatagataaatagtttgactattaacaattaaaaccaagtaagctttgtaagttccaagtttttgaaatttcttggtgcagatgcacacagtttctccccatgcttttgtttggtattttgttaatgttgtagagcaacgaaaggacttaattcaaagtactgaaaatgtaatatcttgcaatttactgttgctcaaattagggatgattcattgatttggagaagcatctttgtgaactttctctacttaatgccaaacaatccgtcgattatttaattccgaggaacatgattcaccagagtggttacatgtgtatttttggaggctggaaaaatgtgttttgttttttattttaaatatttattttaagttcaggggtacatgtgcaggtttcttatataggtaaacttgtgtcatggaggtttgttgcacagattatttcgtcacccaagtgttaagcctagtatccattaattatgtttcctgatcctctccctcctcccaccctccaaccttgaatgggccccagtatgtgttattcccctctatgtgtccatgtgttctcatcatttagctcccaattataagtgagaacatgtggtatttggttttctgttcctgcactagtttgctaaggataatggcctccagctctgtccatgttcctgcaaaggacataatctcatcctttttttttcctttttttttttttaagacagagccttgcattgtcacttgggctggagtgcagtgtaacaatctcagcttgctgcaacctctgcctcctgggttcaagtgattctcttgtctcagcctcctaagtagctgggactataggcatgtgtcactacacctggctatttctttgtatttttggtagacacagagtttcaccatattcgccaggctggtctggaactcctgacctcaagtgatctgcccaccttggcctcccaaagcactggaattacaggcgtgtgccaccacacccagcctcttttttatggctgtttatattccatggtgtatatatatatcacattttctttattcaatctaccattgatgggcatttaggttgatttcatcacttttctattgtgaatagtgctgcaatgaacataggtgtgcatgtgtctttatgataaaacagtttatattcctttggatgcagatccattaatgggactgctgggtcaaatggtagctctgtttttaggtctttgaggagcacaatggttgaactaacttatactcttactaacagagcataactgttcctttttctctgcaaccttaccagcagctgtcattttttactttttaatagtagccattgtaactggtgtgagatggtatctcattgtggttttgatttgcatttctctaatgatcactgatgttgagcttttgtttatatgctttttggccacatacatgtgttcttttgaaaagtgtctgttcatgtcctttgcccactttttaatggtgttacttgtttttttcttataaatttgtttaagttcttatagatgctgtatattagatctttgtcagttgcatagtttgtgaatattttctctcattctgtaggttgtctgttcactttgttgatagttttttttttgttgtgcagaagttctttagtttaattagatcctatgtgttaatttttgcttttgttgcagttgtttttaatgtctttgtcataaaatctttgcttgttcctacatcgagaatggtattgcataggttgtcttcagggttttttatagttttgggttttacatttaagtctttaatctatcttgagttaaaggaagggatacagtttcagtcttctgcatatggctagccagatatcccaggaccatttattgaatagggagtcttttccccattgcttgtttttgtcagctttgtcaaagatcagatagttgaaggagtgtggcattatttcttggttctctatactgttccatggtctatgtgactgtttttgtaccagtaccatgctgttttggttactatagccctgcagtatagtttgaagtcagatagtgggatgcctccagctttgttctttttgcttaggatgacattggctattcaggctcttttttggtttcatatgaattttaaaatagctttttctagttctatgaggagtgtcattggtagtttaaaagaaataatactaagtctataaattgctttaggcagtatagccattttaacaatattgattctttctatccatgagcatggaatttttttttccattcctttgtgtcatctctgatttctttgagcagtgttttgtagttctccttgtagagatctttcacctctttggttagctgcattcctaggtattttattctttttgtggcaattgtgaatgagattgtgtttctgatttggctctcagcttgactgttgttggtgtaaaggaatattagtgattttttgcacattgatttcatatcctgagactttgctgaagttgtttagtagcttaagaagctttcaggctgagactatggggttttctagatagaggatcatgtaatctgcaaacagggatagtttgacctcctttctttctatttggatgcctgttatttctttctcttgcctgattgctcagacttcaaatactatgttgttgaataggagcaatgagggagggcacccttgtcttgtgcaagttttcaagggtaatgattccagcttctgcccagtcagcatgatattggctttgggtttgtcatagattactcttattattttgagttatattcattcaacatataatttattgagagctgttaacatgatggggtgttgaattttattaaaacccctttctgcatctattgagataatcatgtgttttttattttgagttctgtttatgtgaagagtcacatgtatttatttgtgtatgttgaaccaatcttgcatcccagaaataaagcctacatgatcatggtggataagctttttcatgtgctgctggattcagtttatgactattatattgaggacttttacatagatgttcatcaaggatattggcttgaagtattttgttgttgttgttgttgtgtttctgccaggttttggtatctggaggatgctggcctcatagagtgaattaagtattcccccaattttttggaatacttttagcaggaatggtaccagctcctctttgtacttctggtagaattcagctgtgaatctgtctggttttggttctgggctttttttcttttctttcccttttttttgtggggatgatggtgataggctatttattactgcctcaattcagagcttgttattggtctgttcaggaattcagtttcctcctggttcagtcttgggagggcgtatgtgtctaggaatttatccatttcttctatattttctagtttatgtgtacaggggtgttcataatattctgtgatggttatttgtatttctgtcgaggtcagtggtaatatcccctttgtttctgattgtgtttatttggatcttctctcttctttattagtctagctagcactctatcttattatcatttttcaaaaaccagttcctggaattgttgatattttgaatggtttttcatgtcccagtctccctcaggtcagctctgattttggttatttcttgtcttctactagttttgaggtctgtttgttcttggttctctagttcttttagttgagatgttacattgttaaattgagatctttgtaactttttgatgtgggcatttagtgctataatttctctcttaacactgccttagctgtgtcccagggattctggtatgtggtatcttcttttttttcattagattcaaacaagttgttgatttctgccttaatctcattatttacttaaaagtcattcaggagcaggctatttaattcccacatttttttatgatttagagtgaatttcttagtcctgatttttaatttgattgtgctctggtccaagagattggttgttacgatttcagttcttttgcatttgctgagtgttttatttctgattgtgtgattggttttagggtttgtgccctgtggtgatgagaagaatgcatatgtattagtcagggttctccagaggaacaggaataattggatagatgtatacataaaaaggactttattaagaagtatgtacatgtacgatcacacagtgaagtcccacaataggctgtctgcaagccgaggagcaaggaagccagtccaagtcacaaaacctcaaaagtagggaagctgacagtatagccttcagtctgtggtcaaaggcccaaaagcccctggcaaacttctggggtaagctcaaaaatccaaaagctgaagaacttggagtttgatgttcaagggcaagaagcatccagcacaggagaaagatggaggctggaagactcagccagtctagttccttccatgttcctctgcctcctttcattctagctacgctggcagctgattaggtggtacacacccagattgagggtaggtctggctctttcagtccactgactcaaatgttaatctcctttggcagcaccctcacagacacacccaggagcaatactttgcatccttcagtctagtcaagttgacattcagtattaaccatcacagcatattctgttgttttggggtggagagttctgtggatatctgtcaggcccatttgatccagtaatgagttcaggtcttgaatatctttgttaattttctgtctccatcatctgtctaatattttcaatggggtgttaaagtctcccactgttattgtgtaggagtctaagtctctttgaatgtctctaagaacttgttttatgaatttgggtgctcctgtgttgggtgcttatatatttaggatggttaggttgaattgaacccattatcattatgtaatgcccttctttgtcttttgtgatctttgttggtttaaagtctattttgtctgaaactaggattgcaaccctcaatttttttccctgttttccatttgtttggtagatttttctccattcttttattttgagactatatgtgctattgcatgtgagatggatctcttgaaaacagcatgccagtggatcttggttcttcatccagcttgccactctgtgtctcttaattggggcatttagcctatttatattcaatattagtattgatacgtatgaatttgatgctgttactatgatgttagctggttatgttgcagacttgtttatgtggttgcttcatggtgtcactggtctgtgtactacagtgtgttattgtagtggctggtaacagtctttcctttccatatttgatccttctttcaggagctctagtaaagcagatttggtgacaacaaattccttcagctttcacttgtctgaaaaggatcttatttatccttctcttatgaagcttagtttggctggacatgaaattctgggttagaatttcttttcttaagaatgttgaatattggccctcaatctcttctggcttatagggtttctgtggagatgtccactgttagcctcatgggcttccctttgcaagtaaactgacctttctctagttgcctttaacattttttctttcatttcaaccttggagaatctgataattatgtgttttggggatgattttgtaaagcatctgactgggtttctctgaatttcccaaatttgaatgatggcatgtctagctaggttggggaagttttcatggatgatatcctgaaatatgttttccaagttggttccaccctccccatctatttcagggatacgaaagagtcatagatttgttctctttacgtaatcccatatttttcagaggttttgtttgttccttttcattcttttttctctattctctctttttttgttttgttttttttttttgagacagagtcttgctctgttgcccaggctggagtgtaatggcacaatctcagctctgcctcccgggttcaagtgattatcctgcctcagcctcctgagcaactgggattacaggcatgcaccatcatgcccagctaattttttttgtatttttaatagagatggagtttcaccatgttggtcaggctggtctcaaactcctgacctcaaatgatccactggccttggcctcctaaagtgctgggattacaggggtgagccaccatgcctggcctctttttctctatacttgtctgactgtcttatttcagaaagccagtcttcaagctctgagattatttcctccactttgtctactatgctattaatatttgtgatggcattattaaattcttgttgtatgtctttcagctctgtcatgttggttacattcttctctatactggctattttgtctctcagctcctgaattgttgtattatgattcttagcttccttgaattggatttcagtgtactccttagctcaatgatcttcattcctttccatattctgaattctatgtctgtcatttcagccatcttggcccagttcagagcccttgctggagaggtgatgtggtcatttggagtaaagaatgcactccggctttttgagttgtcagggttcttgcactggttctttttcatctttgcaggcctatgttccttcagtcttagaggttgctatcctttggatgggttttttaaaattttattttatcttacttgatgaccttgagggtttgattgtggtataaggtggatttagctgaggggcttcatttctagaagattttaaggggtcaatgctcagttccagctcctgggctgtgtcctctaactctgggggacttgtgttggaccccagctttgttctcttgctcctcaacattagaaatccactgtgctggagtgacaaatgtgccctcaaacctctggttcctgcactctgatgagtggtatcagccaaagtgtattgtagtgtggtgtggtgaccacaggattcatcctcactcacacctgccagcaaccatggtaacagcagtgcagtgggttgcacatttgtcagctgcagcaaggtgctcatgggtgctggggtgcctgcctctctgcaggtgttcaccacagtgacagaggcaatgcagctttgcagggcaggggactgtggcaactgtttgaatgatcgtgctggtggtggtgatggcttgggggtgggatgctgtctggtgtaggtctctgtgccttctctgtttgctgcaagcaggagtgattgctcagtgcaggggaggattcactgttctccgcacctagtttcactcctgtggcagtgttagtgcaaggttggggcactggtgggggcagggctggctgcctctgtgctcatcaagtctctatctgcaatgacatttagggagtgatggaagtgggctgtactttcactgcagcagtggcagagtggtgtgtgcacatactcgctcgcacactggttggacaaggaaagcaaaacctgcctgcacagacatgtgtaaccaaaacaatgtggggagttgtcatgaatgcagggcggggtgagtgggaagctgcagtgtggggaaggagcatgcaggtgggtgcatggccatggggactgtccccttggcactttcaacccatcaggcacagtctgccagtgcagatgctatgatacatgccctcagggcacccatggctgccatgctagcaggtgtggtcaggcttgccccaggagaggccagaagaccaaagagcactcaggtcagactagccctgtctgatgggcaagaccaccctgcagagttcaggcctgacatttccctagggctaaaatcttctatgggagcaagtcaagcctagaaggatggccatccctggccatgttctgctgcaaatactcctgcaccaaacactctgggctccacatcagctgacttgctccccctatgacttctctaaatagctaattctgccaatttgagtgcctgtggtgatggagggatctcctcctgctggggttccagaggcctgtggtgagagtgggttgctccttgccagtttgactcaatcatttccccaaagctgttggcgggtcaggaacaagtccaggtgtgcaatagccctgtgtaggattcccagctttctcccgcttctgctcagcttctgtgccttccctctatttgctctagataccttctctctgaagatctgttaggagtatgccagtcaccttagtccctccatggcagctgttccacctggttatgtctagtcggtcattttgccctccctcttctctggataaaggtttttattgaacttaactacttggtaattaacattggtggatattttatactatcttttagataaattggcacatttcaaaaaatttagaatacagcagaattatccctgtcataaaagtgttttcactctgagtaataagtctatgtatcatcttgacttgtgaaataggtcttcctaatatatagtcacactgaatacaatgtatatataaaacagaacaaaaaattcaaattttcaaagggaatttcattcagaaatttttaatggattttatcatacaatggaagagagtgtaataatataagtgcattaaatctttaagtctgccattttaaaactcaataggcatacccacttattcttctattcattgatcaattaagcaaatatttaatgaatgtctcctaaatgccaggcatcaaattaagtgaataaaaacactatcaggaagccaataagaaagaactacatgtaattactacttgatcccaaaacttgggagggacagaacgtggttctttgaggtcaagaacaaaaaaccttgacatcacaggactagggttggggtagggacatgtatgaattggaattggcagtggtctgggtcagacagttgcagaaccttgcaggccatgttaaggatcgtggcctttgcctaacagcttcagaaagggcttacatggttttatatggatggagatataatcttatgttcatttagcagaacaaataagagggatctaaggagatttttcttagaatcagttagtagtttatttttgtggtcccagtgagtgataaggaaaagttttcttggaccagtgttgtggtcttggagatggagagagaaaaaagatatgtccagggagaaaatcaagaggacttagtaacagagtcttgggaaggaggaagatgtcaaggatcacttgtaggtttctgccttaatgattctgatttacactatcaagacagatttgcatgttattatagggagctggatgatcaacatcactttatcctgcataggttttgtggctcaatgaattattagcataaattcatagatcattgcacaatattaacaaaacctgagtcataagttttacttgacccctaaacaatttagttaactttaccgtcttgcttgaccacaaagtctattcctcattaccactttcttgaaaagcatgttgatcacaaatggccctgggaggaaacatgaagctgtttcattacaaatgtgtctttaaaaacaactgaaagtgtttgttctactgatacagataatgagttccttcaggaaactctcagcacagaaggaattagtacatcctgactagcctaaggggagggggtggcagatgaatgtatgttatagatttgtctctctgagcctacaaacccttaataaagtatctcaagtgcgaggtaataatggaactcagtaacacaaccagaaaaagggaggaaaaaatctgggtcatgagatgttcatggggattagaaaatgacttggttgactgtcctccaggggcaaaacccattagtagaaagcagcctgttctctgatcctgtggagccattgtaattactgaggaaaacatcattctcaggacttacatcaggactttaagcttagtgattgatgtggtttggatctgtgtccccatgcaaatctcatgtcaaattgtaatccccaatgttggaggtggggctgtgtgggaggtgattggatcataggggcagagttaccatcggtgctactcttgtgatactgagtgaatgcttgtgagatctagttgtttaaaagtgtgtagcacctcccctacctctctcttcctcatgcttggccatgtaagatattatctgcttcccctttgtcttctgccatgattgtaagtttcttgaggcctccccagaatctgtatagcctgcagaactgtgagccaattaagcctcttttctttataaattatccagtttcaggtgtttctttatagcagtgtgagaatgggctaatacagtgatggaaagaaccaacttcatcctgctcacactcaaatccccaaagcacagccaagtgcctatcttatggtttatgtgtaataaatattttatgagtgattgaatgaaaatattcccaaccacagtacccaagagaaagtagagctcagtcattgattactgcttgtgctcttacctgctgacgagcagctacaaatttaactagcaaaccatattgtagaagctggagtcagtttgggcagtctttttctcaagttgtaggggccctaccagcatcaaggtataaagataatagcctagacacacaggtaaagggctagaaggacctagattagctatcaggatatagactaggtagtccatagaggcatgtctttccaaactttaaacaaaaatgactcttgggttgacttttttaagaatttcaaggctggatgtggtgtctcacatctgtaatcccagcactttgggaggctgaggtgagaggatctagaagttcgaggcaagcctcagcaacatagtgagaccttgtctctgcaaaaaataaaaataaaaaaaactaccttggtatggtggtacatgcctctagtcacagctactagggagactgagatgaaaggatgacttgagcctgggaggtcaaggctgcagtgaatcgtgattgattgagccactgcactcagcctgggcaagagtgagaccctgtctcaagaaaacaacaacaataaaaaaagaatttcaaaatatagtttctttttgtagaaagaaatgtacagagaagacatacaaacaagaagcttataaaagtcatataaaacccagcttctcagagacaatcattgcaaatatcttggtgaatactcttctagatatctttccatatgtatatacacagagatacattcatataattttactaaaaaaagaatcataccagtatgctgttttttctgaaagctgcttttgtcaacatcatcaatttttaatggtaataactagagatatatatcataattttaaattactgcaaagttacccatctcctgtatatcattatttatttactgattccctaatgatagataactgatttgtttcttagtatttgcttttataaacaacatgccaatgaaaataacaatggtagttcatgcatcattttacatttaacaaaagttaaaacttaactcagacaaataaagactaaatccatgtcaaatatttatttaactcaattatgaaaaaaccatcaggatagtaaagctggttcattaggcatttgtgcaacacatatttacacatttagaaagaaaaggcatgcttaagtttgctaagttgaaaatacaatttcagggcaacacaactctaattttgagtttatcttatctactagacagaaatcatttgtgccctctacgagacaggaatctacaaattaacatgtaacttaagaatatctggaatgtaacaataataccttctatatcaaaatagacccgttatcttagagagttaaataatcttgggggagacctattacatggtgctccagtataagattgtaagggcttgactttttttccctatgtttccaaattttatataatatttcttaggacatgtatgttgtctaacttgactccattttgaaagatgtggattttgaaatatgagaaagatgagattaggcagaccaagtagacaggggtgggaaaggctgaggatacctagaagggtgacagagatttcctcaggcaacctgtgaaaaaggatctgattaactttattgcaaatttattaatctttgattaccaactagattgtaagttcctcaagggtggggactgtgtcttaatttctcctgtattcttcagacaacttagatgggctcgttagagagaagcaaattcaaagctatctcagaatgtgcattttaatggagatgagtgaagagtttcctttctatacaaatttataaaataaagtttaagtggcctttgggcattactggaatggtggaagaggaaaaactttctttttagaatgtcttagtcctaaaagattgattggtctggcaaataagggagtaaatcttggactctgacatcacaagaggtaagtcctactttgctactggcttcaccatcaattcttaacctggacttttccccagttcctgggctggaatatggaggccagttgtcagctttcaacctttgagtttctccttcgaattttggcttaagtttggtttccaaaagagtatctacccagacagctagagggaattaagatggctgttttgaattgctaagctcctcttgactagaacaagaagagtttctatgtgatggctgtttttcacttcacagcttgatctgattaactctgatctctggtgatggctagtaagtcattgcatgtctagtgatagtatcccttctactgcattaaacaggatgagttttttcttagtgcttttagtttgtccaattgggtgaatattaacaaggaagttttttgcttttaggagcattagtgttgctcattcaggtgattttctttttgagttaagccatttagaaaatgagtcagtgaatacgactggggactgaggtagaagattccagctaagttatctgcctctgtctcctgctgaaagcttcagcagagggtttacagaaagttttcaataggtacaatagtatctttgcttagagtcagtgatagcatcattggttttcttttaacattaaacattttattggataattttcacatcccttagggaggatgtgtgactccttttaaaataaagtaagaaaaaaatcacatgatgaaattgacttgcctcatagagccattctccctgaaaccaccttgaagaagaagagtaaatgctttaaagtttattttagggctttattaaaaaggaaaacatgctttctgggtatgcgttggatgtcaatatagattcaggccaatctgcaattctgtctctagccgcaatggaaaagcccatctaggcaggccactgtgtgggaggatcaatgagcaaggaaaatgtcttgttttggactgaccaagacaggaaactgtgcttagatattttaatactacaaatagagaagtaatataatattaaggatcaaagaatgtggcggtttgggtcaagccatacgactttgggaaaataaaatctcagaaccttggtgttctattgtaaaaagtaagaatgaggattgtgtgatctcagaggaaaaaaaaaacgagttgcctttgtgttgtgttttaagagtcctggaaaacttcctggttcagagtccctccccacactactatttggacttctaatattaataattcatttcctggaaatccactgccctctcctacctctcttgtaaatttgaataccctgcaaagggtatagaatgcagttgttttacctcagtctcaacagccttatcagttcatttatgccaaaggggaaaaaagaaaccttttcaacaaaagaaatttgggtatcctggggtgggtttggggtgggtgtgaaatctgcaataatgcaaaagtgatggaaagaggagcacagaagtcaacatttttctactttacagttttgtatgagtttaagaggcatgccctgtctgaaagcatgtgtgtcttttaaaatctgctttggaattatcccattttcccctgctcttatgcactcagattttccctcctattgcttctgtttggttttctaacagtattgtttaattttgtagagtacttaaaatgctgaattttgctctcaaagacacattacaaaataaagccacaggatattgcgttataagtgaaaatgatagggaaccactcagattgaatctgtaatgttctcaagtgagagtcatgggagttttcagatgcactgtgcaaagtggaagatgtgctagtaaatctgccttcacaaggtaatattcccaggtaacttgcaatgagaatctccactcctgctatcagatcacagggcagagccaagacctgctgaagaacatgcagtactctggctgctattatatcgcacacttgaggggagatagaaagacgtttccagagaaatgttattagaaataaactcaggatgaaaaaaaaatggaaatagcatttttttctggcaagtacttgattgatgtttaatattttcagtgttagcataacagctgtatttcaattggaaaggcaaccagggaatttgattaatgaaatgcagaaaagtcaaaccacctcacaagcttgtttgttactcataaaaatgatgacaaaatcgtgtgcatgcaaaagtgattggaacaatgaataattatgtccatgaagaaatggaatcacttctctcaaaatttaccagtaaatgttaagaccttagagctaggcattttttgtttgcttgcttgtgtgttttactgttttttgccttgcattttgagaactttaatatttccaaatgttcagtggccaaagaacatttggaatattgacttttgtttcctttgagggcagtcatttctgtgcgggaagaggtgaagaaaaaagggagatagaggagaaagaagaagacagacaatctggaattatcctccttttactgatactagcagttttccaaaaactcgcatctatgctggctgccctgctcacaatcttttgtttatgctggagataagcaagcctaatacaatattaaaatatcacagatacatactaattggcttctcttcagtatagttcaactcagtttggttcatcagttgagtgctcaatctttgccaggtatggaggattaaaaaatgaacaggagaaggtgtctgtgaagagtgtgtggatcagacacatgcacagagaactgccatataaggtaccaagtacatggggccagagaaaacaggcaagtcagttctgcctgaaagggagggagaaggctttgtggaggaggtcacagcagacttacatttatttatttataatttattatttacagatttattggtttatttagagatgaagtctgactctgttgcccaggttggagtgcagtagcatgatcatagctcactgaagccctgaactcctgggctcaagcaatcctcccaccttagccttttaatagctggcattacagatgcatgccactatgcccagcaagagttatgttttgaaaggtaagaagcatgacatgatgaaacaaatccaaggtatgtaaacacctagaggtgaacagaacttgctagtattgcagaagggctgtcctggaatgagtgacacagagcaggatcctgactccatagcagtgctgagtgcacagttaaggcttgaatcttgcctgtgactatagcattggttccaccagcagcaaataagaatttttttttccccaggaaaagtacttgtgaataaagcagataaaattattctaatgcaggtggaccaagagatacaaaaacaaaatgtaatcgactgagagaagagaaaaatataaacaatgtaggaacatgtagtattattggaatagaagtttacaggtttttgttaagtctgtaagcaatcactgagtacttactgcatacctacgtggtacctgtgcctgggctgggcactgtgaggaccataaatgaaaaagttctgtcccctgcccttaaggagttatctggttaaactacaaagtgcctgggtgggagaggcgtacacattataagaaagggtctatcagtctgcttttagtaggctccacaactcaatgaagttatacttagcaatcttttcaactggccctggctacaacgaagttcttccccactctcttctttcggggtgtcctaaggaacacccttctcaacagaagataagagaaaatatttttttcaaaagctaattccttgtttaaaagtacataatttaaaacaaatatgtttagtttccataccacactcttcatccctgccccaactggataggaagctttgtggaagcaggaattttgtctatcctgtttgccactgactatatggattttaaatttgttggtttttctcaaagcccaccagttcatacactaatgctttattatcaaaatttttatcattgcccatataattgatgaaacatatcttactgcttttttattatttgtgtttcttagtgtgagcacctttaattatagagcaattttccctgtgtatctgttaaaaatcatatatattattatcctgtgtgtctttttttttattattatactttaagttttagggtacgtgtgcacattgtgcaggttacatatgtatacatgtgccatgatggtgcgctgcacccactaactcatcatctagcattaggtatatctcccaatgctatccctcccccctcccccaccacacaacagtccccagagtgtgatgttccccttcctgtgtccatgtgttctcatcgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgcctcaataaacatacgtgtgcatgtgtctttatagcagcatgatttatagtccgttgggtatatacccagtaatgggatggctgggtcaaatggtatttctagttctagatccctgaggaattgccacactgacttccacaatggttgaactagtttacagtcccaccaacagtgtaaaagtattcctatttctccacatcctctccagcacctgttgtttcctgactttttaatgattgccattctaactggtgtgaggtggtatctcattgtggttttgatttgcatttctctgatggccagtgatgatgagcattttttcgtgtgttttttggctgcataaatgtcttcttttgagaagtgtctgttcatgtccttcgcccactttttgatggggttgtttgtttttttcttgtatcctgtgtgtctttataaagtcagcatatagggcattcattcttcagtcagctctgtgcctggaggggataccattgaatactgtctcactgacgtgagatcaatccaaccatagataccttagaaggcatagaagcatagatacttctcatcaccgtacacaattctgctgctttaatttgtctgtcccatttttgagtgctggggctgctttctagagacatgggtctgctgttctgccagcttctctatactgctgggccacttaacttctttcttattctcaccttggaagggatggagggaaagaagtgaaaggcgggtcttagccttttacttctgcatttcccctagccaaacagcttgacagactgtttagccaccatgaggaagctttatccagcaaggtttagcccttcttgacactaaagtctagggacagataaatgcaggtgatttcactgagatgcaggacacccgaccaagctgatttattccaacaccagaaagctgcctgtgcctccatatcatctggtcttccaataccagagcaatccttcctcattgaccctcacactgctcaagccattgtcctctgagctttgaagggcacatgaagattgcttgaatggatttaatcatgctgctgcttctccatatgcaagccttctttagcaagataggcagctcttctagaactagaatacaaaatttcttctgaaaactctgagatattctagactcttagttgtatattcagagaaacaaccatgtaagaaagcataaaatgagtccaagattgcatgagctcatgtttcttttgcaattaataataatagtgatgataaagaataagtaacttgctgagatctaagtgctagaggtgtgccaacattattatagacattatctcctttaatgcttccagtgacctcatgtattaatattatttctgtgaggaaagtaagacttaaaatagagaactagaacccaaatccctctgattctaaagctgtaccttttcacctcaaaaacaaaataggtccaaacattttccccaaccatcacctggtaaaattcatccactaaaacttcacaggtgtcttagtttcatctgtcattttcacctctgaaaaggactcaccaaattattcccagagacaatttgactggcaaatgaagtggcatgaactggaagttaggaaaggtgttctttaggaaaagggacttgagctgtacctgggtgtggaagagagatcaggatttgtgtggaaaataggagacgggaaagtgtttctgatggaagtagaagaaagcatagatttagggagataaggatgagtgggaacaaagcagacatgccattttttaagatttttttttttctcttgcatcttgcagtgataaaaaagttatttagagtcatcctggaatgagtataaagataagtggttcatgtctcattcacttaaaaacaaagaaaacagttctaatgaaaactcaaaaatgaagcatcagcaggaagaagagttaaaaaaaaagatgcaattttcttctgtgaagcctctcatctactttaaatgtagctcttttaattatttcctttaggcaaaaatacccaattaggtaaaatcatgaattagccaatgtttgaaaatattttgaagaggaagaaaacaacagctcaccaatgaatgacattattatttctatttccccattttttgttttgcaactagaaattcaggaattaatttatgtcaccaattcaaaatttcatctccagtagaaatgatttaaggggaaacaaagaatccatttgaagtagcctcatcatttgtgttcactttttgaattagcctttgtatgtttacagtctctttggatgattggtgactaatacgtaaaaaatggctaaacaatgatgtttcttcagaaaaggacattaaggagttttgtgagacaaaaagacacaaatattggccgggcgcagtggctccagcctgggcgacagactgggactccgtttcaaaaaagaaaaaaaaaaaaaaacgacacaaatatcactggatgatgacttaggtcttagtgaatacctgtactatagataacatctgatctgaagtctttctctctctctttaattctaagtgaagtgtgacggaagagggcacattttagtagccatttatggagaggcatccagtaaaaaagtatcatctagaggaaagatggaattttagctgtttagcctagaaaatgtaagacagatgaagacagaactgatagccatcatccaacctttgacaaattattatgttagtgagagtcagatgtgtggttttgaaaaccaaaggttggaagttactgaagaatatcctgacaattagagctgtccgacagtgggactgctgcttgatgaagtaggaagttcctcttcgatgaagtgttcagacacaggctggaagaccatctggcaggctgtcatttgctgggtctgtctccaccaccaattacagtgtgtggaaagggcagggctgcgcgcttcactctaactgcaggctctcaaattttgcatttgaaatggaacttcatctaggatggggatggtaagggcctgatacaatgaactctcacggtttcttttcatcactaagatttttctctttccaaggatattgggaaaggataaaatcagagagttctaaaagaaattttaaaatctttggaaaataatttagtagagagaaaataattatcgcaccttaattttcagagacacaatacttttaggaacacacaaagctggttaacattgtctttgtttttttctgagttgagtttctctctctctctcccaattttaccttttgtcacacccatagattcctgcctaaagaccatctcaccaggtctgtccaagaaccagatgactccaaattctgctttccttaaagtagaattccttaaagatagaaccccaagattttaattcatggttattaaattaaacatgaatctaggtaccactgtgaaaaaacagtgcctgtagtccttataattagtaaattgtgtttaacctttcaggattttttttttctcaaaaagaggacccaggctgggcttggtggctcacgcctgtaatcccagcactttgggaagtcgaggtgggcggatcatgaggtcagagatagagaccatcctgtctaacacggtgaaaccacatctttactaaaaatacaaaaaaaattagctgggcatggtggcacgtgcctgtagtcccagctactcgggaggctgaggcaggagaatcgcttgaaccccagaggcggaggttgcagtgagccgagatggtgcctctgcattccatcttgggcccgttaggctagtctgccataaaaaggaataaaataatgtattttgcagctacttggatggatcttggagctggaggccattattcttagtgaagtaactcaggaatgaaaaatcaaatattatatgttcacacttataactgggagctaagctatgaggatacgaaggcataagaataatgtaatggactttggggacttggggggaaagggtgggagggggatgagggataaaagactacatattgggtacagtgtacactgcttgggtgacaggtacaccaaaattccagaaatcactactaaataacttatccatgtaataaaaaccacctgcaccccaaaaactattgaaaaaaaaataagtaattttttaaaaagagaatccagtaggcaaaatgatgtttctattgatggagggcacagggctgatattttgagaggtggaaacttcctggcacttcttgcttactcaagtttccatggatccaaggccacaccttggcatccctcacaagctcacataccatcctcacctctgccacgtgggtacatgggcacacacaaacacaagcacattacgaaaaagcaaagcttctggacaccatactctcaaagcctactgaggacctagtttgataaagtaaatagacttatgtacataatggttccctgtgtaagtctatagccataccaccttcaatgcacttcacctcatcagatcttggaagctaagcagaatcaggcctagttagtaattgaatggcagattaaaatagtcaaataaataccacatggagatagcctcaaatgaacttacattcttattttataaaaataagccaccgtgacttttcattatgtttcttctttatccaatttaaagacttgatgtgaaatcttaatagaatttgacagctccaacattttaatcaaaattagtagcaaacaataaatgtttatagatttctatatattgtatttattcggtgaaggaagaggacacttttgggtacaggccacaattctactctcttaagatttttagtatactgatgtaggtgatgctatattttatggaacatgaaataatcatactttattaaaatgtttgtcaaaaattgatcatttcaaaaaaaaaaaaactggcagagtaaaatgtaaatcctgttaacctagtgccttatggtagtaatacttcattgggtaactttccactattcttggtcaagatgaatagtaaattcagcaagtttggtttttaacaaggtttttgggaatgcaggcctttgcttgttaaaagatagtcacaatccaaggcaggattaagtgcccttaggtgcacagacaataagaacctggaagaacattgatggaatacattaatatgaataagaataaagttccctgaggagtttatgtccagaaagacattggagagtcagtgaagaatccaagtcattccagtggcataaggaaagaggagagacattgaatgtgtacatgagttgggagaacattaggagactagcctggtcagagtaatgtttgcaggttggtggatctcctgtatagcctgaatcattttctatgttcaagaggctgtgtcctgtgtggtagcactgcccatctatctctagactcctctgtcccatgctaatcctgaatatcactgctaatatgtatacacagatgagatctgattaaaataaactagagaagcctcaaaggagagatgcagtcacaaaagagctatcacatcaggggttatgtgaagaggaagagggaaagggagtgttcttgctaacccctggcttgcaggagtgtttctgatgatggtgcagctacgtttgagcctttgactcactgtatatacagaacacttcacttaggctgcaacgtctgtgtcctttttacctgaaatactgcaacccacccaaccgtaacactaatagctgtgaaatatggtgacaacatcagagtgattcctgcctcataccacaggcaagttgaccttaagcaggggggcaaaggtttctgcccacagaataggaatagtcgaaaggccagattaagccgtaaacattgaacatttctgtcacaagaaactaggatgatctcttgcagcttcctattctacctgaggtgccatcgttggtattaaacaataagagattaggctcttgtcaggcaaactaatgaattttagattgatttctgtcttctgcaatgctagcgacatttttgacagctgtgatttatagggctttcattgggtctattcatgaaaggagttgtttattttggttgatgggaaagcttctaatgttcccagtgggaaatgctgagggccaagatgatggccatcttgaaggagctctctgactatctagggcaggcctcttataaatttgtaatcaagagctcagagaactaatgagggcaggttggcttggaaattgttttggcgacatttgaccagtgaaatgctcctggaaaatatatgtctgctgctcagctgcagagccgtaagggtaaaaattctactttgtgtgtcattttacttgctttttttctttttttgaaatgccatagctggtatttgcagaatgcaacaggaattttagttccacaaagtggtggtggagaaacaatgtaattcaaagatttaaactggggtcttttgtttgtttgttttttgtaagccttctgtagctcattgtagaatatttttctatcaggaataatttgaaactttgcaagtgtgatggatattgtggtggacctcccagagttcccttcaggaccaagacactcatttctataaagagctagtgggaatgataactcttgctagctcacagataggtctctttctcgaaattgccctctgctgaagggaactgacttgccaaatattacatccccctctacgtcagtttgcattcaatgacgggtcgagactaggttgaaaggctccttttctcacttcaggatttttctgttgggtcattccaacaccaagctccctatagggtgagctggagcctctgttgcaagtgtatcatggtgcaactgctttctctccccagcttttttttctctcactccttcatggatgttgtttttaagagcacttgtcaatcaacttccataatgcaaatctcaaagtagaatctgtttcccaggaacccagcctgcaaccaggaggtaaggttgagagaggtggccatgattgaagaaaagtgagcaggggttgaccacaaataggatttcagggatgagaaaggagaatattgaggatgtagcagagcttccaaagctggagaccttgggggatgagaggaaccctacttttgtttgccttttgaggcttatagctcaagcaggttgcagggaaaaaacagccccatatcacctttcccaggggagaaatatcagggaacacctgacatttaagaggtagactgtgcctataatataaaatagggaagagaatgaggtcacggttgataataagggaagaagcagaatacacataacgaatcttatatatcaaatcttttgataatatttctgaacagtggagaaatttggaaagatagaatgtatgattagggtgggatcacttaaaaatatatacagcatctaccaggacatatacatgacaagaaaagatatgacatgctccgaagtcaccagaaccagctctgatggttaatactgagtgtccacttgattggaatgaaggatacaaagtattgatcctgggtgtgtctgtgagggtgttgctcatggggattaacatttaagtcagtgggatgggaaaggcagacccacacttaacctgggtggacaccatcgaatcagctgccagcacagcaagaatataagcagacagaaaaatgtgaaaggagaaactggtctagcctcccagtctagatctttctgccatgctggatgcttcctgcccccgaacattggactccaagttcttcagttttggagctcggactggctgtccttgctcctaagcttgcagatggcctattgtggaaccttatgattatgtgaattagtacttaataaactcccccttgtatacatatatatatatatatattccgttagttctgtccctctagaggaccctgactaatacaccagcaataaaactaacaggttgactgcatgcatttttgtatgtattctggcagtgatcaccagctagtgcaggcaatggcagctctcatgaaccaggagccagccttctttaagaccaaagggacatttttcatgtcttttgtatacattaaagaagtggcaatttgtattaggacccttctccccaaggaattcctggaaattccacatttgttactttttccctctaaatatgataggtcttgattttatttcttctatctgcctgagctcagcataatgtagctattttattttcatttctctttctccctgtaatattaaaaagatcataattacaagatgtcaacaaaaaactcagcagcaggaaaaatctcaggagtatagaacaacaatctattgaaatgccttctcccaaaacaagtagccaacaaaaatagtggctatcatttatttaatagttggaaagtaattttctttataacaaagtgttggactttcatttgtaaagggatagggagtacatatgtttatccaggctaggtctcacagatgaaccaactagggtgacccctggtgggtaagttgaagacctctgaagaggttgcttgtctgccaagtcagaaatcaagcaacctccataagttagaataataagacccagacttctctccttctgatgtgtctgatgggggcccacagtaggatgaacttgcttttgtcactaagtggctccctggaatactctggtaagtaactttttcactgaggcagtcaggaacagcaagattttaatgagcaacttggccaaggcttctcaaactgtaatgtacatatgaatcacctgaggggcttgttaaaatgtaggctctgatgaggtcagcctaagcctgagagtctgtagttctaacaagttcccgggtaataccaatgctactggtccacaagagatactttgctaggccacaagcaaaataagtgagtaagcaataaagggctgcttgttctgtgacagacatcttagaaataattggctcactttatcacatttcagtagattggtttattagattactcagctgtaatctaagggcgatatgtaattataatctaagtatgtaacgtgtaatctcaggaaaatgtgtaatgtaaggacaatggtggagagtgggtaatttgaaattcctttctgtgtcttcctgattcacaggagattttctgtaagatgggcaccctgtgcaggccaggctgggcacagcaggaggcatgatcaatgaatgcattcaggtttctacacccctctttagggaagaggcagaaagacaaatgcagcttattttctccagctcagtatctctttgtgtaacatgcaggagggagaatgtgaaggatagaaaatattaagtggggcagaatatgctaaagtaggtcaagggagaaaatgaaatagagtattttttctattctcagaaaatgctgttaaaattagaactgccacagatcacaagatcagtgttgtaaacattttttttccaggcaaaaaaactctcagctaccaaaacttcgattattaggtaaggatttgaacaaagatgtgtgtcatgtactgtgcaagatgtgtgtggtgttggtttgggagcagagggtgcctatgtctttggccaggccatgtccttggtaaaatgtacatgtagtcaaactgtgtccagcagctgcactttctctaactcctctctttcttcacactctttcacacatgtctgtttctctttgtttaaattaattcacactaagatgttaatgacattacatattacctttcataagagtgtttatatttatcttactttctaaaattagaaagcaatttacgtttgctgtggtattgttagtattctgaggtaatacttattccaaagtactagattagattagattttatggcatgttgattctgctggtctgaaaatcctttcttcctagcactataaaatcattacttgtgcccttccacatgaagggctttcttgcctacacacacacacacacacgtgcgcgcacacacacacacacacaaagccccaccttgtttcttaatggatcataaaaaaagattctataaaattctgggctggcccttccttccttccttccttccttccttccttccttccttccgtccttccttcctctctctctttctctcttttccttccttcctctctctctctttctctctctctctctccttttctttctctgacagcatcttgctctgtcatccagaatgaagtgcagtggcatcgtgatcatagcttactgcagcctccaacttctggcctcatatgatcttcccacctcagcctcccaacgtgctaggattataagcatcagccaccacacccagctctggaatccatattttaaaaggcagttttattatatcaggtctgactctgcccatttgctttcctcttattgtcctgtgggttcctcccacgcctttcaggaagcctgacagccggacaggtgggacatgtctcattagactcagagtttgcatttcaatgaggagaggatatagtaaagttcagtatacaatacaccaacaacaataattcctgcaaatgagatggtcagggagcagtatatccaccatcaggttctctgtctaatctgtttttatgtttagtctttgtctcatttccttataaatgaatacaggtgatatcaccatgattttttcatactgaatctggagactgaaatctcgagtgggtctgactgaactttaaatcttcctgatgaagcttggggagggatagcaggactggaagatcaactggggctgaggaaccctgttaggcttagaaattgagaatatgttgtttgtgggaccaggttccaggttcctagatgagtaagcaaaaattaaatcatcagcagtaacaacacaagagatttactgtggaatcaggtacgttctgatgggccctctattgctcagaagatagatacaccccagtaattggatagctcagctggaaacatcttaagagaaaagtgctccttgtctcatgcagttctgagtagcagaaggatggtcccagtaggaaaatgcatctcttgactacactttgcacaggtgtgaacattacccactggtgagtaatgtcaggtgaaaatggctctgttgtcactgagcgtcccagatggaagtcttgagcccctttcacactctggcttttgaaaaatatttttctctgaaagacattttattttttaataaatgaagagctatgagtcatcctgctttagaactggaagagaaaatttacttctgctataattaaacaataattattattctttcctctgagggagaactctgggagataaacaactcccagataaataaggcttagagaacatgggccaaggcttctgttgattcacaatatatttatctctctcttcctcccaaataaaaaataatgatagtaattatttttaaaaatgtttcccttttttaatcatttaaaattgctgttttccagtctactcaagcagtaattgcttttgtggccctggtgtaacttgtggagaggatagggatagaatgagcagttgagaaaatctactccctaggcagcaactccaaggcaccaattagtatgagctgacctttaacttggtgaatagtaggaggcaagaggacttgaccagggtatgaaaacctgggttttgccacttcttacctgtgcatagatttggtggcaagtcatttaatttcttggaggattgttactcttttaacaaatggttataattcttaatttatctacctcactctgtttatcttaaatgactatatatatatatacataaaaattactgtaaagtatacaaattagggtggtcatggaactttgagattaaaagcattctacaggccaggcgccgtggctcatgcctgtaatcccagcactttgggaggctgaggcgggcggatcacaaggtcaggagatggagatcaacctggctaacatggtgaaaccctgtctctaataaaaatacaaaaaattagccgggcgtagtggcgggcgcttgtagtcccggctactccggaggctgaggcaggagaatggcgtgaactcgggaggcggagcttgtggtgagctgagatagtagcgccactgcactccagcctgggggacagagtgagactccatctcaaaaaaaaaaaaaagcattttacaaagagaatgctggccctaagtattttcgcattttccagtttccttaagttggaagcaaagcaaaccagccctggaattccttcctgaagaaatttggaagtgacatttgtggggatacatagataaggagtcatctaaaattaaaaaggattcttgaagttttcatggcacatacagtgctgtcagctctttctcaagggtggggactgaaaggagctacatcacatttgggtaaaaaatggagtaaactgccaaggccttcattagagcataaggtagtatattgtagttattaagcaggtgcctggaggggtcagtcaatccacggcttactcattacctggggataatattaaaatatctacctaatatcctatgaataaaatgagatcgtccaagtaaagtacataggaaattgccaggcacataaaatatacttaataaatggtttatagggatggctctattaattttacagagagtacatttctgacttcatagtataatttgaggagcattgaaaaacctgttgatccaagtatttcccttttcaatatttctcagtgctttcccctactcttttcatattcgaaatcttctcattccatgagaactagctatgatttaacttcctaaggtcaggtactgtgcttcttttgcttaccactgtgcacccaagcccttcaaggtgcacttgacaaatattcctgctgagtagatgtatgttagtaacttcatggaagctgtaatccatgtgttccaatctctgagtgatgccagagttaaagaagggtctaattccaaaataatggcaaaataataatatatttatttgcatttcttcaacaaatggaaaaggatactgctatggactgaatgtttatgtccccccaaaatgtatatgttaaagccctaagtgatggtttggggagatgggtcctgtgggaggtaattaggtcacgagggtgaaccctcctgaagggattagtgtccctataagaaaaggaagagagcaaaccccctctccctgctctctgccatttgagaaacaaaaagatggtcatctgtttgcagcaggccttcaccagacattgcatctgccagcacattgattttggaatttccagcctccagaagtctgagaaattaacgtttgttttgtaagctactcagtctacggtattctatagtagtaacctgaactggttaagatggatacaaagtttacaaaatacttcttaaaacgttacttttttttttttttttcctcaattagcttctctcacaaaagacagcaactcttatatcttttgcggatttttcaaatcaggctttcttcattcctaatccaatgtatctttatctatgtctctttctttcccattctgtaccataaaccctggaagagcttgcctggtaagacagaaccctcattataggtcatgagaggttaaaaaaaaaaaaaagaaagaaaaagaaaaatctcagtgcaaagccaaatcttccttaatcttcctttagttgacagtgagggaaagctggagacatttatatgacaatgtattgttgttgattttgttaactgaacagttttttaattaaaaattaatttttaattgaaaaaaacacttaactcttttcttatacccagaagcaattgacatatgtgaaaagtccttgaaaattaatcattcactgctttttgacagatctatttttgtctttacatgttacttagattttttattttacttaacatttgtccattatgtcttttctgcccaattaatagatttttaagaaaatttatgtataatacctagcatgatattttatacataacaagtgtttagaaatatttgtggagatactttgaaagacctagttataaaacaaattttatctaagagggattttattctgagccattactagccattatactgataaattattttattatataaatgcaaggtgtttaagaagggatgcttgaggctgaggacatggggtaataaaaacaaaacagggtgaggcaagttagggagtgtggctgggagttgagagatcactgggttagaacttgccagaaagaaggaagataatgccagtaaagaaaagagagaggcccattagagtaatataaagtcttttagattgtattactgttccatacaattttctccttccctcttcttggtgagcagattataatttcccactccactggctttttcatatggcttactttggccaatgaaatgtgaataaaaaggatatgttttgcttccaggcaaatcttcaagagacattaagggattcctctattggtcttttctctttgctatgagactgggctgatccatatggggcctgttccttcaggtttgtctcaggagaagatgtagggagagctgaagctacccagcaagtacttaataatgttacatttaaaaaataatgttttctagagagatatttgtgcatggatcactcccttggtttaagcaaatttgttttacaaaaatggaaccaaagataggcatagcattctccaacttccggagataatctgcaattacctgtattaaaaatatgtaaataaaaagatataatgaaaatgttgattgtgtatctataaagaaaacaatgataaattatgaaaatttcttttgaagatattctacttcaagttatagagtatatggaaagaactgtaaatcattatctaggattctggaatgtaaagtattcaaagcagtcaatattttttaaggtaatgatgtattccctctcattcctgaacaattttgatttttaagaataatcaggaaaacctcctgtttttgaacctgtacagagttgcatagatgttggccattttgaggaaaacatcttttgtcctttgcaagcagcctgcacttgcaaatcattcaccagaaatcagaatagtagctgagactgttgaacttcctctgatgcaattagtggacagagagtcattagtgtagctctagacataggcaattgcccagactttaaactgttttggaggcagctttttggtcagtagaaggaacagtatcactcaagctagcccaagtggtctctagctgtgtctccatgagtgcagaattatttttttcccctctgtagtaattattattagattctaccaagaaatgttgttttccctagtttataatagttaatatttatgaaaaattttccataggtcagcatatcaactatgattcctttggttacaagtgatagaaatcccaacccaagttactcaggtacagagagaaatttattgcatcatgtaatcaaacttgagcgtaacggaggactagctggctttgaggatgattcagaccaaagatcagcactctcttcttctcccacctccacctctttctgtatattgtcatcatttttcttactgtgatctggcttcttccataggctgtttggagctcatatctttccagctgtgaccagtaattcccagtttgcctgagactttcctagtttcactgctgaaaatcctgcattctgagaaacccctcagtcctgggacaacctggacaggtggtcatcagagaggacaggggctttttccttattatgtagttcaaatatggtctaattttgtctcaatttgttcctctgtggctagaaagtcactgtggctagaaagtgaggtactatggttaaaccagcttagatcaggtgcctcctggaggctctaatgaatcatttatccattttcaaatttctcaagcctgtttcaaagcacttgcctcctggaagtaagggaagcagggtgtgtaacatgatggcatcttccattctaacacttgtcaaatgacaagtgtggggcaaacctaacattcactgttgactagagtttgacacaaagctaagtgctgcatccaatatagtctttagcaaccctgtgcagaaagtactctcattatctcacttttacagatgagggagctgagatttcttcaagaggcaatgagacaacaaatgaaacccttaacacccttataattctttctggctagctggttcagtactaactcctagtttgttgttgtttattttgttttgtttttaagattttctctcatcatgcactcatctctttctcccttgaacttccatggcactgatttagatttttaaattatagttttactactcatatgcctttttgcttaaaaatagtgtctcctcaagaagcttctattctacgttctttgagagcagattctacatgacccatctctttgatcattctgtttgtttgtgagtgttcatcttatgtcctacatgataattctgtgtttttttttaaccttgcacctagtttttttccagttgtgtgtgtgtgtgcatttattatacttagaatcttgttggaatttagatatttgtaaattaaaatgacttttatttttagcatctttttttattgcttggccttaggcatggtgaccattaaatgtgcaacctaaatgtgtgcaacaattgcagaaaaagcctgacatgataattaaaatagaatcagcaccacttactctgaagttaagtaaatgggaggcataatgtagaccaggcggggataaaaaacagtgcaacttcagaaagatatttaaaggctacttataaatgcttaagcaaaatgagaaatctgggaaaagtttttatgctaaatgtttgcagaaattagaatattaaaggaatattcattaaaaagtcacttggaaaaatgctgatttccaacctgcttacattttttagtgtcctataatttatttttagatgacatgttttgtttttaaatctaaaaagcaagtgttttaaaatagatgtgtgaaatttgaagatgaataaaaaaatagtaaggattgtcaattataagttgttacttgaggccagttacttcacttctctgaggctcaactttgttctctgtaaagtggtggtgataaagttgggcccaaacaacctagtgttgtatcttcccactctaacagtttttgtttttttattttatttctattgttggattcttacattcattataactggaccaaaacctttataagaatattaagcactgtttactgaagacaagacatgataaaaatagttggcattttaggccttgactagatgaagtttattaattttatcaaatatgaattttagatagccatacgtataattcaattaaaaagtgatattaatattctcatacagatgaagtctaaaatagaggcaaaaataacagaaacattctatggttaaggataatttgatggacttttaggtttcatgattcatacttcccgcccataatttaaaattatgggaataattattatcttaaaatatgaaaccagataccttgttttgttctgttaagagaagtctacctatatgcaaggtgctagcttaccttcttggttttcttttaaccaggatctttctaaatttgacataggtttagttaagtaggttagatagaggaatttcattgtttctggaaaggtaactcatgaaattcagtacctttcatgagatataattttaagccctgcatagaacctagtgtagttctggggtcgtgatatatacttcaatatggttgactcaaagacaatcctttatcctaatatgtcatacctgctcccaatgtttgcggcatccagggaagaataaaaatggaagcttacattccatatgtctaaatatttaagagttatacatcaagatagtgaattgttgaatctaatgcattctgttttctccttccttggctaatatatctttataataacctggaatgacaggtttgagtttagatacctgaacacacccctctggcctaagaccacatctttggcttcccacccatgtctctgttctgcactctgaggtaccttatatgggcatcagtaaatgccccagattaagctttacctatacccttcccacagccttcctggagcaatccctttggcccaagggcatctacaccagtcactcaatctaccctgaatcgaatagtacagagaaggggttcttgaataggattctggggaatgtgggctccaggtagacacatccccttgggtttctgtggagggcatggctggagaaatgctccagtatgactggagaggcatcttttgcttgattcagacgctttcagttatgataaaaactcagggaaccatattagaggaatccacaaggataatttatttcaagtttaccgggaagactcaagggcaggaatgtgttaggtgttgggaccaaggacagaatctcccttttctcttgatgctgtgcctctgtgctttagtctgtctccctgcaggtagtttttctaggtcacatggctggaaatctgagcacaggcttttcctagctgtacctgttttagtctgagcaaccaaaaatatgcttttatttctcgttctaaaattctatggcaatgagtttgctcttcttgggccaggttgcttatcctcaacaaatcggtggctcatgcctgtaaccccaacactttgggaggccgaggtgggtggatcacctgaggttaggagattgagaccatcctggccaacatggtgaaaccccttctctactaaaaatacaaaaattagctgggcatggtggtgcctgcctgtaatcccagctacttgggaggctgaggcaggagaatcgcttgaatgagggagtcggaggttgcagtgagctgagattgtgccactgcactccaacctggtgacagaacgagactccatctaaaaaaaaaagaaaagaaaaaaaatcactatgaacaaagaaatggagtactgtgattggcagagagtttcatggcaaataacacaaaaaaaaatttcatgagaaaaaacaaactcttgaaaaataaaatataaaaatatgaaaagttgattttatattgtaattggaactctgagctaattcttgtaagaaaaataaagaatatgcaacaacttaaccatcctttgctttacatttggcttttccagcaccctcatggagaaagtcctttctgtttaagtatttgagggcttcataagatatatcaaaaagccaccttaattctttgttatttaaatctttcttttctgaagcacttattctgtctctctgttttttttttttctcatttttgttgttaactagtttaactctatactgatttttcaagggcttttgtgtgttctaagtggttttctatgatcattttcatagacctcaggaaatcttgaatcttctgcaaaatgtatgatttcactttgcagtcattttgcattccatattcatatatgaatgcagtgcaaataaacaagagacacctaccagagtggtagagcaggaaggatgggtaggctaggtttaagaactgtggggaggtaaaaggatatacttgtgtagatagttggcttattagtaaatcttttcatgttttaaataattttttcctccctaaaatgtcattactgtgggaatcagataataaattttcagcaaatgaggacccctgaataaacacgtgactaagagtcggattttttggtgggggaggaattctaacagttttgggtatggctctaccaatcatttgtggtttccttccatgcaaggaacttctctccagtctgtagtttcctcctctataaaatggggtgaaaagcctccttctcactgtggagttggaaaaattaaaagggaaaattatctggcactagtgttttctcagtaaatggaagctatttgattgagacacatttctggtcctcctaggagcttagttagtttagaggggataaaaacatgtacagttaattacaacataccgtgaaaaatgcaataacagagatttacaatggccattcaacaaacctttaggaatgataagtcatccaggagaggggtgtcagagacggcttcctgctggggtgatacctgagctgatatctaaggcacagaaagagttatccggatgaaagagggtggggaggcactgctaagagaaggggtccagaccaaggcccactaggagcaaaggcacaggagtgacacggaacccacattcagacaactgctagcaggtctttgaggctggagtcagatgaaaaggcaagatgcaacaataattctttgtaattttatttgtggggagaaatgaatttcaagttacaaatatctattcacaatcaacaaacttgcaactaactaccttataagttatattaccttatgatcatgtgaacatcttacctccccaaacaccaaaaaatataatataattcctaatttaatacactctggtattggtatggttaaatagaaatatttatatacatttatagagaactttataggtttggtttttttgttgttgtttagatggagtctggctgtgttacccaggctggagtgtagtagcatgatctcagctcactgcaaccttctcctcctgggttcaagtgattctcctgcctcagcctcctgagtagttgagactacaggcgcccgccaccacacctggctaatttttgtatttttgtagagatggtgttttgccacattggtcaggctggtctcgaactcctgacctcaggtgatccacccacctcagcctcccaaagtgctgggattacgggtgtgagccacagcacccagccagacctttatagtttttaatgtacacttacattttcagatatgagcttcaccataaccttgtcaggcaggtgagttaaccattagtttcatattacagattagaaaacctagacttaccaatattaagtgatttccccaaggacacaataagcatagtgctaagacaggatcaggttcttctgagaactggttgagtgctgttgctttttcctctgtaacaatggtgaacaggccttttctgtaaaaggccagattgtacacattttaggctttgtgggccatatggtctgtgtcacaactattcacctctgctgttgtagcatgaaagcaataatacacaatgtaaaaataaaataaaagcaaacaggcatcactgtggtccaataagctttttttttttttttacaaaacgaggatgtgggccagatttagcccacaggttacagtttgccaacccctgccctattaacattctacaattttttttgctatattaagtagtggagaattttaggtatgtggctccaatacatttttaatgtttattcatccctagtgtcttctatctggatagcacttattgtgttagtatcacaatctcccctttgttctctcctccataaagatcacctatctctggaataagcaggattttttttcccattagttcctgggtcagttcctacagaaacaggatcttcttttctcactagtgttttcacaatctctttcagctgccccttcgtgttctctaccttgcttctgattattgcctggaatttgaaggtgtccattctccctatggctattgttatattggcttccacggaaagaacatagagaggagtttctgtacacaagcctcagtttcccaaagcgccattgccacaggctgtcatggataacagattttactgaaggagcctcacttccatcccttatgacaaactatcatgtagggaaatcccacttttcctttaggaaactccctcacaggggctgttctctcaccactgggcctgttctcaccactgggcctagcctccttctgcttccaggacaggttgcagcatacacactgcagagcctgtgctattcagcctggagtaatacacacctggccacatgcatccaggctcctctctctcccttgccctcaatgtctcaccagccagtgaattctcttgctgtcactgacttaattagccctcattctctctcatctggaatactgtctccttctcaccagcctacaggccatttttcattattctctcattggtctggtcttcccacccctcacaacctgagtcatagttcctagaagcaaatctgatcacatcacatccctactcaaaattctatacatcgtcacttttacccacagcatacaatgcacatttgttagcttcactcaaggcctttcaaaatctggctctattcttactttctttcttctcccacccctaactgaaataggccttctctttctaccatatatctaataactccccattcaggagaggcctttcctcaaactcatgcctttaaaaacccttttcctaagctagaaacatgggtggacaatctgctttcttctctactacaattaaaatatggtaaatatcactatttagcagcagtaggcctggataggatggtaaggtattgatgctgtctcttccaaacacctatcctaaacaccacacacacacacacacacgcacacacacacacgcgcgcacacacacacacacacacactacgtagacatcagtttggcctaaaatatgctaaccacgccacatgatgtttagaagaagaaatggcttacatacatgatttgtacagattgactattacctatgattaccctcattagataattcctcaactccattgtaactgcctagaaacacattatctgctattagaaaagtattgtctggccaggcgcagtggctcatgcctgtaatcccggcactttgggaggccaaggcgggtggatcacgaggtcaggagatcaagaccattctggctaacaccgtgaaaccccgtctctactaaaaatacaaaaaaaaaaaaaattagccgggtgtggtggcgggcacctatagtcccagctactcgggaggctgaggccagagaatggtgtgaacctgggaggcggaacttgtagtgagccaacatcgcaccactgcactccagcctgggtgacagagggagactgtctcaaaaccaaaaaaaaaaaaaaaaaaaaaaaaaagcattgtttaattgctgagtctatgaaattcatcacaaaataagattgtgttgacttggtggttttccctccctcccctcatcactcctttccttgttttcttactgttttcttccctctgtcttctttcttccccaatttcaccagttttgagtttctcctagatgcacattgttcttttggttgtgaaaaattcgaagaagtagatgtggtcctggttgatggatgaacattgaggccctcaagtgcataaaggtaaggaaaagatgataaaagaagctatgtacttgatagaataagggttggagagggtcggaggagagagagaatgcttctgagaagcaattatgggcttaaagcagaagcctagagaataaatagcatttcagtcaacagagggcagagaagtgcagcttcacacaggaggggcactgcgtgtcatcgggggcagtaatgtgatgtgtgtttgggatatcagtttagtgatgtttagggagagatgtaaatttgaatcaatctggaatttgtattgtaaagagtaggtatgtgatattcaatttttctatacataagcatatcaggagagatattttctttgtttttgaaattgtacttgagctcattccttaatccaggagagatgagtaaaaatcttcctctggttttcatttattcatcaagaactattgattgagtgcccatgtttatcaaatactgttcctggctctgtttacttaagattgtgcatcagacttaagtatgaataatatgtgagattatggattaaatctgcaaacctgtatttaactctgttttcacatttccacatactacttaaatgagagctttccaggccatccattattgaggttaccactgccttgactaaagataaagaagaaacattcaaaacttggttttattatatgagctttactaatcgaatggatttgtgaagttatctaccatctattttaatcatgaaggataatagctgtcacacgcgtcaatgtcacatttattttgttatggcagagtacagaagtaaactgacttattttccctagagtttttgcacaaaagggacatggttagctgctcctaactgaactgcattaatggatcattccttatatgtatcctagcaacactgaaaacaacctaataactgcccaattctcctcatcagcagactgtgcagttttccctgtgttcacagacacaaggtcattgccaaatctccagttgactatatactatttgaaatgattcaattacattttcccaattaaacaaaggtaaaaaaatgatcaggaagtaatcatgtgtcctaggaaatagtgtgtgtgggagattgtgaggaatatttgtttcaattattatcttgtgatgaagaggtttgatccaaggttaatcatcttctgcttagcttcatccttccacttggctaggtgcctgcctggttccaggagagctgagcgagactgggggacagatgagactggggatggttgagtatgggtcttctctttctactgttttccatttatttgtggaatggcacctggcactttaaatagcatctttaatcagcgtgacttaaagtgctttccaaatagatgcattatccttattttataaacagaaaaagacagagagacagttacgtgacttgcccaaggtcatagaaatgacagaagagctggaaatagtcctcagagtattgccacacaatatcaaatcaagggtgtcctgatgagatgcagtggaggccagggagtcacaggactggtttgctgctagctagttatgtgtgacggagcacagtactcatgctctctggctttggtttttcttatttttagaactaataggggaaaggttttctctgagattcatgctagcaataaatttcgatgtcatggtttcagaaatatctacctcttcacttttgagataatggtaatttggcagagctcaattgacatttacctctgtgtttttttttttttttgaaagaagagttttcaagtaaatgacagttttaattaaagaaaaaaaaagcccccttgttttgcacccttggtgtcactaattagaggcaagtgagtttattcagtaacattgtctcgggaggtctagctggtgttctattgtccgtacatttttatttatttggcacattttgtattgaatactatattcaaagcctatgttaggtgcttctggaatgcagaagtgagtaaaatacaatccttgctctctatgtccttagaaccagtaggaaaggattatttttttaaaaaacaactcattagaacccaaggaataattcaatagcagtgaaataagttaaaactagaggattgaggcaatgccctgataaaaatggaattttggagtcaggaaagttggatttgaatttcaactctaccatttatttgggcagtatatagcagctcatatagattccataaactttggtttttatcatctgtaaagtaaaactaataataatgcctacctcatgcaattaaatgacataattgatgtgaaaattttatgctagataaatttatgtataaaaaagaattaaggactgggaactagaagaaaatctaagagggatggtatttgaatgacaacttgaaatctcagataaatgtcaataactgagaaaggatcaatgaaaattaacacagtaaaaagccacacaaatgagcaaaggcctagggacattcaagaatctacagttggtaaagatgttcacttctacagttggtgaggttacatgcttttaaaaacaatcactcttattttcaagcatttcattataatgactttttactaattcagtttgacctctaagagtaaaaacctatgacgttttattatatgtggtatgactataaagctataaaactaattttcatgtgcagcctaacaccccacagataactttaaagtcacattcaaaataaactatttgttattcttgtgtagttatttactttctggagtacccatttcaatactttcttacttttctttttgtatttccctagacccattgggaaaatcacgttgagggtgttggcttattatttctttgcctcctctttgccctatgtaaactgaaaaatgatacatgtattcttggagtgctttttgatgaatagaattttgacagggtattccaaaaagtatctttctcaaaataatttggttttgaggaatttaaaatctgtctagggactcccgtgcattactgatggaaatgtaacatggtgcagccactttggataacagtttgggagtttcttaaagtgttaaatgtaagtttatcatatgatccagcaattccactcttaggtatctatgagaaataaaagcatatggccacacaagatctctacatgaatgttcatggcagcattgttcagaacagtcaaaaagtgaaaacaactcaaacgtttatctattggtgaatgcataaacaaaataaggtatatccataaaaaggaatattactcagcaatcaaaaagggtaccaatgcatgctacaaggtggatgaacctcaaaaacactgtggcaagtgaaataaaccaaacacaaaataccgcatattgtatgatttcattcatataaaattaccagggaaggcaaatttatagagatagaaagcaaacatagagttgcttacagataggagtatgaaggggagtgagtgcacatgagcatagtttctgttttgaagtgatgaaaattttgaattatgttatataaaagttgcacaactctactaaaaattaaaatgggcaaatttatggtatgtaaattttacctcaataaaactaataaaaagctatctggaaaaataagatacatttgaggcaaaatataagggagcatgaacatttactgatacatgtgtagtgtgccttaattcttaagagattagaaaagaaagaaaatcacttttggttgagtgttagataattctttatggaaaaagtagccttctgaagtgactataaaggagtttgcatttgaattgggcattggaagataaatagaattcattcaagaggctttaataatttgacccaaactaaactccttaaactcatatatctattttttttaggactctagttttgattagaattccccactcactgtttgttaaatactagttgacatgcatcactctatcccagagttttactttgccttttagaagtacctttataataacaataatagcttatttctttgtattcaccaataaggaatctatcagattacatagtttagttagtgcccaataaaaaatacctttggttgcttaagtgaccaactgataccatgccaggcgggtagatcaaaatgacaggagtagggggtgataagccttgtgcttgatagagggttgataattcattggggcccaattaggaggctcttgaatgccaggtagaggagtttggcaattgggtagcaaaagagtggctaatacacatggtataatgaaaaacaaacctgccagcagcgtgagggtcagcttgtgggaggaaggcttggcatcaattaagacatgattttttttgtgtgtgatcatacattttaaagctcagttcaccttattgagcatctggtgattgttcaccttactttaaattctacgtcctggaaatcatttttttttttttttttggttctcctttgacagtaacttgaggaggctgagtttgtttgaaaagttcctccagcagcattctttggaacaaggcaactatttttttcccatacattttactcctgttctgctatcattgttttgagaggcagctatacaaaataaaatttctttaaaaatattgacccagactagatattgtattgtattttgttaaataagatatgtttgagttgaaagcccctttgtgctacaaaacttgttcacacatgagactttaatatcatgtccataatactttatttcttgctggataaaggagaagattccttggcatagcagcagcccacaaaatcccactgttaagagcagcactgtgatttagttatttccagtctgacctgcaacatatctgacttccccaaatgaatgccctgagctccacagggcccaaggaccagaaggaagtgtgatcttgaagtcagtatcaataaccatagcacataagctcacatccagttgtacattttccttcattctccttatgaaatggtgagttcaatactcttctattttgaagggaattgaagttcatggaacaaaagggctattaatgctacacaaatcatactgatgttgcagtggacagcttctacaactccagctggagctcataaaactgtgaagtcttgtgctccttaataccaaaaggtggaaagatgtacattaacttcttttaaagtgaagggaagaaatgcttcaaataaaaaagcatacaaaacagcttccatacacatattccccatcattcagtgagagcagaatttgggatggactcaaatagcctcttgtggaattagacgattaaaatgcgcagcaatgacaaagatacatgagcagactttcaaggagtgaaggcacttacattggctggactttttgcaggtcatttgagctggtgtattttttcaaacaagttgatcatcactttatcctcccagttaagtttggcagaaccatagaaatcaaggttggtttattaaactaaactgtccatatagaaagttttagatagattagtttgacccacagtagaattgttcttgaaacatgcaaataccactcactgaacacctcattgatttagtcagaaaaaattctagtggtttcaaatcatgttgaaaccagttgtcactgttaaaaaatattttatctagttgcagtgccaaactaaaatgatgtctacccttttgcatcaaaagcaacaattgtatggtgaatttttggtgtgtagacctcaaatacagaaatagggtccagagaaattaggtctatgatactatgattcatgttaaaattttcctcaaggaactccagctaccaaaatatcacatggatattactggaagattatatagagggaaggctccacaggctcagctgaggaagggaagaaattgaaactatggaaacaaatgaggtgtgtgggggtgtgagagatttggtgaccaggtacaggagtctgttgttccagaaagagcagtgctccattcatcaagccttaagcagccaggaagatccataagggagatccataagggagtggccacacggagtgatcactcactagcaaaaatgtagtgggaagggggctaacccccaacctccaatcatctatttcactgaggcctgaagatttaccacaaataattcctttccttgttgtaagctttgccgtgcaatacctttttttttttttttttttttttttgagatggaatctcactctgttgcctagggtggagtgtggtggcatgaccttggttcactgaaaccgcctccacctcccaggttcaagtgattctcctgcctttgcctcctgagtagctgggattacaggcatgtgccaccacatccagctgattttgttgtttttagtagagacagagttttgccatgttggccaggctggtctcaaactcctgacctcaggtgatctgcccatcttggcctcccaaagtgctgggattacagggatgagctaccgtgcccacccctgtagtacttttatatagataaaaatacttctgggaagggtaacactagaagttaaaactccaagagactttggatatgatttagtgccatgtttcactctacaaaagaggaaactgaggcccagagagttcaagtggctatcttatagcaaattcacaatgagtccagtactaaaactcactttcagacttttttgctatattgaatcaccacatatgacactgtgtattcattaacattaaagcaatttgacttcatgtgcccttcctgcgcagctgtggttctgatttaaatatcatttcttgagagccacataggaggttattgactcatgtttctagctattgccaaaacaaccacagtcatttggaaaaaaaaaaaaagcaacaaaagttttgcagagatacttgctattaggttaatttgcaaagcatatcctggatgctttccccttaccttagaactttttgtaaaagattcaggaagtttctggcattttctccctttttaactttttcttcttttatcctggaaaagagtagagagaagactggtgtataatgaatgttgaatgatgagtaagaatgattttccttcaaagtcagggttggcagctggtcactcactgagtgataatagcaataaaaacaaaagctaacactgatggactgcttaccatgtgccacacatattgttcaaaatgccttcattatttgattcaacttattttatccttattataatgctacaagaggttgagcaattttcccagctcttaagggccagatccaggattccaactccagcatcttcctttcagaacctaggacagtaaccactcaaccacacagcattttgttatagaatgtagctgatttccctgaactttcttcttggtgatcattgttacagttgctcctgtcctcaatgttgaagaatacatatgtaatctggatctctaaaattttatgtgatattaattgctttactctgatgtacagagatattcagataaaggatgtcctgggattatgagattgactaagatatggcgatagaaaagagtccaggacttctcaagattggtgatcccagtgtcaaaaactttccaatggctagaagcacctctctattttgtgacaaaggaacagtttattgtgagaaatgttgtctaagagaccagagactcccctgtgccacttgtgtgctatgagaccctgggcaaattacttttcttccagagatctcagtttggtccactttacaatcatctttgtgttttcttcttgcttcaatcatttaggaatttaaacattgtttttccacatgactcttcttggagagtagaatagctaaccctacatatagataagagccagggcaggcttggactttcacctccatgtcccaagtgagccctcctcttttgtctttatggtgggtcagtgctgaatggcaaagcagacagagctgcctccaagacagctcatcactggcaggaaatcattctagttcctggcattacacctacacattctctttcattgcccatttctccactcccagtcataacagatggggggcaggggggcgggtccttgtcctataggcctattcaactaggaaggtctggggagtggagacagagatgtggaaagaactgtaagaatggtcctcagagctgcttcacagctagtgaggctggatgaagaggtggtccgtggtattaaagaaaatacgatcatcatcagctcaacaaccatcacttacccccaggtctcatcaccaaatacaaaaatagcacctgtttctgtaccttgcactctttgttgacacttcttcctcgatttattttcctgttaatttttctgtacatgttaaatacatttaaataagttccactagcataagcattaaagcaagataaacttcactattcaatttgctttgggctatcagagatgtcagtcaagattgtgcaagtagatgaagaatgtggagatgggcttgggtgggtgtcacctgaggactggaagaggaaagggcaggaggagaaatcaacacccagatcatcaatcaaaccccccatcttttaggtcacaagagtctctctttcccattttctaagaaggatttagtgtggaagaggccataaaagtgtgtttctttggcattcttaagtctaaataacccggttgggctgaaaacctctgtccaacacagtttcactgttaagatgtgtgagtgtcaaacccaccacggtggcatgtgcctgcagtttagctgcttgatgctgaggtgggaggatggcttgaggctggagtttgagacaacactatgcaacaaaggaagactacatctcaaaaaaaaaaaaaaagtacgagagtcaaaactacagagcctcaggtttccagttaatatggaatgtgagaatgagacttccgcccaattccccaattcctccctcctcagtctctgtcgtttgattctttgggtatgacaacttagcacgtagaataagctcacttaatgttagttaaatggacttataaaattcacaacattgagaatttcgagaaaataggggcaacaaaaagagtaggaaggtaaccatgcaaaaagcctccccaccctaaccagctcatgcacatacataaaacacaagaaagttaaacaaaatttcatgatgtagtttgtagtttgtcttggtgaaagaaattaaatgatttgcaatgaatttcaaccctttggcagaattaatggacctattgctgtgcagacactgctgcttgaaggcaatggaattggaaatttccatgcaccagggctccctggccagcagatggcgatgtttcttagttttacaggaagatgccaggccagaggccgttagttatgcagggcgtgtttatcagatggctgttaaatcggttcaaaatctgtaaaggatggcagatcagctcttatttatttatttttacttagagttgatgaattcagtaaaatttcatgatgggagaatgaacgctgtgcctttgtgttggggatgggagcagaggacgaccagtatccaaaatggttgggtagctgcgttttatctctctcagttgctttttaaaatgagattcttctcgcgctgccttctagcagcctggatttagtcaatgtgggaccaaagggcacattggcagcagttttgttcattttcttttacgtttctttgtaagtgggcttgtcttcccgggtcaaccacttggctcgcagatcctggggcagaggcaaaatctgggtgaggctgggtcgggagccagggcagggctgctcagagttgaggaatgggagggaggagagctgcttctaggctctttctcagccacgtgggagaattggagatggatccactttctcctccctgagcccagcagctattgcactgagagccagcatccctctggaaagaggccgaaccattttaagcagagggaaagaaatttgtggagtaaattggtcttaaaatactgcctgctctgtgtgctgacccattaagggatatggcaccacttgggatccaggatattcagtttcttgatttggaagtgtcactagcctactgtgtgatgttggacttgttttttcatctgtaatgtgaacactttgatagaaatcttacacccatagttaaatttgtattcttctgaactagcaactctggtgatacaggagaatttttagatgaccaattaagacagaatatttaggggtgggaccttggcgtgcaccttttttaaacaagctgtccagttgatgtaaatgttcaggtgggcttgagaactgttgctctaaccaggggatctcaaagggaagtctcaggacagcagcatcagcctcacctgaaacctttattattatgattatttttgatgcagagcctcgatctgtcacccaggatggaatgcagtggcgtgatcttggctcactgtaacctcggcctcccaggttcaagcgactctccttcctcagcctcccaagtagctgggatttcaggcgcccgccaccacacccggctaatttttgtattttcagtagagacagggtttcaccatgttggccaggctggtctggaacgcctgacctcaagtgatccgcccctctcggcctcccaaagcgctgggattacaggtgtaagccaccacgtctggcccaaaagcttttcagaaaagcaaattattagttgccctaatcagaatcagaaattctgagggtgagaccccaaaatctgttttaacaagcactcaaggtgatttggatgcaagctaaagcttgaaacctactgtcgtgtttggaaggatgaaacttccccgtaccttttgcataaatggggctggggattacttctgggaatgggatgtaaacccggtgttatatgtcatttcctgggctaaacgtttagttgttcgtgtatgacctttcattttctcatctaggtaagttgtgtgattttaaatagagagaaatgcagcatgctggagcttctgctagtttggaccccagagttgctacattaacatcttgtaaatgaaacaaaacaaaacaaaaatttttatgttaaatgactgaaattttgtggctgtttgttcttgtattatagcttatcctatcctgatgaatacaagtattaatgctgtagttctgatgatttggtttgattagtgctgataagaagaggagggacttccccatccctcctcagtcaccaaacatccatttcacagttcttctaagaatatatatttaggtttaacatactgggataatttgagaaaagcttctatatctggttgtgggttgcacgtgccaaaaatgggaatggaattgaaaaaatattcagtctcatgtcctgatgtattcaaatatctatatttggtattatagtgttcaaatattggggtctgagtttgcatccttaaaagttctttctatagctctggattattatgctgatactaagaatttgatattgcttcttcccattgtaagagctcaaatctgggaaggcattctccttctctttagacctttcctaagtagactactttgtctttctatgacagaaactgcacgttttgtgctcctttactgaggcgagtgtccctggacttgtcctttccccaccattgctttttcctttgtatatttatagccatcactctattaagactgcttcacagggtggctacctttacttcctgttttatactcattaatagaaactttctcagacctctgttttcatcatttctaccattaatctttcttgactgttattgttttgtttgtcagaccccattactgttgtcatcaaaataatcaccaccaccatcattaatattgtcaacatagtcaacatttattgaaattttgctacatcgttaagagtctgaactattgatcattgatcaagatatcatatatttgaccgtccttttgccccatcagtttgctcttctgctctgctttgtaactgtctgttaccttttcatacttctgcaacatggaattactgccctgatccaagatcctttatgtatagttttcttattcctaccttagttcatttattcaaaattataatgctctcttttgcttcattaagatatggcccttagaatcctgatttataaacagcaaatgcccaattctcattcctctagggatctctttgtgacttattccatttttaaattaggagaactcaacaaaagctgctgttatatctgcatgagtttttccctctggagttggtgttgacgatctccccagagctgatttgactaggtcattaagatggatgaaataaccatattgactgtttagtgagctggttatttcagtaatcttaatgagagaattagatcgatcccaaggtactccaaatccttatttgatgattgacctagaagcaatcaattgcccatgttgctctatatgaattctctgcttccgtcaaccagtctcactccccacacaccccctaaacatgaactctacaatacacacacacaggtacatacataagaaaacccatgggcagatgccttattggagatcaggctggaacacacaagtaaaaacgtgcaaggggatttcatttgtgtttccaaatgttactaggactcagtgcagggaaggcaagaagggggactggtggcagagtctaaccttatcacatgatgcatgtggtcaccggggcagggtgctcaaagcctgtttatgtggatattgaagcagaagggaaatatgaagctttaaaatttacaacacactctaatgtttgtgctgctataacaaaatatcacagatgggtaatttatgaagaacagggatttatctttcacagtccggaggctggggagtccaagatcaaggggccggccttggggtctggtgagggactgttccatcgatggtaacttctcactgtggcgacctctcttagaggaagctagaagagaaacaaggggcaaactctctctgaagcctcttttataaggaccttacatcttaataccaccacagtggggattaagtttcaacattaatttcggaagggacattacattcaaactctccatccaactcttgtctttgggaagttcatctataagctgggaattgtgaccctaaccctaccaaccatacaggactttgtgcttactaaataagacccagatggaaagaaactttgaaaagtataaagcattgtaggaatgaagcatgatatactcaagacctaatatcggtcatcaaaaggaattcaaatgtgggagataatttgtcagtattgactaacttaaaaaataattgttttctctaatttttttagtaactttcttgacttcacttacccagataataacctcatatctcacccaaacatttactttgcctgtgtgcttgcactttgaatttccctctaaatataagaaaaaagaatttgtgtgtctgtgtgcacacatatgtgtctctggtgggcagaatttgggagtgtgtagaatcttggaagggcccaggggcttcaactgaatgatccaatctggctttgaagccacttataggactcaaagctctagactgtcctgctgagactcacacagagcaagaaggaggggtgagaaatgtccataagtattttcactcaaaccatgatgcaggaaagaaatgccacagactatcaaagaaacaactattgatgtctcctgtttctgaagcgctacagattttaacgtactaaaatgtaagtttggtgttttttcattatcttatgtagttgtcttgcttataagtgggtttgtcctgtttctccaactctgttttaatgttttgttgttgtttttgttttttttttttaaccaaaaatgctatcctgtgttccctagaacctgtcatttaggacacccatcatgtctttttttttttctcccaaaaacaaacttgtccctaaataattcagttaatcttaatgcatttgcttttacacaactgagctctaccatggtttaattaaactacctcatggtgtaacactagacagatctgtgaattaagatgacagaacagaaggaaaccttgggggttatcaaatgtaaaacctttatttcactcatgaggaagctgcaatctagaaatctggactcctcaaaatttatacatatttctaccttgacagagcttagaaaagaatcaggtcccttgatcccagcccagggctccctccactataccatttactctcagctctcattctgacataaacctgctgtgtggcctcaggcatttcatgtgacctctctttgccttagctttcttgttttaaaaaaatgaggctaatataaatgtcagtctttctgtctcagatgtgctttgtgtatcagaggagacgagacatgtgaattcacatttatgtgactagacctaaaatcactttgaaataagaaattctatccaaaagtaataaagtatattgttctattgagatagtcatggaccaggcttatgtggaatcaatactagtttatgataataatattgataatgtgcacagatgtcagagtgtatgtgatactggtactagcaaagtgaggaatacagctttaaaactggaatgtgaggacagaggaaaaaaaactgaatacaaacctaaacacctcaaaatgactctccatagacccaaggaatatgagagttaaggagattccattacaaggaagtagaggggcttgtaaaacaatagccaatatgtggtagattaaacatctgctgcagacataaatcgaatcccactcggaaacagccgtatcctctctagaaataacactgttcataggaacattatatacggtacaaccatggtaaggagaagacacattaacccgttatcttaaaggtttcaatctcattttttgaatttatatttcagcttttaatccaacaatagtcattacaagtatttaatgactgacttgctaattgtgtatcccaggatgaagctgagagaagttaacacacaaactggtcattaactatgttaatgatcacgttctttgggattatgactattataagctataattaacagtttttaaccattttttttctttttagtaaaaaaaaaaaagaaatattcttgaggctcagacagaaatgatgaatgctggcctcactgttatttcttgtatcataaagaacagcttctgggacaagtttttgttttcttaatcattactagagctcttcaaagtaaatgatggttctggtcaactgagcaaataggctctgtcctgtcctcactagaacatcatggagggcttatgcctggaccatacaacctctcggcatctagaaaggtttccatcaattctcgtgtggtaaaaataaaagaatttaaaatggtgctgcaaactgcaagcttggggcgcaatttgtcccatggaaaaactcctgggcctgatgaaggcttgcaaaacttgagctgtgttcatgacatttatcttttccacactatgccctttcttccccacatgaagtatcttatggcctctcattctctctctcatcaaaaacattctttccagaatgaaactaatgaacatcagaggatataaatgactgatcaataaagcttttaaaccacaggcgaagtcacctagtagaaagactggctctatctccttggcgttggaggacagagctctaaggaataagggcagagtcgatctctactaaaaatacaaaaattagccagatgtggcatgtgcctgtaatcccagctactggggagtctgaggcaggagaattgcttgaaccctggaggtggaggttgcagtgagccaagattgcgccattgcactccagcctgggtgaagaagtgagactccatctcaaaaaaaaaaaaaaaaaagaaatctttattggaaaacaaatattaacattaacaactattttgtgtttttaagttactctagagaaaaatatttcagataaaaaataaatatttccaagacaaaaatttgattagaaacttcccacgagaacaaaaattaaaaaatagaggctactatgataagtgatatattttatttgatgttcagcaaacatacgctgctgtgttccaggtgtagctggatggtgatggttacaacaggaactggatgctgtcacctctttcgtggtacagtacgagggactagtgttgacaagctatgatgaacgtgacagctttgggtcttgtgggagtctctatgggtgggggagggtggagtctagcctagtccagggttcagggaaaagtttgtggggaaatgaagttttgtcaagaggcagaccaactgtctcttttaatgagatctcctggaaccctggaagaaggcagggcttctgctaagcgtcatgtcaacagcttacacaaaagcttacaacagcttagaacagcttacacaaaagaaacagagggtcataggatgatcaggtgctaggaacaagcctaaaagtggctgcctacaatggaggagtggtgagaatacacaaaaaggaagaaatgatgtatttgagtcacaaaacttctgtatttctatggtctgaaaactggggcacaatttttaaatatttgaaatcagaataaaatgttttcataaaaaaatgctttctactagaagagtggaggtttttgctgctagccttctcttaatgacatcagagaagcggggtctgattaacattgtgttgcatcattcatggagatgagctcatggtacgtaatggaggccctgctgaacttcacacattgtaagaaagataatggttcatagaaaatggccaagccctttttatatgagtcatgttaccagaagctctcctttctggcaattcacttcttttaattcattggttaaaataataactttcacaaaagtttttactaacacatttatgaagcatgcactacatgcttcataaaaccttctagaaatttccttttcctaaagtttttctctcatgcacttgaacagatattgcatcttttgacaactaattatctgacttttgaatatagcttttatttactgggcagtaaaacagtgaaaagttaaattatggcacctaattaagcaaatattttgcttggtcagctaaagggaatggaaaatttatttttttctctactataacttctttttatcagtaacttgacaagtggtgtcactaagatgatgatttttttgtattgagataataagactgaattttagaaactgttaacttttaaaaagtgtacataattggattctttttatttctctagttttagtctcatatattctgtatttcatggctttgctttttattgccttcattctgagttaaatatacagtcagctttgtgtggaattaatatctaagatgttgggataatgtaagctgctcctaacaatggatcacaattcattttaaattagtgagttcatttaaatgaaataattgggtcattatttacatatacacagttgtttccaaattttattgagaataaaataataaaagagttggcactgacaattttggcatctctataacttaggacaagagatgacccattttctctctcttcgtattatattcccataatttccccaattactactgcatagaaacgtcaagttggtgttgagttgttggcaaataaatgagagtgcttgaattgtagcattgttcagctcagagataactgcattttatcatgtggaaaggatctgtgttgctaaagtgagggtaacacagaaatatcaaccaaaccacaatagaagagaaatccacactcttttaacaagactcatgctctcccctgacttgacattcatcagcctccttgatcactccaacctttgctccttggctctgtattcataagacatttactgtgttagtttttatttagctgatgtgagttggtctttgcttttccccaaataaagtctttaagaataaataccatttaaaattattttcttatatctctcccagtcagactcagctaaatgtaggcaaatgtaatggccaaataatctaataaccagcatgttatgggaatacaggaactgactctgtatactttaagcctgcaatgaaacaggctctggagccccccactgtgcctggtactcaccctttagttgctggattgtgggaacatccagtaagtgcttaagaaggggctggagtagccaaagacagtggctgtttcctaattagtttggaaatatttcaacattttgggtggactgtcaaccctagctatgggaaagcattatggttgctacaactcagatgttatggccttcagcagattgtgactaaagctaagtttctttttggcatccaaatcatcatgttgcgagcctgtgaaaggtcacactttttctgtttttcttctcagatatctctggacatgtctaggatggtgataagtttggttccaaagatccctccgggtagtggttgcctactgctgccaggcaccagctgcgggccattgtaccattcttctgaagtgccgcaggttaagcacctttcctcaggcacctgttactccctctgcacctctttatttaatgtgtgggtcaagccttgcccataattccacacagtgatggctaaggacagcttctagtgcttagactttataaaaagttaaagaaaaaatgtagaaaatcaaacctggaaagtgatacgactcttctaaaagtccattggctgtggtccctcctcagggaaatttccaatgggtcccttagctctggcctattgcaggaaccaactgcacctagtaggtagcttttgatcaagtctcttctcaaagcctaagactcagttttctgaaatccagagggagaaaagtcttttaaaaaattcccctccagagctgactcttctatctgctttacttatctcttcccacaactctaaggccattcccagcttctaaaattttctaagttagggccactgtattagtccattttcatgctgctgataaagacatacctgcgactgggcaatttacaaaagacagaggtttaatggatttacagttccatgtggctggggaagcctcacaatcatagcagaaggcaaggaggagtaagtcatgtcttacatggatggcagcaggcaaagagagagagcctgtgcagggaaactcgtattttttaaagccatcagatctcatgagatttattcaccatcatgagaataacatgggaaaggctcacccccatgattcagttacctcccaccaagttcctcccatgacacatgaaaattatgggaattacaattcaagatgagatttgggtggggacacaaccaaaccatatcagccacttagtcctggatcactttaaaaatggagggctagaactctactccagatttccctaaacccaactctgttctaccctcatattgtcttcatttcagcctagagaaaaggactgaatgtacctcatattcttattttttcccaacttcctgattgcagctattgagcaatagcccatgtgcatgcatttcaaaaaagtaactttccgttaagggggggtttaaaccctgatttaggggaaaatgtaataagcagatttgcataattttgcaaaagctaatacctattttatagcacccaaataaagagagcatgatatctgagtttgaagtgcctgtgttcagattccttcataactttcagttctccccccaaatagtggaagaatagtaatcataaataggaataaataggaccatccatcagagtgaccactcccagaaaaaatgctatttctattagcaaaaatgactttctcagcttccaaatcactcctccaacaaaaacagaagttccattctttaccaggtattttgatgaatttgatgtattatttaagttataactgtagagagaattagtaatagaattattgtctctttgagtacatgtgactgtggaatggtggggtctataagttattgatggcctctaagagtgaaaacatcagagccatggggctttataatgaaaagagaggatggtggggtggagagttgtgaataggtagatttgggatggagagttgtgaataggtaatgtgcatgtagagagtgtgacaagcctgtgctgctttactgcctgaggtatatttcatcacataaattaggatgaaattttcagatattaacagggattcctattactgaacttctttaattctttctcatctcttggggaacagggggagctttttgtaggtgctgccctcaggggaatagcagatttggtgagtatgaggaatctttggtcaactttgaggttgtaaagcccacaccagaaacagcagtttagaaatctaagctttccatgtacaagacacaggatttttgaaatttttataatggtttctatatataggtttcaaagagtcagatcttggaggactaagtacagttttacttattcggtttactaaaagctaaagcaaagggcaaaggcagcctggtaaactacgcattggcactcagtctgcccagcagtgacctacagacacttccactcacatcccagtggccaaagtgagtcatgtggtcctgccaagttcaaccacggaatggtgtctaatcctcctacaggtagggcaccacagaagaggatgctaaatatgggtgtctagacacacagtctgccacacagacaaatgtacatttcagcaatgccctgtggagaacagagtgggcacacctctgtggactgctcaatccctgcatgcttgacacccctggaattcagatcggtactgtgtgtctgactagacctgggagggctgaggaaaccacggcttatataactccttctacagagaaattttagtctagaaatatttccagtgagctttgctttttttcccacttttgtcaagaagaaaacaacctgacaataatggcaaggagcccaggggagaatcacaaagtcaaaatgacaggcatggaatgaaagaatcaggccagtagtgatgtaggaaatgtcctacttttgatttttcatgtaggaaacacttaaaattgattttcaatatccccatcaatattcttagcccctattgtctatttcttgtgacagggtagatatcctctctccctccagtcttccacctccctattttccctccccactttcccatgtagttaacactggccatcctttaaatgtggtataaaacatagcctatttgcatattaatccagcaaccacagaggacatcagaacacctaaggatggctgcatttagggctcaatgtaacaagggcctttgagtcttagactgtgataaaatgtgaagtgacatttcgcagaaggagaaagcttctatttttaccttagtgttaagaaatggcccctgggaggaattgttgctccatctcagtgcttcccagatgtgtcagattagagacccacccactggaaacatttcaggaagtcagtcagccactccctggggctttcctaatgactggccgccttgtctgagttggttaactcagttggatgcagcgtgtggtgttaattcagtagggctaattagaccaagatcatggatttgatattcttggtttttttttgttttgtctttttttttcctcagagaaaaaacatttctaacctcttattggctaacttaaaaatatacattattggcctaaggaaagcaaattaacatagtggggatatagctgtacaaactacaactcacccctcccttctagaatacaaagagtatttcagtatgtgtggtgtgctatcaataagcattagcttcagtttagtaggatgggcacaggtaaagagtttgcaacacgctttggctcatttcagctgctgctgtgcagtgccaacagtggctacgttactgagctgtgcactgcagttcagtagtcatgatcattgaatgtaattggtaatggtcgatgagatttctcactggatgatgccagtcacaccacaaactcctctagatggcattggttggggcatctgcttcagcgtgcctggagactggtgtgtggcttcccttatttcattagcaggatgttgtttcctgtgtgtctggcctttctagctcttccaaggcatgatcttgactctgcaccaacttctagagtctaactcactgaaacactcctctgaaaaccttaggccttgagaagtggcacaatctatacattaatattacccccccctttaatgactgtaatatcacatttctccatgttgttttgaaattgtcacctgtgccatgaataatttgattgttaacctacagtaggcacaacccaaaataatttgccaaattccccccaacacttagtatgaaacccttatgacaggagatatttattgagtactaatctacattgtcaagaagggctttgccatctcaagtttcttctctttcatgttgcattcccttctgagaatcatcaccattgtatttatgatctggacttatgttagagagaattattgccatgacttatatctcatgtagtgagttcatttctctagaatccaagattacttctgagaggtctttaccaatctgttggctttagaaaccaggagaaacccctctgttttgtaatcataaaacctatgaacacagccaagtcacttaatgatattttcaattagcctttaagagaatcagcccagggagcactaatgccttgtcctgtgcaagggtgagtgaagctggtgagtgaagctagtgagtgaaaggttgaagagagtaacctaggaatcaggaactctaggatttgctcaatctggcacaaatctctttgtgcctcatttggcaaagtgactgatgcatgtaatagttaaaaaattcgatcttttccttaaaaagattcagagaatagtcagtccttcttatgcatggattcagcacttgtggattcaaccaactgtagattaaaaatattatgacaaaagcaatagaaattacaatacaataattaaaaaaatacaaataaaaatacagatagcatttacattgtattagttattacaagcagagatgatttaaagtatataagaggattttggtatccttagtagtcctggaagcaatctcctgtggatattgagtgagactgtactgagtaaccataatatttaatatgcttttattttgccttgttaatagacccaccacaaaagcctatatgatattgttgatgctaggccctcagcaaatactattctgcaagggcagtgaattaccatgctccactgctgtgttactctgtttccactctgctgataaagacatacccaaaactgggtaattgacaaaagaaagaggtttaatggacttacagttccacgtggctagggaggcctcacaaccatagtatatggtgaaaggcacatctcacatggcagcagacaaaagaagagagttgtggagggaaactcctccttaaaataaccatcagatctcatgagacttattcactatcatgagaacagcatgggaaagacctgcccccatgatccgattacctcccactgggtacttcccacaacacctggaaattcaagataagatttgggtggggacacagccaaaccatatcaatttcccttttgagaagacacctatagatgctagaaacaccagtccaactttctcattctgccatcccttcgctaaaggaaacaagagtgtcaaaagaaagtcttttacatatagctattaggttatctgtttgatcaatttagtaatttatttgatgtttagtttaacctgatttcatctgcttgaataatgttgtggaggggttgaaataaggtataaaaaagtatgaaattggaatgtggaagtcataagaaaatgaaagaatagaagattgtaggttgcagcactgatttatcaaatcttccaaaactcctggaaagcctatcacatttttcagtggatactgaattcagtagcattttaatgctttgaaaaagctagtcagctctacaggggaccagtctctataaccgtgctgcccaatcgaatagctgctaaccacatgtgactatttacacttaaataaaatttaaaaattagttattcagtggcattagcgacattgcaagtgctcagtagacagatgtgttaagtggctagagacttggacagtgcacatacagaacattttcatcattgtttggaaagttccacaggacagtattctagagaatttgagaatcagaacattcactcagatgataagtgcacattagataaatatgcaacactttttcaggaaaggtttttttacttgctgttggagtaagcaactgctgctcaggtattatgatagactgcatgacaaagaaatgttttctcatcatattgataagagatgttggaaagggaagattgttaatgttattgaaatacattgtatgtgttctagacattttgctgggtgtattaaatatcacctcacttatgacacagccgacctgagtgaagttttacaattagctccatttttacaaatggggagaagacccaggttctacaattagtaaatggagaaaaagcagttcgtctgacactaaaattagtccctctaaccatcacacacacacacacacacacacacacacatacacagaattactgtgtgttaaaaccaatgttaccctcattagaatttgccagatcctaagcataaagttacttttacatgacttgtatggacctaagaactggattaaaaagaattgctatcaaagcatgaattgaacaatttgccatgattaaaactcatttttccatttggaaaatcttcccttcaggacaagatgagaaacattcagaataaaatgcatgtagattaatataatcttcagagactgaggcaagaaaatgtaaaagagaaaacagtaaaaaaaaaaaaaaaaaagaaaaaaaatcagccatttgctgtaattttctggtagtgaggagctttcctgtacttgttatgcatagcttgagaaattcatttctcaaatagaccagctgggatacatggggaacaaagaccagcacatctcagatgtgtatacaggctcagttaatttcaaatgactaaattactgacatgcaaagatcataaagaagcacgtagctagtcaactcttgtattaaaaacaaggtaatgaaagattctttcaccataagatgtcaggcatgtgaagaaataatacttatttctgcagtaatgaagtgtttttacagagtccagatgcagcctgtttgattgttgagaagctctactatggccctgaagtcagacagacttgagtttgaatctggacatgactccttaattgtgtggggttaggcaaatgactcaatttctttaagatttggttttcccatttctaaagatggagatactacagtttattctacacagaattgtgacagaaaccaactgagagaatgcctgtaaagctttttgcactatgactggctaccaaaaatacttaggttaagctattattattagaattattagcaagtcctttttattaagactaaactgcctcatttagctaaaacctattaatcttattgggccctcagaattcacaaaggacaaactgactctactgtatggcaacaaagtctaacacactaatcaggtctaggtctctcaacaattcctcatatgacaaagttttctaatataatattattcatggtaccctactcttctgtgcattaatggctattgtcattttttaaaatgtgattctgtaaataaaattcagcacttttgataaggtgcaacaatgccagagtacagtggaactatcaatttgtaggattcatatgccatatctttgttactgacaaataagtttactttaaaagttagccatgagagatctattgcatctgggaagatggagtagatatatttccaaattcctcccactatatgtactaagtacaattaacgaccctggacattatgcatataagaaacaaaaatactgaaaagtagagggaagtcagatcaactaaggaaccatggagccacagatttataaagtggtgagttctctgggtttttctgcagaagaaaagttttatatatcccagatgggttgctagagaagctgacaacctagaaatcttaatgggtgcacagcataaaggtcagaataaaagtctactctctctagataaagaaccaggaaaacaataaaaaacctctcccccatcttgctgagatagcattagataaagcctagtggagagtcaaaacttttaccatgccccattaataatggggctaccttcccttctgccctctggttttagtgaaggcagaatggaaactacaaatgaagcacttccactcctcccagccaaaaaggtatctgtaaaggtgtaacagagagctagaattatcacttccacccagtggtatcgaggagcttctccccatttaggtgtcaacagaggttgagtggaaacctgaacttctgcccctacctggcagtgatgagagtaaggagctgctaccttgttcccttcccctgacaaagtgttgtcaggacaaggcagttgaataaaacaatatttaaataagatctacaacctcataacataatatctaaaatgtcaaggctttaattgaaaatcactcatcttactaagacccatgaggaactcacactaaataaaacaagataatcaatgaatgtcaacactgagatggcagagctgtaaggattatctgaggggaaaaaagtaaagaagtcatactaaaaatgcctcaacagcaattacaaacaaacactaaacaaaaaataacctccaaaaagatatatgaagtctcaacaagaaatggaagatataaaaaagaaccaaataaaaatattagaactggaagataaccaaaataaaaagcttagtggataaactttacaccagaatgaaggggggaaagagaaaatatgaagatagaacaataaaattgtataatctgaacatcaaagagtaaatagactaaatttatgaaaagaacaaagcctcagaaacctgtgggaaaataacaagagatataacatttctgtcaataaagtcccgaaaagaggacagagacaaaaagtactcaaacaactaatgactgaaaactcaaatttggcaaaagatataaatgtatagattgaagaagctgagtgaacattaaacagaatatacccagtgaaatccaaccaggaaaatttataatcaaccttctaaaaactaaaagaaaaggttttaaaaaaagtgataaacaacagcttatctatgggggaaaaacaatgtagataacattgcatttatcatcagaaattgtggtggccagaaataaagaggcacaatatttttcaagtgctgagaaaaaaatggcttgcaacccagaatttatactcagtaagaaatatccttcaaggaagatggaaaaatcaaaacatcaaaatattctcagataaaggattactaagagatttttttaccaggacacctaccttacaaaacatgactgaaggaagttctttaaacccaaagcaaatgataaaagaagaagtctctggaacatcaattaagaagaaaaaaaacaattaaacaaaggactaaatacaatagatttttcttctcttgagtttgctatacgatgtttgatagttaaagcaaaaattataacaatgtctctgcttctaaatgtatgtagaagaaatattatggaaaatgaggcagaagagatctaaagggaataagatttctgttcttcactctaacagggatgatgatgacaccaatagactctgataagttatgtatgtataatgtaatcatagcacaaccactaaaaaagtcatctaccaaaacgcactcaaagcactattaatacatcaaaacaaaatttgaaaaatattttgtaacccacaggaagacagtaaaaggaaacaaaagctcagtgagaacaaagagaaaacacaaaacaaaaaggcacactaaaactctaacatatcaataattacactatgtgtaaataatataagggcattaatgaaaagacagaaatacacattaaacaaatatgatccaactgcatgctgtctacagaaaattcacttcagatacagaatgcagggaggttgaaagcacaaagacagggaaaaaaaaatcatgcaagcattaattaaaataaagtagaatttactaagaagatatagcaatcctaaatgcccacaacccaaaaaacagagcctcaaaatatgtgaaataaaaatgaaaagaggaaatgggcacatccacaattttagtagttgcatttcagcactcttctatcaagaactgatagaactactagataggaaatcagcaaaaatatcgaaaaactcaacagcaccatcaaacaacaaaatctcaacataacactccacctccaaaaagcagataactattatttcaagtgctcaaagaatatataccaaggtagatcacatgctggaccataaaacatacctactacatttcgaagcatcatacaatgtgttctctgatcacaatggaatcaaactaaagatcagtacagaaagacaacagataaatctccaaaccctttggaaatatataatttatttctcaatagttcatgggtcaaggaggaagtctccaggtaaataataaaaggatattgaatagaataaaaatgaattatcaaaatttgtaagatacagctaaagtagtactgagaaaaatattttggaccctaaatgtttacactagagaagagggaaaaaagctcagatcattaatttaagcacccactgcaagtacctaaaataagaaaaacaaaataaatctaaagtaagaagaaggaaaaaaagtaaagaaaagaacaggaatcaataaaactaaaaacaaaaacgtagagaaaattagtaaaacaaagagctggttttttaaaatctcaataaatcaacaaatctctagcaagacaggcaaaaaaaaaaaaaaaaacagagaagacacaaatcatcaatatcaagaatgaaatagaggatatcactacaaaccctgagtacatcaaaaggataattagagattggtatgaccatctctacaaacatgcatttgacaacttagatgaaatctatcatttcctcaagatacacaaactacttcaactcactcaacataaaatagatgatttgaatatccctgacaattagaggaattaaatttatacttaacaacctccctctcaaaatatctcagatccacgtggttttattggtaaattttatcaaaaatttaatgcagaatgcaatgtgaactttccataaaaatagaagaggaaataattcgttttttgaggctaaaattaaagtaaaaaagaaaactgcatgtaaagaaaagagatcaacatctctcatgatgttagacacaaaaattatcaaccaaatgtaaaagattgaattcaatgataaggtggtatttattgcaggtatgcctgaatccttccttcaccagttcagatatgtagtgcctacatgattctctcactccttttttaaaaaatccatccctcagcaaagggtgacaccaatcacgtactttggaggatacttttagtctcttttgcttatggtccacagctcaattgccatttcagttttatcacattcttggtgccccctgccccctgccccctgccccatcaggaccttggataattctccttctcctgctgatctagaagagaagaggccctctccagaataccatgtcctctctcttccaaatttggggtcagtcctgtttatacttcagtatactgaagctgagttgccatttcagccttgtctttaattcacaaagaaatggcttggctaccttgacaaagtgaactcaggcatatgtgaaccaagaggaagctgactttcgagcaagggaccttcctttccagaaactctggaattgggtgttctagatgattggacctacttaaagagtcaacaatatggaatgtccatattggcatctaaaagattctggcagtcatgctttgcaccttttaattgctgagcctatgatacttaaatttacttttattgcactttgggatccatcctgaatactcattctatttcgtcaactccacagccagcctaggcttcataacttgcttgcatttcgtgcatggtagcttattagaatgacacatataatgatagagactgagggaaattctcccacttcttcagtctgccttatcacttttgcaggcaacatcactttatgagcacttcagccttaagtcagtggcatctcctagatttaaaaaatcagacatcattcaattgccttgctatttgaagagaaaacaataacttcagcgtaatgacgtttcttccaagatggctgttacctcaggctgccaagaatcctctcattaagaaaaagtgacagcagctgagtatctccatttaagtcttgaagcacatgcctgttcatttttcccaactaccaaatccagcaccttgtttctcgcctctgatatactgcatggtaaggtagctggaaatctgctgtcatctcctgttcctctgagaagacagacatttcccagacagtggcttcggatctttactaagcctgacttgaaactaacagggttgtggtgcacttctggcttatcggaagaaacttacagtaaaatcattgtttctcccaaatttctgtgtttaaaatgtcttaaaaaacaaaaagaacactacaaaataagcaaaataagacaaaccataaaaaggtagataaaatcaaatttctgtcatagatttgtgcttaatatatataaatctcagggaagtggggtataccaaagtataatcaagaatgattccaagtttggaagagagaacatggtgttctggggaggtcttttctctagaacagcaggagaaggagaattctccaaggtactgatggggcaggggggcaccatgaatgtgatgtcactcaaggaactttctttgacccttgaatatacctttgccaaagcaaaacaaaggagatgcaccactcctcacttttgaaaacatttgtgttaggatttcaaagcacaagtgaaactgccattgcaaagtttactactgagacagtgaaagtgatctgacctgaccagctccatcttgcttctaacctccaagctgtccttgttcattccccagcgttagctgaactaactttgggagaaacttagtttatagttcatagtttaaaacagacaataacagccctctcccaaaataaaaccccttcttgcctggggactagacagcctttggaagactaacaaattagcaacaagattagaaattatggtttaggaatcatgcagctggagactgagattctgaccttccccaaattgctcctggggataatatcactattgtaaaacctaagatcagtgcttgagatattttgcagaccctgcacttgatggatccgctggcaccactcagattgataaactggctcatctgaattgtggaccccacccaggaactgattcagtgcaagaggaaagctttgacttcctatgatttcatctctgacccaaccaatcagcactcccaactcactggcccccccacccaccaaattatccttaaaatctctgatccccgaatgctcacaagactgacttgagtaataataaaactcaggtctcccacacagcgtgaattattgtttctctattgcaattcccctgtcttaataacttggctctgtctagacagagggcaaggtgaacctgttgggcagtaacactagttaagtttttattttatttatattttcatttacagctttcttagtatagagagtttttccttgagagtacctaaataccaaaagcacgaggcagatggatacttctttagaaaatgtttatttctggcaggacatggtggctcatgcctgtaattccagcactctggaaggcggaggagagatgacttcttgatgccaggagttcaagaccagcctaagcaacagagcaagaccctttctctaaaaaaaaaaaaaaaaggctagaatggtggggcatgcctgtaaattccagctatttaggcggctgaggcaggagaatgcttgagctcaggagttcaagatgacaatgagctatgaggatacctcagcacccccagcttgggcaacagagcaacaccctctctacaaacaaattaaaaaattagcctggtgtggtgacatgcacctgtagtcctagctacttgggtgggataattgcttgagttcaggagtttgagatgacagtgagcttcaatcacaccactacatgccagcctgggcgacagagagaccctgtctgcaggacaaaacaaaacaaaaaaacaaataacaacaacaacaacaacaaaaggaaaatgtgtgtttctgctcctttacctagaaaagagcaacagaggttgggggaggaggtagtggcaggtcacatgttattctaattctcgaattgaaagatgaagtcttccttgtggaatctctcattttagatgatgtaacaggcatatctgagcaggttctttgggactcactctcaaggggagaagctgtctcttgtggagttctgtgtagggggttactggaaaattttatcccttcagctaagtgttgaatgctgtaaaagagataactaggagctggaatgataactcccagttgtcaaacccttaccaaaggtatttctttcctatatctgcagcctcttcatccttattaaggatgtgtccttcgatttgacaggttgtttatatatttgatctcatagacaattttgttttttggtcttatctcagtttaacattttatttaacaccttcctgtgtcattatcttgttagtttatagagggaacctttatttcagacacatacacacccatactcatatataataaacagattctattaatacaagttattttccacctaacaatttacacacattactccatactcaaaaatgttatttctactgcatacctcacccagcagtggtgtccttaaaatatgcaatgattgaaaaagtggaagtctaaacaatttgaagatttttctacaaagtctccaaactgttgtaaaaatacattaaaataatttatttatttgtttgtttattttttgagacagaatatcactgtctcacccaggctggagtgcagtggtacaatcttggctcactgcaacctctgctttgtgggctgaagtgatccttgcaacttagcctcttaagtagctgggatcacaaatatgtgccaccacacccggctatttttttgtatttatgtagagtcggggttttgccatgttgtccaggctagtctcgagctccctagctcaaagcgatccactcacctcggccgcccaaattgctgggattacaggtgtgagccaccatgcaggccaaaagtaatttatattttgatatgctcttttgtagtttacatgcattacttatgtgtgtgttatattgactgttttctctgaaaaatcagtgtgagaggcaggaataaggaaattgagttttggagaaattgaatagctggtctatgttctcataatttgaaattgactagtatccccagcttctgattctcagtccatctatttatcctatcacatctcctctacactctttcaggtatgtactgtcaatatgtaatcaaagtcagtttggggacataacgtaaaggccaggaaagaaaccatgtagacccctattactatcttttttcaatatctgcttatataccagtgtactcttttattttcctttaaaaaaagttcagtatcttatgactcttatgcttgacacatacaaaacaataaagattttaatgaataaatatatgaattacaaattagacttcttagaagaggtgacaggtgaatggagagattagagtaactattagaccagtaaaaaagcagtattgtcccccatgtgttatctcttgatacccaatctattcgttctctgccagataacaagctcaagaaagcactgccagacctcctaagggaatgactcttatacacacatccctgtgttcaagttataacacatctgccccagaaaacttatgtgacctgcagatcctgggagagctaaattttttgacatgtggatctaaaaaagccctttacaatttattccaccatgaaacgaacagtagatatgaattcagaatttggactctggcccagtttgtcacattaaaatattttaaaaattgcctgggcatgctggctcatgcctgtaatcccagaactttgggaggccaagacaggcagatcacttgagcccaggagtaaaagaccagcctagacaacatggagaaaccccattagccaggcatggtgctgtgtgcctgtagttccagctactccagaggctgaagagggaggatcgcttgagccggggaggcagaggttgcagtgagctgtgactgcacaactgcactccagcctgggtgacagaatgagaccctgtctcaaaaaaataaaaaaaataaataaataaaagctaaacaattaaattaatatataagtagatattcattgtaaaatgtttcaagctatagatagatacacacaataaaatagtaaaaggcttctccctgtttaagaaataccttataatatttcatagtatagatgaaatatgacctacaccattgtacttgccatcatttttcttatgtggcaaacaatggagtaatagacattcttatatatttgtctttgtgtacattcataattatttttataggacggatttctagaagcagaagttcagggtcaaagaatatgtctgtgagtaattttgataaagaatactaaatttcctcctaaaaaaactgtatccctttaaaatgtcactcatttctcacactcttttcaacactggattttgtctttaaaatctttaaaatttctatcaatgtagcctagtcttccacagtaatttttcccaagaccttaaacaatctttttgttttatcttgttaaaagattctgtaaaatgggctcataaattctacttcaggagagttgtgaagctccaaaagggaatcactgtgtcctgtcattgttgcatattctcatgaaaaccctgggaaaaattgcatttaccaatgcagcctaaagcactgtttttaaacattaagagataaaattcttcctcatccaaaactgttcatggggaataaattgcatagtttttcagaagtacaaaggtgtaaaccaaaaatgaaattctagggccacccccacaaacaattgaatggactgctttcctcagccaatggcattccaaagttaacctgaaacacaagttcaggccatggtgggaatgggtggtcagacatgcctcattatgccctgcaccttttgaattcagaaacaactcgtcagcattaacattaaaacagaccttaagattatctattctctctgaagcttgttacctggaggcgtcatccacataataaaaacttcggtcgctacaaccccttagcttaacgcaggcactcctttctattaattcgaggtctttatataaactctttcaaccaactcctaatcagattttttttttttttttttgagacagagtcttgctctgtcgcccaggctggagtgtagtggaatgatctcagttcactgcaaccttcacccctctgggttaaagctattcttgtgcttcagcctcccagaaaatttttgaatccacctatgacctggaaccctcccactgactccttgcctggcttcaagttgttcctttattctggatggaaccaatgtacatattacatatactgattgatgtcatatgtctccctaaaatatataaaaccaagctatcacttgaacaccctgagcacatgaactcaggaccttctatgactgtgacaggggcatgtcctaaactttggcaaaatgaactaaattgattgagatctgtcttggatacttttggtttacagaccgcttacatgactccatacatgcaatcatcaaatatggcatagtggagcatgaggcggggctacagaacccattcaaatttactcaggtttcttgggtgtcctgcgaatgggctcacattttccctctggattttttcaaagcactaatgctgtgagagttcttcataggaccatacggtcctctttgcagaatgtaagagtagactaaaaatactgatgctagataaatgtttccacttcttatctgaaaatattgacattatatgaccatagtcaaaagcagggcaccattacttgctctaaaatttaatttaggagactgtaaccgcccaatgggtttaccttgcccactgcctagacagagctggtttatcaagacagagaaattgcaatagagagagagctcatgcagagctgcctatatgagagatcagagttatattattactcaaatcagtctccttgaaaactctaggattgggggttttcaggataatttggcagataggggccgatgagtcgagagtactgattggtcgagtgggatataaaatcacagggaaccaaagctgtcctcctgctctgagtgaattcctgggtcgggggcatgagaccagatgagccaatttatcaacctgggtggtgccagctgatccatcaagtgcagggtctgcgaaatatctcaagcactgatcttaggttttgtaatagtgatgttattcccacgagcaatttggggaaggtcataatctcataacccccagctgcatgactcctacaccataatttctactgttgtggctaatttgttagtcctacaaaggcagtatagtccccaggcaagaaggaggtttgttttgggaaagggttgttattgtctttgttttaaactatgaactataaactaagttcctcccaaagttagttaggcctacacccaggaatgagcaaggacagcttggaggtgagaagaaagatagagttagttaggtcagatctctttcagtgtcataattttctcagttataattttgcaatggcagtttcaagactcccatgctacaaagaatcctggcattctgcctcctcatagcaaaggaagcaggaaaatagctgttgaagtacatttttagactgaatgtgccaatattttagagtttccgcagaggaaattttctagcagtgacctttgatgtgacaccatgactctgactctagcccattctttgactggaatggacccaaggaataccctccctttttgcctattgaagaggctaagcaggagatgggtgcttttcatgttagccagtcaagagatatttatagaggtctgctttgtgaccaatcctgtgctacatggggttgcggagaatagtctctgtcccagactattttgcacaaaacaattggcaaacagtttaacattttgctagaatggctgataggtcagagttgttttttgcatctccgcctgacattcccattgctaccactctggtttaggtgttgtattttcttaagtccgtggacatcatttgctgttttcttttacttaaaaatatatattgctacaattttagtctttatgtaacttctgttcaaaagccttcgaaggctacccatttgcccagagtttaaatccaaatgtttaatactttttatttaaggtgtgaagggaaaatgtgggggccccaaaattactaagctaaagggaaaagtcaagctgggaactgctcaggacaaacttgcctcccattttcttcaaagtcatccctgagatagatgcatctctgattgcctccttggaaggacttagcagaaactcaaaggaaggcaaccacttgtctctcacctacctgtgacctggaagtccccttcttgctttgagttgttcccacctttctggatggaaccaatgtacttcttacatatactgattgatgtctcatttctccctaaaatgtattaaaccaagctgagccccgaccaccttgggcacatgtcatcaggactgcctgaggctgtgtcatgggtgtgcatcctcaaccttggcaaaataaactctaaattaactgagactgtctcagatgttcagggttcacaaagggtataccttacctgattctcaccatgctttctagccttcactacctttgtcctcaagtttgctcagtctacctattttgtttactcacagttctgccaacatgccaccaacttccctcagtagcattgctcatttttgtgaagagtcctcacgtcaaggcttgtcaaaactattgtcacctccaggaagtctttcttgattatttacaacagcaattctacctcctatttctaaattcctatggcctttggtttgcaagtctcatgatacttaacatcctttttccttgggtaggtgttacaggctctggaatggggtaaatacccgaagggcagagataaagtgttctttgtatcttctttctcatagcagagattggtaaataaatttattaatgatataaaaatatagaaattcagagaagaaggctatcagtgtaagctgaggtaattagcggagcagtaaacatgaacataaatttttcaggattccccacagggtcagccaccagtctctgtagggcttctctgaaggcatctgaagtctttcctaagtatttttggagacaagtgtagccaaaatactacagccacctaaactcagcagttgatattacaggatactgcatgagatctatttgcaatttgtttgaggccacagcacagctgcataacattttatgggcccattttatacagtggggtttctcattttcaaatagacccattaaaactcttattaagctattaagtgtctacagggtgatttcgtggctgtaattacaaatgctctcttcatggcagacacttaggcagaagaccactcactcccaccttcacagagcacattttgcttttaccttcttcccaaatgtagctgcctgtttcaattttgcctttttcagggggaaaaaatttcaaaatgtttactatttttaaagaagaaagtcaacttgctcaaaggaaacttggaactcatatgaactcttgaaacatttctcttctttagcacaccagtttcagaggggtgactgtggacttcctttgtactcgaaggcaggcatttttccagaatatcacaatgctactacaacaggttcctctctgtattgacccaatagcaggagcagagggcaagtcaaggaccatggcagtttccagatgagcctctggatgctgtccattccaagtcatgtggggacagattgctagtacatttcaagcccactcctgcctcagagactttgtacttatttgtctttctacctagagtactctttgcctagtatctgtgtaatatacttcctattttgttctcttctctgaggtgaaatgactttacagcaagggctttactgactacccaaaatagattagcattctacttcctatcccgttgctacttccagaattccataccagattccatttattctgcttaatttatcttcacagcactttctacaatctaacttgatacatatttacttatttacttttatactgtctttctccatccattagaagttaagctcctggagggcacgttctttgttttaaattgaagtattcctagggtttagaacaatgcctgacacgttaggcactaaataaatgtgcattgaatttttaaaaattattctttaaagctcaagaaaataatttaattctagtgaccaaaaacatcttagaaatgattgagggcaaccctctccctttacagagggagaaactgaagaccatattggtgtaatgacctgcagggtgacttggtgatcagttgtaaagctgggacccagcttagcttgtctgatttccagaccatgcccttcaagcacagggccatctcaactccaaatgaggtgatttctcacattttaaatgtttcagcaagaaaaagaaagaaaagaaaaaagactagacttcttttgaaagaacagaatcaagttgggtctcaggggatttggtcatttgccagggcaaggagcaagtcccacatgattgagaacccaaagataaaccttctgtatctactctgcgtatttaacatatacattgtcgttgttgtaaccaaagcaattgagcaagtaagaaacatactgagaaatcaatatcccttgccacttaataacaacatatcattttgtaaagtagcatgccacagcatggtggcagctgatgccatttgttcttcatggtgacattctgtaaggtataagaactcattatgcctagttagcagatgttctcagagttgcttcaaactggttaatagaagagtttgccaagaaacaccctgttttggaaagattattgggatctactcaaataaagacattgtgatgttttactgtaattatcatgtgactcattttctttggcgctggcatcaaattcacccagaccccatcagccctgacaatgctgtgtctctgtgatgcttgtgaccatgggaatgcctgcagacatctcctccttctttgtggttctgggagccattctgtgcctctaaggtcctctttcttttttctcaccaatacacatattttctgtccttcgcaattctattaaacctcacatttgatggttgttttcttaaaattcctttacttggttcctgcattcctcattccttcccagcacaatccatagtaatggcattcctattacattcctctccatgcttagtcatgaatgttcttttgccatatcagcatctaccgtacattgagaggaaagaaagagaaaaaagtgtccttgtcttcaaaggagtttggaaatttcttgagagggaagtctaacctcatgaatcaatgaaagggcaattaatggcaaattgtgtagcactgacaagatgccatgcataggggggcctgcagtatagtggagaagaaaaaacattttggcatctaaatctgaatttaaactttttttctcttacttactagctgtacaacgttggacaagtaacttaatccaagatattaatttaagaaaaagcacaatttctactttacctgattgctgtggagtctaaggaggcaaaatatgggatgtatgtggcacagtgcaaggcccagagatctttgctgctattgtgcctgtagttaaatcgcaggtccccccaaaacaggagcccccaaattttgtccaattcttgttacgattggatatgacatggggaatctgattaaaaagaaaatggctgctgatcaagaaaaatttaaaaggcactggtggaacaggaataatacagggtggttgcaggagaatagagaattcctgactggattcagtggtttgtgcctgtaatcccagcactttgggagactgaggcaggcagttcatttgagctcaggaatttgagactagcctggacaacaatggaaaactccatctctacaaagtacaaaacttagccgggtgtagtggcatgtacctgtagtcccagatactcaggatgctgaggtgggaggatgacttaagtctgggagttcaaggctgcattgaggtgtggacctacctgggttaagactgactgaacccaacatggcactggatttgagctaggtttcacctaggatctcattagatgttcattaacatactaaatcacacacataccagcaccatgacagttccaggaacatccatatttggtgtaaaaatgggtggcaccacagttccaggaaacctccaccttcttcaaggaattttcatcaatattccaccccttggtaaaagaaacccataaaggtagcagctccaaagcctcttgggcgtgactctctcttgagtatgcccacactccactttattgagtatgtacttttcccttcgcaataaatctctatagtttcactgtttttcaactggtccttgaattcattcttgcaacggtatcaagagcctggacagcagctggggttgaggtcccactggtgtttggggacctccaagtgatacccaggtagtgatacctgcccactggtgtcactgagacatctcatgtgcctaccaaagttttctgccatgtgacttctgaaaacacaccttagttattgactcctttgatctaagcgcttgcctctttttgagggtcttctcttcaaatgtgcatgaatgagagactcttctaataacaatatagttggatctgttcacagcttgaggcttgttcctgcaaagtattggaagaggaagatgggagtaggaggattcagaaaagcaaggaaaagaaagtcacccctggttaaaacagtccctctcttcttaattcacagttttgttcaaaactctcccagcatatatgaattttttggagagccacatgtcctgctttatgcctttttagtagggtgagcaagaaaagaaatacttaagtacatttgggggtgtgaatgctttaatacaggaacacttattgtttaaagtaatttgtttccttagaaaaggtttagtagtttttctgagtttcagaaatgtcagccttgctcaaatggaatctgtaattgagacaagacacaatcactcccaaatatttactgggagtttgcctcagaaaataactgcctaatatcactgcaagatgtgcaaacaatacaaagcaaattggatttcctcccgatgaaggtgtggatgtaatgcagcatgaagaatgatggggctcaatctagtgtaaaaccagcaccagcaaaagggcctggtgatttgttaccaggcaaaaatcctgtctatcctgatgattaaattaaaatgaggtcctacattgtcactgttggtgaaatgacttatctgcctgctcctatcattctctgcacagtgcttgtatgtgggatggacatggaatgaagtgtttgaaaagaaagacatgagcacatttttctcccagcattgaagtttcattgcgaatctctcaacaacgtggaatgctcctgttggaaccaaaagcccgattatcatctctagaaaactggaataaaagaagagttcaaatcacaaggcccttccaaacatcccctctctcccttgcttgtgctctcttctttccaattttttatcttcatcaacacttaatactgggggcaagaaggttcttggctgggcacacaatgctatgggaacttaaaaacaaatggactagctgcaggtttaaataatgctacagtccttagacactgtatattattcatagctcgttgaactctattatctcatgtgttcctctcagtggctctgtgaattacccaggacaggaaagaaatgatagagtgtgaagatagaagagtcagtagaggtcagaacccttccccagcccctcagctttttttttttttttttttttttttgagatgaagtctggctatgtcactctgaagtgtcgtggtgcgatctgggctcactgcaacctccgccccctgggttacagcgattctcctgcctcagcctcccgagtagctgggactacaggtgcacatcactacgcccagctaaattttgtattttttagtaaagatggggttttaccatactggccaggctggtctcaaactcctgaactcgtgatctgcctgcctcagcctcctaaagtgctgggattacaggtgtgagccaccatgcccagccccactctgcccttcttattgaggaacctgagacagagaaggaaagtaacctgccagagtcacagacgggaccagaaatcacattgcccaaccctcagcgcaggtttttataactgaaaactgatgaaaaggcaagcaagaaaacaggcagacaacatatgtatgtaaataaattatgttgattcgtggttaattaggcagggagaaaggggccttcagaatctcaggcaaggaagataaaagaagctttatattttgaaaaaattaacaggggatgttaatccacacagccctcccactcccctgctgtagaggggaaaaaatagcatttcatccttctgcatttttaaatgtctatcccaaattgtggaaaggaaaaaaatgcataggaaatgtgggaggaagtgggagaagggcttactaaatgcccagtgaccaggcatccacaaagttactgggtaactgaggactgacatgatgctctgagaactgtatttgaggtaggtgaaggcttggctttctggctctcctaagagtttttctgagactctctgatttctcctgtctatgatcacttttcagtgcagcttccaggaactcatgggagacagcacatattacatggaaaactatgaagtttgcagtacaaagaattggattctaatcttactggacatttactagccctataatcttgagcaagttatggtcccattttgcctcacttttgtcatctgtaaattttggagggtaataccttcctcactgggtagctttgaggaatgcatgagctagatctgtgtagtgggtgttgtattttcagcttgcctagaacttttaaacaccctcactatgcatggggaatgtgtcgccttaataatcccttctctcataggagctaggaattcatatcctagttttcatgcaagcaataacacaagctttatcagtgatgtgcattttgtgggccatcagtggttgtaaaatcctgtttctggtctagaattggtatcactgctaacaacatttgtggttcctggtggttattcttattatccaacatactggttgcctgattgacttaatctagtgtcttttttaaggctaagttaagtttttcagtctttttgtttcctgagtaaatgtatgtaagtatatatgagtgtgtttgtgtatatatgtatgttttattcttgagcctagggctcagtccatttaggtttctatcaaaaacagtaggagataaggtgattcttttgttagaatttttcctaaaggatccttgaggggccttgacttaaactgagtgactatgtggacttgccaatttaggtttacatattactgatcactgaacattagattttggtcttcttccccatcctggtttttgaggttttaatttttcttttcttttcctttttttttttttcttggatgattacttagttcctgcattctaatttggattcttgaacccatcatttcactctcatttcttttcatgttttacagctccagtgccatgacagttttaatcttctggttccatctgcatagatttcagtctctaattgaggaaaatcatctgtttttctcaggagccccttgattcaagtttacacaaaatgtgcctttggagactatcctgttaatttaaacagttcagatcccacttgtatgtgagacagatgcttctctggccatcagccaggtaccactaaaggaggtacaggtaacagatcatttaattttattacattttcacatgtcagagacaggaggtatgagataatattgcacagcccctgcctgcctgccttcaaagagcctgtggtttaaaggagttacacgtaactaaactaatgtggctgtgacaagtatgcacagaggaggggcattttgttcagcttcagtgtgtggggctagggtgatgtcagtaaaggctttctggagataattcctgaaaggaggctgaaaaagtaaatcagcactttcccagggaagatgggaggcaaagatatgccggagtggtagagctggggacaccactgtgactcaagatgcagaagcatgaagcagactggctggctaggatactacaagcagtactaagaggtaaagaagaaggaagagagtggccatatgggctgagcagttgttgagaaatatgaaacaggggtcttctttctgatcgtgggcactgatgctttgctatgacacgaggcagacatggatgaggacagggttaagtggaggcaggcatagcttacttcttgcccttgaactaagggccagtgtgttagtctgttctcacaaagctataaagatactatctgagactgggtaatttataaacaaaagaagtttaattgactcacagttctgcatggctggggaggcatcaggaaacttacatcatgatggaaggcaaaggggaggcatggcatgtcttagatggcagcaggagggagaaggagcacaggggaagctgccacttttaaaacaatcagatcttgtgagaacttccttactatcatgagaacagcatgggggatccacccccatgatcgatttaccttttacgaggtccctcccttgacataacaggaatacaatttgtgatgatatttgggtggggacacagccaaatcatgtcattctaactccagcccctcccagatctcatgtcctcacatttcaaaaccaatcatgccttcccaagagtccctcaaactcttaactcattccagcattatctcaaaagtccaagtccaaagtctcatctgagataaggcaagtgccttctgcctatgagcctgtaaaataaaaaaagcaagttagttactttcaagacacaatgagggtacagacattaggtaaatgttcccatttcaaatgggagaaattggccaaaacaaaggggccacaggcctcatgcatgtcctaaacctggccaggcagtcatcaaatctcaaagctccaaaatctcctttgactccgtgtctcacatcaaggacacactgatgcagggggtggactcccacagccttgggcagctctgcgcctgtggctctgcagggtacagcccctacggctgttttcgcaggcttgtgttaagtgcctatggcttttccaggtacatgatgcaagctatcggtagatctacctttctgcagggccctcttctcacatctccactaggcagtgcctcagcagggtctccgtgtggggactccaaccccacatttcccttttgcgatgccctagtagaggttctccaggggggctctgaccccaaagcagacttttgcctggacatccaggcatttccatacaccctctgaaatctaggtggaggctcccaaagctcaactcttgtcttctgcatacctgcaggcccaacaccacatagaagccaccaaggcctggggcttgcacccactgaagccatgggctaagctgtaccttggctccttttagccagggctgaagctggagtggctggaacatgaagctccatgtccaaagggtgcacagagccatctgggccctaggccttgcccattaaaccatttttccttcctaggcctctgggccagtgatgggaggggctgccttgaagatgtctgaaatgccctggagacatcatccccatcatcttggtgattaacattcagctcctctttacttatggaaatgtattcagccaccttgagttgctccccagacaatgagtttttgttttctatcacatgttcaggctgtggattttccaaacttttatgctctgcctcccctttaaacataagttccaaattcaaaccaactctttgtgagcaaatatagtagtatacattcaggaaaagccaggtcacctcttgaatgctttgctgcttagaaatttcttctgccagactctctcaagttcaaagtcccacagatctctagggcaggggcaaaatgtcaccggtctctttgctaaagcctagcaagagtgacctttgctccagttcccagtaggttcctcatctccatctgaggccacctcagcctggacttcattgtccatatcactgtcagcattttgatcaaaaccatgccgcaattctccaggaagttccaaacttttgcacatcttcctgtcttgttctgagccctccaaactctgcctgttgcctgttcaaacctctgcctgttgcccagttccaaagttgcttccacattttcaggttatccttatagcaatgcctctctctaccagtaccaattctctatattagtccattttcacactgctataatgaagatacctgagcctgggtaatttataaacaaaagaactgactcccagttccacatggctggggaggcatcaggaagcttacaatcatggtggaaggcaaaggggaatcaaggcacatcttacaaggcagtaggagagagagggagcacaggggaaatggccatttttaaaacaatcagacctcgtgagaactccctcagtttcacaagaacatcatgggggaaccacttccatgatgtaataacctctcaccaggcttctcccttgacatgggggtattaaaatttgtgatgaaatttgggtggggacacagagccaaaccatattagccagcctcttgggaggaacttatttcttattgcaggtgcctctccattcctagcttactcagcatgccctccttcctcaagcaggtgtgacttaggtcatctgcatcatgatttctctcgtcactaagatgagaaacctccagagattacccacaccaaggctgcaacctgttgatgtgactacctttctctgccatgggtagtttatctcctctattcatttactctgaggatacaaatctttcttgtcatctttggggtggagggatagggtaattctaccttttaccatcagccactttctgcctaatcaatacttcaatctcctccccagaaagagtcattgattttttttccagattctcctctgacttgtttgagggtcccctatcatgttatatatcacatcccatctagggcaccctctacaattcatgaaacattctagacttctacattttagtagggtctagggaatcaaatttaaaccttggatgtttcaagcctaccagggtaaaacattaactttacaattagaaccacgctttgacacttgaatgagttctcactgcaggaatgcctttgaaaagagatctggcttattatgatggatagatggggtggagcttcttagcaaactacttgctttagaagttaatggaagaacatctatgttcaggaaatcactgtttgctggtaattgaggcaatcagatgtttcaaagtaggtgaactgtgaacaaatgaactcctgaatgacagcaggggatagcgtgtggcctcaatatttatactgtgtaaccatgatcaccaaagcactctcatctattttaaaacagaagaaactatcatcagtggataaaactggatttaaaagcaagccaccaaaagctcataattttttgaactgagcatttttcaaggatgataacataaatacagtcaagctatttctatagattttttaactttgatacctttttggaaaacagatcccacagaacaatcttagtaaaatggattatttttataggggaaaataccaccaaaaacccttaaccctagaatctccattcttggcttaatatttatcaattctttttgattatttcttttatattttccagattatttagattttagagctagaaagattatttagtaatgacattttagtggcattttaaataatgggttcacagttcaggtcagtgtattaggtaacagttgtaagttggaagcaggcaaaggcaaacatcagcgctaactcatgtgatagctgggttaagagaatctttgtgtataaatagcctttctatgaagtaggtataatagcatgagtcaccctttttttctttctgggactctgaatgattttatataaatgttaatgagtccccaacaattcaagttttctttaaactccttcgtaagtattcctaacttcagactctccttttttcaactattttgcatattaatagcaattatcccacacggggagaggaaacagcatgccaagccctgctttagaatcattagctcatcgtaatattaatcctgaacacaaccacagttactacgtcaacctcataaaaaaaaaaaaatgagtctcagcgatgctaaataacttgctaaagtttggacagtgattttgaggctaagttaggattcttttcttttttctttttttaaggcagtgtctcactccattgctcaggctgaagggcagttgctcaatcatggctcactgcagcctcgaacccccaggctcaggtgattctcccaacttagcctcctgagtagcttggactacaggtgtgcacaaccaagtccagctaatttttgtattctttgtagagatggggttttgccatgttgcctaggctgttcaacttctgggctcaagtgatcagcctaccttggcctgccaagttgctggaattacagacgtgggcaactgcacctggtccctgagttgggattcagaaataaattctgatgaatacactgctgttctacagtatttttccttctgttatggtgagtttgcctgatttttcttaattcatttagggtggttcccaatgattgcctttaaaatctacctgtttaatagccagccttgtaattttgccagtgaggaatgttaagctccctgaaggtaactggatattgttttcatgttttctgtcctgggcttcttatcctttaatagatgtcctgcacattcttgtaaaagattttttttttttttttttttttagaaaagaacagctgcaaaatagggttgagtcctgcctgttctctgtaacctgccaatattacctgactttgagttgctgccaacatctgtgactgtagcattcccagttctctccccacgcacattacagggatttctccatcattgtcctgttgacatttgactttgcaaatctgttcaagttctcatttaggttgagcatgtagagtaaatatgtgtaggggccaaaggaaaagcttccctttgtcctctaaaggtttgctgaaaaatcaactgataaagggcagattaataggagaaatgacgtacaaattttttagtatgcatgagcggaaattgcacagtcattgctccatctcccaatagggtacagatactcatatactttacttctaaggggaaagggagatggggaagtggggataattttaaggggtggtaaataatttttaggagaattcaatgggcttgaagaacatacattggcctgggacaaaatctgttgagcctgcagagcagacaatggcttttgacaaaagtccgttgacagtctttagcctttcttcctgcaatatgagttcaattactgaaaactcagggaaggaatcagagataattgttttcttctttggcaggtccagatgttaggcagataagggaacttcagataacaatttcatactgtcctttgggagagacaggattaagagatagtgggagctgtggtcaggggtcggggagtggagatgagagagaccttgaggcttcttcttcagttgagcatgtcaacatgccatttttggggggtattagtttctgaaccccaacacatggaagtagcacagttgataacttgtgtcagattaatgtatttaaagacaatcctaaatagggattccattctctccttggaggaacctttcttgaaataagacaaatttatttatcttctaagcatatttatgttagcaagagactgaatgtaatattcaggggaatatacttagtttcattattttttcttcctgtataaaacacaggttggaaaggacatttgtcataagaggactttttcccccaagtcattgtctgtgcattaatcttcggaatgtgatggaccatgtgaaacattgtaatttgtctatgggataaagtccaatgggaatccagaaagccattcatgcagaaacactctgggaggcctgtgtaggccaactttgaatacatatttagtcctttcatctttggcaacagccaactactcttttatgaaaccctgccttgttattttcaaagagtttattattaaaattgagctaagcacagttctgtattcaccatctggtagaaggtggatcgctgctggtatgtttacaaactaccttacttactctttatcactggcttatacctagaaaatatatacatatatatatatatatatttattgtttttatgtaaacatactgggtgacaatatggtattcagcttggtcaatatttggtgtaatgaatcaatagaagaaatatttacatttttcccagtggctaatgtataggcatttttacaacttctgactaagtcaaaccaattgattgtccttgtatacacaacagtatttacgtggtgtctgggttccagggaccttttcctatctacccatatggtgcccagatatcagtttgaatgaaaagcctagccaacattagggctcaggaaaaaatactggaaagtattgtgctttggcatgctgagcactttgaattaaaataaatgggaaacgttaggggctgcctcagaaccaaaaactttctgtccttctcttgtttgtcctctctcaaacttgggcaggtattctgtctggaatttccttatctgactgaggaaacttctttctaaaagaagcgccattgtcctaaacctggttccctcagaatcccattgcaaaagcaggaaagattaatcacaaaagaaaagaagatactaaaaatcctcaacacacccagtcagagttttcatccattcttctaagggcatcttccagagattacctaagagactttatctatataataaggcaacatttgttcacaggacacttccacccctcaacttcctgtaacttgccattcccattcagtttccaaaggaaccatttaaaaattattgtctgtattttgggcccattaaactctactaaaaaatcattgactatctgggaaaattgtctacatactcccatctccccctcacctatgaagagggtgcatttaaacctcagctctctggcccttctttgagtctcatagtttttatggttcctgggctcatgtacattaatatatgtgtatgccttttttgcctgttaatgtttctattgtcagtttctttcaacagagttgaactttcagagggaaaggaaaatttctcttcactcctatgaaaggaaaatttctcttcactcctataccaatcagctatatattttgttgatacagtaaaaatagtaaatagtaaataataaactttcatattttcaggaatttgtttaggaagaatatttgaataaactggatattttgcttaattagcaattatcacactataaatattatatgcatcacacagatgattattttccagataaatagggtacaatggaattaatgtatcactaaaattctgttaaaaatcattgacaacctgattaaaaattcgaagacctttcaaagctttaggttcaccattctaaatatatatttaattaccaagaatcttagatagaagcagggattatgtggtggtagaattttatttgcaaattctggaatatatcctggaagttgctttgtttctctaataaattccacaggtcaggtttgtgacttgattataagagccaagttatgcaagaacaaaatcaaatcagatatttgaattctaggtcaagagagagaatgatatgagaataatttagctttattttaagatatagatgatttggactataatcagagttcccacaataggatgtgaggtgaggtgttttttttgctggtcgtaagtgcttatgaaaggtaataaaccctaagcttttcaaggacagtcaccaagatgtaaacaattgttgctgttttatgtattatccatgaggataaatgagatgcattacaataggaaaagctactgccttcgccttccagactgcgtcttacaagaccattcaatcaaaattctcagggaatagcacctcttccaatgttcaacttaaatatatgtctgtgaaatgcatttgaaagcttaatgtgtgtcttttggagtgaccattctttgaagtttcattgtccatttcatttccaggaatggtaatacttcactttatctttataagcactgccccatccttgatcttatttggtttgcataactatgtactgtggggataaagttataattcctatgcactagtaaaacaaaaaaaaaaaaaaaagaaagaaaaaagaaaatgtctctgaatccagtacaggcaggaaagttgtgtttgggaatctaccaggtaagaaagaggcaggttagccagcaagagagagaaataatcacttacgatttccttaatgactcacaaaaatggcattggtcattaaaatgcattatacaggtgtagttttatttaagccacatgtcagtttatcttctttttgttatttatttttcaacattttattaaccaagtattacaggctaagcatggttctcatcactggaatagctaccgcctgtgctgctgttccaactagaggagaaccatgatcagtcactccaaccatgagtaccagcatagaaactcctctccaccattgtatccagatgcaggggtccctgtggtttgtaagaataaataagaataaaaaataagaggctcaattctcctcgtcaaatataagggaggagacttctctctgcctccttttgttaggtgatttactatagaaaacttgtaaattctttctctatctctttaaaatgtatgtttagcttcttagaaattaaataaggctcctgccagcgttatgacccaggaatgtctttttcaagaacctgggagccctctttttgaaatggaaacatcaagggagacagtaccctgtagcccgatttctgtgggagggtaggagcctaacttcagtgggtgcctggctccaagctgcaaaactaccttctgtcaagaagatatggaaagtttatttttcttttgtataaaaccaattaactaacacagatggtcaccccaattaacaggtaaatttaggataaactatatgtaataaatggcactgtcaaatcctcttactggaggactaattattgtctatttagagattctgtagataatgagttttatctggtcggctttataaaagggttagatttctttctgtctttgcaatctcttagtagattgcctgtgatgtgtatcacattctggtttaatgcttattcaataataaaactgttttctttactatctttatggagaggttttctgggttgggggcagattttgtttttaattatatttatccaacaatcttatatgcaactttaaggccttgtgggaaaacatcctaattaggaggtcaaatgaggtagaaagaaacaattccaggtcagagcaggcattgttgttactcagactgaagtgtgagtcttggctgactggtggaggctctgggtaaaggcactagttaccacttacatgaaaatgacaaagctatccagcaagttctccttagcgtgatcccttccttgggcatttaaaacatgtcccttatacatgctctctctttagtctcctttttcaagcacttctcagactattgaatctgttccacaaaaactcttcaggactgggttccagacttttcttggcctctccattcaagactttagcacctactctaccctgtagttaaattaactttttctttcattcctcaatgcatttccttcttatttccacaattgttctcaaatgatctttcaaagagagttaagagccaaatacttcttctgacatctgttgagttgatcatatggtttttattttgttgatgtggtataaattaaaacagaagtcaaaccattagcagcacaggactcatttgaggctttgattttcaaaaaccaaaggacttgacaaagatacggtggtggtactggtgatgttggggacaatagggcgatttctccggtacaggtaaataataaacaaaattaaacattaaagtgttatgttttttaaaaagttgaattttccaagccttttccaagtgcatttagataattgctttgcattgcctgaatccacatgggactttttggaacaggatttgtgtgccttgtaattcacccagtcaagacacatcttcccttctgtaacagtgttaaaagaaaaccttagataaattaaaggtaatagagtttaattgggcaaagaacaatttgcatgaatcaaggagcctctcaagccagtgtaagctcagggagcctccagtgcatccatgtggcagaagatttatggacagaaaagagaaagtgacatacagaaaatggaagtgaagtgcagaaacagccagattggttacagcttggcgtttgccttatttgaacacaatttgaacagttggctacctttaattgtccaaagcttggtgattggcacaagagtaagttagtctgcttacacgtttagttaggtttactatgtacagaggaacctttaggctgaacttaaaatatgaaatgaggcagctttaggctaaacttgattttacaataattcaaggcaatcttcacaaatttgggcatttccttaccttgatgctgtattacatctcaataaaattatacctaaacattcaaaagcaataaattatgcaagcaatatttgtgccatttgggtaaagtatcattttattatgtttctcagtgtgactttttattacttcatttgtctccaatgcatttcatacataacagacaaggagattttctctcttagtatccacctccaagctacttcatggcttccagattttgctttggtgttttcccagacatagaatgacacattcttctcaataacttccatattaggagctagcactggatagcctttaataatgccattgtttaatattcacattgaccatttaggtatagtgtttccaccttttttctacatgctataacgtataccagtttataataacaataatgataacgatagtatattttgtcattttttgagcttttataaagtataataaatttcatggtcattttatatacatgagtttatttgaattctaaaaccgtatgaaataggtatgatttatatctctactatccagaaagcaaaactgagggttagtaagttgaagtaacttgcccatgctcacacagtgaagtaccctattttgggtacttagccccactgttagatcctttagtcatgctgccatactactgtaaagtaggtagagtttttgtttagttactaaccttccttcaaaagggattcaagatagcactgttattcttttattaaacagagaactggatctgtatttcataataattaaggatgtagcttctctgtctgaaggcctgtgttagttgtttctattactgttatgctattattaaaaataagaaaaaaaatttaaattatactttaagttctagggtacatgtgcataacgtgcaggtttgttacatatgtgtacatgtgccatgttggtgtgctgcacctattaactcgtcatttatattatacctaatgttatacctccccccaagaataagaaaattaaaaatactccttaagtttggtaagagaacatttctagtcaggagtgggtcttttaacccaacagataccttttctctagactgttgcaatagaaggaacaattttgttctttggaggctgttatccacagagccatcccaaatcaccagcttcatccattaactcaaaatcagtaatctgagaagcaaaatgggtttggtttgtctactaaagggacaaacttgtgataaaaatatgaaatgagttcaaaatagtaccagtgcagacatagacctattattttttgacatttggcaatctggtaaaatccaaatattgtgtcatttcagttaatacttttttttttttttttgagaccaagtttcactcttcttgcccaggctggcgtgcaacagtgcaatcttggctcacttcaacctctgcctcccaggttcaagcgattctcctgcctcagcctccagagtagctgggattctaggcatgcaccactacgcccggctaattttgtatttttagtagagacggggtttctccacgttgctcaggctggtcttgaactcccaacctcaggtgatccacccacctcggcttcccaaagtgctgggattacaggcatgagccactgcacccagtctggttaattcttttggtttcctaattttagaccttcagaactcattacagggatatcatatggcatttaaagataataacctccaagaataaaatatttaacttaatcagaatattgaacaatactgagtaataatctttaatgggctactacctgaatctgaaaaaggaggaatatcagtcaaagatacaagaataaaagaaaattgatacagtccatgaaagcaagaaattgtcttctaacactcaggacttaacatacaaccaattagccctatgaaaagaaaactctgtcttatctgcctaatattgatagaggcaggaggcagagaaattctaggcagacagggggaggtccctggtgaaactccaccttcaagccaaagtagcttgagacctgcacccaaaagtgaggacctctatccctgtttgcccactctctcctgattggttctttctgaataatatcttttttaccaattgaatgttgccttttccaaaaccacctctggcttgccccacccccatcctgtgtctataaagaccccaggctcagttggtagaggagagatggcttgactttggagagaagacggctggacttcagggaagaagagatggcttgactttgggggaaagatggcaggacttcagggaagactacctgctggtcccatactctttccagctcccctctctgctgagagccattcccacctctcagtaaaattcttcaccttcaccatccttcaagtgtccgcaggataatgcccaagcaaccagcatgcatagcaaggaggactctggcagagatggagagctcaggatgttaactagaagcctaattcttcttggatgccagacaagagctcaggacccaccgagtgcaggtactcataaaaaggttgtcacaatggccctttgccctcactggtggacagctgcccgacatgatgaggcaaggggccaactgagctgttaacacgtagctgtctgtggacggcagaactcaaggatcattgtaataccccctgtggggccttgggggtcacaggtacccccctaaacacacagttgggcactgccccatggagcttgctcttgctggcacccagagtggcttgctgggtcctgcagtatctcactggtgcctggtctggccatgggtactgtatggagcttgctcctgccagcgcgaagagagaccctgggcagatccaaattcacttgctcatgtgctccctcccacaaggggttgagcatggagagctgagtaaatggagcccccctgtcacaagtctgatgaagacgctgagaaaaatcctgcatcaatttgatgaccaccccttagcaaaatacatcctggttttcaatagcaaattatctttaatgccttacatgggttttgctacacttcatttttaaacataaaacaacaaacatactatcctggagaaaagttcatttttagcaaagccgccttttaattcaggtataacacagtgccccaagactcttctaaatttgtcctggtagatatttgcagatctacttatcacagtcacagcatgaagtagtttctgatttatgtggtgagctttagacttttagtattttctctcatggcctcaatccatgagaaagcgggcctgcatcacatttaacaccaacatagcagtgtcgataatgcccaagcaaccaacatgcatagcaaggaggactctggtggagatggagagctcaggatgttagctagaagcctaagcagcataaactgaaagatttttcaaatctagaggatttttatatatttggaggggaataatgtatgctgctgaattagaaacccagataagatttcacttataagtggagaattacagttaaactctatgtatttggtatgatttcagcaaaaggctttcagaagttttccatgagagagaaaatgggtttctcagaggtctgggtcaaccagaccataaaactcagcatcattactttcccactatctagtacagaacctgccatagtaaaggtgatgattacgacaatttaggtgtaactcaaagtcagatcatgctgtagctgcttgtaaactctagattcctaacttccaccatatcatcacttcacacctatgttttgctttggatggcacccaaaatatttcaagctgctttcctatccaatttctcatttctggctagggagccatgttatgtccaaatcctagtagaggttattttggctgaagagagccatgaaacaagttgtatatttgtaatagagcataaatacactttctgaagcctaggcaaatgcttgtcatgctattacattgtatttctgcacatgctagatactaggtgctcagtaaatttgctgacaactttagacaaatgaaatggaaaaagaatgaggctgtcatgtggatgctagagtgtttataacaaaccttggccagaaaacatttatttcttcagcaaatatttactgagtatatactatgtggcagacactcgacttaacgcttagatgtagtcttggcactgggagctgagagtctaatgtagataacacccacattaacaaaataattatgttctggagtggtggaagctgtaccagaatgtgagaaaactcagaggacaacaaagaaatggcgtgggggtttggaaagagattaatataagagagcaaaaccagtctcacagaattgtttaccttttcttccttttcttgtaacctttttttttttttttggtggtagttgtgaaatataacatgcttaaacaaaagtgtgtagaacaaagatataccacatagtgatttatcataaattgaacatttatgttaaaaagtgcttttcaaactatctgtaatgacagaccagattttgtttttgttttgttttttctaatccatcagttaaaaaatacaattaaaatgaaacactaaaaaaggaaaaggaaaacacatgtttttataaagatataaacttttgaataaaccagtagaaaagaattaccaggaaaatagaagagaaggaacaaagataaacaaaatccaggtcaaaattttaaattattatatccaacaggcataaaattacttggtaaaataaagtttctgaatatttattgtgaattcctgtacttatgtgaacccatggactaatcatggcaattaaacaaggttcaattgctaaagaaattgacaggacccaaactgacaaagcttacaaaaatgcaatctgttccagaagaacatacaatatggcagtagcactgaagtaaggctacacatcagggccaggctgcctcccagcaagatgtccagagagaccagatgcaggttccaattgtcttacctctgtagcatcatattggatacactttctttcggaccattaacatacacattgaatatttaggctctgggatccccagatggaattttgctggtgcttcttgtgcccagctggtcacataggcatattcttgctatgtaaccagtcccagtgacagagctcttcagtggtcatactggaaccaactctaaatcattaatctcaatgttaacaatgaacagtgccgacaagctggtacaaaccaccctaaactccttagactcatgttaacaaaaacacactacaatcagtaccttggtcagcatcttgcaggtaatttagcaaaacagcgcaggccaattccaggcctattggaattaacttcacagtgttggagccaaaggaagactttcctttcatcctctgaaggttcactgaaaatcactgacaagaggcagattaataggagaaaaaagatgtaaatttatttgattctagttttatgtgacacagaagtcttcagaatgaagacccaaagatacaggggaaattatccattttatgcttaggttcaacaaagtatgggcagctgtttttaaatatgattggacaaaaagagtctgatcttatcttaacagactgagcagggaaacctagcaaggcctgtgcttctagtttttcttggcctctctgagcatgtatttcttccttctgtgcatggggcaggaatctctttggaatgagggtcttatgacctacagtcaaacaaggcaggtcagataatttctttttggccagttttttttgtttttttttttttattttttttttatactttaagttctagggtacatgtgcacaacgtgcaggtttgttacataggtatacacgtgccatgttggtttgctgcacctattaactcatcatttacattaggtatttctcccagtgctattcctcccccagccccccaccccatgacaggccccagggtgtgatgttccctgccctgggtccaagtgttctcattgttcaatttccacctatgactgagaacatgcagtgtttggttttctgtccttgtgatagtttgctcagaatgatggtttccagctgcatccatgtccctgcaaaggacatgaactcatccttttttttacagctgcatattattccatggtgtatatgtgccacattttcttaatccagtctatcactgatggacgtttgggtttgttccaagttgcgattgtgaatagtgtcgcaataaacatacatgtgcatgtgtctttatagtagcatgatttataatcctttgcgtatatacacagtaatgggatggcaaatggccagattttacctgaaaggtggtgggtgggggggaagttagagtaagatttttaggttttatggtgacctttggggagaaagcattctggtttttatgacccatcttggggaagagaacttctatggttaaccttcaaggagaaagagactcaaagacaggagggtgggagaaggtcagagaaaaacttttgcttctgaggctgtttctgaggccttcattttggtgtatggttttctgagtccccaaaacagcataactcatagcagtttatggatgggtactgggttatagaccacactttgagtaacagtgatctatggaacattagaatggaactaaaaatagaatggaacaaaaaccagaatatgaccagtaccccagaaatctttattatgccctcacaattattaatctctcctttcctcaaaggtaaacaaactatcctgaatccatgatgattactttcttttctttatagtttttcacatctctctttttacattttatataaatagaatcataaagcatatattactttttgtatggattcttttgctcaaaatcatatttataatattccttcaatctcttaggtagtgttgtggtttgttcgttttcaatgcagtaatgaattccatttgtggtgtactatgatgtatccatttgaatattgatgaacgtttgggtggttttaaatttttgactatcatgaataatgatgctgtgaccatttgcgttcgtgtacattttgtaattctcttgcacgtataactaaagtggaacggtaaagtcacaggttatatatgtttagctgttgtgcttgccgccatgtagtgtattaaaagagttgtaccaatttactcttccactagaaatataaaatttccttttgcttcacattgttgataataacagtattattaatttttaaatttttgccactttagagaatgtagaggataattttactgtggttttcattatattgccctgattatggaaaagaaaaggttgaacatttattggctattaaaatagaggctttacttatacaggtcttttgcccatttttctattgatttttattttttagtgacttgtagcagttattcttcttcttctttttttttttttttttgagacggagttttgctcttgttgcccaggctagtgtgcaatggcacagtcttggctcactgcaacctccacctcccaggttcaagcaattctcctgtctcagcctcctgattggctgggattacaggcgcctgccaccatgcccagcaaattttttgtatttctagtagagacgaggtttcactatgttggccaggctggtcttgaactcctgacctcaggtgatccacccaccttgacttctcaaagtgctgggattacaggcgtgagtcaccgcgcctggccagctgttctttttatattgtggatataactctttcttcagatatatgtgttgtaaatataatctcttatagtgtggataccttttaaaggcatcttttgatgataaacatttagtgtacacagtagtagcacactgtttaagtactttccctttataatataaaaatgatattatgccatattcaccttttaccatcccaagatcattaagattttacagaagcttcgttgctttgcatatcacacatagatatgttttttattgtgtgaggttagagtcaagttttattatatttttcactttgatattcagttaatccagaaccatttattgaaaggaatgttcttttcccattggtctacagtagcaattttgtcattaatcaattacttatttttgtgtgggtctctttctgggctctttcctctgtttcattaatgtaattttctatctttgtacccctgttacacagtctcagtgatgagttttatggtaattcttgctacctggtagagtaaatccttctactctgttttccttcagtagtgtcttagctattcttgacccttcacattaccatgtaaattttagaatcagtttgacaagtttcacataaaaactttgtcagatttggggatcactgactatccctccatttatgcctgctttcatgtgttttacttaatagtattttattgttgtgagggcttgcacacatttaatagatttattcctatgtatgtgttgctgttctggtacctgttctaaaatttcatttgaaaatgcaaccaatatttgtattttgatttctgtatccacaaaccttgttaaactcacttattaattgtaataattcatctatcttttgagttttccatatctacagtcatatcaactatgaataattatagatttattcatcttgtctattgaaggttagattccccatacatagccctgagacaaacattcaggtgtaaatggtttatatggaagtggatctcaggaaacgttggaatgggagtaaagaagtgaaagaagatagctgatacagggttcactctcaggaaagttaccttgaaagcttaatccaactggggaattaatgaatcaatgtaaaaaattgcatccgagttttcacattaaaggggtaagcaatctaaagtacttattgtaaatgttctgtggacctgcggttgagggatgttcccaggagtgagttaattctctggggtgagcaatttctagcctgctggtaggacagatgaagtgactccaacaatgaaagaaagacttcagcaaagaaatgaaggtgctagtagttggctggtgtacactgaagtgctaaagtcaaggtggtatagatgcagtaccaatagcacctactacattgtccaattcttacagaatttctttctttctcttacattgctgtactggctaaaacccctagtccatattgattaaaagaaatgataaaggtcatccttgcatgctgtctgattgcaaaggaaaagcttcaccataggtttactataaatacctttatcaaattatggaagtttcttctatccatatatatttttaaattatgaatgagtgttaaattatatcaaacatttttatttatctaaagagacaatagtgttacttttctcatttattctgtaaatgggctaaatttcattgattattattattatttttgaaacctggcctcactctgtcacccaggctggggtacagtggtgccatatggctcactgcagcttggaactcctgggctccagtgatcctcctgcctcagcctcctgagcagttaggaccacaggtatgagccactgcacacatcctgatgtttgaatacttaattaatattgcatttctggaataaacccaccttgtttgttttggttattatattaccaaaactttttttaatatttaggtttttgcatttatattcctatatgagattggctggtatttttgttttctttttcttgatttgctcattaaattttcctaggaagtttatcctggtttactgaaatgattgagaagtattttttcttttgctatactcttggagattttgtatattattgaaattatcctttccttaaattattgggagtatttgctgaagacatctggacctacagttgttctatatggaaatatttaaaattatagatttaatttctttaatagttatataaatatttatacttttgatttcttcttgtttcagtttcattacattgtatttttaaagaaatttttttcattttattaaaattttaaaatttattgacaaagcatttaataagaaatttttagtttgtttataataaaaaagacttcttctatgctcctaacattggttatttgtatcttttaacttttttttccttgatcagtgtcaccagggatttattaaatttattggtccttccaaagaaccatatatggcttcgttgaccctcactgttttatggttgttttctatttcattgatttatatatgttatttgcttacttttcgtgttttgattaactttactatatacaaccttctgtcaccctcaggaagaaagtatttctaaaagtcagtctctgcattttggcctgataattatttactatcatgttagcacttcaatattttcgagcaaatgttttaaatttttgtctctagcatttccagttgtacctgtgagaaagtattggcccaatttagctaatccactattacccaagggggaatgtctccactggtttattttttgacttttttttttggacaaagtgccatcttatgtttttatctgaaagcctttccagcagtctttggatagaattgaattctctaattaaaactgcattaatcggtaaaataaaatgttttacagggaatgcagagtagggaaggggaataaaggcctgagacagtaaggctgttacctcctgtaattggcttgcatctgctcttaagctcacctttaggttcaggacctcatctaaagtgtgatgggagctattacatgtgaggaggaataacattctaagtgttcccataccttctatccctttcctttaatgtttcttgcagctcttttttatgtgccagaacaaactgataaacatgagccacccactataaactataaacaagagttgtaaatattggtacctgaaacaaacgtatggcttaaatgtaacaagaaaaacttcagatgcatacttgctgggactagataaaaagacagtggctgaagtgaggacaaaggagtgtaatcttgtggatagcagagggtgggactgaggaaccatgagatacactgtggtaaaaaccattagaactgggaagcttcatgaaagctggatcagtataagtggtgtctttcatcgatgtctggtgagaccaattgctgataacggttagtgtgttgtttgtttcagttgaaatagtctaacctgcattgtatgattctaccttaccctggtgcaatgtatgccttgtgaacagccttccttttttttttttttttttttttttctgttgttgttgttgttggattgggcatttatttctcagcatttccccgacagcagaagagagaggtcttgaatttttcaagggatgttggtgacattaaggtaaagcctcactcctgaccaaattgtgccaccagaactaatttgtagcaattgtgtcgtgataacaacaaagcatatcaccttccctctatatgtataaaatgtatacttaaatgcacactcatatatttgtaactcatagtttttacccttgcagaatttatagtatagttcaggaggaaagacacacacacacacaaacacacaaagacacacacacacacacacacacgcatgtgcgcgggcacacaaagaaaggccattgggttaaatatccatcaatggcacagaagttcaaggcagagagttgtaaagaggtgtttatgcaagatatgagatcatctaggtcttagaggttataaaaagatgaaggacaggagattaatagattaaacaagatcaacatcttgacctataccctatgaacaatggccttttactcgaaatagcatatgtcctttagctttctacagatttgactctcactgctacactatttgaaataggatgaactcatgcatctcagtttagatctttcttctttgatttctctacattctttttttagagttattttaggtctagaatataataaatacttaatttagatgtgagattttgagccagcacaaaggatattgtcttagaataacacattttccatagaacattaacggaataggttgccaagacctaaatacctgtagtcaggtgagttgtcagattgacttctcagtgagtcatttttggttggttgatgaaccatgactgccttctgtaggtggtttatagggctataacttcagatgttctcaattttatcctaggtcaagaaagataagtcaatggtagacatatagacataagtctcttttcttttcttttttttttttaagatggagtctcattctgtctcccagggtggagtgcagtcgtgtgatctcggctcactgcaacctctgcttcctggattcaagtgaccctcatgtctcagcctcgcaagtagctgggattacaggcacaagccaccacaaccacctaatttttgtgtttttagtagagatggggtttcaccatattggccaggctggtcttgaactcctgacttcaagtgatctgcccgtctcggcctcccaaaagttctgggattacaggcatgagccatcgtgcccagatgacataagtctattttcttctcctggctcaaccatacctcttgttccagcaagattattaacaccctcaaggtctttctcgacaagatcactgaggcatttctatcaatccattaaaactacagtggattttgtctttaggatggcaagcttaaagccatagcaaacaataaatttataattctgggggcttcaatcagtagatagtagtagcaagaacctatgtttaggctttctgtgagcaaggaaaacagagaatataatggaggtgattaagtttttgttctataatatactcagtgataataatttggagtgatttttttaaaaaacataaatatctgggataatatcaagtagttttcttaatgaagtttctattattatttcatgtaatctcaataaatatcacaaggtagatatttttagtatcagtataatttttactagtttggaataagtttggttgtttgaaataaaaactccactgaaagtggcctcaataacagagttcaattaacaaaatctctcattataagaagttccaaaaaggtggctcccagactggttaattcagcagttcaactccatcaggtctcatttctcttttttgcagttcttttatctttgttttcatgattcatggttggagaatattggattcaaacatgacctcctcacacaataatattcaatgcaggtaggaagtggggagtgtctggggatggtcttcatatgcttcactctgtatttatcagggaggcatatatttctaagaaatcttcagcagtatttctctttggttttatttggttttgtactttcatcttgctgttgggctgagagactgcctgccagtatttgagtggatttgggcatttccaaccagaataaaaaggcaaggggaattgtgatcaacagtataactgccatatttaccaagactgacagacatactatggtcttttaatattcttgtaggctttattttgaaggtgtcttgtcatggtaatagagaagtagagaggaattgttttgatattaatgacaatataaattacaatattaattgctctcacttatcagcacctaccttctcctaggaactgtgctacttggtattctttgcatagattatttcatttaatcttttccccatgagacagtaaatataattcatctcaacttatagatgagaaaacaaagacttagaaaggtgaaataatttgctcaatatctctcacgtggaaaagaaaaaactgagttcaaacccaggcaatcagtttttagattatgagttcctaatgacttaccattctacttacctgtgaaataattgtgtttctccaggaagtcattggttttctcctctctgaaaggattggagtgttcagaaaaaagttcagggcccacactgactgcttgaagacttgtgtttccataagctgtggctgaatctatctctcagggtcagatcctggcagagagaacagaaatgaccatgtgcaaatcaattgctgagatatgaagggctcctgaaagtctgtaagattgtcaaagaaataaatcttgcctcttttgttcagaatagtattcccagtcctagcataccacctgctaggcttctaaacaatatttatttatttattgtttttactagctattattgcttctctgacatctcactgcatgaaatgatagatgcaagcatttgatttaaagcttttcttttttactatattttaaaaatactaacaatttaaaacaattctctgaaacacaataaataagccatttttagatataaattcattagatccttctatctcttttctttaggatatttaattgagacttaagacttaatcaggataacaagaaaggtagttatggaatagaagtagaggggaagtatgaggatgtttagaggttgaatattacccaacagggatgagtgtggataaagcactaaacaaggtggcttagtaacattgaagccttggattgttgggatatgtgtcaccaagagaggagagaagaccactgttattttgatcagtgttatttctacctgaactatgaaactaccaaaacttactgagatgtaatagaaagaatctcagatagaaagttaaagacccttaattttagacctgattctatcagaaacttcttcagtgacttttatacatttctccactgaaatggaattaaaagtttttttctgggatacaagaagcaaaactgatattctgtgattctgagagaatggcctaatttacccattctaactaatcagacgtggcaaatgtgtgactaacacacaggtcaacactcctagccctactcctattgtgagcatcactaatcaagtgctgcattatttcctgcttaattgggatttagcctcagaaatcaacacagaacatcaagaggcctctgcttttcaatctaagctggccacatagagcaaaaataaaaaaaaaaaaactcactttttggccgggcgcagtggctcacgcctgtaatcccagcacttcgggaggtcaaggtggtggatcacctaaggtcaggagctcaagaccagcctggccaacatggtgaaaccccatctctactaaaaatacaaaaaatcacctgggtgtcgtggtgggtgcctgtacttccagctactcgggaggctgaggtaggagaactccttgaacccaggaggtggaggttgcagtgagctgagatcgtaccattgcactccagcctgggcaacaagagggaaactctgtctaaaaaaaaaaaaaagaagaagaagaagaagaagaaaactcactgctatattacttttgtaggtaataaatttattttaatgctgatatcacttatttaaaataatttatttttttctttagaaatagaatctcgctatttttcctgggctggtattaaactcctggcctcaagcaatcctcctgactcagcctcccaaagtactgagtgtataggtgtgagccatcacgcctggccctctttaaaatatttttgttgttattttaattttcttttgctgctgtaagaaattaccacaatttttgtggatggaaacaaaacaaatttattactctacagttctaaggtcagaagtcaaaaatgtaggtatcagcaggcagggctgtgttccttctggaggctctagaggcaaatctatttctttgagttttccagcttctaaagatcacctctgctctttggtagtggatccttctttcattttcagagcgagcagtgtagtatcttcaaatccctgtgacttctgctttcatatcttattttctgactctgcctctccgttatgaggactcttgtaattacacttggcctgctaagataatgcagaataatcagcccctcccaaaactcttaatcacatctacgaagtcctctttttcatatcaggttctgaggattagaacaggagctttttgttctgttttgttttgaggcagagtcttgctctcttgcccagcctggagttcagtggtgtgatctcaggtcactgcaacatttgccacccgggttcaagttattctcatgtctcagcctcctgagcagctgggattacaggtgaccacccccacacctggctaatttttgtatttttagtagagattgagttttcccatgttggccaggatggtctcgaacacttgacctcaagtgatttgcctaccttggactcccacaatgctgggattacaggcctaagccactgtgcccggcctgaacagggacgtctttcagagggcattcttctgcctaccacagtgattaaagtctttccagaggccctcttttatatgttatttactgcctctagcatattgtgttaaatattctcaattatagaaatctatgtcatgtaacaaaatatctttcagaatcaagtttgatcatcaaactaggcaaaactattttaggtcgaaaatgagatttacctacaaagtaatgagacattttcttttggagctatgagtctggttctgaaaacatttcctaagggggttacccagcaatataagaaagagcactgctgttaaaataagtgtaaatgtcccaaactgagtgtttcaaaaggcatagtcatgcagatggtatattatagcaccaaggagaatgactgagtttagagaggttgaactgctcttccctgtaacatcagcacctatcacagtgcctcactcatacataacaccaaatggttgaattagtaaaataatggtatagacacccaatacacgtggaagtgagttgacagttctaaaaccttataaaaatgggaaacatctttatgagcatccccaaatattaaggatgaccatgatattaatattcaagcagataaaatctatttaaaacatttcctaactatcttgtctccttaaaggtgttgcaatttaaatgaagagagaataacagggattggctcacttctattgtctgcttttctgtcttaatcagatttcacagtaaaaaaaacatagcatcctttaaaggaggaaaaataagtgcagtccttggtgattttaatcacttcttagctgctttcctgagaaagccccatctgcccttctagtccatctgctggttgttaacacttagtcagtcacttgacaaatccaaaatctgaactgagaggggggagggggatgtgagatcatggtttctgatgattacatgttgtgattgacacacacacacacaaatcaagatgcctttgttcaggctcagcttgagcaggacctggagccaattttgcccaggaatgtaatgtcagtgtggctaagggaagatgtaccatggcaaatgttcatggttttgctggacattcctttgttcaagagttaatttttcttgtcatgaaggctggtgatcaaattatttgatcatttaatcaccagtacaataaaaaaagagatgaaatttgatccagtttcttgatagaaaacgtggctgttggactccttagactgatttatttaacaccaatatctgtcaacattcagaacagattcttgaacagatggcttgaatgtacttagaaaaggaaaggctgtagactcttctatttgaaaaggggcatagtaactatccaggtgggtcttactctacagccaggaaaaccaaagtttagcaaagttaagggagctaccacgggccatttctaatgcttatcaaacactatttacacagtagccttttgtctggtggagtagagcacattcttccatataacccttgaaccttcttcttgcagtccacatttctgagctgtggaaactccacatgggacctccagctgatgtcccacttcacctgacatattttcactttagcttgaagcttttagcaatgagatagctgtcaatttcagcttgaacaaaatcagtttatgtgatcatctctttggggcaatacattttattggataagttcaagatgcaaacacctgactaaatagtaacttgtgtggaaaatacttgtggacatttctttaatttgagccaaaattataagtgatattaaaatatcacattatataatatgataacataaacttagagtttattactagcaatataatgccatgattaagaaaactagctattccactcaaatatgcattggtggtatgacatttagagtattgtgctttgatctgatgatcacattcaagagaaactttgataaaattcttagagtccagaagaaggtcaaatgaatgatcaggttggctaaaaaccatgttatatgaagaacaatacatagaatgagaaatgtttgactaggaacaaaaacatgtgaagagaaagacatggtatctgccttcaagtaaatgcagtactatcagttaaaataagttggagttggtttgtgtcacttcagagaacataactaagacttggttggaaggtgctgcaaagcagattttgtcttagtacaaataagaaagaatttcttgaaaagtaaatctgccaacagcataatgtttaactgcctcaaataaaggccagaatgcctggcatgagtagagatgtcttttgaggaaggagtttctttaagtttcacccaatttagatgctaagataaggaatttccgaggatctactatgtaaaatgcactgttagattgtatggagtttcaaaaagaagtatacaacaaagtttcttttttaagatgcttatactctagtatgagaattaaaatatgaaaacatgagcatctaccgtagccttctggagaatatgtgttatctaattaagagaatgggataatcacaatagacagggaaagtcagaaaagaattcatgggagaggccttaaaaaaaaaaaaaaagaatggtaatagaaagagtgatgggaattgtgaggcagataagttgtgaaagtgtgactatatatgctgtgatcagagaaacttagtccaggttattgggttgttttgggagagttgagaccataacaatagagagatgattgtgaatagatttcagtataacttgaaaggcatatttaggaatttaaacttttatttttatgcagttggtaaccattttgtgcctttgcatggataggaaatggtaggatgaaaatggtattgaaagaaaaagacctggatgtgcttgaataaggagaagctgaaagcagcaagcacaatgaaacaggctgcatccttggagaaacacagacagcattctcggaatggtaaatatgctgtgggttgcttcaaccacttcaggcatcaacaattgccttgacactcatttagcaacttgtctatgtcaaataatgagagttacctctttggagcctttagcaacctagcaactacagagccataacaatgttgtttatcatctccttgtccagcctaatgatgcatgattctgttgcttcttagagtgaattggaaaaaaaaaaagtctgttggaacacacaggaattttacatttttcaaaatagacaaggctattagcctcctaagtctgagaactcattttcatttctaattagtttctagaatcgtcagagaacacacgtcttgccactttactatattctggggctgagtaaatgtaacaggggcatggaaaaaactctctttctgctcatcataatttctgagcataggtaaataagtaggatctttacattgatattagctgtggagatataaatgtcagtaacagtcacatagtattccagctcggtcaaatcatactgtaaccatcatataaatctttcttgcttcagaaatggttttctacttgtttaatttcatattaaatttccaagattcctctgctttgcaaaatcctttctcgttttatcttcacaataattccctaatgaattcagatagaaacagcaaaagaaaattggattttgaatcaggaatccagaattttagtcttctctctgctgcaaacttgctataatgccttggtatagtcatctaagttttcttcttcagttttctctctttttacattaaaaacagtggcattcctttttttacataaaagtatacaaaaactttttacattaaaaatttcaatatgcaaacacctgaataaataataatttggaaaatacttgtaaatatttctttaatgagagccaaaattataatgcccaagcaaacaaataatgctgctttatctatttcaaataaaaaaccccacataagcaaattctgttgctctacctatttcaaatgtggttgtgagcatccaaagagacagaaaaagataagagagcattttgataaatattacacctgtgcttatgactgtcattattttcagaattaacaccagtgtaggaggagagattataagtatgagaaggaattgtgaaggttatcctgaactctgttttattcctcacctactgcactgaaaatagctaagcaagtcattgaagttcttggaaacttcacattttaaaatcaaagataacagagtggaagaaatagacctatgcacatgtataaattgagaggggacataaaactgggatgaactcatcaaaggaaatattttaattatatttcttttattaaaatcacaaagcccaagctgtatgagttatattaaaacatgaaaaaaagaataaaaaaaaaagaaaagcagataaataaattaaataaagaaagataaaaaaccaaacaggcctatgaggatttatctggtgaccaggagcattgccagcagctagtgtagagtatttgagcatgtaaatctcataactatgccccttttatgtatatagagggatccaatttgaagaaagatacttgcatcagttttctatgctgtatcacatattaccacaaaattagtggcttaaaatcgtacatatttattatgttgcaatgtgtgtgaggcaggagtctggacatagctgagtcttctaattagggtcttcaataccagctgggctgtgttcttatcaggaggtttgactgaagaagaatctgctttcaaattcacttagtacatttacagaatccatttccttgaggctgtgtgactgagagcctggctccttattggctgttggctaccttcaggtcttaaagcttttggctgttcactgccacatgattctctccatatgcagttaacggcatggttgtttgcatttcagggtcagcaggagaatgtctctctccagtttgttaggacattcttacacagcataaataaataaatcatgggggcaagatcctaccacatttgccatatttactgggtagaagcaagtcacaggtcctacttgcatttaaagaggggttatacaggtacctgcaccagaggatggagagcatgaaagcatcttagaattttgcttaccatggcactaagccaaacctaagtagctttgattcccattgaaataagttttaatttctttaaaattgcatttatggtttatatattatatattatattataaatggcataaaaatcctgatcacattggagtacacactgccagtccaaaatttgtcatagtgaagtatttccaggttttcgcacctctaatggtcaagatattatacagctacaaaataccaaaatgagagagagacagagagagagagagagagagagagagagactacataaggggtaaaaaatgctgttaagaacaactctgtttgccaaagtttcccactgaagttgcccacttcagctttctaacttgatctcctctctcttcaagaatacaactttctttcctcaataactttcaagccaatttaatatagctgtgtcaagctgtatacaacaaagttgctgatttaagagaattaatcctctaatttggagaattaagagcttcttaactatctcaatatgaatttgtttttattaagttaggttcatttcgtaactctgccactgatatatacatgagcaatacctacctctcttatccctcaaaactccaaacagtctttacttatattaaccccaattaaaatctgagtagtgcaatttcaggaaaatatgaaggaaagttaaagatgggctaaccaggtcagcaaaaagggagacaaagattcatcaggcagggctcttcttgacccatgtggttccccaagtcactctctcactctgtcctgctcagctggagtcaggtactatttttttaaaaacttatttattccgtaagaattaatttccagtacaggtaaaattatactaggctgtgtaataagaaaaaaggaaattctctttccttttcaataagtttttctaagagtgttcagaggaaaaaaagtgaatttctgtctaaaaaattttccacttttataattccagaaaatttatttattaattatataattaatttagaaatacagctatatttataatttaaaattatattgatattttcctttcatagattgggtgaagataaacctgaaatatgatacattataatatttttagactcctcagccccatttttttttacatgacctgctagcaatattaacacctgattaaccaccttccaggaagtattctgcgtagtccaagttaatttagttgtaatatttgtttaattacagcacttaaattttatagttggttatgcaaaatgcatgcttgtttgattttaattcaaaaggaaagagaatatttatcatgtaattgacttctcttgtagtcattgtgattttacaacaaggaaactgtgatgcaattttccagaaggctcagtggcttaactagaaattctctcccatattgcttcttagaataactgaaataaggactgtagaaacataaattaccaattgtaatagaatgcaattagttatgtaatagagttatatgaagaagacaatggtagtgtagaggaagaatcagctccctctgcctgggggaaatagaaaggcttttttgagaaggccaggttgtccttgtaaattttcttggaggatactaccaaggcacaggcacgtggatgtggcagaatcaggcatattccatgagtaggaaatggttctgtgtggaggtagaaattgtaggggcaaagtgaggacctcccttttgccctctgaaggtttgccaaaaaatcaactgacaaaaggcagattaatcgaagaaaaggcatacaaatttatcaacgtgcacatggtggagaaacacagagtgattatcccaaactctcactggggttcagagcttatacaccatcttgaggttacagaaagactgggggcttggatcatggtaaaacaggttttgatggcaagacaggttatagggagggaagaagaaggggtctggctagcaaaggcagtcttgttatgtagatgcaacttcacagaaagcagccctcagagagaagacatggtaaatgtttctttcaaacctttaaaggtgtcagactctcagttaatctttcttagatctggacaagggaaggcctcagagaaaacctggctgcattaatgcaaattttctcatcagtgcaaatcttccccacaaaagtagctttgcagggctaattctgttttgtaggccctctgaacaaccacctcaaaataggtcagataagaatattctgaggtgaaatatttttatttccttcaaaaccaagggaggtagggaacttgccaggtttgatacaggttgagtccagcttgtggaaatcttgagtatcgtagtaccatgagtttgttttttagctgaaagagaaggatgccttgaggaacaaatggaggaatcaataggataaggttaattgaagaacaaaatgtttgaagaggtgttatagagtcctggttgtaagaatggaggaggtgaggcatgaaggaaacaagaatgaatagataaagatgaattttgagctggaaaggtgagagctagaataagattataatttggaaatttgtttatgtgctctatagtagccccttattaaaatgcagatcctttttaggtgtaacagagagctctttttgattaatatgttagtagggaattcacttagccactgagggtgaggccctttgagaataggggatggaacagtaactggccatcatcagggatgatagagaatgggagccaaggatgtggcatggggatgagagagggacctgggcctaaaatctggaggtctggaaaagccaaacgaaatctcttaaaaatgctttcaagggctggttctgttagattggtgcaaaagtaactgcagcttttgcccttactttcaaatgcaaaaatcacaattacttttgcaccaaactattagttcttaagatatagcattgcttatgataccaagggcttagacatctctagactagtgtgtgggtccttgtctgctcctctgaagcatcaatggcccattaagccctgctgaaccataggacgacagtcaagatgtttgggtactgagagagttcaacttgtctggtgatatgagaaaataatttttttctgaggattgtcagtccttttaagtcaccagaccaagagaggatttaaaatgaggtagcaatcatgtcctactcccttgcttttaagctgtagaatcatctctggaaactgcttgctattgccacaagtggttataaatttaaatttttaaaatttgtattttaatagtttttgggaaacaggtggttttttggttacatggataagttctttagtggtgatttctaagattttggtacccccatcatctgagcagtttacactgtacctaatgtgtagtctttaggctgtcacctctctcccacccctgagttcccaaagttcattatatcgtttttatgcctttgtgttctcatagcttagcttccacttataagtgagaatatatgatatttggttttccattcctgaattacttcactcagaataatggtctccaactccatccaggttgctgcaaatgccatcatttcattctttttatggctgattagtgttccatggtgttatacatatataccacattttctttatccacaagtggttataaattaacctaataaggccacattagacattctaactcacaccctatagcttaacaatgtatagtcaatcagtagtttatgttatattaatgtgaattattggtaaacaacttaggaactgcctcttctttccctttaaaagtccacttgtaattgttactaattgcagtgtatattcagggaaacttgaatctatatatccacattgcaatcctcaagctaggcccaaataaactctctacttacattagttttgcctcgacttcttccttttagatctgcaccagcttgccttaactgtgatttccactgatactgggcctttgcagggttatactgtgattgggaaagctgttatacacatattttgggggttttaatacagcttgcgtcatgacagaactatgagcaaacgggacttaaatgactccaaatgccctctacatcatattgtgaattcctgggatttcataaaaaaatagaaaaatactcatcaactaaactctaggtgttgcttggtgttgagggaggagggtacaagttagtaccaatagagtaagtgtgattaattttcaagtgctctacttttgccagaaggtctgacttggtattctagttttgtcagttgctgctttctaattttttttttgaagtagtgagaactgaataagatattgtttctgaaaaacctttgtaaacatcaaagagttgtacatgcataatactgcttttgtttgagacactcaaatatcacgtgccacatataacacatgtgtgtgagaaattgtcagtctcagacttaaatacaaacaattcatattccacatattccatattttaaaaatcaaggttatttttattataaaagtaatgcctgcttattatagagtttaccacataaaaagtagagaaaaaagttgattgtctatcactcaaagctagcacatttgaatgtttttcttgagagatttcctgtgaaaatgtgtagtttgttttatgtagttgtaattatactttataagttttgagtcctgactttttcatttgacagtgtaatataaggatattctcatgttattttaaccttaaggaaatattatttttagtgatttcataaatttcaaccattggatatgtcatagtttgctcatgagtcttataagaaatttaacagtctgtgatttttgccattataattcgctcctatggtagcatatcttaagttattcttatgttaggttatatctgactttacaagtacaaaactccagaatgaggtgggtaactatgggaagggtaaaaaaaatgaggctaaatacaaatactttcgttcttgttgtcttgacaacagaagagaagactttcttttattaaatggaattatcgagatcaaaggtggacaaactaggcctgtaaagaggcagatagtaaacattttaggctttgtaggccatgtaacccatttctcaattacttacctttgcttatagtgtggaagcaaacaatatgtaaatgaacgagtgtgactgtgatccaatacaattttatttacaaaaatacagattgggctgaatttggtccctgggcagtggtgtgctgacccctgcttgaaattatgatttcaattatgtacattttgagtgtgctatatactttaaaatgtgaatttcaagctgaaaaatgtattgtttaaagcataactagagtaaggtccttggagtgatggggcttgtcaggtattctccctagaggagtgcacattcaggtagggacagtcttcacatatttattccatgtaacaaatacgtagctctttgtatatgccaggtacagttctcggtgcttgtattagtctgtttttgcactgctccaaagaaatacctaggactgagtaatttataaggaaaagaggcttaattggctcatgttttcgcaggctgtacaggaagcatggcagcatcagctcggcttctggggaggcctcaggaaacttataatcatgagggaagaaggaaaagcgggagtcagtacttcacatggcaagagcagaaagaacagaaagaggggcaggcactacacacatacttttaaacaaccagatcttgtgagaagtctaccatgagaacagcatgaggggaatgatgttaaaacatgagaaactgctcccatgatccaagcacctcccaccagaccccacttccagcactgtggattacatttcaacaagagatttgggtagggacacagatccaaatcatatcagtactttaagtatatttattcaatgaagcttgcgtaacactgctgaatttggttagtatcaggttacttatttactctttttgattccttgaagatctttcctcctctgcttcaatactccagtgaatttgagttctgattatccaaacttactattaggaaagaaccacatatgtcatttacactagatgttgtggtaatgaacatcaggaaatagtatctcttggcatgctttctcactaatgagatttgaaacaatctctctttgtccctaattctaatttacaaaatggggactgtggttagacggatggtttttacagctcactgtagatcagaattgaaaaagcatttaaaaatatctctatttaaaaaaatctcttactaagtgattactaagtgcttggtaagcttagtgcttactatgcttgttagattcttatgaagccagcccagtggtcctcaatcttgctgtacattacactcacctgagaagttttacagacactgatacttcagtcaaacccttagagattctaatttcattggtctaagatatagtctgggcatcaggatttttataaagttacacatgattctattgtgcggctgctgaactagtctgaacttaatcatctgatttgtgtttgcgaatgggtttggaagaatttcaacatattttcttttccccattatgaagagtccaggactttatattattaacccaatataatataaaagaatatggtacttgggttattataaccatgtttatccaaggttatgttcaagttactgtttctttggagtataccaaacttatctaaatgattttgagagtgctgtattactgctcaaggccttaataaattgtttgtagaatatttgaagtgtaacacaaactataatttaagtcaagatgtcctcatggaaatcaaaatgtacatgtagcatgttgaataactgtatttttagatcacttcaagtaaagtcctgagaccatgttgaagagcagagtctgttgctagttgtttaaaattaaattcaattagaagacctggatttcgcattggaggctggaagattcaatgatcaatccatcaaaaaactaatttatatcttacattgatgtataaaaggtaccatactcttggctttggaggataccaaactgaggaaaatataatctctgattttgagtaatttgtaatcttaataataaaacttaaacagagaacaggataataactgccaatttgtaactgctatatgaattcagaacagcaaagctggtaggtggacaaagggtaattagagtggctttcaaagtgagacctgtaggctacttgcataagaatactttatacatggtagcatgaatatatattcatggattcctggcattctcatccaggactactcaattagtctctgggacagggaatgaaaatctgccctttaaacagattcttcaagtatttattatatatactcagcttgagtacaatagatatagtgggtacaatatgagccaggccttaaaagatggtttggagctatgtaattattatagcagttaacatttgttaaatcctagacactttctaatattatacatgtattatgtcatttaatccccataaaaatgttaggcactttattttttattatagactcagagggtacatatgcggattttgcaggtttgttacctgggtgtaatgtgtgatgctggggtttgggtttctggtgaacccatcacccaaatagtgaacacagtatgcaatagatagatagtttttcaaccctcactccactctctccctccctacttttggaatctccagtacttattcccatctttatgtccatatgtatccattgtttagctcccacttataaatgagaacatgcagtatttgatcttctgtatctaagttatttaacttaggataatggcctccaactccatccatgtagctgcaaaagatacgatttccttcatttttatggatgtgtagtattccatggtgtatatataccacatattctttgcctaattcactgctgatgggcacctaggttgataccatgtctctgctgttgtgaatagttctacaataaacatatgagtgcaggagtctttttgatgacaatcatttcttttcctttaggtagatacccagtagtgggattgctgggttgaatagttgttctattctaagttctttgagaaacctccatgctgttttccatagggattgaactataaatagtttacattcccatccacagtgtataagtgtttctttttacatgcatcctcgccaacatctgttgtgttttttactttttgctagtagccattctgactggtgtgaggtggtatctcactgtggttttaatttccatttctctgatgattagtaattatgagccctttttcatatgtttgttggtgtttgtaagtcttcttttgagaagtgtctgttcacatcttttgcccactttttagtggggttatttggtttttgcttatttatttgtttaaatttcttagagattctgtatgagtcctttgtcagatgcatagtttgtgaacattttcttccattatataggttgtctctttattgattgtttcttttgttgcataccagctctttaattaaatcctatttgtctattttggtttttcttgcatttgcttttgaggccttagtcacaaattatttgcgtaggccaatgtccagaagagtttttcctagattttcttctagaatttttatagtttgaggccttacttttaagtctttaatccatcttgagtcaatttttgtatatggttagaggtagataggggctcagtttcattcttaggcatatggccagccagttttcccagcaacatttattgaataaggtgtcttttccccttggtctattcgtgtagacattgttgaagaccagttggttttagatgcatggctttgtttctcagttctctattctgttccattgatctgtatgtccatttttgtaccagtactatgctgttttggttactatagccttgcagtgtagtttgaagttgagcaatatgatgtctttggctgtattctttttgtttaagattgctgtattagtccattctcatattgctataaagaaataccagagactggataatttacaaagaacagaggtttaattgactcagagttctacatggctggggaggcctcaggaaagttataatcatggtggaaggtgcctcttcacagggcagcagaagagaggatgagtaccaacaggggaaatgcagaacacttataaaaccatcagatctggtgagaactcattcactatcacaagaacagcatgggggaaactgcccccatgatttaattacctcccactgggtccttcccacaacatgtggggattatgggcattataattcaagatgagatttgggtgtggacacagccaaaccatattaattgctttggctattcaggttctcttttggtgccatatgaattttagaatagcgttttctaattgtgtgaaaaatgacattgctaatttgataggaattgcatgaatcttagattgctttgggcagtatagtcattttaatgacattgattctttctatctataagcataggatatttttttcttttgtttgtatcatttacaatttctgtcatcaatgttttgtagttcttcttatagaagtctttcatatccttggttagatatattcctaagtatttttttgggaggggattgagttcttgatttggttctcagctgtagttgttggtgtataaaaatgcaacttgttttttgcactgattttgtatcttgaaacttcattaaagccatttatcagggtaggtgtcttttgtgagaatctttaggattttctaggcataggatcatgtcatcagtgagcaaagatcatttgacttcctcttttcctttctggaaggatttatttctttcttttgcctgatttctctggctaggacttccagtactatgtttcataggagtggtgagagtggacatcccttgtcttgttccatttcttagggggaatgctttcaacttttcccctttcaatatgatattggctgtgagtttgtcataaatagctcttattattttgagatacgttccatcaatacctagtttattgagagtttttagcatgaagtgctattgaattttgatgaaggctttttctctatctattgagttaatcatgtgttttttgtcattggttctgtttatgtgatggattgtgtttattgatttgcatatgttgaaccagccttgcatcctaggcatgaagccaactcgatcgtggtggataagctttttgatgtgctgctggattcggtttgccagtattttattgaggattttcgcatcaacgtttgtcagggatattggtctaaaattctctttttttgtgtgtctctgccaggctttggtatcaggatgatgctggcctcataaaatgagttagggaagattccttctttttctattgattggaatagtttcagaaggaatggtaccagctcttccttgtacctctggtagaattcggctgtgaatccatctggtcctggaatttatttggttggtaagctattaattattgcctcaatttcagagcctgttattggtctattcagagattcaacttcttcctggtttagtcttgggagggtgtatgtgtcgaggaatttatccatttcttctagattttctagtttatttgcatagaggtgtttatagtattctctgatggtagtttgtatttctgtgggatcggtggtgatatcccctttatcattttttattacgtctatttgattcttctctcttttcttctttattagttttgctaatggtctatcaattttgttgatcctttcaaaaaaaccagctgctggattcattgagtttttaaaggggtttttatgtctctatctccttcagttctgctctgattttagttatttcttgccttctgctagcttttgaatttgtttgctcttgcctctctggttcttttaattgtgatcttagggtgtcgattttagatcttccctgctttctcttgtgggcatttaggctgtaaatttccttctacacactgctttaaacatgtcccagagattctggtacagtgtgtctttgttctcattggtttcaaagaacatctttattttggctttcatttcattatttacccagcagtcattcaggagcaggttgttcagtttccatgtagttgtacagttttgaatgagttctattttgattgcactgtggtctgaaagacaatttgttgtgatttctgttcttttatatttgctgaggggtgctttacttccaagtatgtggtcaattttagaataagtgcaatgtagtgctaagaagaatgtatattctgttcatgtggggtggaaagttctgtagatgactatcagtctgcttggtgcagagctgagttcaattcctgggtatccttgttaaccttctgccttgttgatctgtctaatattgacagtagggtattaaaaatctcccattatcattgtgtgggagtctaagtctctttgtaggtctctaaggactttctttaggaatctgggtgctcatgtattaggtgcatatatatttgggatagttaactcttcttgttgaattgatcccttgtctttcttgatctttgttggtttaaagtctgttttatcagagactaggattgcaacccctgcttttttttgcttcccatttgcttggtagatcttcctccatccctttattttgagcctatgtgtgtctctgcatatgagatgagtctcctgaatacagcacaatgatgggtcttgacactttatccaatttgccagtctgtgtcttttaattagggcatttagcccatttacatttaaggttaatattgttatgtgtgaatttgatcctgtcattatgatgctagctagttattttgcccattaattgatgcagtttcttcatatcattgatggtctttacagtttgggatgtttttgcagtggctggtaccagttgtttctttccatgtttagtgcttccttcaggatctcttgtaaggcaggcccggtggtgacaaaatctcttggcatttgcttgtctgtaaaggattttatttcttcttcatttataaagcttggtttggctggatatgaaattctgcattgaaaattcttttctttaagaatgttgaatattggtccccactctcttctggattgtaggatttctgtcaacagatccgctgttagtctgatgggcttccctttgtgggtaacctgacctttctctctggctgcccttaacattttttctttcatttcaaccttggtgaatctgacaattatgtgtcttgggattgctcttctcaaggagtatctttgtggtgttttctgtatttcctgaatttgaatgttggcctgccttgctaggttggggaagttctcctggatgatatcttgcagagtgttttccaatttggttccattctccccatcactttcaggtacactaatcaaatgtagatttggtcttttcacatagtctcatatttattggaggctttgtttgtttgtttttactcttttttctctaaacttgtcttctcactttatttcattaatttgatcttcaatcactgataccctttcttccacttgattgattcagctactgaagcttgtgcatgcatcacgaaggtctcgtgtcatggttttcagctccttcaggtcatttaaggtcttctctacactgtttattctagttagccattcgtctaaccttttttcaaggtttttagcttccttgtgatgggtgagaatatgctcctttagctcggaggagtttgttattcccgaccttctgaagcctacttctgtcaactcgtcaaagtcattctccatcctttgctggtgaggagctgcaatcctttggaggagaagaggcgctctagtttttagaattttcagcttttctgctctggtttttccccatctttgtggttttatctacctttggtgtttgatgtcagtgacctacagatggggttttggtgtagatatcctgatgctattcctttccatttgttagttttccttctaacagtcaggtccctcagctgcaggtctgttggagtttgctggaggtccattccagaccctgtttgtgtgggtatcaccagctgaggctgcagaacagccaatattgtagaacagcaaacattgctgcctgatccttcctctggaagcttcatcccagagcatcacctgcctgtgtgaggtgtctactggcccctacttggaggtgtctcccagttaggctatacaggggtcagggacccactttaggaggcagtctgtccgttctcagagctcaaacgctgtgctaggagaaccactactctcttcagagctgtcagacatggacttttaagtctgcagaagttgcttgttgccttttgttcagctatatcctgcccacagaggtggagtctaaagaggcagtaggccttgctgagctgcagtgggctcagcccagtttgagcttcctggccctttgtctacctactcaagcctcagcaatggtggacgcccctcccccagccaggctgccacctcgcagttcaatctcagactgctgcgctagcagtgagcaaggctctgtgggtgtgggacccaccgagccaggcatgggagagaatttccttgtctgccagttgctaagaccttgggaaaagcacggtatttgggcagacgtgacccgtttttccaggtacagtctgttacagcttcccttggctaggaaagggaaatcccctgaccccttatgcttcccaggtgaggtgacatcctgccctgctttggcttgtcctctgtgggctgcacccactgtccaaccagtcccattgagatgaaccaggtacctcagttggaaatgcagaaatcacccgtcttctgcattgatcacgctgggagctgcagaccggagctgttcctattcagccatcttggaacccaacttgaggatgatgttcttgaggaatgcattcaagccttcctccactgctatttgtaatatgctgacacatgcttctccccagagctattctatgtgcatgtagtttctctgtaggtcctggtatacttgcttcagtcatgttgtgagttggagtccatctgtcttgcttcatgcacaagcatgggtacccatgggtgggatggcctttgggctctaggtttgggtcttcatttcaataagtgtaacttctactcatgcatcatggtctgacaaatgaaggtgagcagtaagctcaggatatgataattgagtccattttttaaaaagttgaatgtgataagtatacagaaaatgtcataaccttctgagtgtaggctacgctggcttctcttatcagatgcactgttttggaaacataaatcccaggctcgcagctgaactaacaataccaaaaaagacttttgatctctgccactttacacgtccacagttgttaataaaacttctctacctctttcagcttcacttataaaaatggacattgtgaactatttgaactctaaaatttctgttttgcatgtttaatattctaaaacaaagaggttggaatctgcacagttacctggtaaaattagaataaatctctatccaacaacttcatcactatggtgatcatataccctgatttgccaaggcggttctgatggatgtctcttgtgctggtatggttattagcactgtaacagtaaaggggtatagtaacccctttactctccaagaggtcttcagtttaaatgataatttacatggtcatcctatagataacacctattgtccctagtcagactctttgtattcctcatgaatgttttctaaataagggcaagttttggattcactgctgtgtcctgtgtcctattaggttcccttttccttctggccctgacaggtgataaataaataaaacaaatggcctcttgggagctgttgtcaactttgctcctatccagccccaatttggggtgttttttgttcctgttcccatcactcaggccttgaaggctgatagatttctgatttcttccttgaaacatgacatgatgaataaggctgcatgctttactgcacagtccaagaaagagaactataaaaagtgattgtcctatacaatgggaaattatttaacagggttggccttttgcatggggaaaagtaggggcatgatttcagagctcagaaaaatgttcttctccaacaacagctctggggaatgaacagtcttaaaattttcttgaactaatgtcaaaacatttatctgcaatgagagaactggtttaaattgtatacaattttgggagagtaaatttcatgacattcaaactgttattttacccccagcaacctgggtcccataaagagaaatagagtgttcatatctcaggaagtgagatgccagttcttctgtgctctgcatttgtttggcacacaatatctaaagtagtgtgatcaattttaggtgtctcattatctacaaatactaaaaatgtccagcaccattttttttttttactttttacaatatcatccctgtgtctaggtgtgtttatttttgttttctaatttttattaatcagattgcttttctgtcatcacctgatgtatatcagcataatgaggaccaggaagttggagttctggagaggcagtgtgggagatcagagaaaggacaaggatattagtttgaaacttgaaaccttcaaagagagttgccttagttaaaatgctctagtgatataattgagtggcctggggacaacaagagctactgcccagaatttcttactgcctcatctgtgctttagtgtctgtccactttcctctctattgccgctacctcagtgataaatttattgagcattttacatgtaataacttatttaattctcataaaaaccctgggagggaaattctattaatattgctattttataaattgtgaacttgaagcttggacaggtgaagcaacttgcccaagatctatgttacagcttgtatgcaggagagtcaggattccagctcacacatacattccaagcccacactcattttgttttgttttgtcttttgttattttattttttcttttacctttttatttttacctaatttcagacttaaaaagaagttgcaagaaaaaaatcctgtatactcttttcacccagatttcccaaatgttaacatatcaccatatttgctttatcaattttgttctctctctattttgtagttgtgagatacctctttgcccctaaatacttcagtgtattttctaagaataaggttttcacttacataactatcatataattaaaatcacggtattaatattgttgcaatagctaatctaatccacagactttattgagatttatatattcaataattctctttatagtccaagaaaatcctgcatcacacatcacatttaatactcatgttttcttagtctcttttaatttggaacagttccacagtctttttaattacatgatattaacttaaaaactactggccagttattttgtagaaagttccttattttggatttgtttgctgtatcctcaggctatgcattttggccgagaataccagagaagtgaccttgtattcttcccagtgcatcacactgggaggcatgtgatttggctctgtccaattactgctaatgttagcttcggtcactcagtcaaagtggtatcttctaagtgattccgttgtaaaaagttacattttttttccctttatgattaagacgtatcttgtcaggagatacttcgagactatataaatgtccagctactaaaaaaagtttcacccactacatttagcatccactggtgattcttacctaagtcaattattattatagtggttgtcaagaattactttattaattccaatattggttctacatctagttagtcattctactataaagaagaactttcctcccttccctccttctggcctttcttccttccattttttctttccttcccttcttcctttctttcttctgtccagaatctacaaacctaacactcaaatataggtttggaatacattatccaccaggaagaactgtcccttccttccttcctaccttccttccttccttccttcctctttcttccctccatccctccctcccttcatcttttgttctatcattatttcttcatattaataatagactcacaggccaggtgcggtggctcacgcctgtaatcccagcactttaggaggcagaggtgggtagatcacaaggtaaggagctcaagaccagcctgaccaacatggtgaaatcccgtctctactaaaattacaaaaattagctgggtgtgatggcatggaactgtaatcccagctactcaggaggtggaggcaggagaatcgcttgtacccaggaagcagaggttgcagtgagctgagaccatgccactgaactatagcctgggcgacagcatgagactccatctcaaaaaaaaaaaaaaaaaaaaaagactcataaaacattatttaaaggattataatccattgctattgttttaaagaaatcgatgctcacttgtcctagatttggacagagggtacccatttaagctaatgcctacatatgaggtgtttgtcaatactccatcattcttcaagcacattcttactttgaaggtgttctaggcttgtcttgtatttctccagccttggaatcaatagttcttgttctttttggtggataatgcattccaaacctacatttgagcataggtttgtagagtctggactcctaacccctgtgatcattgtgtctcctaagttctcgtttcttctctggactctgtgacagcacgctgatgatgtccctgaagccatcttgatccactccagtttgttttccacactgtagcatgatgttcttttcaaaatgcctccatgatcttgtaaactttctgcttacaagacctcttcatgatgtctctttgtaatgaactaaaaacgtgtttaatctgcttcctgagactactcctggtctctgagaccactccagcctcttctcactctgttctcttccttactatcttccctccaggctccctggtctttcttttggtttcccgaaactcctatgttcctcccagttcagggttctgcctgtgttcactcctcgtcgaacgctctcacatgcgatgctccacccagcacagctcctcagatctcagctcaaatgtcacttcattagacatcagtctagattagagtctctcactgggccctgtttctttatctctgtttgagattatacactcaatactgtgatattttgattaaattatcttccctactgttcactctaagctccattctcaacactgcttccttaaaacctggacgaggtttggcacatagtaagagttttatacaaatttggtgaataaagtatatactgcccatatagaagcaaggagtgattgaaatactactacattggaaatgcccagacttagcctctttttgttgttttttataattgtcttgaagtaattattctgttgctataatgaggttgcagaaatattaaaaagcaatgtaattttagaaatcaatatatagaggggaaatctgatgctttgagttttcgataataagactgtgcatttggctgaaacaggcttttgatttgaaagagatatcaacattttaagtgacagttctttgagaaaacaattagtcattctaagatgagatttaacatggaaatacctttattttcaacctacttaaagacaatactttggctgtcattggtattagattcccagcattgttgttagaaatgccatagtattaatttgaatcaatagcaccttaattacagtacaattttctaagtaacatcattgtcccccaagtcattgtgatctctctagttaaatgtgtttttccatgataaaataatcatcaagctatgtccatcccctaagactcagaatgttattcagtctgcaccttattcagcattaaaccactgttactgtcaattaagtttcacttttaaatggtagaaggggaagtagtaagttccttcgacacttacaaagccttttttttaaaaaaaaaaatcttattccagcaccatgcttcctaaggatttttaattttcttctataccaatttttaataaactagcaacccacagatgagaaataaaaacccttataagaggtgattaaaacataatggaacattattcattctcacaagtatcctgaattcccatggcaaattaccaaattttacagttttaaaatagggaaatggatatgcagttagtagaaaaatttgcattggtgatgaaaattatacatatgcataatactcataagaaagacaattactgcagctttactcattggccagagggcatttgcctgatatacagttaagttctgtggaagaacctggcttatttagccaaatgccgtctgatgagaataaggatcaagagtttactgaggcatttgtttccaagcattgtgtagagtctttgtctttaagagtgtttttttctttctttctttctttttttttttttgagacagagtcttgcactgtcacctggactggagtgcagtggcacaatctcggctcactgcaacctctgcctcccaggttcaagtgattctcctgcctcagcctgcccagtagctgggacaatgggactacaggtgtccgccaccacacctgactgatttttttttttttttgtatttttagtagagacggggtttcaatatgttggccaggctggtctcgaatgcctgaccttgtgatccatctacctcagcctcccaaagtgctgggattatgtccgtgagccaccacgcctggctatctttaagagtcttgaagctgttctccctaattgagacttgggtcttcaaaggaagcccttaagcaaagatgggaggtgaacgtgaattctattcagttcccgtgtttagaattattgttaccttttgacactttaaaaaattgatataacactatgtggttagcatatgttgtgcacatagcaaattacataaggtacactaatattatgaataaagctcaatgagtatggacatacgtacacactcatgtatctactacctggaagaaaatatgggacgtttctagtgccccagaaggctctctcatgcttctttcctgttggtggcccccttccagcccataactactactctaatttccttaatgaagtcatacattctacatcttttgcatctagcttctttcattcaacttagtatctataaaagttacccatattgttgcatgcattagttacgtttttaaaattcttatatataatattccatttcatggaaatactaccttttatttgtccattttcttgttgattgacatttagatgattttcttattttgatcattacaaataaagctattatgaacattattgtacacatcttttggtggccatgtgtactcatttctcttggatatatgtctaggagtagaacttccatttaatgggtaagtgtattagtttgtcttcatgcttctgataaagacatacccaagactgggtaatttataaaggaaaagaggtttcatggactcacagttccatgtggctggggaggcctcacgattatggtggaaggcaatggaagagcaaagggatgtcttacatggcggccagcaaaaagagaatgagagcgaagcaaaaggggaaaccccttataacagcatcacatctcatgaggctcattcactaccacaagaacagtatggggggaatcgcccccatgattaatttatctcctactgagtccctcctacaacaggtgggaattatgggatctgcatcgcaagatgagatttgggtggggacacagccaacctgtatgagtaagtattaaaaattttccatttaaacgtattgccttttccatgataaaggcaatgattattttccatgataaactaatcatcaagctatgtccatcccctaagactcagtcttccaacttggttatactattttacattcttgcaaacaatgtgtgacacttccagtttcctcaattcttgctgatgtttggtattgacaatcattttagttttagccattttgatgatgtgcatatatatattttggtaacttctggctttagatttttatatggtttttagctttccagtttcattctcagatttagcacctcagatttagtccatctttgtatctagtcctggtgttacaggccaagttcttctaactgtgtgttccaagacagatctctctggcagagttgacagtcaatctgcagaccaaagcatactgccatggaaatttcatctctagggaattgtctcagaacttccatcctccctgggtcacctctgaactcacactcactagaagggcttacgtaaagcatgcccacctggccactattatgacttacttctgcccaggaaagcaccaactcaaaatcctgtaggtaaaaggtagtaggggacccctgcccttgctcctttctttccctaccttataaaaatgtctgctttctgctccaaaggtgaagtagcacctttaaaggcaggatgctttgtgtcatcttcctctttctgaataaattcactgttttgtgtgtgtcaggctttactctcattaattgaactctacatacagggagcaactaacctgcttttcagttacaccagtcaccttctctgatgttacttttcccaatttcctccggtgtacttttgtgtagaatctcattctagctacaacactaccccagttttatttttattattacctaggcattaaaaggtagtagtcatttggatatacctggaaaataaggtagacaacttagataactgcttgcttgtttaattaaaaggtcaggtaatacatacagacaaatatatagagaaaacaaatgtgctacttcacactagcaccatctgctttccacacagccaatctgagatcactggaaagaattaggctgacattatttatatagaattgagtagaatagaaactggtccttaaatgatggttaggctttgtataactgatccaaaggctcatcccaatggatagagatggaaatacttcagtgtttttgtttctgatagcagagctggaaaaaaaatagaaatgaccataaagattcagttaaccagcacatgcaaggtgtaggaaatttggtcaataatatctcatgaggaatcgaatatctaaaccagattaacacatttttgtcaaactttctggtgggcattgtcttagtgtccacatttgttttacgtctcagtaaggagaggctattgaacgtgattgattttgtctctgcagactggggatcttaaagagccttggcgacatcttaatggccctgaattctcagtgtgctgtattaaacagagacagagaatgagttcacaccgaatccataatgaccttaggatttgcactgtatttttgaagtaaaatgctccattttggttttcttgtctactgcttctttctcttaatccattgaactgagaaaaatattacatttgccaactggttacttcagttccaattaattgaggctgcaccatcatttgctaataaatatactttcctaaggtgggaagtctactagaaaagacacatggaaatcaaaaagtcacacaagaacacccaaagtaaatattgtgttatgactcagtgaagtccactttattaggtaaaagcaacaagttctgaacttaccttgggactgaaataattaacttgatcaagtaggtatattttctttttctttctttctttctttctttttttttttttttttttgagatggagtctcgctctgtaaccaggctggagttcattggtgcgatctcagctcactgcaacttccacctcccgggttcaagcaattctcctgcctcagcctccaaagtagctgggactacaggtgcacaccaccatgcccagctaatttttgtatttctagtagagatagggtttcaccatgttggccaggatggtctcgatctcttgaactcatgatctgcctgcctcggcctcccaaagtgctaggattacagacatgagccaccgtgcccagccaagtaggtatattttcttgaaaataacatgagattttgaagtccaatggtcagggtccaagttctggatttagtgtgacatttggcatgatgttaacttttttgtgaaccagttttgccagccaaaaacaggaaatagtaacaataatacttatcttaaaaattattgtgagaatcaaattagagatatacatgaagtatctatatgattggtgaaaccttatgacaacagaagatgtcattatctatggtatcaaatgaaaacatggactacggagggggtttgatagggtgtgaggtagtgtctttactgtgctcatttgatcatatgtatggaggtgagatgatgtcacttttagtaattagtgaattactcaaagtcttcttgagctgtttgtttgatagaaagcagctgggctcaccttccagtttgaattctaattgctttggttataataaagaaactgaaactcacctgttcaggggttatatctgatgagggaaacattaccttaagttatctgattaagcataatttgggtgagagaaactggccatcattgacttgctccaagggctggaggatgccctttggctttacttgtaggctgaaacagaagaagacctgagcagtgcagatttccaggagaggagaaaggaaggtttggtgtactgaaaagaatgctggtctgaaaatctagaaatcaggatttcagcaacaaggaggtggaagaccttggcaaattggcctctcttctttttttttttctttcccctccctccctcgctccttctctctctctctctctctctctcttccttccttccttcctttctttcttatgttttttcaagataggatttcactgtgtcatccaggctgaagtgcactggcatgatgatggcttactgcagcctcaacctcctaggctcaagggatcctcccaccttagccttttttttttttttttttttttaagagaaggaagaattcaccgtggtcctcgtaattatttttcactgtgtttcccatgttggtctcaaaccatctcggctgcccaaagtgctgggatcacagccgtgcattactgtgcctggcctgacctttcttctttagacctcactcttatgtgttaaatggttgggctgtcctcacattcttcactcttgtctactccccagtatagtatccttatggtgtctttttgccctccattaaaatctatcaggaaaagatttaaaagccatccatactgaactacaaataactgatgagatctccactgcagaagagatggaagttttaagctaaaagaatgaagcaccagctgtagaattccaggcattaatcaaaaggtaattattttggaagcaaatagaaactttctgagagcctacaatcaacacttggaggtagctgtgcttttttttttttctatgctgtcatctggcatgagtggaaagataaatatgagagaagcaatgtgtttgggaagttcatcacagcgtgcaggccctgtatggatgccaaatagggaaaaacaactcatcatcctgccctgcttggctggtttgtgccctgacttccttcttaggggttgcagaatattttatttagtttcaatgtctcatttttgaaacttgtactctgtaattaaataagattgtaccattctaaaagagaagaggattgcctaagtatgtttggtccctggacagcagtagcagcatcacttgagagcttgctagaaattcagaatctcaggcccaccctggactcactgaattagaatctacattttaacaagatccctaggtgatttgtgagcacattaaagtttgagaagtgccgaattcatgtatcaggacatttattccccaccccagtaattaaaatccctggtgtcaccaaaggctcttttctctaatttaagcggttcttcttgcaatgctattttcatcctctggctactaatatacagttgtcagatccctcaagcccgctcagaattgctgtgaagcccagccttacatatttagttcttttaatgtttgctcataaatcaagtcctccatccccttaatcaatccagcaactctccactgaatttgcagcaatttgtcaacatctttctatatctgagaagctctaggcctgaatgtaattttctatgaggagacacagatattatttacaggatttaaaactcctttaagatatgtggtcaaggctaataatcaaacaaagtgaaggcagtgtatgtgcaaagactagacaatcaattggagatacatttaatagtagcgtcatcaccatggtcctcatcatcattaactgcaattcaaaagatatctctcaaactcttatcatgtgtaagcatggtggcaggtactaaggataaacagaggtatcagaggggatcccatttcttagaaaggtttgagtctccgagacaaaggtttgcaataaaataagtactagaaagtagaataagtgattgaggcccagtaaggagaagagaattattgtggactacggcgcttagaaaagtttcggggaggtcttaagaaaatttagcaatctagattaatggaaaaaagtagaaagaatattctaggcagataaataaattgaaactatggttttaaacaaacaaacaaaaattttaacttttaaaagtagactatccgcccaccacattctagattgcctatttctttttctctctacatttttcttatcttctaaaggtttttattaatcatgcattactttaaaaagaaaagtaaatgatactttatgaagcagagagaaaaaaataacttagtttatgtatttttaaatcttactatctctttcatctaaaagaagggagaattcagcaaaacagtgtatacagaggaaaaatcgaggttcccttagctgcccttctctcctcttcaggctggcataggaagggaatggatctgcaaaaacagcctccaacaacattttccagtgaaacatttgaaatcacgctcgggagctctgagttccacagctggtccggttgtgactgagttgtgtgatgttgggtgtcacttattctttcatatgccaaatgggggttttattatgattatcatgtgtttcataatagccttattaggatgataagaccttaatatgggcttctaacatgtggagctaagtctgtgatatagtggcatcaaataactgtgtgatttattgtccaaattcagatgtctttgagaatgagaagggcttttgttaatatccacaccacagcaacccataacaatgaggcctgtccccacacataggtctgtttggtcaacccagctagtacagaccagagtatcactacaactctgttgtgggagaaagaaatgttcttttttagtaacagattgtttggttttgtgagactaagatttttttttttttccccagtgtaagcagctctgcccagaacccatattttgggtgaaggacacccttagtccatggagtgagaaacagggatttgctggatgtaatgattttccagcctctccctctcacctctgctattgaagattgagttagacctgctctgaaggccacagaatagatggatgcatattctaattcctaatgcctacagggcaataactcaggctgattccttcagctacaataacaaggtttattttattacagtttgaaagctgtttgggacctcactaggagaacatgtcccctggctcaaataggttaaacatctgctaactttccccccaactttccccttaactttgttttattgttattgccctcatgaggccactaagcaggagttcatgggaggaagaatggaagtgacatttctatcattattcagcacattcaggcagtttattatctgggaactcattcctcctcaacccccaaggaacttaatatgaaataatattaacacattaagcatgtaatgtgaggctgcattaattaatataatgtacagatctcttacaaattgtggcccaactctactcctattactgagctcagacatgaaggcgggtgttacgtccatgttttttaagagaaaacatggtgtccagagggtgactaggcatgtgagatgcctaaaaacaaccttattcagtgtgcaggagaagagaaatgtggaatttatcttctggaaactgaagacttgccatgggaaaaagaagtgcatttatattagtgatgatccagaagacagaatgaaagcaacataaaaaataacttcctgcaaagtagatctgaggccagcctatgtatatgggaaatattttagaaaaggctagttatttggggtgaggcagttttctgccctggataagtgcaaaactgtaaagaaactcaaaatctaggattccatggtctgtaatttgtactctaacttgaagtttattagtccttctaagctagaaacccacttgaacttaaagcaactgcatgtcaacttttaggttactattctccacatgggttctttctactctgtaaagtagtactttgctttatagtaattgctttcaaatttcaagaatatttcttctaattataattgtcatgaacatttcttgttgcctcccaaacataaattttctcctttttgacagattttactcaggtttctgtctttctcttgtgcagctatgttaaccaagaaaagctgagccaatctctggtttcacagatgggctctgattagttaaattaatcgtggtaatgacttaacagtcattcatctaagaagagacatataacccaattctggcctgtgagacttaagaagaaaatggttggaggcgtttgcaaagattctgcttttatgagaaaggaaaagagggttattttttttttctttctcagaaaagacaagaggaatcttggcctcaaaaactgatatccatcataagatcatggtgaaatacagtctgaagcaggtccagagtgagaagagaaaagaatcacagaaatggggctggagtttcaactgtattaagccagaagactacctgcctccaaactttcaagaagccaacaaagttcctgactgtttaaactaatttgagttggatttctattgcttgtatctaaaagaatcctaactggtaagctaaacctcccggagttgatagttagggactttatttactattcacctttacttattattattttacttttattttaaactaattttaggccaacagaaaagttgacaaaaatagtagagttcgtataaactcttcactaatattaccatcttacataaccacagtacactgatcaaaactatgaaattaactatagtacaatagtattaactaaactatgaactttatttgaattccactagtttgtccacaaatgtccacttttgtgttccaggatcctatcaaagatcccacattgcatttcattataatgtctcctcagtttcttccaatctataacaattccttagtcctatctctttcaatatcttgacacttttggaatgtactgatcaattatctttcatgattattggttgcaggtctactcagctctggttttggaaactaaaaagtcttatgatttttgatgcattcatgaatataaattactcagagtttttggcttcttttgtagtagtctctcttggaaacatttccttttcatgattatattttaaagaaaacaccatcaacacagtataagagtttacttgggattgtcctctggcattattaacaaaagggttgctgttttaattattttgtagcttatttccaatggtcattttgaaggcttttcaaaagtttgttggacttttaggccacaaaaaaagacattcaacaaacatatattaaacactcactctgagcaagaaattgtacttcttgtttggaacacaaaggtaatatgacatagtccattctctcaagaaaaacaaaatactgggagacatcttcagagaaaggtaaattgtggtcattagatctgttttagcaattgtggttgaaaatctgtaacctgttattttaatcaatatggagtgtgtctgggccagttgcttaggggagaaacatgagtcctaaaagagtaaggggagagcatttttcacttcattctaaaatatatattatatatttacatattatatatatcttaatgtataaatatatattctataactatatcatagaaatatatatgcaattgaaaacaagcatatctagagtcaccagaaccaagaaatctgtttacctttaatggaagatttaagcagattaaattttcttcatataatctctccaatattttgcaaattttgtgtctgatggttggactgtcagatcttatgaccatttactataagagtcatcaccagactattgaaagaaatgtggaattaacattactatagcctttacaaaggcaaggtactaatgaaatgtaccttgcaatgattttggacattcaaattaattagaattaaaatgaatatgttattttcctagaaacaatagtcactctctgaagctctacaaatactgtagttataaaaattataattttttctgaaatagctaaaatgtgtgaagcttaatctgtaatgcctcgtagccaatgaagctgtgtcaagtttctgccattgattaaatgtagtagcagagctggagcatttaatcaatcataaaaccactttaatgcattgtatcactctaaagctagagcgattagggcagttgcactgcaggccagaatgcaaaatgcagaacaataaaagggaagggaaaatagtctatgtccaggtcttcatgtttcaaaacgtgcaaatggatagttttgtatgcattatgtgtgtcattttactggcacagatatggcaaagcaatcattatttgcaatgtgtagagctatgtctgcacacatataagtgagcataaacaagtatagtagtttgagaaaaaataataatggattttgaacaatgatgaatattttatgcagtatgtcacttctgaaagttacttaattcccacctaaatgagaatttctaatgttactcataccactgccacaggaaaaaagaagttattgccagaagaagaaagaagaggagaagaaagaggtatggggaaagagaaaggaaggaaacggggagaggaagaactgaggccatgtgactcgtatatcagatttgatataataggatggtcagtgtagggatcaccatgtgacatagaatgataagaccaaagaaaataatgatggggtgagaccatacaaagaaagaagatagatgaatgatctaattaaatggatgaatgaggatttttcttggtccattatgaggaagaattatagtgaataccacaaccacatggtattgataaattgcaattcgttttacctacatatataacctatatatatatatatataatattatatttagttcagaattaatctgtttatatcatagtattcgattaatgttcatattcaattaattcctttgtgatctttgtcaagtcttgaggcaatagaacctcagcattgctgaggagaaatccctgaaagagttggatccaaactgacatttgaagttgaaactatggattccaacactgatagaaaggcaagcatgatccctgacaatgatctcatgttatatcactctgcagtatttactgctgaaatgtttacccatttgtacaactaaactgaagaggagtctggctttgcaatacttccatggagcctggccctcaccttttcttcatgctcaaattttagctttaatattttggaatatattgtgggttttgattattaatcagacctgtgtacctttattattttgcatggatgccaactttgattgtacaatgacagtcatacaataagcaccatataaatactaacaaaattaccacctcaggtttgaagctttgagctggtactgagcatattaaatgactactgtcttcaaggaattgttaatattaccgaaaagccaatgttagtacatatgacattacatgtaaatatcttatataatagagcatataaatacaaattgcaggctaaaattattgtaagagctgagaaaaattcaaagacaaatatgaccagtgagaacaaaattgatcaagcaagacttcaagggggaggtaggatgaaactcaagccatcatgataaattagactacttaaaataagtagaaaaattgatcaagacaatttagaagcatcataggcttaagaagcatcccaaagtttcctgttaaacgactgagggaataaagactttaggggtggatcaaaaacattagagaagacaaggacctgagcataagtgcttcagaagacaatattttccaaaaaagtttcaaggtgaatatttctaatgtggcatctgttcatgcatttcttttgttgacacagtgtaaccatgctgaggaaattcctgagagagtgggaccaaggagggcacttggttttaattcaagttaaggagtggctttgagtgtgcacaggattatcctaaaggtgctgagtgtttgaagacagtatggggtcatgtgggtgggcaaagagaagtacttgactttggaagactgacttcttttattcagtatttcatagcaggctctgactatccacatacatgtctgagatgctgtttatctcccagtttttatcttctgtcttttccttttagaattagagcctctaaattttaactggacacacgctacccaaaataaagtcttaaatttccagacttctttgtacttagttgcagccatttgtctaagttttggctaatgggatgtaaacaaattcatattttgagtttccaggttatgccctccttgtggtttgaatctgtattgctgctaaatctcatgctaaaatgtaatccctggtgttggaggtggggcctggtgggaggtgtttggatcatgggggagaatacctcatgagtggcctagcaccatccgcttggtgatgattgagttcatgcaagaaatggttgtttaaaagtgtgtggcacctcgcactctctctctttctctggctcccactattttccatgtgacatgctgcttccatttcgccttccaccatgattgtaagctaccagaggccttcccagaagctaagcagattctggcaccatgcttcctgcacagcctgtcaaactgtgaaccaattaaacccttctacataaattgccctgtttcaggcatttatttatagcaatgcaaagaacagcttaataaaacccttaaaagagaatggacatgatctttatgtcctcttcttcccctttcctgtggagttgaatgtgaatgtggtgatgagctatcttggaccatgaaagatgagggcagagcactaggaagggcagagctacaagatagaaggaggcaaaatctccagctctgttgtgtcatcatgctagccttcgactacctaacatacataagagagaattgcactactgtttaacttaggccagtatatttgggggtctttttctttctacggttgttggcaagaggtaaatattttgatgattgcttactaaaggcttattgattacttgagtaaattaagaacaggtgtttcaatattcactcatagcatgtgctttgatcacattttacttgtaaagaatttggtttccttcttagccttgggcataattcactctgcaggaagaacggcagctttatggccccatctatgtttttcccatattcattcacattgatagtggagcaaggtaccatgaacatgtgatttgatgtttctgagtgttttgtgtcactgcttttgttactagaggaagacagctgcttatttcatgatccttattttggaggttcttttgagattagtttgaacacattgaagcacataacttttttacaaaggttatcatgtctctactttgaactttgaaaagaatagaagagaagtaatcatttgcaagcagctgttgtgtggggtccttcatgtcagcaggtcatgacaagcagagacacagaggtttgttctccgttgggtttcataatttcatttccctgacttcattaacaccgaaaattgatggttatgacatttaaaagcatgtgagtgttgaagtcagacctgggtgatgttatcaagagaataaatgctttccaaaagtcaatggatgttacctcttgcttcatttcctctgccgctaccatctgctaattctagaatcatttctgactgaagcaaaggattagcacctttgcaacagtgcccttccaggccagcagggtgagtcctccctgtactctgaaggagagagatgtggtttaaatcaggttataaacccatagcctctgagctaatcagcagtgagaaatttctgggaaggcaggtccagggttatcaaactctattagaagcaagagcatcggttatgcaaatagcatcatagtaacaaagtcaaaatccctgtggaaaaacatttttctttcacacttctcattgagatataaagcgcattaacattttaaaaacagctttattgaggtataattgacatataataaactgcacatatttaagtgaacattttataagttttggcacttatatatttgggaagtcaccaccacagtcaaaatactcagcatgcccatcagtcccaaaagttttatttttaaattgtatttatttttttacttttatttttagttgacatattataattttacataattatgggatatagagtgatatttcaatacatatgcaatgtataatgatcaaatcaaggatattattatttctatcacgtcaaagatttataatttgtgttgtatacattcaaaatcctgtcttctagctttttgaaaacatgcaataaataatagttaagcatatttatcctacagtgctgtaggacccaataactcatttctcccatttagctgtaattttgtacccattaaccaaacttttcctatcctcccctccctactacccttcctagccctaagaatcacaattctactttctacttgtatgaactcaaatttgtttagcttccatgtatgagtgaaaacacgtggtatttatctttctgtgcctgacttatttcacttaacataatgtccttcagcctcatccatttttccatgaatgacacgatttcattcttgttttttttttttttttggccgaatagtgttccattgtgtatatataccacattttctttatccattcatctgctgatgaacatttaggttgatttcatatctcagctcttgtgaatagtgctgcaataaacataggaatgtggatatctcttcaacatgttgattcctttactttgaataaatgcccagtagaattgctagattatatagtagttttatttttagctttttttaagaacttccatgctgttttatgtaattgattttccaattgacattcccaccaatagtgtgtaagagttctcttttctctacatccttgccagcatttgttatttttttctttttaataatagccattctaactaaagtgaaatgatatctcagtgtagttttgattgcatttccctgatgattagtaatgttggaaaaattacatttttgcttctgcttattttcttacatttctttctttcctatcttctaccattccaccttcttcttgatgaagaaatagtacttacaaggtcatatgggaggtgaacatagtaggatgtgaggaagtgaaggttcagtagccccagagttctgtggtatggaaagataggcaaacatgtctgcaaagctgcctattcttcctgctccagaagcagccctgctcagtatccacacctagcaaggtacccaacaaagattcagtgacattcaagtctatcaaggagatttcctaatttatgtatgtgggatttgcaaacttcaccataatgtattctgaaagttttgcattctttcgacaagatatattgaatctcaggccctggtctctgattgatcccaacactggggtcatatgttagagtgctacacagttatctgacaagcctttattatatattgtaaaaggctagcatcctggtgagaatcctcaaaggtcattcctggaaaagggctttaggctttttaattgggtgagaaatggggagctgtttccactcacggtgttggcagtaccaaatacatgctgttggctccagctgcctttatcaaggtgtgggatgcccgtttggagagaactgccttaaaccaaggtcatgacattcattctcaacatgagagaaattgattttttaaatttctgtttcatagctttagagtgcttgtaacctaggccagcctactccaaataaatatcctgggaaccaagaggaccccaaaggagcattgatatggcatgccaccaacagcttcccttggaaaaatcgggaagtcagcaaaacttagaattttgcctgtcattttactcagatttcttcctttctcgggtctctattggatgagcaaatcttagaaatttccgcaaaggatactggtaataacacaacttgtgactactaagagagatttaatcaatgtcttgaggtttaaaagccccaaacctcaaaggaataaaactgtaatgattgaatgaaagcctatttgtttaaggtttggggaaggaaactaggacacaggccccataaatcaaattgctgacaggcttccatccagcctggctaatccatttcctcacctggggtaaagaaagcaaaacaccaatagtagatcaagaataccagctgcatacaaggacattatatatattaaaaaattatcttggggggccatcatgggccctttctcatactagccgactcaccttagaaatattacttcctcattgttttgctgaagaagttaggatagatgattttatctagccgcttgaagtgaatctctttttctctctgtctcctgtggcacacagggaaatcagtgagagaatgagggcaatggtaactacagaagcaccggtgaaattttcttagtgtatgccagtctgtgtgagagaaaaagatgtcttactcaaggttagttacagggagatgttgctcacaacactctaggatttatgacagttccactcactattttggagagcagattctaaccttactcattggatacagtttgtggaattgctgcaaagtgttattctttgcaacagatggcattccaggcatgtggcaaaattactctattttatttgggcatcaatcaaattttaggagggtgaaatgaaacgatttggaacaaataaggtatttttccccactccatcaggtacaaactttttaaaataaaattgtttgctgggaaatacattttatttaaagttacagaatactaagagaaagcttttcaaattgtgtatcctctgccttggaaagggagaagtggcacaaagctaagcagtgagattatcattgtttagtctggggagaaacttaaagcctaggagtagagctacaagttttagaaggtaaagaaaaccagcttcttcctctgtgtgatttgagaggtgataataaggtcctattggacgaagataatttgtgaattataggaacttaagacttcaaggatccaattgagttttcattgtgagatgatggtatgacattaaacacatgaagacaccttagaaaaccactagacacatgctatacattcagtccatttcagttttcattattgtagtgattattgtcacaatcatagtgtttccctgtgaaaccttagaaaatcaccagacacatgctatacattcagtccatttccgctttcatcattgtagtaattattattactatcacaatgtttccctgtgaaaccttagaaaatcactagacacatgctatacattcaatccatttcagttttcatcattgcggtgattactgttacaatcacaatgtttccctgtgaatgtttcaccctttgcgcttcccacaataatttaccattatttatttatgtgactttctccttatttgactggagctccatgaaagtaggagctgagcttgaaggtatttcttagcattccgtgcttatctaaccttgaatattagagataaataaagcaagtgttattttgcacatggaaattttcctctgcagatgtttttctcttttcaaagaaaaatagcaggcatggcagcactaatagtcagggttcaaataataaataagttttatattaaagctgtatgtgaatcaaaaaccactacatataggtaaacatgactcttgcagaatctgaagattggtttactcaacaccactccaaccctgttgtagtatgtttcctgtagtcaaatgctgcaattaccagactcccataagctcaaactattgctgtgatctgagtcagccagtcaaatacacctggatgagacttggaaagcagatgtaaacatcagaacacagagatgtacagttttgtgaaagtgtattcatgaaaatacttgtgttttgtttgttctgtggcatttggttctgtggcagttgttctggaacttctggtgtttaacaccctagttaacagcctaggtttttgggtgttaagcagtaggtaacactatcactggcattttcattggaatacctcagtgatgtatatgggtatctatctctgcttaagttaagctaagaatagactgtgttgcctgcaactaagaactctgacccatacaataattgggaacagaagtggcaggtaggagatccaaaaaggaatgaaaatctgagatgggttctctaatttgtagggggaaggattcagttactgttagagggtggggtattggttttattccatgccacccagtgcaaactgtgatatttaaattatctctttgggacaccagaaatgaaagaatcgttttgatagactgaaataattctacaatagagctttacaaagagaacaataatgatgcaaaagactagctacttctacccatattgaataattaaagagaaaaaaagtaacagactcaggatcttagattctaggccaagttagaaaacaaggaagtttctgtgacctacctaaaacgatgtcctgtagctccagggctaatgtgtgcaccaatagtcacaggacctgatcatgtaggttgctgaatttaaaatacttaaatttacggtttatcaggtctcccaggcaaatgttaaggcattgattggtaaagaattagactccacaggattagaattgggatgcttggggaaatttcaataactccaaatcccctgaaactcctagggcaggtagaagcagtccccatctcctgtcagttaaggctgatcctgtgatgcttgaagacattgtaatgacttcaaagaacatggtgctaagactccccctgccttgctctgctacttcacctggcatctgaaggtagatcccagtatgctcttggggataaattcaacaaaccaaatccagatgtggacttatacatttcaacattttacaccagcaaaagaccttggatatgtatgagggaatttgtcctaaggatgctagaccaaagaggggaaattatattttacatcaggttgaaaatgtctatattggcgcacttacaataaattctggatttaacgtactaggtcaaactagcccaaatagctggaagtagatttagtaattttcttggactttttttattattaaagctggaccaaatggtagtctatagcaaatgaagtgaagatatcagaaatgctttggtttaatataaatcaagaaatccaaagtcttaggaaaatattggagttgggggtggatttaatcacatgtgacttattcatcctttcaaaacatctagtccttcctgaaaaacagcctagatgttatttcttttcactcagcatagaaaaatacattggtgagagaagcaacagaggccttaaaaagtatttcaatgactctcctctttagggtgtgataaagatgagaaatgtaaccatttaaatggcttcctgattttaatgataagggtgggtactcagagtaacaatgacaaagtaatatttgttaatgcccagaagcaagatgggcatgctatgctaccattgaaaacagcaggcataactgataatcagaataatatgatctacatgaaattttggcaatggctaattgatcatggggttcctagagcttaaatgggtagacatttcatgaaaatttgacttgatttgcatgcctaaaagagaataactcagggcttgataaatagaagcttgacttgaatcaatggtatagactcctgtaggccctcaaccaacttataaaactgacctagcaccagttgaatgaagggaaagttgaacatgcttaaggagggaccctgtctcagtctgttttgtgttgctatgacaaaatattggaaactgggtaatttttaaggaacacaaatttattgtcacacagttctggaggctggagagtccaatatcaaggtacctgcatctggtgagggccttcttgctgcatcattgcagggcagaagtgagaacatgagagacaacaaggggaggtagagcttgttcttttataatgacaccaatctcatccatgagggtggagtcaccatggcctaattacctcttaaaattccactttttaacagtgttacaatggcaatcgtattagtacactctctcattgctataaagaaatacttgagactgggtaatttataaagaaaaatggtttaattgactcatggttcttcagactatttaggaagtatggcagtggcatctgcttagcttctggggaggtctcagaaaacttacagtcatggtggaaggcaaagagggagctaacacttcatatggccagagcaggagaaagagagagggggagatgctacacacttttacacaactacatcttatgagaactcaggacaatacaaagtgggaaatctgccccatgatccaatcacctcccatctggccccacctctaatattgaggaatacaatttgacatgagacttggtgggaacacagatccaaaccatatcattctgcttctggcccatcaaatctcatgtttttctcacattagaaaatagaatcatgacttcccaataatccccaaaagtattaactcatttccagcattaactcaaaagtccaaagttcaaagtctcatctgagacaaggctactccattccacttatgagtctgtaaaatcaaaaacaagttagttactcccaagatacaatggatgtatagacattgggtaaatactcccattccaaaagggagaaattggccgaaagaaagaggctacaagccccacacaagcctgaaacccagtagggcagtcattaaatcttaaagctccaaaataatctcctttgactgcatgcctcacatccaggacatagtgttttaaggattaggctgctaaagccatgggcagctctgcccttgtggctttgcaggattaagccccagtggctactctcaagggctagtgttgagtgcctatggcttttccaggtgcaaggtgcaagctgtcagtagacctaccattctggggtctggaggatggtagtccacttctcataactcttttaggcaatgctgcagtagggactctgtgtggggcctccaaaccctcatttcccttctgcactgccttagtagaggttctccatggggctctgcccctgcattaggcttctccctggacatccaggtttttccatacatcctctgaaatctaaggtggaggcgcccaagcctcgactcttgcactccttgcaccctcgggcttaacatcacatggaagctgccaaggcttacgggttgcaccctctgaagcagttgactgagatgtacctaggccccgttgatccaaggtttgagctggagcagctgggacatggggagcagtgtcctgaagctgtgcagaacagtggaaccctgagcctggctcacaaaaccattctgtcctccaaggcctctgggcctgtgatgggagggactatggtttccaaaatggctttggggcctttgtcccattgtcttggctattaccccttggctccttttcacttatgcaaatttcttcagcctacttgaatttctatcccccacaaaaatgggattttttttttctgccacatagctaggatgcaaactttctaaactattatgctttgtgttccttttaaatataagttccaattttgggtcatttctctgctcacacatataagcataggctcatcacctaaatcaccactctcaagttcaaagttccacagatccctagagcagggacacaatgcagccagtccctgctaaggcatagcaaaagtgacctttactccagttcccaataagttcctcatttctatctgagacctcctcagcttggacttcattgtccatgtcattatcatcatgttggtcacaaccagtcaacaagtctctaggaagttccaaactttccctcatttttcagtctttatctgaacccttcacactcttccaacctctgcccattacctagttccaaagttgcttccacagtttcagtatctttacagcaatgctcattccttggtaccaatttgctgtatcattctgttcttgcattgctataaagaaatacctgagactgggtaatttaaaaagaaaagaggtttaattgactcacagttccacaggctaggaaacatggcagcatctactcagcttctggagaggcctcaggaaagttacaatcatggcagaagacaaagagggagctggcatttcacatcgctgtaggaggaggaagaaagagagaggggaggtgctatacatttgtaaacaatcagatttcatgagtactcaggacagtaccaagggggaaatccacccccatgatccaatcacctcccagcaggccctacctccaacactgaggatcacaattcaacatgagatttggtgggaacacagatccaaaccatattagtaattaaattttactacgagttttagagaggggaaacaaatcaccacagaccctgtaatgactttccaagcagtcattataaatttttctcctagcttttcccaaagagattggtggcaaatttaaggttaactttgccttaattggctcctggtctttggagaagttattggacattgactctatgaccatactgttctctggtaaatcacaacagtactgtggtccagaggtcatagttgagacttatgagtgaatatcaggtggttaagagaatttatgcttgatattatgtcctagtgggcccagaggattcacaaactcatcttgtggctactgtggtatagatggaaaagatatatactcagcaataagcagcagttccatgttagccttgaacttgtggagtggtagatattaaaagacaagtgaaagtccttggaactgaaagaaatattcctagaataactgcagaggttggttcataatcatagactctaaagatacaaagatggttttttctattatattccacttaacattgtgatgactgtgtagtgaaagaagaaccttggtaatgacaaaggattattaatgtaagtgtaattaaataatgaatccaattgtaattttccagatatattatctttgttattagcagattatcccagcttttggctcctgttctttagctatttagcttgagcatgtttttaattcctcctccaccccatcctaataaacagaaaatgccagaaatagatttttcccacacctggaaggagtaccagcgtaccataaccatctttatctgggcttagtaccataaccatcttcatctgggctacatgccttgattttgtcctcaggaactttctccatcacataatttctcaggataacgtgttggtctacaaaattgatgacatcatgttgatagaaccaggtgagcagaaagtaaggttgtcttaaatggttcagtaggagtcatgtgtgcttggcaccccagtgaagatatcgggtgatatatactttaacatttgaggctacatcttccaaagagaaatacaagttgcagcacattttatcttctcttattaggatagaggcataatgtttaattgtcctatttggattttggaggcaacacatatcacatataaagtgtattgtttcaacttatttgcccaaaatgcctatagccctgagcaagaggaaggtcttgtatataagcatccatcttgtatataagcaacgctgctagttggctgtcatgacccagataatccaacggtgctaaaaacatctgaggcagatcagtatgttctatgggccctttctcaagctctatgggaaattacagttgaggacccagttttggagcaaagtcaagccctcttctgaaacaattttcctttaagaaatagttgtgagcttgctaatgaatcatcatatagaagatatcataggatgtaagtttacatttaacctaagttgcttatctttaactgggtttagtctaatctactgtgtcataaagtcagatgaaaccaagagctttttatcaataaatttaactattatttagaatattgtgcaaattacgtaggatatcgctggcacaaagccagctgctacaagtgatgcctctcaccccaatatgtctgagtggttgatatgactgctactcactgggatggtgtcctaataaagacatggctctctctctccttgggctttgacttccattctctggaatgggaaatacagggaactcagtttaccataagccacatccattgggggaagggtatgcctggatctatttggtttggaaaataggttgtcatgtgtcttttttttttttctgtttatttagacatatgaggaactgagactaagaaaggttaaacgaatttcccaaggtgacagttttaggaaatagttcagctgacactaaagttctctcattctttatccaatgtacttttcactataactctgtttcacttgggctttaactgttatttctttaagaactctcagatgatgcctttacatagtattaaaagctgttacaaaaaatccttattcttttcatttcccaggggcttctctattttccaatcccaaaattaccttctgccctccatcccagtctgtcactgctcgatcttactcttaatgcatcagtagtttgctttctgattgggctacttttatctttggaatttcgcagtgtaatttcatcatcatcattctttccccttgcccttgccaactttaggtgtattggtttctgtccattgtttactttacatcataaaaacccagacattggaaaagtaaaggaagattcaaagaaatattaagcagaccaaacctaaatgataagcctatagtcctatctaaaataataatttgtatcccaagacaatactctttcaaatatgtgaagacaatggtcattttcccctttgagtcttcttttctccaggccttccagccttcctaggacttactgcctcagtccttctaaagcattttcataagccctagttttgctttctttttactaatcttgtgggtgggctccctttttttgtgtggacaacttgaccaactagccactaccagcatggaaaaaaaagatgatattttctcttgctctgatctttatatttctattaacaatgtccagttttattctcacttttttcctcagtaatgtcacactttgtttctctttagtttagctgaaacagtcaatgtatttttaccttgtatcttcctttagcattcttgagttgtttcacattcctgctacatgactaatatgatcaccatccattgtcttgctttgtcctatgggatgtgctctttattaccactactggtaaaatttccctactgtgacctctcttccactttcagagttatgtaaggatacttgcttacaagcctagatgtggtccaattggctatctacgctaatataatcctgcttcacattgaaggcacaatatttgcaaatttgctttacgtctatagcttggaactgacatattcttattttggttttttgggaagacatttagttcttcttggtcctgtctgaacactatcaaagagaattccctccttcccctaccccatgactttcagaaagttattgtgacatttcgacagctataatgttgatagtatgtttcctttatttcctcctctgacttaggtagaactctatagagcactggagactcgtgaatcaatggtgcagttattcatttttcgctaactttgacaactgtcttgtatgtttcccttccccatttggcccagacctaacctgtggctgtcttgctgaatatggggacctggacgtttcacaggctgacagggtgagacaacacaagcaaatgcagctggcctgatggggatgttgtcagatgcagtcaaccccactggaggtatactcactcagagaggctggtcctgagtgctcctcccatctgcctccctgtcccacggttgtgccctggctgccccacgctgacagtggggctagccaagcatggctgttgtgaagatctcaagacgattcagagaaaaagcccagacatcattttgcagaggatattatacatacagacttggaagcattttgaggaaaggtggataaggtccaaggcaattttttttagccctacttgagggtatgggaggggtgagtgggaatgggggtggggctgcaaatccagggaaaaaatacttgacgtgactgaccatcttgagtgcaaattgttaactataaaaatcatgagtggttggcagctactgtttttgtttgcttgttttttgagtcagtcttgctcttttgcccaggctggaatgcagtggtgtgatcatagctgacatcagccttaaactctgacttatttatttatttatttttagagatgagatctcactatgttgatcagtctggtctcaaactcctgggttcaatctgttctcccacctcagcttctccaggaactgggtgtataggcgcaagccactctgcctgggtctttttttttaagccaattttttccctctgtaaagatgttcctctcacttttcaccaaacctggacttcgtggttgccacttctatgcatagtggaagggacaaatgtgaagggaattagtgttttcatatacttaagagagtgcctatcttttattgcattatgaatatggcatttggtcagggaaggtgagtcccatagacagtcaaaaaaaatgtcctgtaggtactgtttcaggtcccaggtgttcttcaggctgccaaatattagctttcttcaaggcccagtcaaattccaccttattttggaagcatctgcttattaatttacccagcagaaattattctccctctgagctcgccagagcatgcatattgtctgtgatgtcacttacttggtagattttgaaagaggcagtttgttctgctcctgtgtgcttccagtcttgaagcttacctgactacctgtgtggccttggggaagttagctagcctatctgaatccacatgctctcatctctccaagaaggatgataacattgccccactgttgtaatcgttgggtgttgccatgattcactgttactatgttagtgccattgcttcataagctatgaggaattccaggaaagtcagtaatgattattatgatatcatataatttctgaagtggaggcatctttttttttcccaaccacactgacaagtacttgagatcaaggattaaacattatgaatctctgctttcctaacactgtaatgctatgaacatagtagaaagttaataaatacttactgggggccagacgggagtcgtgattcccttgaaaaattaccaaaatgttgacgtatcgtcaccaacctctttccagaaaaagagtaagcagattaaatgatgatttattttgcaacattgtaactttaaagccgttgcactgtggaattcgtgagtcacagcttcttgtctacagtatcaactctaagaagagactacaaaataatgagaccagttaaacaaacttgccagaactttccatatctaaatgtttcaaaatatttactttaggaggcttctcagttatttcagaagccattgctcaccacaaccaaatcctagtacaattcaaaatcaaaacagacaaacaaaaagcaatcattgctctgcccaaaacaatgtctacccatccaaattcttcagtcttccaatcaaggcccatctcaagctggcttcagcccacttttcctctcttactattcactaagcagatttagcatggtgaagataatgttagatttgtaagaaatgtaggagaaaacctagctctgtctcttatttttctatgaccttggaaaaagtgtctcgtctattctgagtcttaattcttatatctgtgaatgaagatactgatgtttttctgtctcagcataaggattaaataagatgaaatacaatgtatgtaaaagtgtcagtttgggaaatatagtaggctcctaacaagtgctaggtcccttttttggcattctttagacaaattcctgattttctctgtactcactgatctcagtgttggaaatgtccacccaatgtctctcttcctacttaacttttacagactaatttaagttagttttactgggcaaaacctttactgtcccctctggccagaaaggtctctttttctcaacttctttagtacttgtaaaactaatcatgtatttgccctttgctgatccatattattaagtaaaaaaaattcttttcctccacaagattgcaagttatctagaagacatgaatttctcatatatatttatatttcctctgctctgtaggaaggtgtcatgcctatagggaggcagctcattgtaggggaaagaaccaatgcttttgcatgagacacaccaatttccagctacaaagtggacaaaatccttgaaagatgatatattcatatacacagtcaggtagatgaatgtttgatttcttctgttaagtacatatgtgtccattaagtatagatacacatttttctttacgagtataggtaagattggatataggaagttgtgagtaaataaagttctggtgaaagtcaaaactgagccaagaacagggattaccaggcagcaccagcagcccttaagaataagcaagatgctgtgtaagatgatggatcagacaaaaatgccaataaaagaattgactaaaaattatcttttgcatcacttgagtaaatgtcatccttggctccctcctgcttccactccccatatttaaatccattccaaaaatatgttccaaatctgtctacttttttctgtttctacagctgctactccacatgaagctaccactctctatcatcaggattattttacagtctcttacctggtctcccatttctgtccatttttcctttctttacagaagaaccagaatgactctttaaaaacataaatcaaatcatgtcattacctgcaaaaatatctaataggttccatttgaaatagaatattttaatcctggcttatacgttttttaaagccaaccaactttttaccagaagatggtattacacatggatgactggcagatatttctctggtagaataagatttgatgctagtgatttgatatatggccaggggtcacagttcagtcaatactaatactgcaatttgtatttaaaaagaaatgatattctaggcattcaatatggaggaaatttttgtttcaacatgggccataccatgtatctttgtattgatgcaggagtttttcttgaactcttcatcagacttgcaatgggagtgccctgtttactcaggctgccacactcaaccttttgcaggaggaaatgcattagctagtgagtgcaggatctggctggccattttgggcactagcaggaacaggctcaatgagtggccccattttagtgcccagctgggggtgcctgctacccctgaaaccccagagggtgtgttacagtagtatcttagctccaccacccattgacagcgtgtgttatcagctcagtaggtcccttacctcatcgtgtagggcagctgccctttgccagtgagggcaaagggccaatgtgacagccttttttctgtacctgactaggtgagtcctgagctcttgtctggcgtctaaaaagaatgaggtcgcacggacacttgagggatggtggaggtggagaattttatttagtcatggttagggctgtcagtggagaggggagctggagaggggatgggacaggcagataatcttccctaaagtctggccatccccagccagcccttctctgaagtccagtcatctggacttcatctgaagccacctctcctccggagtccagtcatccctctgaagtctagttgcctctctgcagtcaagcagcttctctccctctaccaattgaatctggagtctttataggcacaggatagggagcaggacaggccataggcagttttagaaaaggcaccattcaattggaaaaaagacattattcagaaagaacaaattgggagagagcaggcaaacagggatagaagtttttacattgggttgtgggtttcaggcttttcagctcgtaggtggggttttgccaggacctgccgctgtctgcctagcatttctctgcctcctgcccctatcagtatagaaatagtgaacaaaccagcatgataagtagcccttgaacctggctttcttgtcttaagtcttcctactgtgttccaatgaaatactccattgtgtctataaaaagcagctgagtttttgtttacatgtctaaaaaccaagaacgaataaatactgcagtgtagtgaaaactacaggtcactttgtgttatttattttatctgagttttaccaagcttcctgataatttcacagaagactaaaaaatcctgtgaaagctgagacctttacattttctgaacttttataaaatgtctttatttggttctaaatgacctctgataacatgctcatgtcaggagttgaggttctatgtacattctacccacccccttcccaaacacactaaaagttcttctttgataaaaatttatagttcttggaatttcagtgacccaccatcctaccagatcactttcttggctttattatcatgtatacttaaaagtggctcctcttgtagccacaaactgcaacttggaatgtcaacataatattttatgaatgcttattataataaacaatgacagaaaaaatacaagcacagagttatattccaaggatcacaggatataaataagcaacgtgcttacagaaggagagaaaaatggaagtgccatgtctggatatgaaaagaagagaagacttcttaataaaatgtgatcataaggcagagtcaccaactatatattattgaatgaatccaacataccctaactaactgtgcatatcttttaaagcagtaaaattaacaagttaagttttaaaataatgtagacctgtcactgtcactgttggaaatagtcaaataatccttttttttttcttttacaaaatacttttgcataatttgttctgtaaagtagactaaatcatgttaaagaaagtcatatcaataaatattttgagctcctaccatgttttctgttcttgagtaggtagtaaataacagaggaataaaaatattttatttgcttttcaggagtttgctgctttctagaagagataagtctataaacaaggcaggatagcatcaaatgctagaatttttggaatagacttcaaatgctctagcattttacatttgttgggagtaatatttgaataaagcagatgaagcccattcaaggtttgggcaaaataattaatgtaggaaatatgttgtctgtggagtatatcaagatgtacctgtccacctctcttttcaaggaatgacattatatgacctacatggctgtgagctcaagctccacaaatgatcacacaaatcctttccaatattctatctaaaagtattcttcctacaatatacttgtatggaagatgcatgcaatgatttgataaataaaattatagatgatttttattctcagtggctttttaaaacaagtcaaaagaaagttattttcagtctaactgcagcaattctacttactgtaactaaatctgataggaacctgacatacaatgtgaaggaaaacttgaactagttatattatctttcttttatttgtgtcactcattcaaaaaaagaagggatttgtactagattatatcaaaagtccttccctaattgaaatgtctcttttaaaatcttgtatgtttgagatgttctctaaatgtcttaatgttttttcatctttttaaaaatatctactgattatatatatatatatatatatatatatatatataaaatggtaaatggggtacccatcaccacaagcaattatgctttgtgttacaaacaacccaattatactcttttagttattttaagatgtacaattaaattgttattgactgtagttgccctgttgtgctatcaaatactaagtctttttcattctctaattattttttgcacccatatatttgagatggagtcttgctctgttgcccaggctggagtgcagtggtgcaatctcggctcaccacaacctctgcctcccagattcaagctattctccagcctcagcctctcaagtagctgggactacaggtgtgtgccaccatgcctggctaattttttgtattttttagtagagatgggatttcactgtgtttgccaggatggtcttgatctcttgacctcatgatccacctgcctcaaccttccaaagtgttgggattacaggcgtgagccatggcacatggccgatatattttatagttatatatattctcatacttctggatgtcttttagatactaaattttgaaagcttcagaagacaccaagtctagtaataaagtaaccatctaacttttgacataaggctaggacatatgtccaaattcaaaactcaaaaggactttgctgtttattttaaaatagattctatggataaggtagtatctatctatctattatctatctatctatctatctatctatctatctatctatctatctggctatcatctgtcatctatctaacatctacatatctgcatatatcttattactcttaattgcctatataggaaaactggcattatgaaaaagctgaagaattttttaaattttaatttttgtcggtacacagtacaggtatatatttatggggtacttgagatattttgatacaggcatgccatccataataatcacatcagggtaaatggggtacccatcaccacaagcaattatgttttgtgttacaaacaacccgattatactcttttagttattttaagatgtacaattaaattgttattgactatagtcaccctgttgtgctatcaaatactaagtcttgttcattctttctaattattttttgtacccattaatcatccccacttcccccagcccccacacccccactacacttcccagcttctggtaaccatccttctactctctatctgcataagttcaatcgttttaaattttagctcccacaaagaagtgagaacatgagaagtttgtcttttcgtgcctggcttatttgacttaaaataatgatctccagctccatccatgttgttgcaaatgacaggatctcattcatttttatgagtaaatagtactccattgtgtatatgtctcatattttggttatccatttatttgttaatggacaggttacttccaaatcttggctcttgtgaatagtgttgcaagaaacatgagaatgtagatatttctttgatatactgatttttttttcttttgggtagatctagcagtgggattgctggatcatatggtctctatttttacttttttgaggagctacctaaccattctccatagtgaatgtactgatttacaatcttaccaacagtgtacaagggttcccttttccccacatcctcgccagcatttgttattgcctgactgttggataaaagccattttaactggagtgagaaaatatttcattgtagttttgatttgcatttatctgatgatcaatgatgttgagcacattttcatatacatttttggcatttgtatgtcttcatttgagaaatgtctgttcagatcttttgcccattttaaaatcagattattagtgtttttcttatacagtttttttaagctccttacctattctagttagtaatcccttgtcagatgggtagtttgcaaatattttctcttattctgtgagttgtctcttcactttgttgattgtttcctttcctgtgcagaagctttttaaattggtgtgatctcatttgtccatttttgctttggttgcctgtgcttgtggggtattactcaagaaatatttgcccagtccaatgtcctggagagttttcccaatgttttcttttaagagttccatagtttgaaatcttagatataagtttttaatccattttgatttgatatttatatatggagaaaaataagggtctagtttcattcttctgcctgtggatacccagttttccagcatcatttaccaaagagactgtctttttcccaaagtatattattggcacctttgttgaaaatgagttcactgcaggtgtatggatttgtttctgggttctctattctgtcccattggtctatgtgtctaattttatgcctgtaccttgttgtcttggttgctatagctctgtagcataatttgaaattaggtaatgtgattctttcagttttgttctttttgctcaggatagctttggccattctgggtcttttgtggtttcacaagaattttagggtttaaaaaaatatgtcattggtattttgatagggattgcatcgaatctgtagattgctttgaattgtatgacttttaacaatatttattctcccattccatgaacatagaatatctttcttttttgtgtgtgtttctttcatcaacattttacagtttttattgtggagatctttcacttctttggctaagttaatttctaggtattttattttatttgtagctattgtaagtgagattactttcttgatttctgtttcagattgttcactgttggcatgtagaaatgttactgatctttgtatgctgatttcgtatcctgcaactttactgaaattatcagttccaattgtttcatggtggagtctttaggtttttccaaatgtaagactgtatcatctaactttgggaggctgaggtaggcaaattgcttgagcccaggattttgagaccagactgggcaacatggtgaaaccccaactctacaaaaaagtacaaaaaattagtcaggtatggtggcatgcacttgtattccccactactcaggaggctgaggcaagagaatagcttgagcctggacggcagaggttgcaatgagctgagattgtgcccctgtactccagtctgagcaacagagcaagaccctgcctcaaaaacaaaacaaaaacaaaacaaaacaaaaaaaactggccagttgcggtggctcacgcttgtaatcccagcactttgggaggccgaggcaggcagatcacaaggtcaggagattgagaccatcctggctaacatggtgaaaacctatctctactaaaaatacaaaaaattagccaggcatggtggcgggcacctgaagtcccagctactcaggaggttgaggcaggagaatggcatgaacctgggagttggagcttgcagtgagccgagattgcgccactgcactccagcctgggcgacagagcaagactctgtctcaaaaaaaaaaaaaaaaaaaaattgaacaacaaaaaagattatatcatctgcaaacaaggataatttgattttttcctatccaatttggataacttttatttattctcttgtctgattgctttagctaggacatccagtactatgatgaataacagtggtgacagtgggcatccttgtcacgttccagatctttgaggaaaggttttcagtcttacctcattcagtatgatactagttatgggtctgttgtatatggtttttattatgttgaggtatgttttttctatacccagttttttaagagtttttattataaaaggatattaaattttatcaaatgctttttcagcatcagttgaaatgaacatgtggtttttgtccttcattctgtttatatgatgtgtcacattgatttatttgagtatgctgaaccatccttgcctccctgggataaatcccacttggtcatgatgaatgatctttttaatgtgttgttgcattcagtttgctagtattttgttgaggatttttgcattaatagtcataagagatatacgctggtaggttttttttgaatgtgtcttttttctggtttgtggtgtaaaggtaattctggccttgtaggataagtttgtaaatattcccctctcctcgtttttcagggcagtttgagtagaaataatatcggttcttcttcttcttctttttcttttcttttcttttttttttttgagatggtgtcccgctctgtcacccaggctagaatgcagtggcgcaatctcagctcactgtaacctccacctcccgggttcaattgattctcctgcctcagccttctgagtagctaggattacaggctcatgccaccacgcctggctaatttttgtatttctagtagagatggggtttcaccatgttggtaaggctggtcttgaactcatgacgtcgtgatccgcctgccttggcctcccaaaatgctgggattacaggcataagccactgcacccggccatgttacttctttaaatgtttggtagaagtcagccagtgaagccattaggtcccaggcttttatttcctgggaaacttcttatcatggattcaatctcattattgttatttgtctgttcgggttttggatttttttttcagggttaaatcttggtaggttggatgtgtctggaaatttatcaatttcttctagatataccaacttattggcatatggttgcttgtaatagccattaatgatcatttgaatttctgcggtattgtttgcaaggttttcctttttaatctctgattttatttatttgggtcttctcttttttttttcttagtgtggctaaaaatttgtcagttttgtttatcttttcaaaaaaccaacttaatgttaccttcatcttttgtatttttttcatttccatttcatttatttctgctctgatttttattatttctattcttctactaattttgtgtttgagttgctcttgcttttctagttctttaagatatgttgttagctgaattatttaaagtttttctgcttttttgacataggctcttattgttataaacttccctctcagtacagctttcactgtatccaataggtttgggtatgttgtgttcccattatcatttgtttcaagaaacttttacattttcttcttattgtctccagtgacccactggacatttaagagcatattgtttaatttccataagtttgcatagtttgcaaaattcctcttgttattgatatctactttttctaatttgaattttttgtttgaaaggtcacatatctgtcccggattggtccctggtgccttgtttagttcattttgtgaggtcatgattttctggatgatcttgatgcttgtggatgttctttagtgtttgggcactgaagagttagatatttattatagtcttcacagtctgggcttatttatacctgtttttattgggatgctctctgggtattcaatgggacttgggtgttgttctataagcagtacctgcattagggggcactccaagcccagtaacattgtggttcttgtagacttatagaggtaccatcttagtggttttagataagagccagaagaattatctgaattatgaggcagagactcttgttatcttcccttactttcttccaaacactctctctctctctgtgctgagatgcctggagctgggtgtaggatgatacaaacaaccttgtggccaccatcactgggactacactaggtcagacctgaagccagcacagcactaggtctcatccaaggcatgctgtattcactacatggctaccatctatgtttggtcaaggccctaaggctatacaatcagcaggtggcaaaggcagacaggcttgtgtgcttccctttaggatggtaagctccacgcagcttcaggtgggtccaaagataccatccaagagtcagggactggagtcaaaaaactagaaatctatctggtgctctattttactgttattaatctgatgctcaaaccacaagacaaagtccttcccactcttccctcctctttccacagtcagaggagcctcttcctatggctaccaccatcacaaacccatggggaatactgccagcctattgctgatgtttacttaaggcccaggggctcttcagtcagctcgtggttaatgcttctaaatctggaactcacctttcagggcagtaggatcccctctcacccacaccaggtcaagaaatgctacccaagagcctagtcctggaattggggacctcaaaatcctatttggtattccactcctctgtggccaagctggcacctaaggtgaaagagaaagtcccctttacttttcctgcttttttcaagcagaagtagtctctcagcataactactacaactgggaatgtgttgggtctcacatgaagccagcatgtctccgagtctcacccaaggcccatggtgtattgctgctggttcttcacgggccaagagttcttaagttagcaggggccaagagttcttaagttagcaggcagcaagagttcttaagttagcaggataaatcctgccaggactgagtccttcccttcaaggcagcgggttctcttctggcccaccatatatctatatatgttttccaggggctggggcctgaaatggaagcttcagaactctgcccagttccctattctactgtgactgagcttctatccaggatgcaagacacattcccctttattctccatctcctctttttaagcagaaggaaagagtcactttcattgctgcaaactgcactgccaagggttgggggaggggtagtacaagcacagcctcccagctgatgtctcagtaggatgtgtgcccctacatccactgattctgtgtccaacacagcactcggacttgcctaggaattgtggttcttgtggcctaaactgcctttcaagtttatttagcaccccagagcactttagcctgcagttgcaaggcttgccaaaactcaagttctgacaactgggatgagcaatgggcaattccctttggctaaggctggtctaaatgctccctctatggatgagcaacagctgagtttagcctggttttactttccactgtgacagggcagcgctgacttcaatacaggggctcacaattgctgcattctccttcccccaagtgaacagattctctgcatcatgtggctgctgctgcttctaggtcagagtaggggaacagaagaggggtggtgtcagctattcaagtccatctgtcctacccccttcagtttctctttctgcaatataaagtaaaaactaggtactgtgattgctcacctgatttttggttcttatgaaggtgccttttttggtgtagttgttaaatttggtgttaccacagggaagacaatcagtgaaggcttctattcagccatcctactctgccaacctctgaaggaatttttatattaaattattgactttccacacccaatcctggccatttgtcttcagtttctcagtacatatattcatcctcctaaactgttccttctacttaatagcattataatctatcgctcttcagaactagaaaccttcttatttactctggccactttcttgttcaatgtcatcaaatcccattgattttagttcaaatcttcatcatcagttgaaccttctgcattcgtaggtagattccactgctaagcagttctagaccttagtaagttgccttatctctcaatatctcgtttcctcacctctaaagtggagatgatagtaagttctttctcattggtttatgatgctgattaggtcaaataatgcaataatatgcttagaaaagtgcctagcacatattaaaataaattctatctatgattatattatcataatttgctagactgtttaaaataccttcctttatcattggcttggcatcagtgtttgaattggaacttgtcttcctgaataaaaccaggattctctttgcaaaaccaggttctaattatgctactatggtctaaaagtcctcagtggttcctagtgcatgtataataaagtctgaactgttaccaagacgagcagaataataaaaactgaaattattgctccagtcttatctctatatatcagccaactttgcaccacggatgttgcttacttttaggacatgtagacagacaagactcaggctctcatgagttacacgctgtgctgggactacactgagtcctcatgtactttgttgcatctaaggttttttcacagtcctctttctgccttgaatatccacttgcctcctttgtatgtctagtgtatgtgaactcaaccttctaagacctatttagatgactccctcattttgaagccttttctatgattcaagtacaggcaattgtttgagcattagagtttccacagcacttcacatatatttctattatggcactgaacagcctgatacattcttgcttgtttgttctttacttccattatcctgaattataaatgcattgaaaaccatggccttggctgggaggtgggtaagggtatgagataaatctaggctatgcattgttccaggtatttttcttatgctgttccatttaatcctcacaatgaggctataagaattaatgagcccaaagtaaatttaggaggttaagttacttgttacagttatgaagtataaaaattcaagctagctgtgaactagggaggcaactattctttcaaaattactgaatgtattgcatagatatacaaagtttttttgtataattgacatctctacttgtcttcaccaagaactagccttttttatcctgatgatgagaacacacatttatagtagcttctctacactgagcagagctttttaatggtcatcctcagaaatccaggattgcacacatctgcctctgagcctgctttggaaagtagaaactacagcctttttggctttaatcctctttaagtggtgaaactattgtctcatttgtcttctatattgggattcctttatgtttcttaaacaaactatgcagtttacaatatttaaaattcactaatctatagcatttttaaagcttatacctcatcataattcccaaataatatttcacccgaagccaaccacaaataagtgataaatcaatttttaatttaattcaaacttaatgtaagttatgccaaaccattgtgaaaggccagagggtcaaatcaaagggttggagaatgaagttttttgactttcaattttaccccagtctggcttgtagctccaaaaacagggcagctgtatggcagagggaaagtgaccacctagatcaccagggggaggaaggaggacagctggaagctcattcacccagactccacttttgatttctggggaactttcagtataaacttagtggccacaactgaatgcagtacatgtagctttcacagcacgacagatcagctctctggatctattttcatggtttctgctcactttgccatggacagtccttctctttaataaatctgatgttgctgaatgggtgtgcaatttcccatctcccatctgaggctagctcaggaagagatttattcctgcctatgtggtcaagcagccctgcagacagcgttaataggaaaggtcacttgatgattggctgccaagcagctagttcttcaggccatatccgctgctgctgcattgaaatgtgttcagcacctcttcagggacagaggcattaaagttaaatgttatagatgtgaacggatggcagcgagcatttgggcttgcaaaagagctctgactcgggatgaaaatgttgcctgtggtgacagaatttattttccaagcacaaggagtttttaaggataaaaagaaaaggaaattaataaatgaaatttgcctgcctctaaaatccgaccccatcctacctgtctagctttatttttcctgatggagagccacatctctggtctcctctctgaaagcctgtatgcatttcatatctggttgaaaggcctcctcctctgcctcctttctgtccataagctaaagactcaatggatattggtaacttgatttgtcatgcaattctttgttgttgctgttttttttttttttcaaagtcaaggctattgattttttctcattttaaatgcctaccttccacagagctttcttttattattaaagttattatcattttttaatgtgaggatttatggagtcacatggcctaggaaagatagaactacccaggccgtgagattcatatcttaggacccactgagatcccacattgcaaaaatagctaataacatgcaaccggaattggcaatttatagaatctccttgtcagagctgtaagagaccactgatataatcttttctaactgtctggtgtgattaatgagcaaattcttttatgttcaaaaggagattatctgccctttatgaatagggtatacactttatctgattttctaaaaatagatatggttaaaactaagaaacccatagactgttatccaggtatttttgcaatcaatactttaaatttgtaaagtgaatgattgggattttccaaaatagaggtaaaagtatagaagggtgtagtgataaatctgaaccaaacttggtcagagtcccaacagtaaatattaaaagaaagtctccatagataagtagtgagtatccatcagtttgaggagcttgtagcatggacacaaccagaattaatgttgttcccagcaggactcttgtttttgaaagtgggtatgagaataaggctggggcccagttgcaaagaagcaagcgtgcattcaggtttcacagtaagtatataaatgttccaagtaatgagaaagacaccattgttagggataaattatgagaagaacattcatcaggtttgtaatttccacatactccctactttgtgtgccagcatagtatggtcctagacaatacattgtacagtggcatattcaattttacagaaaagacaaagatgactttttggctttggttaacccagtatttcccaaactcatctttaaccatggttctcgcgtgtgtgtgtgtgtgtgtgtgtgtgcgtgcgtgcatgtatgatatgcctattaaccactcacagaattagcatgcaactaaatcactttggaaatgcagatctacaagtcctatgttttaactgccttgtggtctggacttgaagttctagtcctgagagggctgaatggcttcagctatgggggttacaatgcacatggggcaagtgactaggcagactgagatgaattgagtaaaggtatacctgcagaaattcatatatttcagtatacattgaggaagagatataaataaggaaagtaaagatgatgatgagaagacaatatttctctacggataaactgagtaggtaaacctggtggatgtagttgaatgtggtaggaaagaaggatcattattttgaacatggaatggtaagtataaaattgtattaaaggataatttactgtgatgtcacatacgatgaagtgtaagaagaaaaggtagaagataaggcagccgaatgacatttggttgaactaagaaagcatggaatgatatggatctgaaattgggtgatgacattttgaatggaaccaaatgtaggaaggaatgaatgaaagaccagatgtggtatctaccatgatagttaaagaaaaaagagttaaagattattttggaatttagagccccagtgattagagaagtggagggttttgtaacagaaatgatactgttccacaggtaaccaggacttgaaatctcatacgtaaggaatgaaggaaggaaaaatcatctctctgaggagatctctctgaggagatcagcagagataaataagtatgttagtaaacaagttcagagtcataattataattaaatgtcgcagcatctatataaaagtgatacataagcaatgttatgtgttggtttagattatccaaggtttttttactattacagaatgtctgtgttgaccatatggttatgccatgaagtgcgaattatagccaacttcttttccttcttttagagtaaatctttcttttttatttcttgatgtagaccaattatgaaatttggaaattgtttttaaacacattattgtgcttttatgggggtatagcttgaaacatgttagagggatgtaccatctttgcaatctttaaacaataattttggaaatattttcatccacttacacaattaataaactaaaaaatttcgaacataaatttctccaaatatttaaacatggattgaaaacttaaatgttttataacttcatatatcagtttctcttaaaggctttaaactgcttaaaagattataaaagccgatttagctaaattaacttaaaaattccagtagtcataatggaattatgaccacttaacttattggccatagagaagttttgataggagggtatctgtcagatgtgtggggattttgcgctttagcatgtggagtagtatttagtatttttgctctttagtatgtggagggctcctcagacattggcgagagaaactacactctgggtcttttccacattgatagtaagctcctggagacatgttaagctggttttatgcttagaccccaaagtggtgtgaaaataacttaaaacatttaatttagtcaaataattagtcaagaagcaacttttcttatgactgttaagtatctgatcatttgcagatatttaactttttcactaaaaataaatgctcatttaactgaagtgcatttgtgtaaaacacaattgaatgtgtttgccttcctaagaatggacttataattacaaattgtataaaatgagaatgataggttagagaacagataaaagcccttctgccaacagatgcacagtgaaaattattccaagattgaaaattagtatatatcctggctctcttgtcacttcctggttgccttttggtgtgaaatttcaactttctgagtcctgatccctcatctataaaatgaaatgataactaatgtcttacatggtggtgagggtgattaaatttgataataaatgtagtagtacatgcacaatgcaagtcaatatgttatcatcctatgctttgggtagctaacatgtagaagtatgactagataataattataacagctgatgagactttatttctccaaattcaagatgaacttgaagtgaatatgaatggataagaactattttattataatataagatgacttctatggagggtgaatggtcagaagtaacatcagtaattcttgtttgttttttaggtgtcataaactttctaagacagtgccttgcctgaagactatgagtttctgtgcatcctaggacctttatggaaattagataatttttgatgaagttaaacaattatattataagaaactcctcaaatcaagaataaataaaaacaagagtagcattaaaatttactgcagagtacattaatacagttcaaatctaaatgtctgctcttgcatttctgtgacttttcatgccatgctgaaaatctggaatggaaactctcatccatcttggtgatttcctagtgccctgaggatgacttcatttaaaagcatttgaagatttaagttctttctgagatgtgctcttgttttcaggaataaaagtgacattatgatgagttactacgaagtccctattcatttaccagttttaggcttccaaaaattagctgtcattttcagagtttaaattctttagcttataaaatggacttgtgtggggctcaatgactaatattgtgtagtttacctcccacatacttggtgctctccctttcacctatgcatgctgtcttttctgcctcaggtgcacttctgcaaaggttcagacaatcattgaggtagtggagaaaggtcacgtaaagtccttgagggttttgtcagaactttggctttcgctttgaataacttgaggaatcatcagatgtttttgagcagaagagtaagatgatcttcatttaaaactgtaactctagctacagtgtaaagaaaagatggtgagggacaaggttggaaataaagactagttgggaaactactgaattagcccagctgagggacagtggtggctggagttggtgtactatggagattctggatgtatttcggagttggggccaaagatattgacagattgggtataagaatgacttggagattaacatgattaaaaataattttggactgagaaaattgaaaagaatggaattgtgatttactgacaagggtataactgatgaaaaccaggccttaagagggggatgtcaagagttaggatttagacgtgttaagtttgaactgcctattagacatccaaataaggctgtcccttgtgttgtgggatatgtctgtaatttggagggtaaggtaaataaagaggacaggcaaaggtgggcaggatgctattttatataggattataagggaagacttctttgtcactgtaacatttaagaacagacttgaagaaaagaaataaattaataactaaaactatcaatctaggacttctgggggatctatgtagttttttgtagccacttgactgaatgagattgcctaggcagttggtgtaggtagagactaaacaagtccaaggactgagccatgggactctcccacatttagaggttggaaaatttaggagcaatcaacagaggaagttgaggagcagtcaatataacattaggcaaaccatgagggagtgatgtcttagaaacgaagtgaagaaagtttttccagaaagaaggaatgaagcactgtgacaaacactacagagaagttatataagatgagaactgagaattgaaaatgaaattgggcaatgtaaagatcgtcatgattttgatgggatctatttctgtgatctgggctcagcttatgagcccagggaaaacttcttgtttctcattgtgtatgattcctggtaagcattatttttcatctttagctactgggttataaagaataactttcttttacatcagttaaaaggattagagttgtgggtacccttggtagactagtaatttgatgccctttcaaaatgatattattgaaatagttaagatgaggaggaacttattttaatgtaccatataaattggcccccaggcagctgctcatctagctcactccttaacagagctctgatccaaatggccactcatagtgacagatggttgaagtagtatgagtgcatgggaggtggaaggagcaatgggccaataatcaagagatgcggaccctggcctgggccctgtcactgcccaactcttctatctgcaactattagcaagttatttgatctttataggtagtaatgcttcttagaattgaattaaataatctttaatatcatctttaaattctaaaaagaaggcactttcattatcaatcatatatgtgtattattgaaagagatgtagctgtaggaagaggggaaataacacgctgaagaacaatggtgaatgtctcttatatctaaaacgaatgctgcaaccatcttcgcagctgctgccagcccagaacacctgagacacattagttcatttagcagaggcttttacatcaccttcaggtgtccattgtgaatcccctgtgagactgatctagtaagaatgtcttgggctctttttgggagagagaaaattctctgtccctaggttattcttgcctggaaggctagttttaaacttaatataaagattttccagatgcagcagtctctggtttttctgactgtctgtacagctctaggtgtgaactatatattcctgccactttcaactcagtgcgctgctggctgctcagaatgacttaaaggcttgcatcccactcctggccaagctgatcgaaacactagttttagttatgacatgacccagttatggcataaacaatcctttatccacaaagtatacttaagcctcctgaggatggctatatgctaacttcataacctagagagggcaacaatacatgctgtgtaaacacataatattgtaatgaattgaactgaatttattagaatccattatgtccctcaggaccagaaatgttctggctaagaagcaagagtcacatagatgattttgccagaccctagcacaaatagaaatcaaataatgtgtgtcaattgacctgttaaactgaatttcttccatggagacatattttatgtcttaattggctcaaaataaatgtattacctcgttgtctaggtaaggattctttgttaatgtctacttttccttatgccctattctatccaaacacatatgattcttgaccagtgcatttagcaaatatgggaattgaccattttcaattgttttggcattcatgaggatgttgataaaggtaggggttgggggcagagctgattctttaatgattttctgcaaatgaacataggctaagttacaacagaattaatgtgaaattaaatattacagtaaggctattatcaaaagaggtcatggtgatgaatggcgtatttaaatgagaccaccagaaggaattagagctgaagcctattaatcccagtcagtctgcaagactccatttttatgcagattaaactatatttcaggttgataaatcatcatgacatactctgtgacaagagccaaatttctttccctttctttatttctgtgtggttagggctacagcagggtggatacagcttagtgagaacttccctcactaatgggcagcactgattgagatgagtggcagatgatcatttggttcatattgttggacctctggtttgacttccttttcttttaggatgacagccagtgaatttggagctgccaacaattgcagaattatttatgtggttttgtgtgtgtgtgtgtatgggtgtgttggcactgtgtgctgttcttactcctgctgcttttccttaggaatccagctgcatttcccagattttctttttctgtttggaaaaatcttggtgccactaatatattttcccttccttaaattaagtgaaatttaataaaatatttccggaaaaactggtgtgctttatttggaggttccaattaaaccattgtaaacataacacagataaagtccatgttatttgcccaattgaaaatagttgctccagaacacgtgatggaaatgggatgatggataacacagctgggagcaagggcagctagcttagccctacactaaccagccctctgaccttggacaaatcactaaaattaaaacctatagcacagtacattgtgcatgataggttctcaaagaatatttagtattaggtggagtgtactgaactcctctaattccagacttccttctaaattaggcagcatatcttgcatggatggaaaatgtgacagctgcaattgacccacctgcctacaaaaatagcctgcttgctctcactcgtctcgacaaattctcagtatgaacaacttcctagcttaatttagcattatttagctttttaaagtttttgagaatgccttaatctctttgatagtagtagtccctgcagcctaggaagaacaggcatcgttattcgcctgaggaagagccacagcggcagataattgtggcttctccgaagcgaagcacaattctagtgcttcagctctcctgaagtacaagaactctgatctccaatgtagagggctgtgttctgtcctgtgttgctactaacccaggttgtaactgtttccttgcaaaacaacttggagggtaatattatttcatgagaaaaaaaaatggccaatgataattaattaccttttggtcctgagggccatggacatctgagagggattgaaatcggggtttgccccggtatcccttaccatcattgttgcttgggtgtgcttcttgccactttccataccgctgactgacccattgagcagcgaatgggctagggaaggcaggaaattggcttgttccccagaagcatcacattgtggttgtagcatgacccagttatgtcatgagcagcatgtctcacagagggaaatagcctggagcctggccagggcaggagagaagccacatggttggtgagtactggatgctctctctgtggcaggaagcagcctcctagctgtgtgccatcttggaagcttgcaatattgccaaaacaaaggcagggccttcttgtttatagaggaggtatctttataaggactattgtaattctccactaaacatatatgacctctacctgatatgggtatccgagattcccttgttagagaacaaagacttttgattctattgctggagactaggcatagagtgcaaaacccctggtacagagaacatgttgagtttaaagttatgcacatcagggcagtgtacatgactggttgcactaacttcagaaggagggtgagagctgggattcccaggcatgtaaacacacacacacacacacacacacacacacacacacacacacgcacacttctacatattctcttgtttttcttatgctgtttcctctgcctagaatcttactatggctaatttctagtcatctctcaagacagggctcggagcttactcaccttgtgaagtattccctgtttctcatcctgttgcctggtttgactttaccctctttctctgggcttctactgtaccccatgcatgtttctactgtgacatgtattatgctatattttcatacatcgtttttctcgagcatgttcatagatgtacctttatagaaagcattcttttgtgtttaagttttgagactgtatttgacttattaaatttaaaaatgtagaaatctagttctggggacatcatttttatttttatttatttatttttagttttataatttttattttaatttttaaaatctttaaagttccgggatacacgtgtgggatgttcagatttgttacacaggtaaaggtgtgccatggtggtttgctgcacctatcagcccatcacttcggtattaagcccagcatgcattagcgatttttcctgatgctctccctccccagccctcatcaccatgggcaccattgtgtgttggttccctccctgtgtccatgtgttctcattgttcagctcgcacctataagtgagaacaactggtatttgattttctgttcctgcattagttttataatttttaatgtatttttttattatactttgagttctagggtacacgtgcacaacatgcaggttttttacatatgtatacatgggccatgttggtgtgctgcacccattaattcttcatttacattatgtatatctcctaatgctatccctcccccctccccccaccccacaataggccctggtgtgtgatgttccccttcctgtgcccaagtgttctcattattcaattcccacctacgagtgagaacatgcggtgtttggttatttgtccttgcaataatttgctgagaatgatggtttccagcttcatccatgtccctacaaaggacatgatctcatccttttttatggctgcatagtattccatggtgtatatgtgtcacattttcttaatccggtctatcattgttggacatttgggttggttccaagtcttcgtcattatgaatagtgctgcaataaacatacatgtgcatgtgtctttatagcagcatgatttataattctttgggtatatacccagtaatgggatggctgggtcaaatggtatttctagttctagatccctgaggagtcgccacactgtcttccacaatggttgaactagtttacagtcccaccaacagtataaaagtgttcctatttctccacatcctctccagcacctgttgtttcctgactttttagttatcgccattctaactggtgtgagatggtacctcactgtggttttgatttgcatttctctgatggccagtgatgatgagcactttttcatgtgtctgttggctgcataaatgacttcttttgagaagtgtctgttcatatccttcgcccacttgttgatggggttgtttgtttttttcttgtaaatttgtttgagttcttcgtagattctggatattagccctttgtcagatgagtagattgcaaacattttctcccaatctgtaggttgcctgttcactctggtggtagtttcttttgctgcgcagaagctctttcgtttaattagatcccatttgtcaattttggcttctgttgccattgcttttggtgttttagacatgaagtccttgcccatgcctatgtcctgaatggtattgcctaggttttcttctagggtttttgtggttttaggtctaacatgtaagtctttaatccatctggaattaatttttgtataagttgtaaggaaaggatccagtttcagctttctacatatggctagccagttttcccagcaccatttattaaatagggaatcctttccccatttcttgtttttgtcaggtttgtcaaagattagatggttgtagatgtgtggtattgtatctgaggggtctgttctgttccattagtctgtgtctctgttttgctaccagaaccatgctgttttggttactgtaacctcttagtatagtttgaagtcaggtagcatgatgcctccagctttgttcttttggcttaggattatcttgacaatgcaggctctttattggtcccatatgaactttaaagcagtttttttctaattctgtgaaggaagtcattggtagcttgatggtgatggcattgaatctataaattaccttggacagtatggccattttcacaagattgattcttcctatccatgagcatggaatgttcttccatttgtttatatcctcttttatttcgttgagcagtggtttgtatttctccttgaggaagtccttcacatcccttgtaagttggattcctaggtattttattctctttgaagcaattgtgaatgggagttcactcatgatttggctctctgtctgttactggtgtataagaacacttgtgatttttgcacattgattttgtatcctgagactttgctgaagttgcttatcagtttaaggagattttgggctgagacgatgggattttctagatgtacaatcatatcatctgcaagcagggacaattcggcttcctcttttcctaattgaataccctttattactttctcctgcctgattgccctggccagaacttccaacactatgttgaagaggagtggtgagagagggcatccctgtcttgtgccagttttcaaagggaatgcttccagtttttgcccattcagtatgatattggctgtgggtttgtcataaatagctcttgttattttgagatacatcccatcaatacctaatttattgagagtttttagcataaaggctgttgaattttgtcaaaggccttttctgcatctattgagataatcatgtggtttttgtctttggttctgtttatatgctggattacgtttattgatttgggtatgttgaaccagccttgcatcccagggatgaagcccacttgatcatggtggatgagctttttgatgtgctgctggattcggtttgccagtattttattgaggacttttgcatcgatgttcatcagggatattggtctaaagttctcttttttggttgtgtctctgcccggctttggtatcaggatgatgctggcctcataaaatgagttagagaggattccttctctttctattgattggaatagtttcagaaggaatggtaccagctcctccttgtacctctggtagaatttggttgtgaatccatctggtcctggacttttttggttgataagctattaattattgcctcaatttcagagcctgttattggtctattcagagattcagcttcctcctggtttagtcttgggagggtgcatgtgtcgaggaatttatccatttcttctagattttctagtttatttgcatagaggtgtttatagtattctctgatggtagtttgtatttctgtgggatcagtggtgatatcccctttatcattttttattgcatctatttgattcttctctcttttcttctttattagtcttgctagtggtctatcagttttgttgatcttttcaaaaaccagctcctggattcactgattttttgaagggtttttttgtgtctctatctccttcatttctgctctgatgttagttatttcttgccttctgctagcttttgaatgtgtttgctcttgcttctctagttcttttaattgtgatgttagggtgttaattttagatatttcctgctttctcttgtggacatttagtgctataaatgtccctctacacaccgctttaaatgtgtggggacatcgtttttagagttaatgaaaaagaacacaagacatctatatattcattaactgaaatcaattttattgtccttcctatatttcataatagggttctcataacatcctggatatggataaaattcaggtcccagtgttcccatgctactctgagccatttgcttgtatctcatacccccatgatgcaaggaaccatgtctcacatgaggggaactcatgaagacttgtcaatgggacagaaggaccctccaacctgagagtgaggttctcttttactccagtgtcagaggttgcttggctctctacagagattcagctggacttctagattcacaattgaatttagaaacattcagaatatagctatgcagtgatatatgtagggagaagatagctgttgagatgcttatgggtgaggtagctgttcctctgagagggcaagggaaaggagtggccatgggggtggggaggcaaacttagcctcccacagaagccattattctgtcccttcacaattataactgtgatatccactatcctaatgagtcagctgagtctctgtcctgcaagttcatagatttggctgccccatgcctgggtaccaaggcattctcaaattgtgattctaaaattcctaggagttcgaggcttaaccctgatcacatcaccagtgctaaagtaacatgacatgattaattcttctagacctctgcccttactctaaacctagctgttccactagccaacccatcacactactgtctcctctatcagatgattcatactccatgcactgatattgttctagaatgttgtggaaagatctttggctcaaatataggaactaaaaaagtcccatcgttggttctcatgtcacttggctgtctacatgcatcgattttaggagtccaaatcttacttggctctgagtctttgttctctcacttccttaactgaacttctgatctgtgtcttagctcactttctggacacattgtctggcctatctgacatacaggatttttataaaccaatctaaataccatcagaaaattgtaaaggagagagcgaattggtgagaagagtggttctcacagtccggaaactaattttcaattgactaccatagttccttgatcctgaaaagcgcacttgttttctacaattgtgtatctctgaaattaaggtgtcctgtaattaataattaaatctaatgtagaaagtatctttctttttttctgaaaaacttttattggatcagtgtgttgaatctgtgctcaaatctaagaatgaagaacgaaggaattattatatgcctgcaaatattttggttatgttgatttgctagccctaagggcattaaggtatgttgtacagctaggaaaagtgaaatgagtaaagagaagaaaatcagggatcagccagggagcatagggctagtttttcattttgacctccaattctttcataattatttgctctgagcatctgggcctcattccttgatcttgtatgcctcaggctgcttctttgtctttgtggttgaggttagtggaggctgtgtctgaatttaatatcctgctttcttatagcgagctgatcctttcaaggcacaggtaattcagcaacacccaaaatattatttgcatttgtggggattgggggcagagttcctatataccagagcaagtgctttatgggtatatacattttataatttaattctcagaacaaacctatgaagtggtattttctcagttttacatatagggcagcaggcctaaagatgctcagtaaattacctgtttttgacccaaggaatttgcaaagaatttaacaatgttaatctctgaaatccattttatggcattatcctgaccctcaatagacctttataccaccttaattggatattgtgaagatgaatatgttcacaatctctcccacatatgcatgccacacacacacacacacacacacacacacacacacacacagtttatcagcaactttattgaggaaaagtttaggtctggagacaggaggtagggatagaaaagtacctggtacatagatatggagaaaggaattgagtgcaggccagagagcctgcagccttcagtactgggttagaacagctatgtgcacacacaataggaagccattgcaatgctgaaaactgaggaacaaggaaggattctgagaggtcatctaatatctttcctgttttcagacagctccagatttaagctattctgaaagcatttatgtggaatttgaaatgaaatgtagctgcttagtctttaatagaagacaaacaaaatgcaggagcttgtgggtcgattctgaacaaggtatctttttttaatgcatcacactggggggtgaacacatatttgaaagggcttagaatgcacataaaggctctgtactttgaccttgaccaatgccagagaatgcaaatccccacagtaagaaactaccacccagaactataaataaaaagaaaatgagaaataaatgagctacatgttggtattttgtgacaaatcccccagattgatgagaagaataccacacaaactcatcctggaatgttgagatccataacatatgtacaaaatgcaaaagccactcttcttaatgcttctttatgggctgcttctccatggggttgtcctgaaaaaaatgtgttttgggaagtaaaagagaaccttcactctaagatcttagttctgcagtgcttaaatccctctcacagtgacaaacagagaccataactgatgcttttgaagttaggtttaatctaagaaaagattcttaagcttttaacaagactctggatagaatagctggatcaggattttttttttaatatcatctgaatgtcactgaacaaagcatttggagatggaggaagcatagggcattattaactggaggaaaagtgatgacttttccctttttgttcattcttaataaattatgtgctttcagctaaaataaatggggctcagtattcataaccatttcacacttcacgttaactcttttttgttgttcctcagctccctgagagccaagttctttatgaaggcttgtttttattacctgaattaatctagagttctaggtggtaaagattatcccctgaaaccgtgaatgagaaaatggatataggtgaggtgcttttcctctgctgcttatcataatttacagtgatctggattgcaagttttaggggagattttgtccagttgtttgttggtagatgtttaacaactggctctccagaaaagaaaaataaataaataaaaagagaaaaaaatccccactgataaccgtgtttgacaatttcgttggtataaatactctaaccaatgttgaattcaacctaccagtgccttaacaactggccaaattttgccaattggcagttgttagtgctgacttcaacctttcattatctcttttagttttgcttctcaaaatcctctcaatcaaaattggaaagatcatttgaataagcagaaaccaccaccaccatcaccaccaccacactacattaagtcaagcaaaatcacaatgtacccataagtatgtgcaattatcgtgtcacctacaattttttaaaaataaaacatttaaaaaagaagtcaaactgaatactgaaccctgtaacacatcactagggaatacagtatgtccttatttaaacttgcctataggtttttggatatactgtatgttatagaaacttaactcttatttatatcaattagcctatggtaaaattatttctttaatgcagtacattgtttcacttgaagtcaaacttttcaaaaacctattgacaatgttataggaggactcactgtataccctagtttacttttatgtctatttaaggtccacagagagtgtattaaaaatataagcccagtcctcacttctggatggctgtgaataataaaacataacctattcttctttatgtttttttttaagttcaaccaatttttacataaacaaaagtgatttattgcctttaaccaaaagtctgtattttggcaggaatattgagttcatcattgtacagttctaacccatgagtgcctgcttactatgcctgaaatattctcttgcattttctgcctgtcacagatgactctttgtggtcagcaggcaaaaaagaacacaagatacttagctggtgaggtaacatgttgattttagctttgaccttttaaacctcagttagtttttattatttggtttgttcaggaatgaggctaacattcttgatgaccattcattcagtggtcagctagggcaataacattgatgctcctgtaattgccaaacaatggaaaggaagtgatgaagaatactcatggctggaatttaggcagctaggggaggaaggtacagtttggaaatgatggctacttggttcgtgttagcacaagagtcaggcaagagagcatttagggagaaattagaggaataagattgcatgtgtcagtccaggataacatagtctagataaactttgtgtctccagtcctaattattaacttaatgcctttccattatctctttggcttggaatcatggttatttccatggaaaatgggctaaaatatcagggcataaataaggagagtctatatgtgttatcctgatagggtggtatgttagtttattcttgcattgctataaagaactacctgaaactagatagttcatattttaaaaaggtttaattgattcacagttctgcaggctatataggaagcaagcttggaagggctcaggaaacttacaatcatggcagaagttgaaggggaagcaggcatgtcttatatggccagagaaggaggaagaaagggaggggagaggttccatacacttttaagcaaacagattgtgtgagaactcactcactatcatgagaacagcaagggagaagtccacccttgtgatctacattacctcccaccacaccccctcttcaacaccggggatcacaatttgacatgagatttgactagggacacaaattcaaaccgtatatttgcaaccctgcctgttcccaaatctcatgcccttctcacattgcaaaatgcaatcaactattctcaacagtcccccaagtcttaactcatctcattatcagtattaacacagaagtccacagtccaaattctcatctgagacaaggcaagtcccttctgcctgtgagactgtaaaaaccaaaaacaagttaatacttccaagatacaatgaagatatggggattggctaaatactcccattccaaaaggcagaagtaggccaaaacaaagggctacaaaccccatgcaagtctggaaccaagcaaggcagtcattaaatactaaagatccaaaataatctcatttgactccatgtctcacacccatgtcacactgttgcaaggggtgggctctcaaggacttttgcagctctgtccctgtggctctgcagggtacagcccctgcagctgctttaaaaggctggcatttagtgcctgtggcttttccaggtacatggtgcaagctgtaggtagatctatcattttggggtctggaggatggtgaccctcttctcacagctccactaggcaattctctagtggggactttgtgttggggcttcaaccctacatttttccttcacactgccctagtagaggttctccatgagggctccatccctgccgcagacttctgcatggacatccaagtttttcctttcatcatttgaaatctaagtggaagctcccaagcatcaacttttgccttctgcctgctcacaggcttaacaccacatgaaggctgcctaggcttatggtttgcaccctctggagaagaagcctgaggcatatctggggcccttttagtcacagctagagttggagcagctgggctacagagaccagtgtcctgaagttgcatagggcagcagggctataggcctggtcctggaaaccattcttccctcctaggcctccaggcctgtgatgggaggagctgccacaaagttctctgaaatgctttcaaggcattttccccattttcttggctattaacattcagctcccctttacttatgcaaatttctgaagtgatttgaattcctctcccaaaaatggggagaggaaatctacatggtcagactaaaaatttcctaagcttttattccctgcttccctttgaaatataaattccagttttagataatctctttgctcatatatatgaccatacatgaaggaatcaggccaaatcttgaatgcttgctgtttagaaatttttttctacctgctaccctaaatcaccactctcaagttcaaagttccacagatctcttgagcaggaacagagtgccaccagtctctttgctaaagcttagcaaaagtttcttttactccagttcccaataagttccttatatccatctgagaacacctcagcctggacttcaatgtccatgtcactatcgcactttggtcacaacaatttaacaagtctctaggaagttccaaacttaccctcatattcttgtcttcttctgagccctcctaactgttcaaacctctacccattacccagttccaaagttgctttcacatttacagttatctttatagcaatgccccactttccaatacaaattttctgtattagtcagttctcacattgctataaagatacctgagaatgagtaatttataaagaaaagaggtttaattgactcacagttctgcaggctgtataggaagcacagcttgggaggcctcaggaaatttacaatcatggcagaaggtgaaggggaagtaagcatgtcttacatggccagagaaggaggaagagagagaggggagaggtgccacacacttttaagcaacaaaatcttgtgagaactcactcactatcatgagaacagcaaggaggatatctgcccccatgatccaattacctcccatgagccccctcctccaatattgaggattacaattccaaatgcgatttgggcaggagcacaaattcaaactatatcaggtggccaacttgttcctgtttgtctataaaaatggaaaatctttattttcccattttagaactggaaacaccttgtcctggaaatgctttccattcccaggaaaacaggaacagttgataacctacatactgagcattcagatcacattcccatagtaagtgtatgtgtgtgtgtgtgtttgtgtgcatgtgtgtacttattaaatcagatttataaactactatatgacacatccatcaattaacattttggggtgtacaattgtttaatcagatattatccatctatttatgatttttcatcttgtcaaaaaatatgtcatgaggggcttgtttttctgacatcagaatataataaatcaatacatcagttttgccattgcaacagacacatcaaaaacgacataaatgtcataaaataatactttttgaaaatttgacagaaattaatattaaactctctgttcaatagaatatagaacctcctaggcctccaggcctcttttcaatttactatcatttactttttattttactatcagttttttgcttttaaagaatatgtggctttgcaatttaggcagaacttgtcttaaattttgtatcttccacttgtacaagtcataacctctatttcaagtcattctatctttcatttcctctataaagtcatgctttttagaagacttatatttaattgagataatacatgtaaaaggtttgatccattgcatatgttcaataaacattaatttacttctcctcattttttaaaagctagtactatgtttggccatatcctgttttataatcttctcataattcttttgtaataattgacagtggttttgtaataatataggtcaactagtgacatgacaggacagtaatttataaagcaaaacttttattctcacaatactaattcataaaatactaataacaaatgtatctgattactgtccaatgtgaggctaaggactgaatactattctgtgctcaatgaaaatgaaaacatttacttgaggtgtgaacatgcttttgatgagaataatgagtcctttctttcatgttcatattaaacaatttttgaatattatttaaatactggtacatcttaacaagctgactctaattacagtaaactaagtcaaggtgccagcccctgattgattaattacttggttgacttgactgaagtttgtcaaaattaactctcagtatatttgtagagccagtaatgaaaatgagtgcgggatactaaatacaaatactaaataaaataagatattaaagatatgtttagtttatacaaacctctcattttaaagaagaaacaaaaagtaaatgttagaagtaacagttccaaaatcacacagagaattagcaacaattaggacaaaaattaagaatcttggcatctaatcaacactgtctccacaacattttatattttaaaaaagatattcagggaggggcttgaaaacaatgtgtttttttccaacattctgaacacataaattttttcaagaaaatgcattgatagaatttttacttagatttatattttgtattctaaaattattaaatacagggtcactaattagcagagtgcaaggaaacaactacattcccatcggaacaattctattggaagattactctgctaactggtttttaggggttgttgccgtggccaattgactgctaacccctgcagacagtggtattatgtgataggtatctattcttactccttgtccagttacattaattgattgatgttgataaatctttatttaatcacatcatgagaaataagaaaaatggcctatttaagaacatcaggataacagccttttcccaatgtgaaccaagaggatcataactcaaaatatctacattatcttaaaaagtgatcttggtaatgaatattgtaattgaatttagtaccaatagccagaagaaaattgtacaaatttagttattaaaggagattatgtttacattctccaagagagttgttgcaaagttgcaatgataaccaagaaagtacagagagaagaaaaaaggatgcattactgaaattctcaatagaaaaaaatagactaacctggacctgagaagaacaagataaaggctgaggggcccacgagaaggatggtgttggggggatgttggggaaattcagcaaaaattggattttgggaggcagagcaggttatttgaaaaggttgggtcataaggagtatatattttagatgtgttaaactcttatcacatgcagttatataaacttatattactgaggtgggaaagttcagtagacagtataagtcatgggcattaagactaaagtagagaacgcagttgaagcaataggttcaggagccattggcatttgcgtgataccatattcccaccatgtatcaaaccctgtatattataataaattaccttgtcctgactccccaggaatttgctcatacttcagtagatgaaacagacaaatgaatcggttaaaatacagagtgacaaaaatcatggtaaaataatatataaatgtcctttgggatctagagggagaaattacctctaatttggtattagaatggaggatagaaatttgctcaatgcagaatggtggaagagcaggccagggagaaggccagagttggtaaagccatggaggtggaaaagaaaacacaaaattttgaaggactcattatggattcatcgtggatagcaaagggtgaatcaaatgtacatgaactgaagagatagcccgtagtgccttgtgaagggtgttgttagtcctataaagaattttgaacttgtttttgttggggaaatcattaaatcgttttcatcagagaagtgacatgatgagatttgcatctcaggaaggtcagttaggctttatgagaaatgaactagagggaaaaaagcagaagttagaaagactagacaagagaccattgcaatatctaggcaggtgatgatgatggcttgaaacaagaattttgagaattatttagggggtagaattagtagactaggtgaacgaatgaatataaagaccaggaaagaataataattcaaatcaaaaacacaggttgtggcatgatgggttcattcctcgagatagttgtaacaagtatccaagtaaagaaagaaggatgtgatcttgaacatattgagtttgaggaactcatgagaatcacaacttgtcaccttgacatatgagtttggaacaaagtagagaggcatgagatgaagtaaagactaggaattattactaagctttagttttttagggttttttttaaagcctcaaaattaaattaaatctactatgaagagcatgaagaatgacgaaagaagtcttcatgcaaaaccctgagaaaccctaacattataggcacaggtagagaaaaataacctgtaatgcatttagaggaggcatctatgtaggaagtaaaccagagaaatgtggtggtattagcttgaatgtagataaagtggatggttgactctaccttgaggtggaataatactgggtagatgtaataaaggaaaactggggcaaaaatttaaaaattatggtaagattgttgcagtgatcagaaaatggtaactaagagagtccaagaaagaaagacatgaggcgataaaaaagtgtcaaaccccagaaattctcaataatgtcaagatataggtaaagagagtaacagagtataagaaagataaagattgtggtaaagagtttttttcatatatgtacatttaaaaattctacaaataatgtatacatacatacttattgaaagcaattcaggacatacagaactacaaagaatgaaacattaaaatatctccttattgtcctcattattaacctttttcccaaagaaatcactcttagcagtttatttatccttttggaaaattcctatgcatttatacatacacatagctgtaaatgatttatttgcacaaaaatggattgtaatattctgataaaagtccattaagatacgttgttaattgacttttttcatctaactatatgttttagaaaactttcatatcagcatatttttatctacctcgtttgtataaataattgcatgatatcctgtattatgcaatgacaataatttagccatttcctattgttgggcaattcagttatgtgagagccgaatttaaacgaaatgtttcagaagtaaaataacactggatggtagcgaagtttagggtgagggcagtgggtggatggcagaaatagggttggggaggcactggtgataaaaacacagagaggaatttaccaattgtacagtggcttaacacaaggggtactgagggcacctagggtgaagacagaaatggagctgggccaaagggtagtgtgctttaagctaaaggaagcaatgaagaaggatgaatgaccagaagcatggtaggtattagtgatgaggaggtattcaaattatatgattaggtagaaagagctgcaagatgtctttttctttcttatttttcttactgaggtctaaatagaaatgttctggaaaaatcactagagagagagtaatgagaatgataaccatttctttgacctagaggcaaggaaaatgaaggagaaaaagaaattttcatttgagatgcatttattacaatttgtatccttcaggcacttctagatatctgttgaggcctggaaggggcaaaacaattcaggaagcagttgaagataaaggggtttaccatggaagagaagatccaggtgccttcatggaaatgcttgtggttgaaaagagatgaagatgagggtccctggaaagaggaagaaccagccaggtatggtagctcatccctgtaattccagcactttggaagactgaggcaggaggatcacttgaggtcaggagttcaagaccagcctggtcaacatggtgaaaccctgcctctactaaaaatacaaaaaaataataataataattagctgggtgtggtggtgggcgtgtgtaatcccagctactcaggaggctaaggcaggagaatcgcttgaactgggaggcagaggttgccgtgagccgagatcacgccactgcactcctgcctgggtgacagagcaagactccatctcaaaaaaacaaattttaaattaaaaaaaaagagagaggaagaaccaagcaatgtggagttgagagaagaggcaggatatgaacaagggtgctgggagtatatgggagtatgaggtggtaggttgagacggcctcctgatttcctcaacttagtccttccattggccaaggaggaattgggagtgagaggattcaggcctcttaagagttattcatgacctgaagtgagggtgctcatgagaaagttctggtcacagcaaagaggctgacaatagaaaccagtccctgcaactgccactttgcactagaaatagcccctctctccctcaggcagcaatgatatagggagcagtgtatccataccagggtcatctctgcaagcgattctcctagtctaggctcaatttcctcattttaaaataagtgactacactaaattatatccatagtcaaaaatcaaagattccacatattaccctttagttcataaaattttcttttttctttcattttttttttaggaaaattataccattagcaagactggcatcagcaagtagttcgcagtgttggttgttcttggtttcgcaggattttataggaggtatgacatttatttaaaatggatttgtttctttgttactcctattccatgctggctagacagctttccttggggtctctcatctatttcagtgccattccattcatcactcacaaatcattaatttgcctgtgttgtgttacctcctgagattttctgtttctgagtcaatagagttgagagctaatgtacatttcacaaatattcctgggaaagggcttggagcaagaattgaagagactttatattttagtatagcatataccgtaataactcattccttttatatgagtgttgaagaagggaactgccagattagaggcaagtccatcaaaatcattcctccgtgtattcagtcagacagagttatgttcagctgagcttaaatcataagcagtgactgagcacctatgatgtccctagcattgggctgggataagataatggaaggaacatgaaacatggtttttctctcaaaatattcacaattagttggagagaccaaaaacaaccaggtaaacagataaataaggatcgaaagtaaataatattaattgttaataaaagaaaaggtattacaaagcagaacttaattaatgaacaaataaattatacagataggaattgccatagactttgaaagaaaattgagatatttcgggctataataaacagtgaagattttgaggtaaagtttagtattagatcttagtgtcttaagtatatagcttaaagtataggcaggatttgaacatttaaacagaattaggaaggagatatgcaaggtggctgtttgagaacgatctgaacaaacacattaggttgagaaatagcactgtgcatttgcagtaggggacatatgagtggaagcattacgagttggagccagatgacggaggctatgggagataagcctgagggttttggtttacaagcagtctttgttcaggacaagggaaatagaactctgatatagaaagacatttgagtgtcaataaggaatgaacagagcttgaaagtaagaagaccatgagattgatgagaacagagcaaagtccaagggaatgggcctgaacagatgcagtacagtgggaaaaggtgaaagaaaccctgggaagaggaggattggctcactcacaaatgcctatcctctttctgcatcctatacacactatattcagagatattgtactagttgatccctccacctgccataatcttctttcatagctttgcacagtttttttttttttttttggtctttcatgatctcaaaaaactatctataaaagtgccatacattttctatcacatcccactgccttattttcttcctaaaacttctactatcttaaagtgttttattcttcattcattcattttttgcttgcttatagtaatatggctcccttgaaaaagtgtaagctctgcaaacagaattcttgcctacaaagttcataactgtaatctgcagcacccaaaataatggctggtacacagtagtgctaataaatacttgttgatgaaggaatgacagtgagaaaaaaggtgcaatgatgtaagcgtcatttctgaaggctgtaattctcattattatcatatgtgtaacgtgtaataatgagtttatgcttaaagaattgcaaattaaagttttgatgccaatgactagccgaaaatattacccctagggaaattaaatgttgcaccaaaaatataagaatctttattccattaacttaagtgcccataggaatgatagagaatttcttcaaatttattgaaagaatgcttcagacaggttctaatatactagcagcaatatctctaaggtctccttccttccaatgccaacactcttatgattttaagttactgaattcataatccaaatcaatattctttttatataagtactcagcaagggtagccacacacttattccactaaaacttcaaatatctgatatttatgaatgttaccatggggaacaatattcatagcctatttcaagaaccacataattaaatatatctcataactttatatgcttcagtttttgtttaaagttttatgagagaaataactatatttttaaaaaaacacacattgaggcacttgttaagattcaatcaaatttctttaacataatctaacactgtgcagtgataagtcagaagtataaattgaatttcatgttaaactatgcatttgtgattaactgaggagtgactgaatcaagataaaagtcagttttatttacatctcttatgcaggttacaaataaaatattggatagaagcatatggaacatttcagcatgcttgcattttagtctgatgaacagtcaccaacacaaccttatttggaagaattagagttcaagaccatccataccctctaagcaggagggagaagcataggttatcctgtttctgccacaggtggaatgacttccttaccaaagggtaggaaggagagaacagcatgactaatgtactccaggtggctagtagtgatagaaatattacttttttttttttttttttgagacgtagtctcactctgttgcccaggctggaatgcagtggtgtgatctcagctcacagcaacctccccctcccaggttcaagtgattctcctgcctcagcctcccagatagctggaatcacaggcatgctccaccacatccggctaatttttgtatttttagtagagatggggtttcgccatgttggccaggctggtctcagactcctgacctcaggtgatcatcccacctcagcctcccaaagtgctgagattacaggcatgggccaccatgtctgcccaaaaaattgctacttaatctaagcagaactaatttaggtagaaaagttagaaacctaattttgattgcaaaagattttgttcttattcattcactgctatatgaaatatttttagcagaattcaaagcatgccagggttatgtttaaaaggagacttaaacaatccttttacagagataactgtgagctaaattcacagaaagctgtaattgagtggtatgagcatctccactaagagcattgtttgagaagtatggaggtaggaagaaggatacaggggagaaagaaagaaatagctcagtaggaagagaacatggaataagcaaatcagggttgaaaaaggactgtgcttaactttataattttgcttctaaaagtcactttctttcaaaaacaaaaacaaaaaacaaagaaaataactataagcagtggttctcttctcctctgcaaagttcttcagtctagcttaagaaaattcccttgatcaggaaataagttagataaaaatcccatggggtaaaactattgtgaagtgattatgagctttctctcctaaaaggaccagccaccaaaacgtacaatagcacaatcaactcagcctctgtgagccacatcaggcatgtctcagtggatccagtgtaagtgtttttactagcagggggtaaaaacggtattccttagaagatgagggttccacagcctatttaacatagacatgagaagcactacaagacagaagaagtctatggcttgaccctattagatgatcttctgaggtgtttattaataagtgataggttgtgttttttttcaatgacaaagcaaggatttttttcttttacaagacatcaaaggagtttgactctaattttctctgtggagatttggctgagagtctctagattatggtgataacaacacctaagagatttatttaagaagtgccccttggcccttccttcagagaatccacaaatctttattcaattctgtcagtctctggcaagggaaatgccatttagtccagtgaacaattaataaatggtgctcagtaagtgctagttgatgataatgataataatgatgagatgatgatgatggtaatagacttatcttgattcaaaaataaatgtgtaatgtatatgtatatatatgtttatgtatatatgtgtaaatatatatgtttcaaattctcttcagccttgaaaatgaagattgcacatttttctttaccatatgtaaaggaatgctttcagtttctggttttctgtgtaaaaattctaggagattttatcatcaatgcttgcacttagttttgatgagcagtcatttctgagctgaacataaaatgcttcagtaaaataaatagaaaaagttattagtctgtagttcttggtgcaaaaatgatttttcccaaaattgtatggattagaaaagtatggtaaaatagtagatttttaactcctatccaagccataaatctcttctcaatctttaggattctgtaaactttaacatgtactgagtttactctggaatactcacaatcacttactctcctccaagctctctcagccacgaataagatagacagatttgatgtgtggttgggaaatttcctcttataggatggagttgtgcaggcaagaaataactcttaagacagtctggggaatgagtctaaaacatgggccgacagagggtaatgtgagattgtatagggggatgtttgagggcataataaataaagcaagagtgatgcacagacatatttttgtcctaggaaaacaatgtaaatttagtaaaaatatgttcaatatttattccaatatatcttacaataaaccaagagaaatacaaaatttgatgtcttgtagttaaagagtaaacaataaggactctgcaattttcatctccttcagtcagcctgtataataggtagagctattaccaattcattcattcatttgacaactactaattgagctttaactgtgtgtcaggctttgcaataagatctgctctttcaagtcagaatcaaacactgtccttatctgaaaggagctcccagcttgaaggggaggaggtatatacatatgcacttaggatattgagataagtgaggcagtggtttgtaaagaccctgggaagtacaaagaataaaagcacccatttgtaaggtggggcataaactgtcaagggcatccacagacaggagatgataaccaaattgaaggatgagtaggagcttatcaagcagagtggaaaggccattccagaatgacaggctcgcgggcacaggcatgatgcagcagggatgattcaggaagctacaagaagtctggtgcaattgcagtaggtgttgtcttgagggcagtgataggttttgaggttagaaaaataggcaggcaccaattcacagaaaacttttttgtaaagctatgaattttgagcatgaggcagtccttaactatatcaaatgtgagaatatttcttaaaaccacattttttcagatgcacatgagacaaaatagttactaaatgagaaaatatataatgacatagggccataattaataatgcacttaataaatttatgcttatcactaccaaaaaatttattgaacacttacattgtgcccttcatggtactgggaaaggaagaggtgcaatttagaagagacaattctcgttcttaaattggttagcatctattaagggaacaaatacttgacaacccaaaacaatacactgtgaaaatttcaataatggagggacctgtaggtgcaaaagggattgcagagatgagagaatcctaggttttctcagaggtgtcagggaaagtgtcacagaacgaggcttagtttactttttgcaaaaggagtaggaattctctagaaagaagcatttctatgaaggaggcaatagggcattttaggcggcggaaacagcttgtgcaaaggctgaggagtcaggaaaggcaaaatatgaacttactagaatggcaacaaggtcaaagggcaaagaaattatgactgtgaagatttctttttatctaatttggaaaatgaagagttagttctccagctgtgtaagaggtaggcagattcttgaccaactagtttggcattaggactcctgggcataagaacttttaattggaacatctagttattagtggaatctacggcgattctctatttgcctgaaatatcacagtgagaacaacagaggaagcagctttgtaggaattaaacaatattataaaaatggaaataaaactgaaattatatatgcttctaatttgaaaatgcagatcagagagaaaatatcaaaatggtaatagctgcattttaaaagcactatttatcactactttgcaacctactattattggactattaccttgatgattaaacttttcaattacatgttgcatcgtattaggttttatacaatcattaattagttcactcacataaaacccagtgaggaagctgaaagattttattacctactgttttacagatgagaaaacaaggcaacaaggttaagtggcttcctgaatttttcctatcgggtctgaggcctgcaggatgggagtctggcccccagcatggcctgcctggcatggctccctcagttctgctcccagcttcacatgctccactaattggggatgggtacccctggtgttcttgaaaattaatgatattcaaagctacaagatgtatctgttgtagtctatgtttgtttacttgtggcaattagtgaccatctgctctggaggtgatggtattaggccctcttttggaaatagtaacttctaggaaggagacgcccaggctattagggaaggagggctgacaaatgaatggggtctcgggttctccagagggtggagagactgcatgtcagacatgtaaggaaaaaagcaaactgagtcatttattctcttctcttgttgcctctcctttttctctatcttctgtcatcaaatcatggttacttgcccagagtttctgtcaggcctttgagcccaagctaagccatcatacccctgtgacctacacgttatacatccagatggcctgaagcaattgaagatccacaaaataagtgaaaatagccttaacggatgacattccaccattgtgatttgtttccaccccaccctaactgatacatatattctcccccacccttaagaaggtacttcggaatgttctctcccgctcttaagaatgtgctttgtatgcctatcccaaacctgtaagaactaatgataatcccaccaccctttgctgactcttttttttggactcagcccatctgcactcaggtgaaataaacagccttgttactcacacaaagcctgtttggtggtctcttcacatggatgtgcgtgacatttggtgccgtgactaggattgggggccctcccttgggagatcaatcccctgtcctcctgctctttgctccatgagaaagatccacctacgactttgggtccttagaccaaccagcccaaggaacatctcaccaattttaaatcgggtaagcagcctctttttactctcttctccagcctctctcagtatccctcaatctctttctcctttcaatcttggcaccatccttcatttctcccttgtcttaatttcagttcatttccttttctggtagagacagaggagatgcgttttatccgtgaacccaaaactccggcactggtcatggattcaggaagacagtcttcccttggtgtttaatcactggagggatgcctgcttgattattcacccacgtttcagaggtgtctgatcacagtggggatgcctgctttgatccttcacccttagtggcaagcaccactttcctggggggcaagcacaccccactccttctctttgtgtctctaccctctcttttctctgggcttgcctccttcactatgggcaaacttccaccgtccattcctccttcttctcccttagcctgtgttctcaaaaacttaaaacctcttcaactcacacctgacctaaaacctaaatgccttattttcttctgcaatgctgcttaaccccaatacaaactcgacagtggttccaaatagccagaaagtggcacttttgatttttccatccaacaagatctagataattcttgtcgtaaaatgggcaaactgtctgagctgcctgatgtccaggcattcttttacacatcagtccctctctagtctctgttctcaatgtgactcgtcccaaatcctccttgtttccctcctgcctgtcccctcagtcccaaccccaagcatcactgtgtcttttcaatcttccttttctacagacccatctgacctctcccctcatccccagactgctccacctcgggtcactccctgccaggctgaatcaggctccaattctttctcagcctccactccccctaccctataatccttctatcaactcccctcctcacacccggtctggcttacactttcgttccacgactagccctctcccacttgcccaaaaatttcctcttaaagaggtggctggagctaaaggcatagtcagggttaatgctcctttttctttatccgacctctcccaaatcaattggcatttaggctctttttcatcaaatataaaaacccaactcagttcatggctcgtttggcagcatccctgagatgctttacagccctagaccctgaaaggtcagaaggccgtcttattctcaacatgcattttattacccaatccactcccgacattaaaaaagctccaaaaattagattctggccctcaagccccccaacaggacttaattaacctcgccttcaaggtatacaataatagagtagagtcagccaagtggcaacatatttctgagttgcaattccttgcctccactgtgaaagaaaccccagccacatctccagcacacaagaacttcaaaatgcatacaccgcagtggtcaagcattcctacaagacctcttccatcaggattttacttcaagtgccagaaatctggccactgggccaaggaatatctgcagtccgggattccttctaagccgtgtcccatctgcacaggaccccactgaaaatcagactgtccactgaaactcacccggcagccactcccagagcccctagaactctggcccaaggctttctgactgactccctcccagatcttcttggcttagtgactgaagactaatctcccaatcacctcagaagcttcctggaccatcacagatgctttgggtaactcttacagtggagggtaagtccgtccccttcttaatgtggagcctacccactccacattaccttcttttcaatggcctgtttcccttgcccccacaactgttgtgggtattgacggccaagcttcaaaaccccttaaaacttccccactctggtaccaacttggacaatattcttttatgcactcttttttagttatccccacctgcccagttcacttattaggctgagacattttaaccaatttatctgcttccctgactattcctggactacagccacatctcattgccacccttcttcccaacccaaagcctcctttgcatcttcctctcatatccccctaccttaacccacaaatatgggacaactctactccctttcctggcaaccgatcacatgcccattactagcccattaaaacctaatcacccttatcctgctcaatgccagtatcccatcccacaacaggctttaaggggattgaagcctgttatcactcacctgccactgcatgtacttctaaaacttataaactctccttacaattctcccattttacgtgtccaaaaactggacaagtcctacaggttagttcaggatctgcaccttatcaaccaaattgttttgcctatccaccctgtggtgctcaacccatacacccttttgttctcaataccttcctccacaactcactattccgttcttgatcttaaagatgcttttttcactattcccctgcaccccttgtcccagccactccttgcttttacctgggatgaccctgacacccatcagtcccagcagcttacctgggctgtactgccacaaggcttcaggggtagccctcattacttcagccaagctctttctcatgatttactttctttccacccctccacttctcaccttattcaatatattgatgaacttctactttggagcccctcctttgaatcttctcaacaagacaccctcctgctccttcaacatttattctccaagggatatcgggtatccccctccaaacctcaaatttcttctccatctgttacctacctcggcataattcttcatgaaaacaaacttgctctccctgctgattgtgtctgactgatctctcaaaccctgaccccttctacaaaacaacaactcctttccttcctgggaatggttggataatttttagaggccctcaaaatcacaaactatgctcaactcactctctgcagttctcataacttccaaaatcaattttcttcctcacacctgacacatatactttctgctccccgactccttcagctatactcactctttgttgagtctccctcaattgccattgttcctggcccagacttcaatctagcctcccacattattccagataccacacctgacccccatgatggtatctctctgatccacctgacattcaccccatttccccatatttccttctttcctgttcctcaccctgatcacacttggtttattgatggcagttccaccaagcctaatcatcactcaccagcaaaggcaggctttgctatattatctttcacatttatcattaaggctaccgctctgccccctccactacctctcagcaagccaaactcattgcctttacttgagccgtcactcttgaaaagggactacgtgtcaatatttataccgactctaaatatgccttccatatcctgcaccaccatgctgttataggggcagaaagaagtttcctcactacacagggttcctacatcattaatgcgtctttaataaaaactcttctcaaggccactttacttccaaaggaagctggagtcattcactgcaaggaccatcaaaaggtgtcagatcccattgctctggggagcgcttatgctgataaggtagctaaagaagcagctagtattccaacttctgtccctcatggccagtttttctccttgtcattggtcactcccacctactctcccatgaaacttccacctatcaatctcttcccacacaaggcaaatggttcttagaccaaggaaaatatccccttccagcctcacaggcccattgtattctgtcatcatttcataacctcttccatgtaggttacaagttgctagcctgcctctttagaacctttcatttcctttccactgtggaaatctatcctcaaggaaatcacttctcagtgtcccatctgctattctactacccctcagggattgttcaggccccctcctttccctacacatcaagctcagggatttgctcctgtccaggactggcaaattgactttactcacatgccccgagtcaggaaactaaaatacctcttggtctgggtagacactttcactggatgtgtagaggactttctctcagggtctgagaaggccaccatggtcatttcttcccttctgtcagacataattcctcagtttggccttctcacctgtatacagtccaataacagaccatcctttactagtcaaatcacccaagcagtttctgaggctcttggtattcagtggaaacttcataccccttaccattctcaatcttcggaaaggtagaacagactaatggtcttttaaagacacatctcaccaagctcagcctgtaacttaaaaaggactggacagtacttttacctcttgcccttctcagaattagagcctgtcctcaagatgctacagggtacagtccatttaaacttttgcatggacgtactttcttgcttggcccccaacctcatcccagacaccagccctctaggcgactatcctccagtcctccagcaggctagataggaaatttgccaggctgctaatattctcttgcctactccagattcccagccatatgaagacaccctagctggatggtcagttcttgttaagaatctgacccctcaaactctacaacctcaatggaccggaccctacttatctgtagtaccccaactgccgtttgcctgcaggatcctccccactgggtttactgttccagaataaagctgtatccaccagacagccagcctaatctctcctcttcctcctggaagtctcaagtactctcccctacttcacttaaactcactcacatttttgaagaacagtaataactcttatgaacctaatacatcgtttcattctattaggtctattcgtccttaccctactttttgcaacaggactttatgcagtcacccccactacttggcctgaccccccaaaacttgtcatccctactgtcttctgtccagtcatactcctattcaccattctcaactactcataaatgccctactcttgtttacactgccagtttacactgtttctccaagccatcacagctaatatctcctggtgctatccccaaaccaccactctttactccctcttagagtggatagatgatctttggtggcaggacaccctccaatactttcaccacactatcaatctcattcactctttcctagccatttctaatccctccttagtgaacaattgctggctttgcatttccctttcttcctgtgcctatacagctgtccccgccttacagacagactgggaacatctcctgtctccctacacctccgaacttcctttaaccgccctcacctttgccctcctgaagaacttctttactttctagacaggtccagcaagacctcctcagacatttcacatcagcaagctgccaccctcctccgcacttacttaaaaaacctttctccttatatcaactctactccccccatatttggacccctcagaacacaaactactattcctgtggccactcttttatgtatctctcagcaaagacccactggaattcccctgggtaacctttcatcttctcggtgttccttcagtcttcatctccaaagttcaactacacacatcactgaaacagttggaggcttccagctccatattacagataaaacctctatcaatactggcaaacttaaaaacatcagcagttattattgcttaggaagacacttaccctgtatttcactccatccttggctaccttccccttgctcgtcagactctcctcccaggccctcttcttatttacttatacccagccccataaataacagtgaaaggttgctcatagacactcaacgttttctcacacaccatgaaaatcaaacctctatgcagttatcccatcagtccccattacaactgctgatggctgtcaccctagctggatccctaggagtctgggtacaaaacagcttttttagtactccttctcatctttttactttgcatttccagttttgccttgcacaaggtctcttcttcctctgtggatcctctacctacatgcaaattggacaggcacatgcacactagttttccttactcccaaaattcaatttgcagatgggactgaagagcttcctgttcccctcataacactgacacaacaaaaaagaattattccactaattcccttgcttgtctgtttaggactttctgcctccactattgctcttggtactgggatagcaggcatttcaacctctgtcatgaccttccatggcctctctaatgactctccgctagcatcacagacatatcacaaactttatcagtccttcaggcccaagttgactctttagctgcagttgtcctccaaaacctccaaggccttgactttcactgctgaaaaaggaggactctatatttttaaatgaagagtgttgtttttacctaaatcaatctggcctgatgtatgacaacataaaaaaactcaaggatagagcccaaaaacttgccaaccaagcaagtaattatgctgaacctccttgggcactctctaattggttgtcttgggtcctcccaattcttagtcatttaatacctgtttttctccttctcttattcggaccttgtgtcttctgtttagtttctcagttcatccaaaaccatatccaggctgtcatcaatcattctatatgacaaatactccttctaacaaccccacaatatcaccccttaccacaaaatcttccttcagcttaatctctcccattctaggttctcacgccactcctaatcccacttgaagcagccctgagaaacatcacccattttctttccataccacccccaaaaattttcacagccccaacacttcaccactattttgtttttttcttattaatataagaagacaggaatgttaggcctctgagcccaagctaagccatcatataccctgtgacctgcacatatacatccagatggcctgaagcaactgaagatccacaaaagaagtgaaaaaagcaataactgatgacattccaccattgtgatttgttcttgccccaccctacatgtattctcccctgcccttaagaaggtactttgtaatattctctcccaccgctgccccctgcctttaagaaggtactttgtaatattctcccctacccttaagaatgtactttgtatgcctattcttaaacgtataagaactaatgataatcccaccaccctttgctgactctcttttcggactcagcctgcctgaatataggtgaaataaacagacttgttgctcacacaaagcctgtttggtggtctcttcacacggacacgcatgacagtttctattagactaacaaaaagctgctgagacacagtgtgatctcctcaatcttggcccttctgcccaaacaactgaacatggcagagtccagaggatgagtctgtatccaccgtgcacttgctgtgcacctagaggtggccatggcatgggggtgacatggagaaactacctgagaggaaaatgtcaggaccagacaaggggtaggaaattagaaaggagttgcatgattataaagaatgtccttagtgattgttttgtgggaatcttctgtaccttctgggatgatgaagttgtcacttggcctctgtcaggggctctcatgcctgcaagaaggcctagcaagcctgggaaatgtaagaaagtactttttaaaagagaaaatttaggctgcctggctgatctgcaagataacaaatccccacgtgtccaggcttgatttcctcagtctgccaatctgaaacgtgactctggtgaagctttgactcccaggcttactgcatgggccaagatcttgttctggttgcttgcaattaggcattttccctttttaaatggatgttttcttctattctcaagtctgtctgtctttttttgcctctacgcctggggtctccttcttgagtctgatcactcgtttactgacaagtaaaacatacctgtcccatgtctcctactcattattggtgctgttttcctcccaccttctatttcatttgttgtaagaaactagcaccagggagaccactggccttaaatctaatattgtaggaactccgctgcatccttcctagaacatttacatttgtaaagataatggagatggccaactcaacaagatgatttttcaggagaaaggttcagaattcctaaagatttctaatggccttggtggtagtgtgctgggccagtttccattggtttacaagaactaattgtacacatctctttctttttccatgtctagtaacctcacattggtggcctaaagttagccatggtgggagtatttacacaatgggaattggcaaaccctacacatcagggcttgtttttttggaaagccaatttactaataccccattacctttaggctccattgtgtagatgatgtccttctgtgtgggtgattaaatgtggtcttgttttctcacccttttgtatctcataattgaaagctgtaaagtgttcaatatgttgagctgcagaactcataatgtttctggcctgagttttactggcagcaggttgtagagtgagcttgaggagcacaacctagcccaagtcacatttcaggtggctggttcattctggggaagaaagctcaggcctggagtcaggagccccagacatttgtctttcttctctcatgaatcacacagcatagagcaattatctgttagatgggacaatcatttgttctcacatgactcctactagcttatcctgagaaacagatggaatgatgtcttttaagtgagagcgttgtacatggccaggatgaagagcatggatttaggaataagatggactaggtttaaaatctgggcttgtctatgaggatgagctatgtgaccagttccatcagttctaaggcagttctaaggtgaagctaatgacaacaacttatcaaggtagctgtaatgattaaattaagtaaccttttaaaaatgttcaggactcaatatatggctgctactattaataacaatgctttgaaaatactatacacatttgaaggcatgattattattttatttccatatatggaacatctgtagtgatcacttgctctactacatgacttatagtgaatgtttagtaacttttttaaggatttgaaatattaagcaaggttattttcagtacatttcaagttgaggtgaattacttacctaagtaaccacactcctcagagcggggaaaaaagagtctttgcttcagacgaaatatttttggcaaactgactgaaagttgtccttcaaaaatctaaagaacctaggtaagtgaaactggctggtaataaattgccttaatagatataagacattgtaggttttatcccgggcacttgagagttgtcataaaaatagcacttacattctaatttctttaggggttgtttgtaagattcttttaagtattcccttgggaactaacctgttcacattcaggctgaatacagaagtgtgcttggctgattccttttagaaatgtaaattgaattgagttatacatttataccatcctaggaaggcagcatcctttccccatcacccccagagtagaaacaaatgaggatttgatttgttattctctgtgtataccactagggaacagcgaggcccatatatggcaagaaaaatatttcacttatcagggtcatttattccaggttagcatcttacttctaaagagaaaataatcaggaaatagttgctaggctgccacacaaaaggctttcattttctctcctgagctggaggaatgatgctgaggcttcctttgagggagtgtggaaatgtttggtggaatgagccttagctttgaggccccatagagcactgaggaaccttgggctagttgtttagtttctctgagtcccagtttccacgtttgaaatacaaggaaagcatttgctactttctggagtaatgataaggattaaaagagctaatgtatgtgcaatagagtgtcaggcatagatctggaaccaatattaatctttaccccaacaaccaaggattttagttactaacaccttgggtatatttgttcctgatttttgaaataatagcagattccctcaaagaaggacagaaataataaaaagaccctgagctaaaggtattgccctgaggggtgggcttatgtggcaaggcttgaacctccaggtggcctgcttgtgtcaggggtgggtatagcagaagagggaggagcatggggaagtggagggtaatcctctcgtactttgcaattttgtctggaacaagtcaaggaacttggaaacctcttgctcctgtaactgttgcaaacatttcctacaattttggaattttacctggattatcctaattattgttattatttttagtaaggtgttcctcctgaaccagaggaaatgaattttgtgactggcagtttcatcctgcaaatgaaacataaagggaaacagagctactttgttaaaggcttgagaaaacataattcttgtttaaaaaaacaggcaagaccagccagacagataaagatgtgtgggttaattgctgaatctgcatctcacctgcatcttttatgtggcagatatgaatactttataggtaatgaggtcctcaacaggagaattatggcctaatggcctgacatttgtaaagctgtaaaatgtagggggagatttaacaagcaagatgagctgcccttccgcatattaacacaattacacacctaagcacacgtctaggtgtaaatagtgtatttatagcattaggactctctgaagaatattaagtagatgttacaatgtgcaatttaggatttttttttttttttttttttacaagaaaagctttctatttgtctggaaacttctgggggctctaagcctttttcactctttcagaggtctctgcctctgtgatgtgttttgtagcagagctagcaggactgacggtgcactcagattccgggaattgaggctgggcgatggatacttcaacctttctaacataaagatgttgctacactggaggccagagggtctgggaggcccaccccatgtcactgactttgcctgcaatatttggcttttctgttccttgcctaactttcttttctaaagcttttggagtatttaacagtgttagattagcctaactcttgaaatatttttgatttagaatctaagaggaaagtgacattgttggaccactagccaaaatgaaacaggttatgaaataagtgaaaaagggaaagaatattccagcactgcttttcccttgaactgtgtttttctttcatgaacctatagcctcttacctacctgagtaagcgccaacgaattgcagaaactaaaacatgatcaaagaaaaacttcagccaaattaaattcaaaggagtttaactgagcaatgaacgattcacaaatagggcagcgccagaatcccagcagattcacagagactccagcacagccatgtggtgggagaagatttatcgacaaaaaaaaaggggaggggaataacttacagaaatagaaagcgaggtaaagaatggctagattggttacaagctgacatttgtcttatttgaacacagtttgaacgctcagcagtatatgaatggttgaagtatggcagccgggattggccaagactcacttacaggcacatattgttaagttaggttttcagttttttctacctattaagctaggttgcagttcatccccaaagactcaaatatagaagtgaggattccttctcaggtcatatttagttcactttaacaaagaatacttcttattttctcaagtcccaaatcaaggtgtcacgaggtccatgatcgcttaaagacttcaagaaaatatcctttcttgcctctttctagcttctggtggctcctggaaatccttggcttttcctgacttgcaggtgcctcacccaaatctctgcctcttttctcatgtggctttcttccctgtgtgactatatccctctataaagaaagacacctaagaacctctgtaagaacctctgcttttaagaacacttgccattgaatttaggctccaccctaatccaatatgatcttatcttagcctcattgtatctgcaaagaccctattttcagaaaaaaaaattcacattcacagttttctggggttagcattttaatatgttcttttgggaaatacaattaaacccacaacagttgagtaataaaaataaattcatgatctactttcagtatgaaacatgagttgtgaacacatgtccagactaatatttaacattgtgcagcagcagccaattttagagatggatgtgtagtttgataagctccacaatgtttcagcaggcattttctttgttagagaacagttgcttaaggacagagaaaatcagggtgaaagagttttacagttcctgttaaatctggacttcattcccaatcttctctgtgtatttattttttcctcattaaatagagagccctcaatccagtcaggcagtattctcctgtaatcctaccccgattctgttctcatattttattataaatttaaatttctgaattcctcttttcccagagtaatttcccacagataacttcatctctaatgaaaggaaagactctattcttcctcgaaaaagaattgtagacatgagttacaatgagcagattaggaaggtgttttgaagggaggcttgtttcagtgctcttatcatcagcaaggatgccagttctgattaatgtcagttctttgtgcatagatacacactcagaggtgtgtaagtagactttctcctttgcttgagtgtctgagtcatttgtttttctcatctttcatcagtttgaggtaagaactagggtatccaattgaagaaagccaaagccatagacaatgccatagttacgtacttctagctccctcttgtatctcaaagagcttttctgctcaccagacagcacttgttccactcatggaacttagttgagacaatggatgagcaagaatttattggctgagtaagagcttggaatagaaagctgccttattcaccctcatgaatccaatgagggttggtgcaggagagaacaatgcatcatctttccttttaaaattctgtaaaagtaaaggccattctgacaaaagtgttctataacaaagctttgtctttatttcagagcggaagccttggtgaaaatttgctgatctggttatagtacattcacgacaatggaaatccatataattaataatcacagggttttatttttggtccagcccatgaagcagtcactatttatagtacaaattttcatgtgctcttggcactgtttcacaacataagtaaaagagtctacagctctgtaactccttcacttttttaaaaagctattttattcattatttttagctcctccaaatccagtataagattttcccaaatttaccatttcccctccaaattgggcccctaaatatggtaaattttggctggaataatttttctatcttacgtagagtatatctactcactcatatagaggcacaaacaaaattattactttttcagtttgggaatcacttactattagctaggcagtatattatacactaaagataaaaggattaatacttgatgaaaccctgtctctgctaaaaatacaaaaattgggtggatgtgatggcacatacctgtagtcccagctactctggaggctgaggcatgagaattgcttgaacctgggaggcggaggctatagtgagccgagatcatgtgctggaactccagcctcggtgacagtgggagactctgtctcaaaaaaaaaaaaaaataagagaaagaaatatgaatgctgctgtgctgctggaccgtgtaccctgggatctcaggtgtgtgtgtgtgtgtgtggtgtgtgtgtgtgtgtgtgtgtgtgtgtgtgttggggggtgagaggagttgagagtggggaagtagggtgtatagaaaatgtaaggatgaagatggggaggagacatgttaagtagaattaagcaaatggtgtaaacgacacacacaggagggaaaatgtgttgtgtacaaaatgggccagggggagcttctggaagaaaagaaggcctgaaatgaacaatgccttacatataaccaggccaagctgtgaaatggagtttcaagaaacagcacgtgcaagagaaaggagctatattcagaggctggcaagtggttcagcttggccatcagtaggtattcaatttatagattgatgtttagggaatccctcattctagtccaattccagcttaacaaaagaatgtgaatgcccagtggggttcgttaaaatggatgtgaaatatgttgcatgcagaagtgtgaatgtacattactgtaggttgtagtacattcacatatatttaaataaatggaaagaaaaacctggtcttctgtgatgagctatgtcactccctcccatttaacgtgattaaaggcaacgtttaataggtccgtggagctttctgtgctgatccatatttcctgggtagcaagcattttcttttgtcctacatattagggtacaaaacagcagtgtgacatcagttataaaagagaatctaggttaaaaacaaaaccatgcagtcctgtgatttttgagttcagcattatgaggcatgttttatacatatgtgtttctcttttatttctttccttctgtgagaggtccctgcatttccagttaaggaagggtagtgctgtctgttggcattgctatcctctgcttctaagttcaaagttggagggtcagcagcaatgccaacagctagacctttcactgcccactgtctgtgccttctattctttggacagtgtgaatgaacttcaggggggtgtgtgtgtgtgtgtgtgtgtgtgtgtgcatgtgtaggtaggtggtttaggaaggtagagtatcccagaggcttattaccagaggaacctgaagagaaggtctgtgtgtgtttaattgtccatgtagaatgagtcagccagccttagaactgctagatggaaaaagatagtctgggagaagtggtatgagaggtaatgggaattgccagagaagtaagtactttaaaggtaagataaaatatgctcttcatatataaaagaaaggaccccctaatgtgaagatacatacattttaaaaaggtagtaattttgtcttatgtatttgggaggtttcagaagaaaatagttttctgacatatatgtattaactagggatatcaaagttttcaattaagttttattaaaaattaaatgtgcttattacacttctaccatgtggctgtcatgctgatgaagatgcgagaggagaaggtgcagaactcagtcttgttggggaaaatgagagtgcacaggggcatgtttctatttagcaatatcattagtaaaattgaattcaatgtttccccaataaattagtactaattaagcatttactaagtgcagggtactaggaaatacatatgaaagagcatggactttgccactttctgcctaggcttctagattctcttcaagtacctagtttttttcatttgcaaaatgtgcatgataaacattttattctattctaatgtgatgatggcatagcagctggctcaccatatggcgagaagccaacacttaataaatactagattttttttctactgccatgtagccaagcttctacatggaattctagatttccagggtctgaacttgatctgagctccagggttctgacagtgatgccactgctgtggagtggagtccacagcagtcctacttaatagtacggttcttgaccactgccctgcttcagcttctattagcagagacattgaatcttaattcacttcagagctggcacccaacactactaatgcaagcatttttttaagtctgactcagtaactttctgccaaatccagtttccagatgttaataataatatgtaattaagaaatataggaaacatggctgagtgtggtggctcacacctgtaatcccagcactttgggaggctgaagtgggtggatcaggaggtcaggagatcgagaccatcctggctaacatggtgaaaccctgtctctactaaaatacaaaaaattagctgggtgtggtggcacacacctgtggtcccagctactcaggaggctgaggccggggaatcccttgaacccaggaggcagaggttgcagtaagcggagactgcacccctgcactccagcctgggcaacagagtgagactctgtcataaacaaaaaagaagtataggaaacaaaccaataaatataaaggatgatcatttgaactccttctgcaggtttatgatagccaattcaggaaggtaaggaataaatgggatgggagtataacttcccagggtcaatggttgctaccaaaacttgacatgtgtctctggaaagccctgcttcatggtgtatcattccacattcttctttctttcaagatactcatttctagaagatgctcctgaataatgctgtttcatgttattcatcctctgaatcttgatgctgaaaattaactgatttgtctttttctatcttcgtttacattcaaagataagtttgttactagtgcacactctgtgtcatgcaaatatgtgggtgtaacttgttggataatagtatgtgtatgcctccaatatcccttctgattcttataatgcctttaagaattggaggactggttagaattgcatttaactacagataagtgtgcaacaactcaggtgaagttatttggccaaggttatacagccagttccacttaagatctagattgcaaatctgataattccaacattttgtattttttcacaatttcttgtatttcttaatttactaaacaacttttatagattttagtagataaagaaaggtcaacttctttgtagatgctcacattttaaggataaccttgcttgctttaaactgagggagtcatttccctaataaagtgttccaagtgccatagcaaactttagatgggatgatggtgtcagaaagttctttcctcatacacttgggctattacttaagtcctgcttataaccttactgatttcaatcatgtgttgacaaattttccataaaaagagtatactgtctgctagatttatagatgattttggtaaagttatttacatgaacagttttagttaaacttacagtaactctgtgagggctgttagtatctctacttaccaccaccaccccatcccgacttttttttttttttttttttaagagctggtgttttgctatgttgcctaagctggtcttgaactcctggccttgagtggtcctcctgtctcagcctcccaaagtgctggagttacagttatgagccactgcacctggcccagtgtctccatttttaagataagacaactgagactgagagatagatgttaattaacaaggcatcaggcagctgtcagattaattttcatattcaggtctgatttgatcaatgcatggaaatgcttgttacacttctgattagttcataacctcagttattttccagtggcccagagctggggtgcattacgaggctgtttcagaatcttatttctcctacctgctctgctgttggttgatattcccttgtattctcttgaggtctttctctgttgtcacctggagcagccacaaaagtgggaatagactctgtactcggagcccctggtcatcccagatatgttgcataatgaccttgtctcatgggactggcctggtccactctgtgatggtggccccgcataccacagccctactttcccagtcccaaaggagaacatgaagcccctggtagcttttgatagcaggtgtaccttacatcaaagtcagactgttagctgcagctgaatggttctctttaacagaagttattgcaactaccatcatgcctctcagacactcccagcttttgttatgtttaaagtcatatttttcgacgtagaagagtgacattctcatgtcagggtctgtctctggctccaccgaagcataacaacctttagctagaggacaagacttccatggattgctcagctgcggtgctcaattagtcttccaatgtatatttttttccctgttttcccctaacacgctgtcaaacatgtcaaacacagagcagctttttgatgtggacactggctcattaggccccagctgagatcattaaattctgtttctttaaggccaatgggaagggcagatttatgtttcctttgatagagctggtcttaaatttcctccctattgtgagatggatagttggtgatgaatcagtgagatttcagacttcactgggggcagactggctgttcataggattgaggtttctgggctagaacagtaaacaggcagtcactgagtgaacacacacatttctgatgttgcctcctgccatggtccagtcttagtggcattacctgtcacctttaagacagggtttctcaaccttggaggtatcaatgttttggaccaggaaatccttgtcatgagaactgttctgtgcattgcaggatattagcagcatgcctgacttctacccattagatgccagtaacacactctccaagttgtgccaaccaaaagtgtccccagacattgccaaatttcccttgagggcaaaatcacgtccagttaagaaacactttaagatattccaggagtttagctccctcaagtcaattacctaaacagaatacaccacgagtctaagttatgcggtagtaggcatggaaacatcagatggtggtcaaaaatatggccggatgagcagactgggagtcaggaagaagtgtttgcaatgacttctgacttctctcttgtttacttctcctttcacttttaacccccctttaccctacttgctgatacttagttctcatctgctatcttgtagcacacagagtttgctactatagtttgggccaaagttggatcccctgatgactctgtacattctcctggctgtacttttcttcacataatgtctatgaaacattacttttatgtgttctgttctccgagaatcctgctgactagagaaacattatacatactcataactgagtattaatagttgttaagggttgaatggtttcactctcccagattgtgtgtgtgtgtgtgtgtgtgtgtgtgtgtataatttcattatataacaactaaaaaatgtgtgaagagatatttagatacaatagtaggactacaaataggttatatgactagcaagacttcaaatcacagctcttcctaactatgagagcaatcttggtttttgtagttcaggattgggatatctttaaatagagagacgttctttacttctgatcctataggacagttcttcaaactgttgattatgcaatatctcaaaaaattgaaaaaaatgcgtgggcctcagtatacgtattatttgtaaattatataagtaaactatttttaatcatactatatattaatgagttaaattctataatttttggataatttttacaagttgaagttatatattttttccattcccccaaaatcatcctattactctgaaagtgcttaaacgcctacagtggaaacctcttcttggtcctccacggatgaggttcaggagacctccaaccctctagaattggatatataattttgtgatcctaggcacaagttgcatttttgtccatggcattcatacgatttaaaaagaggtccatactctaaaagttgttaaagaccatatatggtaatctttgagagtgatcaagcattcattcagtggaatgtgatagaattgatgtctttttataaggatgtagaaaacagagcagccttctcttcaaacactggtccttcttggcccctgaatcaagggagttttctcagcctccattcttctgtggtcatcatgagctaagtctttgaattttaatttctcaaatatgcaattaccctgacataaagctagaagggattttggatatcctctagtcttcctttctgtttttagagatgagaaaagcatagcttccaagatcatccaagtcttctgctcatgtacctatgtgtcacactgctgctctctggggattatttttattgttgcttcactctgtaatcattttaacattaaaaaaagaaagttgcaacaaaccaatgacctctggtgtacaaatgttaagaaatatttaatgtttctggaattcatcttgaatttcaccgaggtctgggcaccaggacagagtgactgaaacagcaaacttatcattaaatggatggacatatttgaggagaaacaagtggaaatgatgagtaaaacaatgtcttcagtagctacgaggaatttatttcatttcatctgtgatgaagccattttagggattgcattgcaagtgtgtgcatgcatgtacacacacatatgtattaacacatcagaactgtatattaagttaaaggaaatgaggaatggcatgaatattaattcccttttctagacactgccattgaaaatcataggacctgaaacatagagcatttttgctcatctctgaagtctgttgctcatctccagtgtttcaatctctgtccccacaagtaggaggctgtagttgctctcatatctactcctccccagggtcagaaaaatgggtagtgttgtgtgcgattataccctcactactgtgctgcatttcactctgctcagagtactattgctcccatgggaagactccttcctgtgagctagacatccattactgagcccagagcccatgccttccttcttccctagagccctgctcatattgagcacagcctagggatgattgtgagtagcatttttctcattgtgcttctaagagcctctctaagggctgataaagccatgatactctcatcggttgcacacattgggtttctgagtgagcctgtccaaagtttgacaatgattgatttcgtctaccaccttcattacccagagacagagaatcacttctctgtggtcacttcctatggccactcctctatggtcacaaggaattcaagttctgcttcccatcaggtctttattctattaatctccacagtctttctctgtgttttcctattctaattatgaaacaagatagtgggtttatattccagatgaaccagtttctagctgaaacaagttatttaacccctatggttcagtttattcatgtgaaagttggggttataatggaacccacatcttgggtttaatgtaaaaattaaagaagaccatgtttgcaagcacaggcatgggaaaattcatttattattcagttaatttattcaacaactagtgattgtgcatttatgctgaatgaaaccctgctctagcttctgggaaaagaaaaatacttctgcactcatggagcttatattgagaggggcgagaaggaaatagtaagcaaatattcacataaatggcataattccagacagtgttcttgaatacaagatgcagggatggggagagatggatggacgtaggtgggaggggttactttagttggtggtcaaagctctgaaaaggtacagttgagaagaggccttgtattaatctgttctcacgctgctaataaagacatacctgagactgggttatttatttaaaaaagagttttaattgactcacagttcctcatggttggggaggcctcacagtcatgggcagaaggtgaatgaggagcaaagtcacatcttacatggtggcaggcaagagagcttgtgcaagggaactcctgtttatgaaaccatcagatctcatgagacttattcactatcatgagaacaatgtgggggaaactgcccccatgatcaattatctccacctggcccctcccttgacacctggggattattacaattcaaggtaagatttgggtggggacacagccaacccctgtaaggcctgcattatgtaaaggagagagctttgaaaggatttggcctgagagcagtccaggcagtgggacagagaatggaaagtccttgtaccttgttctagaaacaagaggccaatgtggttggagtgaagtgagtgaggggaggattgtgtggtaaaatatgagactaaagattgcaaagagtacagataagaaaaagtttcaagccctggtcttaaaacattcatttttcttactaaattctaaccatgaaatataacttctctgaattgattaaagtgttcttttccttaccagctcaaacaggaagaatgtattttattgggtttgcttaattgtggagtcatgatgtggttgccaaggttgtctagggctggtgatatcactgtggttcctctttgaaggtgagccaactgacctggacatgtgtagctctagggctagagggttatcctccacactactgactctaaataatctctaagtactggcttgagtcccctccataactgttctaaaatttaacatctgtttgctctcctatgtataactcatattatttttattatgtaagacattgacagagggaaatattgaataatcggccatacaagtccatcctaccagatccttagtactcgtattcttcacatctttaatattcatggcctgtcagctcactggggtcacataatgaccaaatcttatttaatatcatgtgaactttttgatttggctcaaggtattagccttcagtataggagtagacaaagtggcatcttgagcctgagtttatgggtttataaggaaaaggacacttcaaagaatccagctagggtatattccatggtgtgtgtgtgtgtgcacgcgtgtgtgtgcactcatgtgcacgcgtgcatgtgtgtgtgtttggagagagaatggaagggatggtgggggagagagagatttctttaaaccagttgtgtatatgtatatatttatctctacatggagaagggttgaaataaacaacaaaacacacttagtttcaaaagagataatttactaaaagtatctctcacttagatgaattctgatatgtgaacaggcttatgaattacaaatttctggacagaaaacagggtaaaaaatctgctccgccaaggtgggcatattctgaaatgctcccttcaaatgtgacaaggagtacaatggagaagaagtcaagttctcaagaaaggagccaagagtctcgaaaagctgtgggctggggaggtattctcaggcagcaaaactgaagcctaatcaaggaatactttctgtccccagggaatatcactaacatttcgtctggggaatttcagaattgctatggaccagtaactgctcaatgctgctcagaattgtcctttctgaatcagcctccattatggagattgttccccctttgtatattaattgtgtgtgtggagggaaacaacctattgctcttggttttttttcttgtttttctccttcctcctcctcctccactgcttccttctcctcttccttacctttctcttacttacccctctccttctcttcctctttctcctcctttttctcatccttcttctccttcaaattcaccttatacttctgcttcaacttctccttatcctcctccttctattcctcctttttctggtttataattctccagattaagaaaagccatatctagaaatattgttgcagatactattgtaggagccaaaactttgagtctgatgatctaataggatgaaactttggggattcttccttgaagataaagtgagtatatttatgtgcaagataaatagaggaaacgtggtgaacaggagggtaactgtgatagattgtattattcagcaaatagtcatctctgtctctgtgctcattgattgtgaacttggccatgaaatttatttttaccaatggagcataaatggacaagacattcagtatgttcaatcctggatcccacaatgacaagacatataaagtagacctgatcctgacccttgacttggagctgagcccagaaaaggctaccaggagtaaagccaagctgcagcaagcctaaagatctatgagtaagaaataaatgtttattgttattagccattaagttttttaaaaatccaatataacttctttgaaagttaactaatataagcacttattagcgtccaagtctgttctgaatggtggaaaataatatcaaacaaaacaatcaactatttctcatctggagagattatattctgtgtgtgtgtgtgtgtgtgtgtgtgtgtgtgtgtgtgttagagtatgttcattagtattttgtatataatacatagatacaaatgtggtcaattgcatgaaatgtaagaaggcatgctcacttaacatgtcagaaatagttgactcagggaggtggagagaaaacagtaattaaaacattgaattattttttaatcaggtcttccaaacttcacatcctgtgcccttttctctatatcatccagcctgccactgctgtttttttacacttttttgattcagggaaattcccaggtcagggagctaataaagattttaccatttaaaatgttccagaagtagtcctccttcacccacatgacagcaagcacagcttgcagtcaagaatagcagaagtaacttccatctaaagacaaaatgctaccaagtttacttctccacttgtagcagcctgggtataatattgttaatctttcattactgggtagaagaaaaacttttgccttgtacaagtgacttaataaggccttaatatacagatgaagacttttgttcccaggaagctagtaagcgtgcataatttcatattcctgagaaaacttccctctactgatcaagcaggcttcagcctacctgcatttacctacaaagtttcaaaattaccacaggtccaccatggcaatgtaatcatttgtgcccttatagaaaacactgaggctgactaaaaacaattatgtaaatgctgtttctatagttatagttgtatgtttctcacactttgacatacttagcacatacacaaatatgtctttttagagcatattatagttttcagccatttttacatatatcacctcatttcactttcatagcagccttgtcatataggtggaacagggcttattctgcaactcataagtaagcccaggaaattctagtggtttgaccaaagtcagcacagctacaaaacacaatgttggaatataaacctgttttccaacctcattgtctgatagccttaccatttttaaatgcttagccaccacttcctgtccattttgtaaatatctgaacaatttacaattgaaaaaaaagtttcctaaaagaaataaatagttgctattttataggtgaagggcactactgaactcctttccctgtagaaaatggaaagaatgaatttgaacagggtccaaaataagagaaagtatagaaacttagccctggagggtggcagcacagttttcttacattattttatgctgggtgcctactgcagaacctggcacaggatgagtacttggcacatttttccttgagtgaatgaatatatgcacgaataaattttgtaatctaactacacactgtgataaccaaatctaactcaagtcttgtggggtgtatacttaggaaaaataaggtgctatttgaatagggtggcaaccttttataaaaaaacaaatgcgtcaatgagtaatcttcaccagcttctgtccttagcatcctcaccattcccctcaacatctcgcaacctggtttgcctgctgttgaaccgttgttgctgtagtccacagtgacttttttttttttttttttttgagatagagtttcgctcttttttgagatggagttttgctcttgttgctcaggctggagtgcaatggtgcaatctcggctcactgcaacctctacctcctgggttcaagtgactctcctgcctcagcttcccaagtagctgagactacaggtgcgtgccactgtgcccggcttattaatttattaatttattaattttatttattttgagacagagtctcactctgttgcccaggctggagtgcagtggtgcgatcttggctcattgcaaactgcctcctgggttcaagcaattctcctgcctcagcctcctgagtagctgggattacaggtgctcgccactacgcctggctaatttttgtatttttagtagagatggagtttcaccatgttggccaggctggtctcgaactcctgacctcacgtcaattcataagtgagcccaggaaattctagtggttgaccaaagtcaacacagctacaaaacacaaggttggaatataaacctgttttccaacctcattgtctgatttatttcacgtgatctgcccacctgggcctcccaaagtgctgagattacaggcatgagccaccatgcctggccaacagtgacttttttcctctttagggtatcttgcatctgcctactcctctccagccctattgccaccatctgagttcatttcctcagtaagacatgtctgagctactgctggggcatgacttcaccggcagcccaccaaagctgtgagctactgctctctgaatgatgaaggttgtacttgagtgtctgttcattggcaatatagcagttttgcctgcttttaacgcattttcaaggcatcattcaatccacagataaagttcctctgcgtttgctaaccctcctgagtgattctcgtccatcagggcaaatggaaaagaaagaaaaccagaacatctgatgcccacccaggtgccagcatttgctagatgttggtctctgtgcagccaatgagcctctcaggtcctacttcttgacgatcaggtttgtggtataaaagaaagtattttagcgctttctaaactgtaaaattctatttaaatgtaaaataaaagttgctatattgaacatctacacatatggaagccaattttgttttttaagtctataatcctaaaatcctaaaatgaaacttctattttacagatagagaaacagaactctctcatagagggcttacccagctctaaaatatttgatcccaaccatcatatgcttccatttattgaaaatatgactctgctcaggtactttaatatctcctcactgaacagctgatccaagctgagcttctttgtttaacataccagacccttatatcaaccggtcaaaaacttctatgcatgatttctgaacatttcataatattttttctgactccctaacatctacccttggttctggctactacaatttctttattatgccttctcccttccaaacatattgtaagcccctgcctaagacttctacaatatgtttggatttctggacagaaaacaggatgagaaaactgctctgccaaggtgggcatattctgaaatgctcccttcaaatgtggccaaggagtaaatctagacatattgtaatcccctgcctaagacttcctttcttccttaaaccttcacagaataacaccctagtctggtctcttactcataaaaaaggtggcaagagaactcaactaattcacaaagacatgttgttttttcagtcatttttgagaattgccctgtttgttttatgtgtttatttgcatgtttcaaactaaataaactgtaagatttgaagagcaagggaaatagctgatttttaaaaaagctttcttaacactttgcagagaactctcaattttagacagccttgctcaatgaattatttatctgaacatatcttgaaaggtggattttcctcagaaagttacatttttgactctcctttatggcacctacttactccctaaagctgtttaatagtaacactctgtaaaatattccactttcaaaggccctttttaggtaattgctgaactcaaactcacaatcaccacataaggcatctactgtaatacctattttgtagatgaaaaaactgaagcctaaggtctaaatggattgctcagggttaaacagagagttactgagaaagtcagaattggaaggaagtttcctgatacccacacaattcagcatgcttccaccatgatgcctttctacctcctgttgccctgcacccaactggagctctatccattggcacctttacatcatggcgtttgtgaggatgacaagagtatgcacattagcataataaaaagtgatgtgcaatggcttgacagatcccacagatttcctaatgaaaaagggatattgaatttgaaattcataattttgacgagggaaaccattctacccttttgtgcaagcaaggctacaagaaatatttcctgataagcatggtgaggcatgggaacctgacagggctcatatgtcatctaccagttatgactttttgaccttaaaccatttcttttgtgtcctggctcttattctgctcctttttaaaggcgcaactcatctgtgggatgcatttttattcctttaagcccatctatcaacttactgaaatacagtcaaagccctttcactcttacactcagtacatttgtaggccatcagtggaactgcttgaaaattacagggctccataaaacccacacttctctgaattcagcccatgctcagcagttttcaatttgcttccctcattatttcttacaggtgtgctcagggttatgcaattaaaccacattctatatttaaaattctccctctgactccatccttaccggatatgtcaaatataaagtgttttgaagtgctaatcaaaactaacagaatctgggaagtaatagaaatatatatgtgtgtatgtgtgtgtatatatatatatatgtgtgtgtgtgtgtttatttcatgcttttgtttgtttgtttgttttggtgaggtgaaacataccacaagactgacctagaatctggaacatcattatctgattctggaagcttgatttttaccccacttttgtcaccaaggtagctaaacaaatatagcaactaaatataatataaaatgcaaatacgcttatttattttaaagatatttcttgattagtgcatccaatagaaatataacatgagccaaataggcaatcttacattttccagtagtcatattaaaaaagtaattaattttaatagtatgttttatttaactcaatgtatctaaaatacgaacatttcaacgtgtaatgaatagaaagatggcaagatattttgcatcctttttgtgtgctaagtcttcaaaatatgttgtgtattttatgcttaaaacacatttcagtttggactaaccatcccagtggaatgctggagccagctctcattggattataagagctagttaaatttttggaatttcatgagctagttgatggtaggttgaaattgcccactgtgggagtgtttattccagagaattataaaatgctgcaatttctgattgtggtggggggagtgttggggagcatattgttaaacgtttactagcataccacctctcaatagtcactgtggctagtggctaccgtattgaatggtgcatgcctagataataaacataattatatatttattagaccctattcttaagcatgcttagaactttctctaatgttttctaagtatggtgacaaaatggtgccttccacaatggacaccaggaatggtaagcatgattgagcatctattagcagcaaaagcatcactgttccactgctccacacagtcccatgcagggttcggtctggggagagattgcttcttgtatactttaagaataagtctagttgtgagtgctggcattgttgaagagacaacaataagagaagcagattagcataaaaacatgagcaagacactaactttcttataatattataagtagcagttcttctgttttgtgaggaaaatagagattttatgtaaagatattagcttatatatttaaacctcataaagacttattaaatattatttattaaagagcacataattcattgggttttaaaattacctaatatacttctaataaattaaatttaaataattaaatctaattttagtggagcagaatatgtagaaggtattctaaggtgttatattccaaaagtctctgatatatgtaacaaatatatactcttccataaaacaataatattttgcttccagtgggtgtgtaactatgtgccagagactttaaatacatatttcagttgatttacacaatgatcctaagttgtgggattaattatatgaattcaaagagtagaaaattgaagctcaggaaagttagtgagttcagccagccatcaggtaaatggtagatttgaacaatgaactgtctttcttatttcaaagtctggactttttctctagatcgtactgctccctagaagtttaattcatgtttattggatttttctgttttccttcactgggaggataggactaaaggaaggttggaagcctcatgatgttacaaatactaaagcctcttatgttcaaatgataagggtggcaggaactgaggaagataacaagctcaaacatgtaaagcagaatatgagctttatcttgttcaccctggtatccccagtaaatatcacagcactaggacaggatgggtactaaatacctatatgtagaacaaatgtgtgctcttacagaaaaacaaaataaaacagaaaacaataacaatagcaaaacccttactctccaggaatgataatggcaggtggcatttacccagcatgcaccaaacaacaggcactgttctagaggcttcacttgcattgcctcatttaatcctcacaacaattgtatgaggttaagtacaactaatatttccattttacacatagggaaggctgaaacacatggaagatacaaaactcccatgctacaaatatatagcataattgagatttaaacccaagtaacctgaatccacagtgcaactacatcctatgtctgctttttatttttatttatttatttttaattgagacaagatcttgctctctcacccaggctagggtgcagcagcatgattccagctcattacagactagacttccctggcttaattgagtctcgcctcagcctcccaagtagctgagaccacaagcacacgctaccacacctggctactttttgtattttttctagagacgaggtctcgccatgttgcccaggctggcctaaaactcctgggctccagtgatctccctgccttggcctcccaacgtgctgggattacaggtatgagccactgtgcccagccatgtgcccagccacttgtatctgtcttattagttatatggcagacaagtcataggcacttcaaacttttaacaataataaatgttgaaagtacaagttcaaagtgactatgaagaagagatatatgtgatttcatatattagttcaatattaatttgccatactagaagtaagaaatgattgtggagaaagaaatcacttctcactctcaaactatggaagatagcagagttggaacttaggttattgaaggataagtgggatttgtataaacaatggaaagttaaggcatatctagccagagaaaacagcatgaataaatacacgagaaacaagctctaaatcctataagggcctgcaaattttggaaatgttggagtggacaatagcagtggaaaagtggttatgggtgagagcaggcttaagtctacctcatatgcagtgaggaattcaattttccacacattaggcactcctattcatggaacctccatcacaggcaatatgaggattttaacacctccaggaaggtattaatattctagtgtgctatatgaccaataactctaacataatgtaaagtaaggtaagtggtctagcaagcaaagtgatgtggaagaaaagaagaacatgggagtttaaagagggagatgcatatggttctgaagactgtaggaaaggcttcacagattatgctgtatttggagaacatcatttggtttgttaatgtatcatatgttatgtgatgaggaacgatggtaaatgacactagaaagatcagttgagatcatagtgtggagaatggcaaatgccaagtgtgaggaactttattttatcaatagcaagtgagtaggtagccttgatgggttgtgaagagcctagaattacatttccattttaggaaaataaatctgacagttataatgggacgaagaataatagagggatttgtaggctggaattaatgttggtggttattctagaaggttgagctagcgataatgacatttgcagataagatagtggcagtagatatagaaagaagaggatgtgtgaaagtactttggctactaaaaaaattgttctcagtataatgaggacaaaaacaggatttgagagcagggaaatggcaaaatcaaaagtatatgacttagaaattctcttgctctgttctgaatcctttaatatgtgctgagattcagagaaaacaggaatggtgaaagtttaagagtttagggatggcagatagtatctataacatttgccttcttttgagcagtcagaaagaaagttgattgcataatataggtgtggggacaagggaaagccatttttccaagatattgtgtgagaataaattaaacaattcatcttttaaaaggtgatatcactgtattcactagcagaaatgctacataaatgttatattcgtttttttctcggtctactttagccatcaaagtattttgcagggtagacctcatgtctggataaactaatattgccacttctcatataatctgtgctgaaggatctctttcttttttataaaattttctgcccatcactgaccaatactggaaattcatacacaaaataaaatgaataaaaaactgacatataacttcaaaccccaatttattattatttcattcaatagacaccaaattactccattggattgctaaaaaattctaaattactccattgaatagctataaaactttctaaatagtttcaatctctgagcttgtctcatcctatcagtaacaaacatctcaggcaccagcacctccctgcactgcccatgcttcccatcactctggtgttttcattgctacaatgtgatttcagagattttagaaagactctgaggttctctttcatcctgttctaatactctaattctactttgcctatcttctgcatattttgagggaaaatattacactttttgccatctatatttttagcttaaggaataagtgaaaacccacatacctttgcaatgacacatactttgtaccaccctcatgtatactttgctgagaagaagtgtaattaatgactgatggataaaaagaaaacaagacaatgccactaccctacacaagcaaacactcaagcctgtgttgctttttcactatctaccaaattatctttcagccttttccttcttatgttacttccatttaacaagctccccattttcccccacttattagaattttatcctacttaaatgcctcaaccaagtcctagctccttcatgaatacaaccatggcccaatgcaactcataatcatctcacccttctctgacatttttagattgactatattctcacttggtattatttgtaatatattgcctagtgctttttcttgctcaattattattttctctattaaaaaatacatatttcctacacatatttaaaattttctttttacatacatatatgcacacagaggaacaatattaataataaatcaaacaactttcaaagaacaaccaggtaagaaaaaaaaattactaagagtatgcagaagcccccgcatgcatcagcatttacatcctcctacctttacccaagagacaactgatatcctgatctttgtcataattaatctctttcttttctggataacttttctaccaatgaaaatatttacaaatgaattattaaatatgtacaaatatacgcacataaatttatgtatatattttaaaatataaatatattcctatcattatataagtatacatacatatatatgtactgtgtatatttacatattttaacagttctgttttttatgcacctaataggaattaaatcatgctgtaggcattgttctttcctcagtgttgtatttattatattaatccacgttaatttgggtggcttaggtcatttactttcactactctatagaaattatgtgcatgaatacataatttactatctattatattgtggatgaatttttggttgtttccaaaccaaatttttgctgttgtatacaatgattctgtagacacacgtgcaatttctcctggtacacatgaagtattctatagtatagaaccatgggtgagattgctgcattgcagggcatgagcatgtttcatttaactagatagtgccaaacttttatcacattagttgtaccaatttataccttctccagcagtgtatgacagttcccattgatccatagactagacatcatttggtgtgatagatgttactagcgcccatcaatatttccgggacacctcttctttcaggggacaacaaggctgatcacaattcctcacctctttaaagctaagcaaaagcatgtgaccatgtgacttagtcttttctttggacaatggcattcatttctggacagaagcattgaaagaccttgtaattctccatgttcttttccttctgagacaagtccagatggcagtgtcacaatatggtgaaacttctttcaaccttatttaccatagctttataatgagctgtgatagataatgagtccccaacctcaatctctctctttaaaacatttgtctgttcttgatctttgaccttacaaatatattttaggatcaatttgtcaaattccatggttaagtctgttggaatttagattagagtaacagtgaacttataggtcaatatggaagagaactgaaatctttacagtattttatctcctaatgtagaatccaagaacagagaattttcctttttttaggtctcatttagtgtttttcaatcaggttttataattttcttcataaagtgtttgcaacacgtttggtagttttgtcttaaggtacttcatatttttgatgctactgttaagtgctaatttttagatttttcttttttttctaggtatttgtttttaacatatagttatataatttattttcttgtggaataatggaataattttgtgccagcaagcttgttaaattttcctattaatgtcaacattttacttgcagtctcttttgggctttttaatacaacaaatatattaccaataattgtcctttgttctttccagactttatgccttttattttaattttttaaattcattgttatactggctaaatagaagttgtgataaaagtcatatcacaaaggattttcctcaaagaaaatgctttcagtgcagctacataaatcataataatacatttgttttatgaggttttccttcttctttctctctctgtctctgtccttcctttctagatacctgtatcagggtaaaaaattttctccttttcatagttgaccaagatttttttcactgtgaatataggttggtctctaataaatatttctccagatttttttgaagaggtcttataatcatttttaattgtgtattcagtaattcatattaattttaactaacataaattaattaatgttaaatcaacctttaattgttatgataacccaacttggtcatagttttcattcttctcatgtcttgttatattcagttcattaacaatttgccttagatagtagttatatttataagtcattttgggcatatttttcattcacataatctccttgccaagattttgtatcaagctaattctagaccagcagctctcatctgggacttatttttgcctcccaggtatcacttggcaatacccagagatacttttgattgtcacaacttgtggtgaaggtactactggcatttagtgagtagaagtcaggaatggtgataaatatcctatattgtacaggacagcattccaaaacagatcattatctggccaaaaatgttaatagtgagaaatactgttctatcttcataaaaattgcataatctaaaattgaaattacatgttttatagacctcaccaatgaaaacatagaggctatatcatataaagataccatctcacaccagttagaatggcatacgtaagagtttttttgtgaaaatatgtttgaccttctgttttttaatggttatagaacaggttaggtttcttttgggggaagttttagtaaatcatattttcctgataatttgtttgtttcatctaatatttaaaatttattgtctaaagatgtttattctatagcttaagaacttttaaatatctacagtacctgtagtgatgtctgctttttatatttcatattttttcatttgtccctaatatgtttttgtttgtttgcttctcttgtcaatataactaaagtttctctgttttatcagtttttcaaaaaactgtggatctttttttgcatatttattttccatttcattgtctttttacttatgtttatttcctgtttactatccttttaaggttaatttttctgttttttaaaagttcttaagatagatacttggttcactagagttaaaacgttatattttctactataagtattttaaggctatagctctccctctggtttttcttatagttgcatgctatttatacttatacatttttagtgagcttgaaaatattatgtgttccgtaactggtgtatagtatcaactatatctcggtagctccagtatatactaattatactattaaagtcttctacatcattaactcttttttgtgatttatataaaatacatgttatctctcattgtgattgtgaattgccaatttcttcttgaagatatctcagttatttctatacatattgagactgaattattagttaaattttaagtttcagattatatctccttaaactgataagcaacttcagcaaagtctcaggatacaaaatcaatgtgcaaaaatcacaagcattcctatacaccaataacagacaaacagagagccaaaacatgagtgaactcccattcacaattactataaagagaaaaaaatacctaggaatacaactgacaagggatgtgaaggacctcttcaaggagaactacaaaccactactcaagaaaatatgagatggcacaaatggaaaagcattccatgctcatggataggaagagtcaatatcatgaaaatggccatactgctcaaagtaatttatagattcagtgctattcccatcaagctaccattgactttctccacagaagtggaaaaaactactttaaattccatatggaaccaaaaaagagtgcacatagccaagacaatcctaagcaaaaagaacaaagctggagacatcacgatacccgatttcaaactatactacaagaccacagtaacaaaaacagcatggtactggtaccaaaacagatatatagaccactggaacagaacagaggcctcagaaatagcaccacacatctgcaaccatctgatcttcgacaaacctgacaaaaacaaacaatggggaaaggattccctatttaataaatggtgttgggaaaactggctagccatatgcagaaaactcaaactggatccttccttacaccttacacaaaaattaactcaaggtgaattaaagacttaaacgtaagacctaaaaccataaaaaccctagaagaaaacctagccaataccattcaggacataggcacgagcaaatacttcatgactaaaacaccaaaagcaatggcaacaaaagccaaaattgacaaatgtgatctaattaaactaaagggcttctgcacagcaaagaaactatcatcagagtggacaggcaacctacagaatgggataaaatgtttgcaacctatccatctgacaaagggctaatatccagaatctacaaataacttaaacaaatataaaaaaaaaaacctgggaggcaaaaataagtcccagatgagagctgctggtctagaattagcttgatacaaaatcttggcaaggagattatgtgaatgaaaaatatgcccaaaatgacttagaaacataactactatctaagcaaattgttaatgaactgaatataacaagatatgagaagaatgaaaactatgaccaagttgggttatcataaaaattaaaggttgatttaacattaaatcaaaaagtgggctgtggatatgaacagacacttctgaaaaaaaaacccatcaaaaagtgggctatggatatgaacagacactcaaaagaagacatttatgcagccaacaaaaatatgaaagaagagctcattatcactggtctttagagaaatacaaatcaaaaccacattgagataccacctcacaccagttagaatggcattcattaaaacaacagatgctggagaggatgtggagaaataggaacgcttttacagtgttggtgtgagtgtaaattagttcaaccattgtggaagacagtgtggtgatccctcaaggatctagaactagaaataccatttgacccagcaatcccattactgggtatataccccagggattataaatcattctactgtaaagacacatgcacacatatgtttatgcggcactgttcacaatagcaaagacttggaaccaacccaaattctgaacagtgatagactgtataaagcaaatgtggcacttatacaccatggagtactatgcagccataaaaaggatgagttcatgtcctttgtaggggcatggatgaagctggaagccatcattctcagcaaactaacacaagaacaggaaaccaaacacctcatgttctcactcataggtgggagttgaataatgagaacacatggacacagggaagggaacatcacacaatggtgcctgtcagcaggtggggggctaggggagggatagcactgggagaaatacctaatgtagatgacgggttgatgggtgcagcaaaccaccatggcacatgtatacctatgtaacaaacctgcacgttgtgcacatgtaccccagaacttaaagtataataataaaaaaattattgtacttatgggtgaatttaacttattgttattaatattatgaactacctatatctagtaatgcttttgcttaaaagtatatagtgataggaaaaacattcctatctgtttacccagccactgcgcctggcctatttcgttaagttttaaacttattacaaatcataggtggttggattcttttcagtttggttgatttttttgaattaactgtttattactttaattggaatataatatttgatatattggaatttggatcaagcatcttatttcaagcttcccattgccaaaatattttgtgccacgttttccttcctttctgctttttggaattgttgagattaattttttcctttcatgtttgctgctagcagctgggaagtattgtattgatttatttagtagttaccctagaaattgaaacatactttacttaggaaaagtctaaaattgttcagtatcattagcatccttctaaataatagaggacttaaaaacatataaactacttttagccatctcctgacttatcctctagtgattttgtactttttttttctttttctgagatggaatctcactctgtctcccaggctgaagtgcagtggcataatctcagctcactgcaacctccacctcctggattcaagcagttcttctacctcagcctcccaagtagctaggattacaggcatgcaccagcacacccagctaatttttgtatttttagcggatacggggtttcaccattttggccaggctggtctcaaactcctgacctcaggtgatctggccgactcagccccccaaagtgctgggattacaggcatgagactttgtgcattttataagccaatatcatcaaacatgactatgttaagcagttaatgtttgtttaaattcactaacaaatttatcacattagtgtccatcatttttttcatctcagatttgattgtccatctgttatcactttgctcattatatactatttactatttatttatttatctttagtcaggatctgttgatgtaaattcagcttacatgtttcagaaaatatcttcatattgctatgataagatatttttactcggcatagaacttttggttgacattccttttttctctgggcatattgaagatattattccactgtgtttaacttttagttttgccaatgagatgtcagctgtcaatgtgttatttcctggaagataatttctctttctctctttctccctagctgttttttctctttatcattggagttttgtgtttttattctattatgtttatattgtttagtattcattagatttgttaaagatatatatagatacacacacacacaaacacatataggtacacatacacacacatatagatgtctttcttcgattctggagaattctcagccatttttattaaaatattgtctctgccactttttcttttcttctctggaataaacatagatatttttctctttagcctctgtgtatcttagagtccttttatattttccatcattctgcctccttttactttattcctgataatttctcagatccccgctccactttgataattttctcttctgttttgcacactaatgttttaagtttcaaataatgtattttttaatttctgcaatttctatttgctgctgcaaaatcttctgtgtttacatgtgccatgctggtgcgctgcacccactatgtatacatatgtaactaacctgcacaatgtgcacatgtaccctaaaacttaaagtataataaaaaaaataaataaaataaaaaaaatcttctgtgtttttcttcaaggatgtttgttctctgcacatattcaagcttgcattttattttgtcttaaaattaagcagttattttttactttacctactgcctagttattttgcttttggttatattttattttgactttagaatgtacatttggttttgtatgcttctatttctttattgaaacttcctgttacttaagttgttgttatcacatctttcctttaattcactcaatatagttttctttaattcttttactaaatttatgataattgcttaaaatctttgcctgctaaattcattatttgtgtccccttgcagttaaatttataatggctgatttttccctgagcggtgtagatcattctttttatttctttgcctgatatatacgcactttgctaactggacaaacctagtcaaccaggaatgtgtgaagagcttatctcatctcttctgtggctctcacaggatcaccccattaaatatatgatggcccactgcccacccccatcagcatcataaactttggctcgcagaactgtaggtttttctcatttgtttggtagcaagtttgttactttcactgacaacactactgtgcatgttcaccctccatttaaaattgggcctacccttgctggaagacacagccctagttttcctggccagcccacgctggtaactctactgtttttgttgcaggaggtggtagagggtggatggcagcagctccatgcaaaagaattgtagactctgcagctcctactcaaagttctagcaacttctcatgactagccaatgctcaggttttgttgtttttctttgataaattgccagagcagcaaaatggttgttttgaccatttggaccaatttgactattgcttttaggggtggtaattcaccataatcttcattctaccatagtcttacattagatatcaaagttactgtaaaagtaaatagttattctgtaaactcattctagttatttctagatctgaaatctttacagttcttttaaaaccctctgttcatttctgctggttcttgctcatggtatcttgtatatttaaaaaatgtatttttggccgggtgcagtggctcacgcctgtaatcccagcactttgggaggccgagacgggcagatcacgaggtcaggagatcgagaccatcctggctaacacggggaaaccccgtctctactaaaaatacaaaaaatgcaaaaaattagccgggcgtggtggtgggtgcctgtagtctcagctactcgggaggctgaggcagaagaatggtgtgaacccgggaggcggagcttacagtgggccaagaccgtgccactgcactccagcctgggcaacagagcgaggctccatctcaaaaaaaaaaaaaaatgaacttttgtcttttaaatatttcttggaggaaattatttgaggccttagatgaagattgtttcttccaaagaagatttgcttttgcttttattggatatctgaaggcactaccagtctagtgctactcagagttaagtttttgcctgaggtatttatgattcatgaatggtatgaatttgggatataaatctatgtaagggctgatttgcacatcctggtttcagtgagtattttctccattctgctcttcatcagtgctgataagtgtttaccctcaaggtggatgggaaaagggtttggttaccatgccaacttacagtgtggatgtagttgtgtgggcacctccttttagattctaaactagggtagattctggacttgttgttttctgttcagtctataagatccatctataggatctaaagttcagcaaattggcaaatggtaaaagccgacttcaagttctctttttaattctttgagttcttattttactcttttctttttgcataagagtatcttacacttttgtgacatcttggatgaattttagaaactgtgtatgtatttgtatttgtagttataatccaggatttttactgtgtcagtggcaggatcaatgcaactctctactctaccatattattggagtcttgccttttctacaaaaggaaaagcaaatgaaaagatctatgtttttaactactcacctaaaatgcctagtataatctcttatgtgtaattgacattcagtatacattttaaaatacaagaactctttttacttcttatagtcagcaaaatataactttaacatcaatgtataatgtattttattgtagataatctagtgtcacttttacatgattcttaaatggcctcatgaacatttctatcataagcacttatagcctctgcttctgtttgtgaataactccagtgatctgtaactcctttccttctttaggggccagttctatttctagtctgttctactttttgggaaattccatttatgctgatctgaaaaaccctgtaagaaagatgtgatatacataaatatctgcatttcaaagcaatgcatacatgcaattggtaagataagaactaagtgcagaggccagagaaggcccattctggttgagatgattaagaaaagtacagtggagaaaggatgaagtttggtattaaaagataaaagggacttcaatagagaagacagacacagaaagggcaggtcaatgagtgaaagcagtggaagagtgtagtggtagaaaaatgttactcatgtttggaaaattttaagtaatgtgaaaaattttgtgtagggtaaagttagaaaggtagttccaactcttctggaatgaacttcatagagaacttcaaaagtttccaaaaattgttgttgttgtttcttacagtagaagggtctgctttaataatactaattacctattgctgtataaaatacattagatcattgagagtctgaaagcaagaaaatgtattaggcatagttatcgaagtctgagcttgaagttagcaaaaattggatagaggcacttgtactgagaattgaagtaaagaaatggatttaggaaataccattgtagaggacatgtcttgaatcctcattagatgtagaaaggataaagagaaaaaacagtaaaatttaactgggattctgggaggagtaacaagaaaacatattgtctcacagctagagaatataaacttggaaatattttgagagtgacgatgatgaattcagcttttagatatgctgagttaaagacacatagatgagaatgtccacttcttctgtaagaagacatataagactgtaatccatgacagaggtatgtctaagatgaaatgcttgggaatcctctatatggacatgatagatgaagccaaagagaacaatgaaatgagtcatgtcaagttatttgatacttaaaaaagtatataagtattttagtagtgtgaccacttgtgtctggaaattttgaaaagcacaaagatctacgatgatttatttaactctacactgatcagtaggaagcttttgacatggggaattgtgctagtgagtatttggaagcaagaagtgtattcagcaaggatttacaagatcattagactttcattttgcagattcaatcagatctgttcaatatactctcctgttggcataattggtttcctgaggacttgctacatgtagatgcacagttttgcattccagcaatgttctgcattccttctggactctcttgttttgaggatccctttaaagagctaaaacttcaggaacttcttctacttgtttcttcaaagtcaggatgagagacagaatagagcgtacagccataatggtttttccctaggttcttctctcatactaagctctttatggtacgatgtgcctctcaaaaagaatgcaaatctaatagcattgcaccactctgaaagaaggatgaggagaaggcagaagagctgcaaagagaaaaacaatcctgatacttttattattctcatcagaggagcatattttctagagtaacctaattttgtatctttggttcttggcagatagtaatgtcctgggctcctggaagtagaaggtagatggatatagagataatagggatacagatagagattgagagatattacttacctgtatgactatgtgttagggaaatagcagtgttgagaaaatgtatcggttgatgctgtgagtaagtagttgacaaaattggctgcctcttggagtaatttgcatagctcttcaaacaataatcacatggacgacatttctgaagagtctaactcagtaggtctaaacaagggtactccctgtggacaaggtcttgccttgtccacagggagtacattccaagaccctcagtggatgcatgaaactatgaataggactgagacaatatgtactatgcattaacttctttttccttcttcacagtttcatggatagtagaagatttgttcttatgtggatcttagcaacatcagcatttgatgttttttctttccttattaagttgaggacattcactttttcatgtaaagaaagcacttagcaacttctctttggcatatctgaattgctagcatcactactcttgtgctttggggacattattaagtaaaataagggttacttaaatacaaacactgagatacctacagtgttaatctgataaatgagacagctactaagtgactaacgggcagatagaatagacagcatggatatgctggacacagacgattctcatctcaggcgggatggagtggaaaggagaaggactttgtgagatttcatcacactactcaaaatgattcacaattcaagacttagaaagtgtttatttctggaatttttcattaatatttataagctgcagtttaccacaggtaactgaaaccgtgggaagaaaaaccatggataagcagaggactcctgtaggtgtctaagatacacacagaataaaccagtctacctgacaaacaagcttcccaagtgattctgaggggcagggctcctgttaacttatatggcatctttgtacaattagagaggtacatgatcctccatcaccagggcagatacaaccttataccaagatgcagaacttggtgagtacagtattgactagatttaaagtctcatctgcttcctccttgacacaggactgagtgcctgtgtacagtgcatacattgtacaaccaacagtatcagccctgctcatgggcactagttgtcagatctgcatctaaaagtcactaaatattaacgagtttcaaatataaaaatcccctatgtcttcccaaatatcagacatagtcttgggattaaattcccattggcagtggaaaatatctttttctgtgtcgctgtgcacagaaaactgtgtaccctgactattctaattgctagtccacagttcattgtctcctgagatacaccctgggaatgctctcttactcctgccagccatttatcctaagattaacctctctcaagagataaagaggagttcattggccttatttaaatggacttgcaaaatcaacttatattttgtttaatttgtaggacacccacaatggactcactgtattatattgtcccattactttgtcaggtgcaggtaagctcagcaggaatcatgcttaaagtgatttactagcactgccaagagaaaatgaaagaagagtggacacttgtactattttcagccagtgataccagctgttcctgagggagataaaggtggcccatgcatcaaccacgtagtgatgttgctaagtcatgggtcacctttaggttgatgttataaaaaggattatcttatatttgcaagtaagtgataatgcttatatttgcttctactcaacctgcctcatctgtgagagaatataaaggcctgtgtcatgatagtagaaatgaaatgagacttgctcaagtttttccaaatgttcccatgttttcctccattgagtcctgaaactctgccttaaaggattgatttctgaattataaagtattctagatcatatttcatttgaaataactaaggcctagaggagtgaattgcccagggccatacagctgcttgtccacaaagctaaggcagaactccttgattctagtcctatgtacatttattatgtcatgttgcgtttaccccattgctttttgctggtattctgtttagcaatcagataatctcaggagagaccacaaagtatgttcttaacacttcagtcttaatgagttataaacttcatgataaaagaaatcagagtaagacagaagaaaccaggataagatattattggcttctaagaaacaaaaggagtaaaggggaagaaaagttgaggaaagagagattaaaactgaagccttggagtgacagagggaatttttgtcctacctgattttcagttttcttttgggtcaaactggccttgtgaaatcaaaagagttgttcattaaactgcctgcttcccaagaccagtgtattatcacagataataatatctgtgaagctctgtgttaccagttcattttatttccatcctttttattgtgaggaagacaaacaattgtgctatcacccaagtagacaatgtcatctgtgaaaatgtgctgcttccaggagtcaggaatcggtactctttttaaaagaattttaaatcagaggagactgtcaacaatcacaaagaggaactttttatttccttgagttctcactacctcttctaacatgccacagcaatcttcatatagctgaaggaagtcaggcatgaaatggtgttctatttagtttaatggttaacagacagcttcaacagccacattcaacacattagccttgtgtagaaagacttgataatttttaataagttcaaaaagtgttttctatataaccctcctgtatagcagaagtatccttgactgtctttttcttttcattgccacaaaatatattgcagagtgaggtttcataatagtgtttttctagcttttgatttcacaaagtgagtagctcatggctccatggagttgaaaaagagaattaaaagggaagaacttcctccaatttttgaaaagatcttagctatcttctagtccaagtccttttatttgttaaagaaatcaagtctagaaaagttgagtgactccagtgactcaatttattaatgcatagcttatgttttcctccttccctcattttctcctttttccttcatcctttcttgcttttcttccttctcttcttcttttgtcccacttaccctttcatttccctttcttcttccctcccctccttccttcctctttccctctttccttcctttttatcttctgcttcccttcctgtgtttcttcttaatgctatgagatttttttttacctttctttcaatttcatatttgttcatttttttttcagtctgaaagactgcttctcttcacacctacacagtggctattttcctaagagatgaaatgccgttttcctagaaaagaagagaaagcagtgtataatacctgattttctcttactttctaattattatgtttcctagtcccaacatgtctaacttctaagtttaactctaaacttttaagttctcagggcaacgtctttattttagtattcatttatttaccaggtgaataaatagtttgctctgagattatattaaaacttcatcttccatctgatagaattaagaaaactccaagaaagagcataataattattgactattttgactacaacatgaaataccttgcaaatatggattcttacaattattttccatggatatttcacattattacctcatgtaaatcttgtgatcatcttctgagggtaatataaagaatatgacattatcttaatttttgtaaatgcgaaaacatttctaagatttcacatgacttggtaaaggtcacatggctcagcattagacccatatgggaaaccagactttctaacacccggctcaatatcctttcactgtaccaaacacttcttctcatgacagtaacttctgtttggttatgtacttaatcaggagctatgacagagaaactgggttcagaaagagtcttgggagagtaagacataggacagcacagtggaggagaatggaagagaggattgcctcatttaactttaggtctgtacagagatagtggcaagagagcagagaagtacctggtttatacaagagactccacatcattatgaaactgtaggctcgattagtccagaaaaattgatttcaaggttggaggtaagcaccgtagatagcgtcaaaacaagcaaaggactgaggcaaagggaacccatgatacagatcaacgaatctgacagtgggaaaaatagtaaccaggacaaataaaattatatagtactatggaaggattggatctttctgctttttggtcttaggtaaattgtctattcaaacaaatttccgtgtgtgtgtgtgtgtgtgtgtgtgtgtgtgtgtgtgtgtataacttattttcttcttttgcataatctgaacgcatcaatgaaggccttccaaggatgcaatatggtcagttccatgaatgatatccttgcatactgcattctcagattcttctcattctagggctctgtgtcagaaactgttgtgtggaacaagacccactaacttgggagttaacaagtgtttacttgactttgcattggcatcttataggctatcatcttgtagatgaacaatttgctccaaaatgacatgccacagcactgcttaagatgcaagtaacattttccttcacttggagggcccatttaacaagatgatctaaggatatggtttcagtgtatgctatctcatgagctattactgtaggtttatgtgactaattttattaaatatacaataattaatgtttccaaaaggtaatagtctctcttttaaagtaacaatcatgggaagttgtaagcaagtttaaataacatattcattttgggaactcttttggtataatttaaaaaatttaccagagtgcttttattggaacttgaactgtaagtgcccacctaatgcctgttggttaatatcacttatatcataggatcataataagaaggaaaatggataaagttcttccaaagaaccccagtgattctactaaaccctgttcacctcctttgttgcaagtcagataacacagtttccggcctaaactgtttcattaattaactgtgtagcttgagacaagtaaccactcaatatctttatctaaaaaattggattacatgatctcttagtttcctgctagctccatcagtctgtgtttctatggtccacttgatgtcaaagtcagtatcaggttcactttgggaaggtgtgatctatttttttaaaggttgtctaggttcacaagtttaatggaaccctgcctgtaccctggaaatactgcctatgatggttaagctattttataatatgcaggtttaaagttatctaataacttctcacaatataaaataacttaaaaagttttttaaaaattttgaacataaagcaaatttacaaactttaattccagtgagtagaattaaatcagcaaataagtggctaattgtatgtacttattgtcaactgggacttcaggaaagaacactgccaagctatatgctttggataatacaaatagtgtggaaagaaggagcaggggagcagaaaaaaaaataaataagaataatggaatgattgaagagttttgaatatccagaagaactattcaaacaaatagcactgacacatttttaaacaatcatagatagattcgagtaaacatgaacagaaaaataaacataaaggagaaaactcatgaagtgacagtctttacatttttttgttctaaaacatcattgggaataaacacaaaaatgatatataacttgaatactaacagaggtcatcatacgtaatgataataaaaaacagcaagaccagtttacccactccctgccctccattctatgagatgcctcatgtcttttctaagactttgggaacatttcaaggtcttgtaatttccaaaaattccagggttttgcagtttcctaagaatgtctggcctggtgtctcccctccagccaagcttagacagcattatagtgcccatctgttggtgtaatctccttcttaagctttgtgctcaccctcaatgtggagctcaatctcttgatgtggctgtctgccaaagccattccatgaaatgtctacatatacaaaatatgtggggaaatatagagtgttcacggcaacaacaacaaaaaaattataatgaaatctttcacatagctattgtggtgttttggagccatgccaccattttggagctctttctgtggttcttgggcataaattaagccctctcactttcaggaaagatctccccctgctcaattccccttcctctaactagctccactgagggtatatgtcctccctttaacaagaatgcagattttaacttcatgtggttagcggtcaggttttccaatatcaaataaaaccttgcagtgagtttagagaagttgatcaataacagcattagctaagtaaacaaaataatatcccagactgttgagtttgggaaatgatttttgagtttgcctcctgcaatcttaacaactgcacatgattatcagaccatgaaactattagaatgcttattgtttaaacgtttcccctccaactgcacacagattttatctagagatgaatttaagcatggaaactttaatactgaaatgaaacactaaacacaaaatgcaaagaagacaaacactacccatctgaggagaacatggcagtaatttaaaagcacatgtttttgtcaaataaatctttaggccaaagtgctaaagtactcttgcattctttgatcctttgcaagaagactatatatgtcaggaatgccaatgacaacagaaataaatacatagaaatatctacattattatgcctaaattatcatttgattcttttaaaatggtcttgccatgttatattatttcttaacacaccgagatacatgctacattggattataaattactttgaatctcggaattcaaatttgcaaactgctgagagttgtcagactgctatgctgattaaatgaacaatctaaacatttgcataaagaagaattcctagggcaatactcaactagaaaacaacaacttagaataacatgactaagagctgtgggtgggaatcaccaccaagaaagtggcaatgctgagtcacaaatttggggctgcggctatgtatgaaaaccagcaggcaggtattagagagagtgaatggtgaaagaaaggagttgggagggagggagtgagacttagagggtagaaggagaagactggaggatgaacatgattctgagtgagaacataattaccatgtaagtggtcacggcctcccttcctcaaaaagaattttgagtgtcagcataggttccctttcttctcacatcatttcccaacaatgttgccagtatcttcctctctccactcattttctatccaaatagtatatcaagttagagtgtcaacttttgatacatggcacctattggagttagttcagttggcaagactaagaaagagttgaatagcctgtaatcccagcactttgagaggctgaggcaggcagattatgaggtcaagagatcaagaccatcctggccaacatggtaaaaccccatctctactaaaaatacaaaaatttactgggcgtggtggtacgtgcctgtagtcccagctactcaggaggctgaggcaggagaatcgcttgaacctgggaggcagaggttgcagtgagctgagattgcagtgagctggagtataaaagtactccagcctggtgacagagtgagactccatctcaaaaaaaagaaaaaaaaagagttaaataattctcaaaaaattctttaattggactatgaagtgagtaaaaaaaaaatacaacagcctcaggccaccataattttacctgtgaaagccagcagccttaaataaaaacaggacttagaatagagcatctggactgtttgcatcttttgacacacctggagtagctaatatcctttacccccgatgttgatgcctgcaatcttaatgtttcaaggaagagttagagtaagaaatatgtgtggcaataaatctgtgctgtttttcatggagctgcaactaggcattcttttgccaaaggaagaacagagttaagttagttaaaatggctaatattgactagaaataaggttttgtattctagcaggtgctctttaaatttgcctacttatacattataattaatcatcttctgtaaagaatctatgtatttcaaaattgcaatcacctttatatatttgcctaattttatacaatatcaaattatggattttgtacacattgttctccaaaattgctagacagatgtgacaaaggcaaaattataaaacttaatctatcttaaatggtcaaaaatgattatgttgtaggtttaattggaattagagaaagggaatttcataagtacactattgtcttagtttgggctatcataatagaaaaccttagactggataatttataaacaacagacatttatttcttacagttctgaacactgggaagtccaagagcaaggcaacaacagattcaacatctggtgagagctactctctgcttacaagatggcactttcttactgcattctcacacagaagaagagaccagtactgtgtcctaccatggtggaaaggcaaaaaggagccaaacaggctccctcaagaccttttcttttctttcctttttttttttttttttttgagacggagtcttgctctgtcgcccaggctggagtgcagtggcgcgatctcggctcactgaaacctccgcctcccaggttcaagcaattctgctgtctcagcttcctgagtagctgggaggacaggcatgcgccaccacgccctgataattttttgtattttagtagagatggggtttcaccatgttggccaggatggtctcaatctcttgaccttgtgacccgcccacctcgacttcccaaagtgctgggattacaggtgtgagccaccgcgcctggccctcaagaccttttataaaagtactaatcccattgctgaaggcagagacctcatgacccaatagcctcttaaaggcctcacctcttaataccttcacaatggggattaagtttcagcatgaattctggagggaaacaaacattcagaccatagcaattaccaatctttaaggggctactgccctcaaattgcactcaatttacatcgtatcaattgctataccacttaatggacattgttttcatcatataattttttttctacttttctctgctttcttcttgccattattttttagcattgctattgaatatatgcattaaaacatcattaacatgtcacatttcttttcacaaatatttaatgaatctctccccttcattgcctgcaggataaagatccattacttggcttttaaaactctacaggacatagtcccatgtgaaacaccatctttttatgggttctagtaacaaaattggtacaagcctagcaagaatgctgacctgagaacctactcaaagtaacttaatcttttatcccatggagaaaataataattctatatctcagtttttaagcttccacatgattgcctcctgcctaatcctttatcagatgtgacccaacttcccttactttatccagtacacttacgtgtagcattaatgacattttggtcaattatggcccacatatacgaaggtggtcccataatgttataatggagttgacaaattcctattgtctaatgacatcgtcattgtcatgtcatattacaagacatcactaacatgtttgtggtgatgctggtgtgaataaacctactgtgatgccagttgcataaaagtctaacatatacaattaggttcagcacctaataattggtaatgtacataaacaactatgttactggcttatactttttattgtaattttagagtgtacttcttctatttacaaaaaaaaaaacaacaacgttaaatgtaaagctgccttcagcaattcctttaggaggtattccaaaagaagtaacactccatgcgtgttactacctctgaaaatctttcagtgggaaaagatgtggaggtgaaagatagtgatattgatgatcttgaccttatatagacctgggctaatgtgtgtgtttttgccttagtttttaataaaaatgtttaaaaagtaaaaatatgctttataaataggaaaaaccttatagaataagaatataaaggaagaaagtatttttggagagctttgcaatgtgtttgtgttttaagctaagtattataacaaaagagtcagagttaaaaaattaaaatgtttgcaaagtgaaaaagttatagtaagctaaagttaatttagtactgaagaaagaaattttaaaaataaatttggcctaagtgtacagtgtttataaagtctacagtaatgtcctaggccttcacattcactcatcactcacactctgactcacacagagcaatttccaatcctgccatctccatttatggtaagtgccctacacaggtgcaccttttttttttaattgtcttttatagtgtatttttactgcatttttttctgtgtttaggtatgtctagatatacaaataccagtgtattacaattgcctgtagtattcagtataataacatactgtacaggtcagtagcctaggagcaataggctgtaccatatagcctaggtatgtagcaggctataccatctaggtgtgtgtagcaataggctgtaccatatagcctaggtatgtagcaggctataccatctaggtgtgtgtagcaataggctgtaccatatagcctaggtatgtagcaggctataccatcttggtttgtgtaagtacacactatgatgtttgcacaatgatgaaataatctagcgactcatttttttggaaggtatccctactgttaagcaaagcatgactatagttagaacttctattgttccctctttgctctggggccttacgcctgctaatctctctgcctgaaagcttttgccctaagcctccatgttagctctcttgttttagctgcctcatacccatattttatgtatcaaacaacttcccctttctctgagaatcttttctggatatctcatcttggactaggtgcccataccatgtgttgccatgccatcctgtgctgcctttattatacatagatattgtcacactttattgtaatcagttccatgccttcccatagactgtaaaaagtttggatcaccttcattttattcatcatttcattccagtatctctccccatcccatcgtttctagcttatagcatatgaataaatgcagtttccaagttaaggctatgaaaaggtatttttgagcgcagaaataagtagcaaagtcaaagtgataaataaaggcaaattataacatcaaaaaagcagtttttcaaacattgtttctgagtggaaagagtggcaatgaacaaagttctaaaaccaggaagacttagccaagaattcatctactctcctccccaaagcaaagtggacctatatttcctccaggttgtttgaatccttctcatactatgactgcagtttccaatttatttctttgcggattttgtttttccagtttttaatatttagtttcctccatttacctgagttctagatggcaaaaccacagcaattttggttcttaccaaatatctcctctgacacagctatcttctcccaaccttacattactttccaagtgttgattttattgttgatattattattatctccagtttgagtctaagctctaccaaggaaggaagagtgccttgtccattttggggttcacccttaaattaccttgggtgctgtccagcacatggttaataatcaataaacaaacagcctactggacttgccagttttcctgggagaaggcatcttatatttcaggaacaaaatatattttacaagcaaagaatacatagataaacttcttttaaaagttctatgttttcatattacttatttgatttgttagcattattctctgccttatttcaacagaatgtgatgtgggtgagaaaggatgataaagtcaaaactaccttggacactaatcaaaagatttgggttaaactgtataagttgtctgagcatcagtgagttatgcaagcactctgggcttcagttctctcacttgccaagtaagaggcttgggtcagagaattttaatatctccacaagctacaacaattctatgactatttttgtattatgcaaacagagatcttcacaccttttataaacatgtggagcaattttctgctgagaatctcagtgtttatccatgatagttaaataataatccattgatagtcaaatactcttgttaaaagatttccgtgtgtttaatgagtctatttattacccattgggaaacactgagtgatataaaaaaaaattcctatcatttatcatagaatttcctttcaacacaaaaaatcaaccaccaaaattctaatattatcatgtatctacaactcgaattcaattttaatctgctgctccaaagagttctacaaaaacacactgtgcttggctaatctctggacacagtcacacctatttaatgtggaggagtctgcacatgccactttccaaagtccactgtaggaaaagctttcagcaagataagtcacagctaaatgcattcttgaagattaattatcacttggatcttttcagctttcaaatatacaattgcattaagtgtaaattaactaccttggagctgcataatggacactgggtagaggactttcacctttatgtctttggttggaatctatccccagcttaagactgactgaaagtcattatcctttgtcaactgttcggtgacttatgaaatgagttattggtcttagttaagatcctagcgcagcctaaaagaccttcacaattgatgatcatcaggaactgctggaacttgagaaagaggatcggagattgaattggtcatggaaatttaattagcgtccccctggtccaccttccaaacactcattgaggctgagttttgcccttctctggaaaagaacgatttcagtctttggggttgctgactggacatctttcattagcataacataatggagacaacttatggctttttcttctagttagggcagcacaattatccccaatatttttcttcacataaagagatatctgaaggcttagtcaactgtgggaaagattttatttttttgttttaagtctctcagagtacagaaaaactactgagattccataacatatctcatcattattgtctctacggaggcaagaacatgttggcatcagattattatttttatctgtctagaaataacatggttcaggaaaaagtgtccttgtcatgtgaaggcttttgttgtctgagttgtttgtacctgctctgcatctgtcagtgaatggagtttgaggctttggtttccccacatataaggtaaaggacattagactggatttttcaaagtctcttctgagtttatcagattctagcactgacacattttccttttcctgaaagtcttgggactatatggaagcctggggcttttctcttaagaagacactatcattttaatggttgaatattagacgggatgtagcttcatttggaagtcattagctgaggaacattaaaaaaatttatatgaaatgaagagtgggaatcattaagagtgacaatataaaacaggtaaataaaaactagaattagagagtaaatgggtaaacagtgctttctatcatatcccaggagggtgagaatgtaattcaggaggactgcaagaatcatttcaagtgtaaagatgacaatcagaggccaagcgtagtgacagcagctgcacctgtgacggtcagaggccaataattggtgcctgggagttcagagttctttctcttcctcttcctccccttgcctaccctcccctccgctccctgcccctcccctccccacccctcccctcccctcctgtaccctcctttctcctcctctccccattataaaatacatatttaaaaaccagagattggccaggcatggtggttcaagcctgtaatcccagcaccttgggaggctaaggtgggtgggtcacctgaggtcaggagttcaagagcagcctcgccaacatgatgaagccctgtctgtactacaaatccaaaaattagctgggcatggtggcacgcacctgtaatcccagctactcgggaggctgaggcaggagaatggcttgaaccctggaggcggaggttgcaatgagccaagatcgctcactgaactccagcctgggtgacagagtgagactccatctcaaaaaaataataataaataaaaaacaaaacaaaacaaaacccctgagatttagccttgattcttgaatttttcttcactctgctcatatagactctactatcaagttcagttgatttaagtgagttttcctattactcttcatctccactgtcaccattttagtccaaacacctgccatctcttatccaatttaaagggataaatttctttctctttgattccagttagcctcctttcccatcttgaatcttttctccacatagttgtataaataatcttttaaaaaacatgtgttaggaaacaacttatgttcttaaaacctttcatagcttcccattttcacaaaatccaaattacttaccatgacttaagttttctgccttgaacttttacatatctccaatattgccttatgtcactgaggtcaacagaataatgttccccacttccccaccaaatattgacattctaattctttaaacctgtaaatatgttaccttacctggcaaagagaactttgcagaggtgagttaagaatgctgagataagattagcttgaattatgtgtgtgggctgaatgaaatcccaggggtcctcagaagaaggaggcaggaaggtcagagtcagggaaggagaggtgatgacagaagcagaggttggaatgatgcgattgctagaaagggggaccataaccaaaaacaggctgccagaaaaggtaggggcatggactccttggcaaccttgattttagcctagggaaactcatttcaaacatctgacctccagaactgtaacttgtgttgttttaggcaactaagtttgtggtattatgtgacagtagcaatagaaagctaataaaatcactccttctattcacaaactatgccctatctatgtgtcttttctcagttcttggaatacagcatggttcgcaatgccacggggtctttgtacagacctggacttgtgtaattttatccataattatgggctagtttcatttattccttttgttatcatcagtttaaatgacatctccttggatagatcttccccaacctcttcttttatttttgtttcggctccttcttttcatttttgttttaataggatgccttagtcctgacagttgttttatttattgtatactacttggggttctttggtcgattttttaggttttccccccttttcttggtctattgctttctgtagaactaagttccatgacagaagaaactgtacctatcatggttagactcatatctttagaatggtgtctggcacatagtaaataccaaatgaatatttaaagtctacttggcagacaaaatgaatgatttggggggaagcagcatattagggagacactctactctaagaaaagaaagatactaaatgctagccaaggatcctcagccattgctagattttaggcttgattttgtgccacaggggagatcaggccctaaggaaaacaggacaaatgctaaagggatgtgagttgtcagagaagaagcccaatccagtaaactaagcaaatctaagtgggtctggtctgcaaaggtgctgtatggggcttaaatttcagacaggtgtttgtgcctgaatattagatccttggtcaggtgaggctcagaggccacacaggaactcagcaaatggaccaagttctaactcccagtataagggaaaaaaagatgaatgtaagtggaaaagagggcagagaccattactctcttgtccaacctggaatcctgaaaatttgatttaatgccaggcacttaagaaatccttaataaaaatagtcaggacaaatacgagtgagagatgaatgaatgatgaatctatgtatgtaaaagtaattactgtaacacttgacatattagacaatcatgatctctttctcttttataagttgtagcaaatgacaaagctgatgctgctttctatcttgtcagggacggctgtggaattggggatgggcttttgaaatgctggcaggtcccatggtggaaacactggaaagacaaagacagagaaacaaggcagggtcagcagcagcaactgattgcttcagggaagaggctgcttagaggagatgttaatattgtcactgtttgagtgacatttcttcaagattttcgtcagtaaagtgagttagattaagcttagtataattaacccaaataaattagctttaatcaagtattcaattctgtaattttcttgtctccttgatctttctattccttcctaatccttttggcattcaatcctattttattctagattgatatctgttaaatcaatttccctggctatctaaatgacatttgctctaaagagaaatagtaggtcttaattcccctagtgtattagtttccttgggctgtcataacagaacaccacaaactgagtagcttaaaacaacagaaaattatttattttttaaggttatagaagctagaaaccaagatgtcagcaaagccacgatccctctgaagggtctaggaaagaataattttctcttcctagcttccagtggatgctagcaatcattggcatgcttgttctcatggttgcataattccagtctcagcttctctcttcatatggctttttctccttggttgctctgtttccaaattgccctcttcttacaaggccatccattatatttgttttagggctcaccctagtccagtatgagcacatcttaacttgacgacatttgcaaggaccctatttccaaataaggtcacattcactagttctgcatagacatgaattttggggggaaatctatttaaaccactacacacagaaagaaagaagagtagtattgtgggatatgcccaggttgaagactttgttgaggaaagcctagggaacttttcacagagagttttgtttcctatatactttttcataagggactatcccttaatcatctttatattctctatttttttttgaaacttgttctatacacagtggtatttattgaataatacaaaagcaatcttgaataaatggattttaataatgatcctcttggcttatgacccccgcagtcctccagtactaatgaactagctttgtattgactcagggtctaggctggggaatgcctgattcatatgtcttggtctcctgggaccaccaaactttgttcctgagatgcctgtcacctgggtgatatgttcatgactcctttcaacacctgaattttgagcagtgctttgagaaatgaaacctacaggatgaaggatttttttgttcaacaaagttagtaatagactggtgcttacatgaactatttttaaggtaatatttatataggtaatatacttaaaacaagaggttgatataaagagttgttcttcaatttataacaagctatttggctaaattcaagtattttgtttctgaaaaagcctaaaaagtataaatctaaactttagaaaaatgagctggtagaaacagacaatgctaaataatatgttactttttctaattgtttcatttgatcagtacacagtaaataagacatgcaatattttcttctcttaccaaacaagaaactgaagctcagagagggtaagtggtgatgttaaatataacaagggaagaatgagtggcagggttttatgtctccatattctggtcccctttcgtttccagtacatcaccctgcttctcatcacttgaagttacaaggtacttttcacaatgtctactcagcttgtagctatatgttacagcccacttcttcatttaatttagtcataatgtggattttgttcagagactactaggtttttcatgttcaattagttttaatattatttgtttacagtcttttaaaaaattacatctcaaatataaacataaaattagagaacagagaaggcctgtgcacttggcccaaaagtacccgattcatagtgtgacagcctgggtttaagtcctgtgtgatgtagggtgagctactgcactcagagagagcagtcatgctgagccagtgtgggctcctgcatttgccaaccctgtgatatgcccacaattggatatgaatgaggggaagaactccagcaggaagtatttgtaagtaaattggtcattctggttgcattgccaattagactttgcccagcacatgaacgactttgggcctattgatatttgctgtgacacttaaatgttcagcacagtattgattctgaatgtcaagccctctgcttagatgctgtttctatgtgatgagcagattaccacagaatactaattgaaccatttaaacacacacacacacacacac

SEQ ID NO: 394 - DNA, 60001 bp, Homo sapiens
gcattgaggagggaatgagcagctacgaagaggagggtgtctgtctctttaaacccttgcctgtgaaaggctgacagtacagaacactggctggagtgaggctgacattgacaggaagctgccgaaagagagagggatgctggagaaataaaactcaacttatggcactcacatcaaggaagtgggaagggatggatccagagggacaagccaatggagacgggcgagcagggtaaggagatggtatcctcctccttgatggagaagctttttccaagaacaatggaataggtgtgcggggcatagggagacttggaaggacccccaaagggaatagaaaaggagagcctcttggccactaggatggtgttagggagccaggggaggttggagcctctctggaagtgccctgtggctgcccaagtgaggggagacaatgagtacacatgtgaagaaaggatttcctgtgggaaaaccagattcatgtccttcctgcccagagttatgttcttcaaggagttcagtcctgcacacactagtgaataatccttataaatgtccacatatgccccccaagtacgtctaccaaacatagctcagtcttacgtaaaacagtgtacacatgttactaatcagatgctctcataaggaatcatgccattttgagagggcccgaagctctaacaacttgagacctcctatctgggccgtagctttctcattataaagttggaagtggtaggattagcctggatgggttctcattacctcccaactctggtattctgtggttctaatggtagttggtagcccttggcatcactcaagaataatccttgatggccagtgtgcagcactgcctccctgtgggcacccctcagtctaacagccacacagcaagtccccagcctccccagctctgccccattgtatccaggtaagcaaggtgagcccttgctgtaagcatcaccctggttgccttcccatgacccagcttctgagaatctccttgctgtgtgcatagccctcttcacccatctctccagctcttcgtgttgggctccgcccttcttctggtagtcttctgattccatgtggccccatgagccactctctgcccaaccagtcatgtagatgtggcttgtgcacagtctagagactatataagcaggccatgatggttggttgtgatcatttttaggtatcatgctcttgataatgaacatatccctcgatttgatactgttttgatgggaaaatcagttttatcccctcaccatccctttgtgagcatacacctagccttaagtgcttagaagtggctgttctggccaggcgcagtggctcacgcctgtaatcccaacactttgggaggccgaggcaggaggatcacttgagcccaggagttcaagaccagccggggcaacatagggagaccttgtctctacaaaaaaaaattaaaataaattagaaataagaaataaggccaggcacggtggctcatgcctatgatcccaacactgggaggctgaggtgggaggattacttgagctcaagaatttgagaccagcctgggcaacatggtgagaccccatctctacaaaaaaatttaaaaaattagccaggtgtggttttgcacacctatattcccaactacttgggaggccgagatgggaggatttcctgagcccctgcagtgagctatgattgcaccactgcactccagcctgggtgacagtgagacctggtctcaaaaaaaaaaaaaaaaaaaaattctgtggcaccctcctggagacgggtctgtttttagcttccacaccattaatagtttaatctcttaagtcacaagtaaggaaagggagtcacatacgacagcaaaagcccgcagttcccagcaaaagccagaggcaaatgagaacccacgaagaacccagagttcacaccacaacctgtgcgctggtcggggtgacccatgctggacctccacagaacatggggccattcagctaactcagtaaacacttgctgagcatctgacctgagccaggtcctgtgctgacatctaggactttctacccttaaggagctgtggctttttctctagttggtgagacagatggaaaccccttcagttccactacagatatttttgaaatacctgttatgtgccaggcactttctgaactcgaggtaccgcagtgaaccagacaggtgttatctatgccctcctggggcttctaagccttcagagaagatagacactgtacaggtgagttaagtgctccaaagagtatggctcctggtgtgtaagggttcaaatatctgttgatagaaaggataaaggccatgtcatctttattctttctcacagggcccagcatggggcctaacacagttagacttaagtaaatggattcaactcactggtccccagcactgtcctctgcatgatgttaccgaaatggagacaaccaaaactaactggacaacttagtcagctggactggaagactgcacttccaaatggaaaggtttgcagtggctcctttggaaatgtggcttcaagggtggagaggggggaagtgaatgtggggctcgcattataggctttgggggttacagagcttgctggtgttgcttgcccttacgctctgtcaaatctcaggcagatgaaacaagatgtaagctttctaaattatcaatagagggcctgtcattcaaatggaagataagaccagagaaaataaaagtccaccaaaataatgccagagaaaaacaaccctggtctttcaaaaaaccatagatacaatttcttagagaagtttaggccaggtacagtggctcacacctgttatcccagcactttgggaggccaaggcaggtggatcacttgagcccaggagtttgagaccagcctggccaacatgtctctaccaaaaaaaaaaaaaaaaattagcctgttgtagtggcacacacctgtagtctcagccactcaggaggctaaagcaggaggatcgtttgagcttgggaggcagaggttgcagtgagccaggatcacgccacttgactgcagcctgggcaccagaatgagaacctgtctcaaaataaaataaaataaaataaaaaaggtttagtccaggaggcctatttgtgttttgaatcaaaattcactgctttagaaagaaactgcatggatttcagtgttctcgtctgtcatactctctcagacttctttcctaccctcagaaagcttccattttaagataggaaagagaagccctgaaacaagaccagtgtaacttaagttacaaagaggcattcatgtgggtctatgtgtgtggagagaggtcacttctagtgtcactggtggtggagacccaggaaaacttcacagaggagatggcattggaattagctcttgaagcataaagaagactaataattaggataagaggaaatgcctctcaggaggaagacaaatataggcaacagcctggatgtaggataacctaggacacacttaagtaagaaggtctagtataatttcccttgactctagttcacatgagggtaatagagggaggtaaatgaaccagatcactgaagtctgaatttcaagctaaagagtgtggtttcattttcctcatctataaaatgaagataatatctctgtctcttgcaagaattaaagtgaggccaggcacagtgcatagccctcttcacccatctctccagctcttcgtgttgggctcagcccttcttctggtagtcttctggttccagataatggctatgattccggcactttgggatgctaaggtgggagaatcacctgagccaggagtttgagacgagtctgggcaacatggcaagaccccaatctctacaaaaattctaaaacttagctgggagtggtggcgtgcacctgtggccctagctgcttaggaggctgaggtgggaggatcgcttgagcccaggagaacaaggctgtggtgagctgtgattacaccactgtgctccagcctgggcaacagaaggagaccatctcaaaaaaaaaaaaaagttctgcattagatgtatatatattagatatgtatatattagtcattaactacttgcataatgctttgtaaaaagcagctgacacaggctgggcgcagtggctcacacctgtaatcccagcactttgggaggctgaggtgggtggatcacgaggtcaggagatcaagactgtcctggctactacggtgaaaccccgtctctactgaaaatacaaaaaaattagccacacgtggtggtggacgcctgtagtcccagctacttgggaggccgaggaaggagaatggtgtgaacctgggaggcagagcttgcagtgagctgaggtcgcaccactgcactccagtctgggcgacagagcgagactccatctcaaaaaaaaaaaaaaaggcagctgacacaatggcagtggtggcagcggagaaccatcgaagattttgactaggggagatgagtcacttgtgtggagatgtgttttagattaacacagcactgcacaaattagcaattagcacttttgtaatattagtactcataaattgcttttctttccaaggaattaaaagacatgaacagacatggtaggtggttacatcggtcagggttctctcgagaaacagaaccaatagtagagatttattcaagcttgcacagttgtgtaggctagccagtctaagatctgtagggcaggcagctgaggcaggatttctgtcttaaggcagaattccttctttgggaaacttcagcttttgctcctaaggccttcatctgattgaatgaggcccacccacattatcaatgtcagtctcctttatttcaagtcagctgataaatcacatctacgaaataccttcccagcatcatctagactagcatttgaccaaccaactgggcatcatagcctagccaagttgacatatagaattaggcatcacagtggtctttatcttgaatatggaaactgagacacagactggcaaactgacacagaagcttggccaaattagaattcctagaacccggtaccaggcctaccaggtaactcttgtgtcttatagttttatattatttattcctgctttttacataaaatttaccatagacataaccagactgaatatctatgggtagattgtgccgaatgctgatgcaaaccactctattttggggaggaaagagaggactgacgtcaggtcaggcccacaggtagagacacagactttggcttggtgcgaagaaacacttccagactggagtttccaccagtgggacaggctgcctgggacacacacagctcttggtccccggaggcgagcaacaaaaagctgagccacttaacatggtgctgtgaaggagatccaaacatccagccagcatggaccaggggctgagaagagcctccctccgagcctgtatgaattccgataaccccagatactagaaatgatcctcacaattaactgcatccttcagaaaagtccttgctcctctccctaccccttctccaccaccagggagcctgtggagattggagcagaacggggaacctccctgagatggaagccatctgcaggccccactcacttttcctccactggcgccctcttgcctgccagcctaccctggttaaccttcctgggaggagagcttgtcaaagtcgcctccgcctcagcctcctttcacaaccctgcctcatcttccacaccaagtctcagggggcctgcaggacccaccatcatcctggagaagtcatgggtcgccagccacctgtctcctgtgcctgcacccaactaaccatcgcttcctgctaatttgcattgacaaccttcctgcacttggctgctcaggggagttttctggttttatctcctcaattaactttggcctcctgggtcactctggatttcccactgcagacctggctgtggaagcctgcctatatgctccagaggattcttgtcttttcacgagccctcccttcccatctgcaagccaggctgtgcacacagcaacatcttgcaagggagtctcggccatggcaggatttttgaagttctggtgggtgtcagagctgcaaagggccaaaggactgtctagtccactctagcccacccgactttgcctcctctcctcacttcacagatgggaaattgaggcaagaactgagaaaaggcttgcggtggtcatacatcaagtcagaataatggccagacccaggccttggtgccccctcaaccccctcacactctctctgccacattttgtcaacagaaaacaatttgcaaacttcatcaagttaggagggagtgaaaaatgtgtttaaatattgagcttcaacagccttgttacttctaggcaccttcagctatttgcaagaatctctgggcatagcatgagccgggctgtggcatgggagtgaggggctggatggagaagaggcctccctcctgggccaggaagccgactcccatcccctcctttagcaccgtggactgagcacctctaaaataacacctcccatggagttacgatgcgtcagggagcaaatgaactctgagatgcaggaactagacctgaggacaggaggaaactgggaagggagtggggagcagcagcagagcaaacagaaaagatgcccgaaggaagcgagttcctaggccaccaggggccaagaccccagcacgtgctatagattatcttggggttcccaagagaaagaaactctcaagatcagaaagtcactgttgtcttggaggactttcagagataatgaagtctagaatgctcttggtacctatggggaaactgaggcccagagagagcctcgcatcccatactgagttgggggcagagccaggactactgcccaggcccgaccccagtgtgagactctttccacaaggtggggaaccagggcgtgggagcagggtttgcaggagacctgaaggaggggacatctatggttgggtgttgaactttttggagccctagaggccagtgaggcagaaacaccacagaggaaagctggggtttctctgtgacaacagactcttgtggtgctatgaagaaactggtgtggttgtgatgaggaaagaaaggctgtgaaagtgaaatttccaatttgtgagaggaggaaactgcaaatgtgttctccatcccatgcaaattatctgtggccttttgtcctgcacctgcagcggctcacaacatacacaacaccagggctcagacagggctcagggtcccgcagagtctgaactgggtcttccagctccaaacacagcaggagcacaggggcagagaaagtctccctccagctgtgggggtgtcctgagatgcctgagctgcacctgtagggtgtctgccctcccaagggcctgccaggatgagaacgggcaaacctggccaaggtgaccccattagggactaccctcctagggacagcactcagggccgttcccaatcaccccggatttcctgtcctgctcgtctcctgccacacctccttttgatctacccccaagacacccctacctttttattctgtgaaaatttactcatgctgtgggccctgctggaaatgccctcctactgtttccccaaaccccgtcagaaattccacggggaaactcccttcccttctgctgcaggcaccgtcactgtgtctctcagctctgccccccagcctctgagtaccaccttatcctagcccttagctactggcttgtcattgtctctttacgttctcagcctcccacagaagcctgggagctcctcgagggcaggtatctgattcatctctgtatcccaaaagcccagcgttttgcttggcacccattagaggccaggaagggcaaacctcctgtcaaatcccgggggagatgttgctaatcagtcctgaacaccgttcccttggagactcaggcttctcaacgtggtgggtaggccctgcctgtcagccaggacctgctctcccaaaggggcgctccagaaatgtgtgactcagttcagctggaagctcctggcccctcagaggtttgacgccagccctctggtgtgtgatttctgagataccaaggcttacttcctcatgacgcccgcatgctgcctcagcttcactcctgagacagtccaggcaggaagcacagaactcctctcagttctgtactcacactcgatattcacactcatacacacgcaagtatgtacacatgcacatatgcacacttgcaccacacatgctgccacatacacaataacacatgcacacgcttgctcacacttgcacacacacacaaatacactcccatcaaatgttttacgggattcaggagtttcagtgaagatttggggctacgaggacaggttacatgacactgggcatagcttcccactgtccttgcagctccccctacccactctctctgtcctctccccctcaattccctccattgttccagcactgccccacctcggtcccaaattctcatccctctgttttatagagccattctactgtctgctctggagttgggaactgtccatacctgtgcctgcagatcccaaacaagggagtgtttcccaaagaggcatttgaatcacatgtttctccgtcttgcttagtatcattatgaacaaatgaatggctgtagcagaagaatgtcttgtcacagctctccatttcccattctaaactaacacaattctggccagacataatggctcatgactataatcccagcactttggaaggctgaggtgggaggattgtttgaaccccggagttcaagaccagcctgggcaacatagtgaaacccccgtctcagtttttttaaataaaagaaaaaaaggaataaacacaattcagtgacaaatctcttgttttgggccctactcagtgcctggcactgtgccagacactgcaaatacagagacagtagctcccccaagaaagcaccacagtgcctaatagcaaacacacacacataagcaaacactaggctgggcacagtggttcacgtctgtaatcccagcactttgagaggccaaggtgggaggatcacttgagcccaggagttggagatcagccagggcaacatagaccccatctattaaaaaacaaacaaaaaagcacgcatggtggcccatacctgtagtcccagctactcaagaggctgaggtaggaggacatcttgagcctggaaggtcagggctgcagtgagccatactcatgccactgcactctagcctgggtgacagagcaagaccttgtcccaaaaaacaaaacgaatagtgacaagtgaaggatgtgactgaggccatcctagaggtagagaaacagcctttctgctgtgatatgaaggacagtcaactttccaggtgagcaagattgggaaggtcatctcaagcaggaggagcagcacgtgcaaggacacaggagtgcctcacctattcttgagcttcatataaatggaatcatccagtgggtactcttgtctctgacttccttagctcagtgagtctgtaagattcacccatggggagaatactctaaagctttgtttcaaacattgagaattggggagctaacttggaggagcccaaactcaacacaatagtttcctaatcaccccaccacagaagcagggctctcatgaaaattagcttttatcctcttcttgtaaaagcttccacagaacctaagcctcaaggagcacaatgtatagcaagctcccccaccgcctgcactgagcagcaagagtctcactctagtccacaacttaagatgttctattaaacccagggtggattttctatgcccagtggttttccattttgtcttttaatttttactttaaggacttaattttaacaaaagagccaaattaccaccaagctttgaaatgaactttagaggagttaagaacaggctttggaatatgaagctttaatgaatattggaagacagtaattaaacagccactgtgccctgtctcatgctttacaaaaggcaaggaacagagagatcaaagactggaggtgtttgcttcggaaccactggaaccacctgaggagattttttttttttttttttgagacggagtctctctgtcgcccaggttggagtgcagtggcatgatctcagctcactgcaagctccgcctcctgggttcatgccattctcctgcctcagcctcacaagtagctgggactacaggtgcctgccaccactcctggctagttttttgtatttttagtggagacagggtttcgccacgttagccaggatggtctggatctcctgacctcgtgatccacccacctcggcttcccaaagtgctgggattacaggcgtgagccaccgcgcccggcccacctgagatttaaagtctcctgtgcccagcctgcacccccagaccaatggcatcggaatctgttggatggggacacagacaccacaattatctcttaagcactcacgtgattccaatgtgcttccaaggttaagagtttctggattgattgacagtgaagtgatgagaaactgataaaggaaaacgggtgaagctgaaagagagaggtcttcacaccaaaatacagctcagctttggaaggaaccgagagggctacacccaagcctggtgacaccaagggacatttccaacctctgaggaaggagttctgttatgggctaaattatgttcccccaaaattcatatgttgaagtactaaatcccagtacctcagaatgtgactgtatttgaggctggccctatagaggggtgattaagttaacgtgaggtcactatggagagcctcagtccaatctgacaggtgttcttaatacataagaagaggagaccggaacacacaaagagacccaggggtgcacagggaccacatgaagaggcagccagagggcagccacctgcaagccaaggaggaggcctcagcggaaagcaaccctgccgatgctttggtcttagacatctgtggatgacgtcactcagtgttagtttggtgtagcagcccttgcaaaccaatgcaagcttcatttcagcactttggtcttatgtctaaagagtcttctcacaaggttacttcttcagccacttctcggactcttccctaacaactaatgaggatccccttaaatactgatccactaagatgttcacagaatattcctgataattatggatagtggaaatgtttgacaatgagagaatggagaagtaaatgatagcagtcagttcaatagagcatgaagaagccattaagttatcaagatttttttagcctcttcccttgtcttctaacaaggtctttttttttgtttttttgtttgtttttttttgagacagtctcactcccatcatccaggctggagtgcagtggcacaatcttggctcactgcaacctctgtcttcctgttcaagtcattctcatgcctcagctgggattacaggcatgtgccaccatgcccagctaatttttttttttttttttagtatagacggggtttcaccatttggctaggctttcaccatttggccaggctggtgttgaacccctgacctaaggtgatccacccacctcggcctcaaaagtgctgggattataggcatgagccgccttgcccggccgacttaaaaaaatctcaatagaaggcctggcgcagtggctcatgcctgtaatcccagcactttgggagactgaggtggacagatcacctgaggtcaggagttcgagaccagcctgatcaacatggtgaaaccccgtctctattaaaaacacaaaaattagccgggcgtggtggtgggcacctgtaatcccagctactcaggaggctgaggtgggagaatcacttgaacccaggaggtggaggttgcagtgagccaagatcacaccactgcactccagcctgggcaatagaatgagagttcatctcaaaaaaaaaaaaaaaaaaaaaagatttttaaagttgcactttcagcatgatctctcacctacgcaaaaacgcattgaaaatgcccttcagtaagcggatgggtaggtaagttctgaggtattcacaaaacagaatcccacaccacctgcaacaacatggaagaatcttacaaacattgagctgcagggaaaagaagtcagacacaaaagattccatttccctaaaattcaaaacagccaaaactaaatctgtgctgttagtagtcaggatagcagttcccttggggagaccagaacggggtacaagggaaccttctggggtgcggaaaacgttctgtgtcttcatctaggagatcaagaccctcgtcctgagacctcctaaccccataccaggacacttgagtatgtgtctactttctttgcccccaatgtctaggttacctataggtagtcctgcctctccaacacatatggggacacccacagagagtctttagcttcacagttggtgccttgacctacccatctgcatcctaaacccatacaaggatgtataaatatagaaaaatgtattgagttgtaattgtactttatgtaggttaatgtcagttttttttaagtgttttaaaaggcagtgtaaaagagctggaagttagtatgtacacagatggccatggcattcagctggggctggtacagggtctgtgggactggttaggggtggggcaggcggctcagttctgacttgggttggaagagtggaatctgggcaggcttcccctaaggaagtggctcttagatgaaagcagaatgaatggggggaaaagcatctcagacaggcttgttcaaaggctcataggcaggccagtggaggagtcatccaggctgagagcactggtcagggtcggaacatggttgtggtgggagaggagatggataggacagagacagggacacccaactgcagatgaagttgtctgattccaggaatgatcccagcatggctgaccaagggtggtctgtgctgtcgatgatctcaaagcggggtcgggtagccatgccagcttggggcacaagggagaagatatgatgtaccacagtctagatgatgtggttgaggtcccaagtcactgtacgtgagaatattgatgggtaaaccaaggcacaagctggagagctcaagactctgtggatgtgggtgtgtgtgtgtgtgtgtgtgtgtgtgtgtgtgtgtaggagagaaggtaaaatacataggtaggtagacacagtgtcctgggatagagtgaggggatatcaggacaaggtcatgagttgaggcttggaacctagggcagcttaggggttcttagctgatctggtttccccttgggttttgtttcgttttgttttgtgagtgcgtgtgtttagaaatggagccttgaggccgggtgcggtggctcacacgtgtaatcccagcactttgggaggctgaggtgggcagatcacctgaggtcaggagttcgagaccagcatacccaacatggcaaaaccctgtctctactaaaaatacaaaaaattaaccgggcatggtggcaggtgcctgtaatcccagctgctcgggagcccgagacagaagaattgcttgaacccaggaggcggaggttgcagtgagctgagatcacaccactgcactcctgcctgggcgataagagtgaagctctgtcaaaaaaaaaaaaaaagaaaagaaaagaaagaaaaagggaggaaaggaagaaatggggtcttgctacgttgcccaggctggccttgagctcctgggctcaagcaatcctccccctacagcctcccgagtagctgggactagagtgagttttttgcttttaaataagatcagattggaaaggattcttggtgattcttttccttactttatgatttgttttgtaatggccttttcttgccccccaccctcacctcattttacaaagggcaacactgagacccagagaagggaagagagtcataagggaagggaatgtggctaaatctccatggaccaagcatgcaagggtttgagggtgtctgcagcttagtctgtgcccgaggctgggctgtcaggaccaggacctcataagacatctgccccctgccaccggccacccgggaggcccttgaaccagttattttgggagtgccatctgaataagatacagaaatgtgccattgtgtttacgaagatcagcagtagttccttctgaatcttttcggggtattttggctgggtttttcttaattatccagattagcattaggtaaattcccacatgtaaagacgtctcatcttctgaaaacagttgtcaatgtggaagtggacttgtggctggcttgccccctagacaatgaataggcagaggacactgagacccggccagccccatccagccccatccagccccacccttcagcctatgaagtcatttctcacggcataaacaacacggactctgcaaatgcaactctctccttagtgttcaagtacagcatttgtttccatgatgaatcgggaccccagtgattatttctctccccacaatgtggctggttccggatgcttttgggccactgcgtgggacctccaaaggaaggcaggagaaagggatgtgcctgaatcaagccatgagtctgggcgccactggcccatccaccatccggggaggctttccacgtgcaggatgcgccaccgagggcacggccgcctctcccacccgaggccttcactctgccctgtcttcccccggtacccctttctcccgtctctgcccagccaaatcctgtcatggtcagcggccggctgcagcgccacctcagtgaagccttgggggagaccatgccgtcccagcgaggggtacagtaaggatgccacagtcaccccaccctcggggccacctcatcccggcactggcactggcactgtcctctgtggctcccagcacttcacacatttgtatgctttgcttcagaacaacaaacactaaagttgcagaactttatttaaaaatgaaaataaaactgcctgatttataaagacacgtatatagatgtttgggaatgtatgtgtgtatacatatgtagagagagagcatataaataaatttatatatatatatatatatatatatatatatattttttttttttttttttttttttgagacagagtctttctctgtcacccaggctggagtacagtggcacgctctcggctcactgcaacctctgtctccttggttcaagcgattctcatgcctcagcctcttgagtagctaggattacaggtgttggccaccacgtctggctaattttttgtatttttagtagaggcggggtttcaccatgttgcccaggctggtctcgaactcctgacctcaagtgatctgcttgcctcagcctcccaaagtgctgggattacaggcgtgagccaccacacctgtcctatatttatatattctatattacctaatataaatatataaatgttgatatattctatattacataatataaatttataaatgtttatataaagaaatatgtctttgcatattcatagaaagaaatctggaagaatacacaccaaactgctcctcttgcttatctctggcaagttgattttgctttcatatgaagcagtgtttgaatttgttacaggaatgtattaagtttttaagctcttagccaatatttctgaagatgaaaagtgtcctggatatgcatctgtcttctctcttgctggacagtgggaacctgcctctgtcctctaggctgggtcacagagcaaagtgggcagatgtttgtgagatgaattacagagagtgcaaggatgagccccagctgcctccagtgaggcccgggagtgatggcttctcactgctgccctgcagtgcctggaccggcacttagggagtgctccctaaaggtttactgaatgaagaaggaaggaaggagggaggcagagaaggagggcagggagagaaggaagggaggaaggaagggagggaggaaaggagggagagaaggaaaggataaagggaggcagggaaggggggagggagggagaaagagaagaagggagggaagaaggggtatgagtgatcataaaccctgaatttgtgtatctgaattaatgactgtttaatgtataaatgtgggaatctaatgaaacactgaaatacagggtaccatctggatggatggtggaaatattttattactaggcgtacaattgttttcattataaagtaacagaactgtatcccaaaagtatgaaaaataggctgggcaaggtggctcatggccataatcccagcactttgggaggccgaggcaggtggatgacctaaggtcaagaattcaagaccagcctggccaacatggtgaaaccccgtttctactaaaaatatgaaaaaaattagccgggcgtggtggcgggcgcctgtagtctcagccactcaggtggctgaggcaggagaatcgcttgaacctgggaggcagaggttgcagtgagctgagatggcgccattgcaccccagcctgggcgacagagtgagacactgtctcaaattaaaaaaaaagaaaagaaaagaaaacttaatcattacgtcaccctaacaaatcccctatttgtatttttgtgcatttccttccgagtaggtgagtgtgagcacatatatcttctctacgtgttcgtgggggctgctcacaccattttatatcatacttctgttgtaagttcctgtcatatcctaagcctttcttcgtcccgttataaagtcctcaacctcttattttataagtgctgtcaactacattaagaggacatatataacttatttaaccacttatctctttttatattgaggtaacctctcattttttattattatagcgtttatgattttttaaactactagcttttgcctaatgccttcataattttccctgggtaccactcagagatgcttggacacctcaggttagtgtccccagaagcagcctgaaagtagctgggccacaaactttgttaccatgagttaagcagcttttgccccagagagtaaatcagtgacctgcttcctttattgagaaagtcttgctgtggaaaaagtcagcaggactaaatagcccgctgagtgacagtaacgtacattccagtgcgagcttcttattccccttcatggacatctaaccaagcgtttgcagagcagcacaggtctgcaggtgacattttgagcagcacttgtctacagagcttcagtaggcacaattggcttactgtagaaggtttacacctgggtggattcatggttggagtttggaagagaataaagtccctgccatgagcctggcgccgtgccatggccttcccatgtaacagtgctcaaagggtgcccctcccaccactggggcctgctgttctcgagtccttgagcatttgcctcatgtccttcccacgtgctccagctcctgtccgggctgcagatctcccgtgcattgccatgtgtgagcacgcacagccagggctgcccctagaaacaaggagaaccagagccactcaattagaggggccaccacaataactgtactgttggcatctttcataggctccttagggtattgctaaaaagagtaattttacaattgaatttcaattattctcagaaaacaggaataagacccccacatgaaagaaggattgtaaggatttttaagctgaaaggtaatatgctcaggtctgcattttagaaggagcaaactaactactctatggagaatagatcagagagtttgagaccagaggtgaggactccagtggggacgtcaggactggaggtcccaggaaggtcagtggtggcagtagtaggtgtgaattttagtcccaattcttccacctccctgcatccacactctggctatatgagactttgggcttggtcttgtgacttactttgatcaatggaatggggcagatgagtcttgataccaggtctgagagctgatggtaagagaccttacatatttctacttttcctctcatgcatctgccatcaccatgagaagaacctgtccagcttggccgtggaccctaggaggatgagggacacgtacagcagagatgcccaccagcttgccaacccctgagtgagcccagccaaggtcagtagagctgcaggccctgagaaggaacgcctgttgttgcagaccactgagattctggggctgtttgttacgcagtattgctgcagcaatgggcaactgatacagtgggcgtggaaagaaattaacaaagccaagaaatacttaagtaagcaaatggagttagcggccagtcgagtgagtgggcaagacggagagagcctcagagaacttggtttggctcaggtacctggatggttgaagggcacagtgcctgtggtaaaggacacagaggaggagacgtggccacccacagtagacctacattaagagcactctctccttccccctacacttttttcttgtttctggaggaggccagggcctgtgtctgaagagataagctccacagggacagaaccacagtgtgggattataggcacccctgccacagtcagccacccccacggcctccggctctgtcagagcttctcccccagtacagactcattagaacaaccgctgatgtggacaagggggtgacccagacttcccggccataggggccaactcaagaaaggcccccagatttcccagggcctcctgcagaaaacacagcctgcatctcgttactttcatttgcttaaaatacctgcctttgcagcagtgaaaccacccaaaatactcacttctttatttccagctagataagttgaactcaatttgcattggataattattttcaattaagtgataacaatcctgtttggtgcaaaagtaatcttgtccaaaggccaaacagtttatcccatccaagaaacaggaggcagtgataggaggaggcctattagcatgcttgccatgaggatggaggggccaatccccacccctggagggatgcctcagccaagtcgttcgtgggggacctctgacgctgtgggccgggtgggaccattgacctggtttgccctttgacagcccccgggccaagcagccactctttcttctttctggacaaagaaggaggcacctcctgccagctgcaaggaagtggaaaaggcagctggtcagagaagggcccaagacagaggccaggacccaagttctgggccagccgtgtgtccctggacaagtcatcccccactgggcctcagtgtcccctctgtgtggggagcagtggggttagatggggacagttccagctcagatgtgattctgtcctggttatccagagctacctaggtctgaagccaggttttctgtagggaaaagccccacttcctgtgtgatgtgtgtgttgtcggggcagggatgctcctccaccaggaaagagggagcaggcgctgagttctggagcctcacaggggccccgccactctcctggtcttatggcagtgtcacattctctgcaggcagctggagttccttactttcctccacagccttccctactgttgcacatctgggcaaaccccctccccaccaatcgagccgccgtgaacatcttgttcaaggctgctggtgtattcaagagcagaccctgtctcaaaaacacaaaaaagaaaaatgaaaaacaacctgcctgccaatctttctattgttatttacattgaaaaacatgaggatcgaggtggtccaaacaaataactcttgtgaatttttgcagccaatacttcaaatatttgatacttgagtaccccatgctgtgtgctctctgtgtattcactgacatgcagtcctcccacagcaggagaactaaaactcttgtcacttatagacaagaaaaccgaggctcagagaggctaagtaatttgctgaagtcacacagtggaattctgactttttgttggtttcaattgacttccacactgcattttttccttctttccttccttccttccttccttccttccttccttccttccttccttccttccttccttccctccttccttccttcctccttccctcccttccttccttccttttttttgagacagggtcccactacattgtccaggctggtcgacctcctggactcaagcgatcctcacctgggcctcccatggtgctgggataacaggtgtgagccaccatgccctgctgttccgcattcttttctctacttaatggtggcagcggcccttatgcttctctggcacacagtgtaccctcagccaagccgaactgagaagctggacaggaggagggaaagaagaaaccatctgagctgccgtatctcttaagtacagttttctgtattcaaattaggcgacacaatctccatgaataacattacagttcccaaaggatcacacccaatttaaatgtataagaggccattaacgggtggggctagctattagaatttagctccagtgttattgtggtgtggttctgctattaggcaggcgcaatggggataacagaagcccaaggcacactcgcccctggtctccaaggctctgggtcctcagactggctgagtactggggaccaaggtcacccaagaagccctgagtggccctcttgagggttagcagagcttctctctgtccaagacaggtcaggctctctcccctggccccagctccaccgtcactcagaggagtggcctaaacaaacgctgcaggtgaggctcccgagcccctgacatggatgtttatggaagaggactcttggcatcagcacctgggcaaggtgggtagaggcaggagtgggcaaatgggaaagtctagctgccatgcgggctgagcaacaatggggccaacctcaggggacacctggaagcccgaatgtcctttcaaaagttctgaatgtgggctgggtgtggtggctgatgcctgtagtaatcccaatactttgggaggccaaggcaggcggatcacttgaggtcaggagttcgagaccagcctggccaacatggtgaaactccgcctctaccaaaaaatacaaaaattagcctggcatggtggtgtgcacctgtaatcccagctactcgggaggctgagatggaagaatcacttgaacccgggaggcagaggttgtagtgagccaagattgcaccactgcactccagcctaggcgacagggcaaggccttgtctcaaaaaaaaaaaaaagttctgaacgtggagtttcatgcagagacggccaggcctttgtacccccatgcagatcagtggctggatgtgggctgccctgggaagggtgtgacctcaggctgggtgatctcagcagctgaggctgtcctacagggctggtcacttaaggccgtatgctgaccgcctgcccagctgctgggcagcacgtccttcttggaaggggatctgggcaggtggcaatgactgatgcccaccagggctgtggccttgtcagtctgtgggataacacagaccctgcctcagtggctccaggggaaaaagagaccatctacgtgaattgtttagctcagggcacagcacacaaataagagctcaaaaaatgtcaaccactcttgttatccccatcctgacccaaatcacaggatgaccctctgctcttctccctcatcctcgcgtacctccccagcgtccagcaagtgtccaagcctcacttccacacctccactaatggacaggtcactacttcccaaggcagcccaagtcactgttgaacagcttttttttttcctgtggtaaaatatacataacctacattttaccactttaatcatttttaagtgtacagttcagtggcgttaggcacattcacattgttgtacaactatcagcaccatccatttccagaacttttttcccaaactgatactctttacccattaaacaatattccctcattcctcctctcccctgaacgcctggcaaccaccacccccatttctgtctctatgaattggactggactgctgtaagcatctcatgtgagtggaatcacacagtatttttttttccttgtgtctggcttatttcacttaacataatgtcctcaaggttcatccctgtgacagcatatgtccggattcccatttttctttaaggctgaataatagtccattgcttgtacacaccacattttgcttatccatttatctggccgtggatggatagttgggtggcttccaccttgtggctattgtgagtgatgctgctgtgaacactggtgtacaagcgcctatgtaagacccgctttagcagggcatgtggctcacgcctgtaatcccatcactctgggaggctgaggcgggcggatcacttgaggtcaggagtttgagaccagcctggccaacatggtgaaaccccatctctactaaaaatacaaaaattagctgggcatggtggcgggcgcctgtaatcccagctactcagaaggctgaggcaggaaaattgcttgaatccaggaggcggaggctgcagtgagccaagatcatgccactgcatgccagcctgggcaacagagtgagactctgtattagaaaaaaaaaaaaacctgctttttttttttgtttttgtttttgtttttgttttttggggttttttttgatagggtctcgctctatcacccaggttggagaaggtgcgatcatagctcactgcaccctcaatctcccgggctcaagcaatcttcccacctcagcttcctgaatagctgggactataggtgggcaccaccacacccagctaatctttttatttcttgtagagacagggtcttgctgtgttgcccaggcttgtctcgaactcctggctttaagtgatccccccacctcagcctcccaaaaatgctgggattacagtgatgagccacgccggccactgctttcaattattttgggtatgcagaggcggagctactggaccatatggcagttctacatttaattttttgaggaactgccatctggtttcccacagtggctgcaccatgtttctcgagcagctctgagagaaaacgttctctttcatcacgctgcattcccatgacgtcctcactggcccttggctttgccctggggacagccctgctgagtcttttttttctttttctttttctttttttttttttgagacaaggtctagttctgttgcccaggctagagtgcagtggtgcgatcatagctcacagcagcctcgaacgcctgggctcaagcaatcctcccacctcagcctcctgagtaattgagaccacagttgagtgccaccacacccagctatggtttttttcgtagagacggggtctcactatgttgtccatgctgatcttgaattcctgcactcaggcaatctgcccaccttggcctcccaaaatgctgggattacaggtgtgagcccccgtgcccggcctctgttgagtcttgatgccaactcaggagccccgctgagccctctgctctgggcacgtcacccattccagtgcccagggccctgactgcccacttcacagaagtgcagtggcattttctcttgaggaaccccaccagggggagagggaatggggtctcagagtcaggagcaagctcacctggcacttggaaggaaacccaggacctcctgcccacactcctcttcagcgaggccctcctgcccacactcctctccagccgggccctcaacttcccccagccttcctgcccctctcctctcctcagggcatcaccctaccaacaggcgaaagtaatctgtgaccaggagtactctcctaggaaactctgaaggcacttgacacgcttgaagaggtgacacagatttaaagttgttgctttgctcagtcagtttaccggatcagaccaaaagttgctttgatattcaaaaatctttaaaagtatctaacttcaattcttttttttgtttgtttgtttttgagacacagtctcactctgctgcccaggagtgcagtggcaggatctcagctcactgcagcctccacctttctcctgcctcagcctccagagtagctgggatttcaggtgcacaccaccacacccagctaatttttgtatttttagtagagacagggtttcactgtgttggccaggctggtcttgaactcctgacctcaatgatcctcctgcctcagcttcccaaagtgctgggattacaggtgtgagtcaccgcgccccgccctcacctcagttcttgaagggattaacactgcatctcttcaccatttctgaaggttcctgattttactgtcctgagacatttctacctttattaaatcctccccatgggatggtggtggtgggagaagggacatcaccaccaacaacaaagaaaataagacagccagatgcggtggctcatgcctctaatcccagcactttgggaggccgaggcgggtggatcatgaggtcaggagttcgagaccagcctggccaacatggtgaaactccatctctactaaaaatacaaaaattagccaggcatggtgacgcatgcctgtagtcccagctgcttgggaggctgaggcaggagaatcgcttgaaccctggaggcagaggttgcagtgagccgagatcaggccattgcactccagcctgggggacagagtgaaactgcgactcaaaaaaaagaaagaaaataagacaaaatcacactttagtggaaaacaagtggtgaccactctgcacagctcttcaactcctcaacgcctcctaaggcagctgtgccaggtgctgagtccacatattttcaccccgtgcttctcacactgggacagtgtacttccagcagcaccggcagccacacaaaacccactcacgggctctgcccacagcaggctgggaggcaccagctctcctggctgagtgcaggctgggccctgggagcaagtgcctcctgaaacttctcaccctgatggcagcatgcctcaccctagtcccagcccagagcctcaaccttgctggaaaggcttagcatccgctaggaggaatattagacccaactcaggagaagtaagttctagttctggctttgccaccaaatgtggactctcatcctcactctccccattcagaaactcacaggttagaagtgattatttccaagggcgggtgcggaggctcacacttgtaatcccagcactttgggaggctgaggtgggcgaatcacttgaggtcaggagttcgagaccatcctggccaacacggcaaaaccccatctctactaaaaatacaaaaagtagccaggcatggtagcaggcacctgcagtcccagctactcaggaggctgagacttagcctcacttaagccctcacttaagacttagagaatcacttaagcccaggaaatcgaagctgtgatgagccatgatcacgctgctgcactccaacctgggcgacagagtgagaccctgtctcaaaaaaaaaacaaaaaacaaaaaacaaaaaaaaaacctcaaaccaaaaaacagacaaaaaaaagaatatcacaggaaatttggagaagagaaaaaggaaaaacataattaccccattcatcccttaataccatccctgagctattcggtgtgtttccctccagaattttccctggtatgaggggcacgggctactgctgcgcatctcccctccgtggcgcatggtggaggtcatgctgctcatggacacgtctgccctgctgtctccacgtgcttccctctccaggctcaatagtacctccatatccagcagctattgctatgtaacgatctaacactcaacattcaacgggttaaaataacaagatttggccgggtgcggtggttcacgcctgtaatcccagcactttgggaggccgaggcgggcagatcacttgaggtcaggagttcgagtccagcctggacaacatggtgaaaccctgtctctattaaaaatacaaaaaaattagccgggcatggtggcacatgcctgtaatcccagctactcaggaggctgaggcaggagaatcgcttgaacctgggaggcagaggttgcagtgagctgagtttgagccactgcactccagcctgggcaacagagcagtctccatctcaaaaaattaattaattaattaaaaattaaaaaaatacaagatttattattgcccaagagtctatggtcaggggaacagttctactgatctgggcctggctcagctagtcttgtttatgcatctgtgatcagttgctgggtcccctggttggtctaagctggcactgttcacatgtcttggctgactggtcatggcctgggcaactggggtgaccaggccacacagtgtctcaccctccatcacattctactggtcaaagcaagtcgcaagaccggcccagagtcagagtgggagggactacaaatttcagggtcaagggcatgcatacatggaagccagtaatcgtagtgtcaatcactgctcttaatctaccgtaatccctaattttcatacctgccatttttggtagcaatactgtttttcatagatgtacatttcatagattaccattaaataagatgtaccacattttaatttgtttaaaatttttctcttataacacttgtgtgaacaactttggtggaaccttcgcctttgagatcaggaaaagcagcgtttcccactctcaatcagaaacccaaggttaagtgagaaaattgagcccaagtgtcccgaaggccctttagaagcagcgccacctgcagaccttcccgagttcctcacctgaccgaattcaaaggtgtcagaccaggagtctcagaccaactctgagtccagctgttgaaatcactttcagtatcactttccgtctctgggcttcagtttctccatctataaaactgcagggttggactagaacagtctttctcaaatgatgtcactctggtctaaaagccaaaaagatgccagtgaccaccttcttgaaagtatttttattgattgattgactgattgattgagacagagtcttgctctgtcgcccaggatggagtgcagtggtgagatctcagctcactgcaacctctgcctctcaggttcaagtgattctcatgcctcagcctcccaagtaactgggattacaggcatgtgccaccacacctggctaattttttgtatttttagtggagatgggattgcactgtgttaaccaggctggtcttgaattcctgacctcaaatgattctcccaccttggcctcccaaagtgctgggattacaggtgagagccctcgtgcctggcctatttattttgagacagggtctcactgtgtcacccaggctggagtgcagtggtgcaatcatggctcactgcagccttgacctccctgggctcaagcaatccttccacctcagccttccaagtagctggggctataggcaagcactactatacctggctaatttttttttattctttctgtatttgtagagatggggtttcaccatgttgcccagtcttgaactacttggcccaagcgatccttctgccttggcctcccaaactgttaggattataggcgtgagcaaccacgcctggcctgaaagtatttttaaatgcataagaaaaagacaaagcagttccatatcattctaactgctcggcggtgatccaccttttagaaatggtgtgctaggagcaggggtcacggcgtgagaggctgcccgtccggcacctacgagggcgatgtcagactcgggaatccaggcacgggcagcacatgaggcagctatcataacaaggctgaggatgatggctggtctctgttcggtgtcttgtcttgtaatcccaacatgtatttgtgacctcgctcaatgttcattgtctgttaaatgcactacacaaatttaattcccatggtctgtggctgagcaaaggaggtttcaaaagaaaatttgtgcattctagttcatgagctcttgctgttatttttaaagagctccatggaacaaatgggtggactccaagcaccctttgagctctaacagcctagagaagaggtgggaagggggtgcctcttttctcttccccagctgagttcagaggtcaacagtcctcacagctggacatgggcagggttgcccagtagcttaggggtcactggtcataatggcatcctgcatggcagagaccctgggagtagcattttcggcaatgtttgggttacagacctccttccgagtcgcctggagaggtctttcccgccctttgtagtggatgtatgattttgtttgcaagcgtccttgggagaaccactcctcccacagcatgaggctgttaatcctggtggcttcttcctccaacccaggccctctgaggagcactctgccccacccctcggcacgtgattggttcagaggcaggcatgtgactcaagaagccaataagaattcttttctgggattgttactttagtccctgggtgaaaggaggactcccctggatagagctgtcttgctgggacgttctctatctgtctgcccaccaccatctttcctaactcatagaagaaagcgaagcagagaggcaagagatggggggggtggggagaggcggggggagagagagagagagagaactgacaaggctgcttgagcccctgcatccagctatgcctgcttcccctcagacttccacacttcaggagccaatgaattccttggttgcctaagctacaatgagttaggtatctctcacttgcaaccaagagtcctttaaggcccactcaacagggctgccatatacagtgacaccccttcgcttacacagtactcagtcttttcagatgaatgaagtaaattgttcagtcatcatctcctctcagaagccttccttgatttccctatacagaaccagtcactccctaatctatgcttccaggaatcttgtaaaaatatacactgtggcccaagtccctctgtgtatttatgataatataaattgaatataagaatataaattgaatattcaatttatattcttacacacatgcttgtctccccatcagagtgggagatccttggggtagagactaaatctgatttatcactgtttcccccgtacccaaccaagaaagtgcttaggtgtttattgagtgaattataatcaaatctcactacaacaaacaattgggatgtctcatctaatttgttattaagaaaattctcacctgagtgggtggctcacacctgtaatcccaacactttgggaggccagtgtgggaggatcacctgagctcaggaatttgagaccatactggcaacatagggagaccctgtctctactaaaaataaaataaaaattaaaaaattagttggtcatagtggcacacacctgcggccccagctactcgagaggctgaggtgagaagacgccttgagcccaggaggtggaagttgcagtgagccgtgatcacaccactgcactccagcctgggcaacagacagagaccctgtctcaaaaataaaaagaaagaaaagaaaagaaaattctcagctgagcactgtggcttatgcctgtaatctcaatattttggcaggccaggggcctgaggctgcttaagtctgctgactggccccaggtcacacacagtgagtctgggtcccatagggaccggacgtgctgacctctgtggagctttgcgcccaatcacccagaggcagcaggaggagtttcttttttgttttattttgtttgagacagggtcttgctctgttgctgagttcagagtgcagtggcacaatcataggtcactgcagcctcaatctcctgagctcaggagatcctcccacctcagccttccaagtggctggcactacagttgtgtgccactatgcctgactaattttttttaattagagatgggggtctcactacattattgcccaggctggtcttgaactcctgggctcaagagatcctcccactttggcctcccaaagtgctggggttacacatgttagccaccatgcccacctcaatcaagatttgtttcttttctttttttattgagataggatctcactctgttgcccaagctggagtgcagtgtacagtggcatgatcttggctcactgcaggctctacctcctgggctcaagggatcctcctacctcagcctcctgagtaatttggactacaggtgtgcaccatcaggcctcgctaaattttgtttcttttgttttgttttgcagagacagggtctcactatgttgcccagcttggtctcaaacttctggcctcaaatgatcctcccaccttggcccccaaatctgtgggctacagatgtgagccactgcacccagcctcgaggtttgtttcttaaactatcaccctccaggggctgctctgtattcatgcaccttcatgcatttggctctgggctctacccacctcccctcaccccagattctgccaagctggtgcttaggacagtggccctcccacttacgctgaggccgagatctctgacatgtttgtgggcctcacttcccaggtgcctcccagccccacatgagctgtctcgtagggccaagacagcacttttgtatgggggtctgtttcagaggcacagatggctccaaacacgtcttctgcatctgtaaaagataacaggtgtacatttaaagaaaggaattcatacatatttaatgatttagcttaagcaactgggcaaatattcattttcttaaggtggtaatacataattaactgataataaaattaattgggtaaaacagtctaaaaataatgcagtacttattacatgagggaatataactgcattgaaagaggtttaattgttccagagactgatgagtccccaaaagcagcaaagggaagaggtttttccacctttggaataagggctctgagtgggcgcttcctgttcaccctgtgggaatagggtgggaatggagggtggagaggaagatggtttcttgcaatttaacagcttcacaacgggtttagagagcatcccaatgtctactcccaaccctaaccacacatcttcacccctgccaggtcaaaaaatacagaaaagaaagaatctaccacagatacccttttattagatcagaagagagaaagcttgtagacgcctcgtgaactcaccccttccactgcgaagtgccagaccctgggctggacaccgtgggagaggccagctgggcaagtctgtccttcggggaggtctggggtgtttggggaagggagatagggacacacaatcctcacaacaactgcaaaaagaagtgtgagcacgtgggggcagagggagcgtcagtcagacgggaggtgatcgggactggagagagatgtcccagaggaggtggcttgggcaggtgggctttgactggcgtctatgggagaggagcccgtaggaagaagagagagcaggacagctgggattgagttgggctgaagccggaccggggagggtgtggcaagagatgaggctgaaccggtgggctggaggagggggtcccaggaaaagcagctctggtcccaccgtcagccctgccttttattattaatctctcttgtgaattcaggtgggaaaaggcctgctgagagtagtgccagaattcacaggagaaagattctgtaatttctttgagctctgtgactctggacaaagtattcagtattaatgcagttgaccatgacgtcttctgtgtgcgcgactgacagaccaaattacctttccttatctcctggcgagaaaaaaggaccattttcttgacatatttcataatcatttcacctgcttgccccctatggagagcgccggtgacccggccccctcccctcccacacaatgcaggaagtatgtcatctaataagcccagtttctaaagaatgtttttaatcttggaatagtgagtgtgatttttgattgtatttttaattctctatctacttttttaaaagcacacgcttttgttctaattctcatcttagctcatcagggccaggaggaagcgtggacatcttccattccatggatctgcttagcatttgacaggtgaggcccaaagagaaggcatgggccaggaccccttagggcagctgggggcacaccaggaattctggagtcagggctctatgccctccatgcccagtgggcaccgttctctaggtggtgccccagcccggtaactacaaaacctcagagcatttttttctaattgtggtaaaatacacataacaaaaaatctacatcttaaccttcatttttttttttttttttttgagatgaaattttgctcttgttgcccaggctggagtgcaatgacacgatctcggttcactgcaacctctgcctcctgggttcaagagattctcctgcctcagcctcccaaatagctgggattacaggcactcgccaccgctcactgctaattttttgtatttttagtagagacgggatttcaccatgttggccaggctggtcgcaaattcccgacctcaggtaatccacctgccttggtctcccaaagtgctgggattacaggcgtgagccactgcacctggccacatgggaaatatttatgatattaagtataaaaagccgattgtggctgggcacggtggctcacgcctgtaatcccggcactttgggaggccaaggcaggtggatcacgaggtcaggagttcaagaccagcctggccaacatggtgaaaccctgtctctactaaagatacaaaaaaattagctgggcatcggggtgcatgcctgtaatcccagctacttgggaggctgaggcaggagaatcgcttgattccgggaggtggaagttgcagtgagccaaaatcgtgccaccgcactccagcctaggtgacagagctagactgtctccaaaaaaaaaaaaagcagattgcgtagccaggtgtggtagcacacacctgtaatcccagcactttgagaggccaaggtgggaggatcacttgaggccaggagttcaagaccagcctgggcaacatagcaagacttgatatctacaaaatatttaaaaattagccaggtataatggcacatgtctatagtcccagctactctggagactgaggcaggaggatcacttagcccagaagtcttatgctgcagtgagccgtgatcgcactactgcactccagcctgggtgacagaataagaccttgtctctaaaaaataataataataattaattaaattttgtaaaaagcaggttgcaagttggtatatatagagaatggctcccacttacatgagtaaatatgtaaatgtcagtgggtatttgcaaggatatttaccacaatttgaccaatggttattcctgagtagtagaattatggatggctttttctattttctttttttaatgaaaaatgaataaaataaaagttgtcctgctagggctaccataacaaaataccacagactggactgggtggcttaaacaatagaaatttattttctcacagttctggagtctggaagtccaagttcaagatgctggcaggcttagttcttctgaggcctctctccttggcctgccgacagccaccttcttgctatgtcttcccacggcctttgccctgtgcacacgtgtccctggtgtctttcttcttttaaggacatcagtcatattgcgtgagggtcccacccttgtgacctcattttaccttaattacctccttaaagaccttgtttccatatacagtcacattggggtttagggcttcaacctatgaattttggggaaacacaatttagtctataacaaaagttagtttgaaaagaaaaagaaagtaggccgggcatggtggctcatgcctgtaatcccaggaatttgggaggccaaggcgggctgatcacttgaggtcaggagttcaagaccatcctggccaacatagtgaaaccccatctctactaaataaataaataaataaataaataaataaataaataaataaataaataaattagccaggcatggtggtgagtacctgtagtcccagctactcaagaggctgaggcatgagaattgcttgaaccaagggggtggaggttgctgtgagctgagatggtaccactgcactccagcttgggcgacagagcaagactctgtcttaaaaaaagtaaagcttgttaaagcagtgctcttacaaaaggacacacacagttcttaggatgaattttgtcagtttcacccaacagttaatttctgtgctatgcaacctttcccagagcttagaaaaaagttaaaaattttccaattaattttacacactttgcataactccaatactaagacttgatttttaaaagagcacaagataaagtgtatctatctaaaatcaagaatcaacatcatactaatgataaaacactaaaccccgtctagaggagtttggattagagtcagaatgaagacaagggtgtcagttaggtatcagcaatgctagctgctgtgaggaacataactccaaacctcaatggctgaacacaatggaagtaaattacttgtttacacaaagagcagtgagaatccctggttagccagctgcctcccatgtggccattcagggacctccactgcttgtgccatcccccagagccactgccagctcctctgacggcaaacaggaagaaagacagtagaggatcttgtgggaggttttatgggccaaccgggcaaggcacctgtatcacctccacccacagtccagtggctagaacctggtcacgcggccactcctaactgcaagggaggctgagaaatgttacctccttccgtgcccagcaggaaaaagaaacaggtgacgttgcagcatttcttgcagaataccccactgtcgtctctgggacttttgttgacaaatcactgatgttttctgcacatcctgatttgcagcaggcagtgactactacctgagcaccatcccagtttcagagattaaaaatgtgaaaaacttggagttgatgaaatactcgataggaatagtaggtgaagctgtaggagatgctgcgcttgtaaaaggcccacggatgagccagggctttccgggcataaccccaaggccaaaaacataagtgatagactaactatataaaaacaaaaaaatcccttatatcaaaaaagaacattgaaaggagaagggcccactgtgggggaaatatttgcaatgtgtgatagagaatgagcaggcttgctatttaaagagcccttacaaatcaagagtgaaaaaggtgaagaaaatggacaaataacagtaacaggaaattaataaaagaagaactaaaaatggttaaatatgttaactatgtaaaactatttagtagtcaaagaagcacaaattaaaactaccatgtaataccacgttttaccatcagattggcagagatgtgaaaattgataatggtgtttgcaaagactggcaagtaaaggctattaaccctctggaaagggaaagatgggtgccctgtttaccactgtgggtgatacggtcttgaaaacacttatgcctgttgacccagcagtcccacctctggaatttatcctaaggaaacaaatgaagagatgtgaaagacatatgttcaaggctgctaatctcaggggagcttttaaatttaactttaatttgtatcaagttatacatgcacatgatttcaaaggtcaaaaaattctacaagatttgttacaaaaatcagcaattccctgaagccactcccccagtcatggccctgctctgctttttcagtcccagagatactttttttttttttttcttttttgagacagggtctcactctgtctcccaggctggagtgcagtggcatgatctcggctcactgtagcttcgacctccagggtacaagtgattttcccttctcagcctcctgagtagtgggaaccacaggcatgtgccaccatgcccagctaacttttatcatttatcctagacaggggtctccctgtgttgcccaagctggtcttgaactcctaggctcaagcagtcctcctgccttggcctcccaaactgttgggattgcaagcatgagccaccatacacagcctcagagatactatttcaatcctttaagtatttagtgtattttctctaaataccatgcttatattgctacttcttgatttttcaggtttatacattatatagtgatttttcattatggaaggggagaatttggctctcatcaatcactcactcacaataccccccaccctggaacaaaacgcatattaatacatgtattcccaccccccacagcctcccaatatagttatttgtcattctgatcagatcaatattcgttatttgctttattctgactgcaaatctgttttcaagattttcagagttaataattgtcttgcttttttttttttttttttttgagacagaatctctctctgtcccccagacgggagtttaatggcacagtcttggctcactgaagcctccacctcccaagttcaagtgattctcctatctcagcctcctgagtagctgggactacaggcacgcgccaccaagcccagctaatttttgtactttcagtagagatggggttttgccatgttggccacactggtctcaaactcctgacctcagatgatccacagcctcagcctcccagagtgctggaattacaggtgcgagccactctacccggcccaattgtctcgtttttaccattggcttggtttactaattttcgtcactaatttaactacaaactctttctttcagaattttgaacatattcctccatcatgttccggttcccactgacgctgttaaagaatccagtgccattcggatccatgatcctttgtatgaaatccactttttctctgcaaacttgtaggatattttcttcatgccagatacttgtgttcttcaattctgggtttttgaaaacaaaatatttttaaaattactttcttctttctttttttttaggacagagtctcactccgtcgcccaggctagagtgcagtggtgtgatcccagctcattgcagcctcaaacccctaggctcaagtgattctcccacctcagccccccaggtagctaggactacaggtgtgtgccaccagtcctggctaattttttaattttttttttgaaaacacttatgcctattgacccagcaggtgtgtgccgctatgcgtggctcattttttattttattttattttattttatttatttttgcagaagccattgataccatctagctaagctaggttgaagatactttggactcgacaattctatattaggatacatgccctagaacatctctcccgtgcatgcacaaaaagatattgatgcctgtaatcccagtgctttgggaggccaaggcagaacgatcacttgaggtaagaagtttgagaccagcctgggcaacataacaagacactgtttttacaaaaaaaaattaaaaatgagccaggcatagaggcatgcacctgtagtcttggcactcaggaggctgaggtggaaggataacatgagcccaagagtttgaagttacagtaactatgatcatgctgctgtattccagcctgggtgacagaacaagacactgacttaaaaaaaaaaaaaaaaaagacatttacaagaatgctatggcaacgttgtttataaggacaaatacaagagaaagatataataaatacttattgacaggggaatgaataaagatggcacagttatacaaaacatatacaatattgagtaaatacacaagacatataaggatgccatgacatacacaagacatacacagccagccatggtggctcacacctgtaatcccagcactttggaaggctgaggcaagaggatcacttgagctcaggagttcaagaccagcctgagcaacatcacaagaccttgtctctacttaaaaaaaaaaaaaaaaaaaaaaaaattggccgggcgcggtggcttacgcctgtaatcccagcactttgggaggccaaggcgggaggatcacaaggtcaggagatcgagaccatcctggataaaatggtgaaaccccatctctaccaaaaaaaaaaaaaaaacaaaaaaattagctgggcgtggtggcaggcgcctatagtcccagctactcgggaggctgaggcaggagactggcgtgaacccgggagtcggagcttgcagtgagtggagattacaccactgcaccccagcctgggcaacagagcgagactccgtctcaaaaaaaaaaaaaaattaactaggcttggtggtgtgcacctgtagtcctggccactcaggaggctgagatgggaggtttgcttgagcctgaggaatttgaggctgcagcaagctatgattgcaccactgcgctctagcctgcgggacagagcaagaccccatctcaaaaaagaagaaaggggaaaaaattgcaatcctacttaaaattgcaatattccaccacccctgcctctccagcttcccttattttttccctctgtacttctcacgttgtaacatattaataatgtatctcagtttcataccttttgtttatggtttggctcaccccaccagaatgtgtgtcccatgagagcagtaatcctctctgttgtttacggatgttcccagggcttaggttggtgcctcacatacagtaggttctcaatatgtatatgtttgtgagtttatgaatgaataaaagacagaaaccgctactgaaagtttaaaaccatgcaaagcaataccacttatcatttatggataaacacgcagttcaggtttgggttacccctggtgacagaggtggggaacaggatcaggaagggacacccaagagtcttccagtgtccccgtaagatttatttcctaagcagggcaatagagatggaaatgtttgttatattattatcaacaagttttgcatggcagagaaattctacagcttgaaaaaaaagaaaaaaaaaaggaacagccagcacctgcagcaggtgttagagtttcccagggtttttccacatgacctcatgggacaggggtgcacagggggcttcctgtaaacccagctcagagccaggtggggcctgggactgggggttcttccagagctccctaacaggggggaaatcccagtcagatcaagagaggaaggggcagcctaggaggccacctcttctgggtgagatggggagagtgggccagaatgaagcttgatcttacactgtcttagtaacagcccaacaagttctagcccgttgcccaggtagagccgatttatcaagacaggggaattgcaatagaaagagtttaatacatgtagagctggctaaacaggagactggaatttattattacttaaatcagcccctcgaaaattcaaaaatgggtcttttaaggatgattcagcaggtctgggaccagggattggggagtgcgtattggtcagactgaagatgaaatcatacgggggttgaagtcgatttttttttttttttttttttttttggagatagagtctccctctgtcacccaggctagagtgtggtggcgcgttctcggcacactgcagcctctgcctcccgggttcaagcaattctcctgcctcagcctcccaagtagctgggattacagacatgcgctaccatgcccggctaatttttgtatttttagtaaagatgaggtttcaccatgttggccaggctggtgtcgaactcctaacctcaaatgatctgcccacctcggcctcccaaagtgttgggattacaggcgtgaatcatccgcctgaagtggattcttgctgtcttctgttcctgggtaggatcgcagaactggttgagccagattacaggcctgggtggcaccagtttgtgcatcagagtgcatcagcagtgcagggtctgagaaatacctcaagtgccaatcttaggttttacaatcgcgatgttatccctaggaggaactgggaaggttcagaatcttgtagccagctgcgtgactcctaaaccataatttcaaatcttatggctaacctgttagtcttacaaagacagtctggtcctcaggcaggaaggggtttgtttagggaaagggctgttagcatctttgtttcaaagttaaactataaactaagttcagcctatgcccaggaatgaacagggcagcttggaggttaaaggcaagatggagttggttaggtcagatctctttctctgtcataatttttttgttgtttttttttttgagttggagcttcgctcttgttgcccaggctggagtgcagtggtgcgatcttggctcactgcaacctccacctcccaggttcaagcgattctcctgcctcagcttcccaagtagctgggattacaggcacctgcccagctaatttgttcatatttttagtagagacggggtttcaccatattggccaggctggtctcaaactcctgacctcaggtgatccgcctgccttggcctcccaaagtgctgggataacaggtgtgagccaccgtgcccggcctctgtcataattttcgcaaaggtggtttcatctttatccaagagtagggacttgccgctggatccccctgtcagacacacgctgctgtgagtcagctctggattccgctttaggacacctgggagctgtcccagttcagaatctgattccctgttggaagctctgcccagaatttctcaaaactcagtctgcatcctggcccccacccccatgaataatggggagaataaatgtgaacccggttttgtctacatcatagggctgctgtgagaatcaaaaagggtgaaaaaaaacctccctgccggtagagaccagtctaactgcaactgtgcatttttttcttaactatccccctattgtttgattgtgtttgccattttctctgctataaacagcactgcaatgaacatctttacatgcctgcatatgggtgaagggaaaacttccccttttccttctgaaggttcactgaaaatcacctgacaaaaggcagattagtaggagaaaaaggatacacatttattaacattcatgggagagaattacagtgtgattaccccaatcccccaatggggtacagaagcttatgtactctttttcccaggggagcgaggagatgggaaacatagagcattgttttgaggagcagtaaatgattattaaggagaatgaatggatcagggagacagaaatcaacttgtgaatggaatgagtctgagaggcagacattatgttgtggaaaagtccatccagctgtggttggacttctgacttcttttcttccggcttcttttctgcagtggataatggggtatcagacggacagaaggcaaatgtgtttcttttggcaagacactttctaggtcagataaggaaattccagagagtccctccaaggacttgaggggtgagagggagagaacgagacaaggttagagaggccttgatgctgaggcttatttgtgaggcctttcagttttcaaaagcactcagcatgcccaagtgccacattttggggaatcattttctgtaccccaacacttatatttttggtttgctttaaaaaaattatttctctgggataaatcccagaggaaataattggttaaagcatataaattgtttctatggcttttcaacctgataatcaaaaggatcagaatactgttctaaagagttcatgcggctgggcaaagtggctcatgcctgtaatcccaacactttgggaagccgcggcggggtgggatggtggatcacctgaggtcaggagttcgagacgagcccagccaacatggtgaacctctgtctctactaaaaatacaaaaactaaccaggcctggtggcacgacgcctgtaatcccagctattcaagaggctgaggcaggagaattggttgaacctgggaggtggagtttgcagtgagctgagattgcacaactacattccagcctgggcaacagagcaagactccatctcaaaaaaaaaaaaaaaaaaaagagttaatgcaagtgcaaagtttaaggatgactgtccgggagacacagactccagaggaatggaatcaatgctctgaaatggagaagttaaggttttacttgcataggtagaaacaaagaagtttagcaggattactaaagtttagcagccttttccatacgaggctgatctatgaattacagcaatctgattggttgcagcttgttctttgtcaggaaaggtatagtcaacatctatcttgagtaaattgattgtcacagagcctattgtgctatctggtcggagtcaggtacaagagaggaaagaaggaagttaacctacaaggagagtcagtaatgaggaaaaaggggtctttcctccagtgccctttagtcttttacgacattttacaaaagaatgtaggtatggaaaaagttgatctataatcagagaaacagaggttgtggctgcctgttatgtgactcaggtcccacagtcacatttcctttaaggctccaaataaaattccaacaggtttgtaagcagacagggagggtctccagggactataggcatttagtcaactggcacaataagcctgtttgacagcctcctgctttgcagcttgttttttcccaaaccctgtgttgaatgtggtcacctagttgctggcaccagctcctgacagacccaggcaacttctagatcaagcttgtccaaccggcggcccaggacggctttgaatgtgacccaacacaaattcataaaccttctttgaacatgatgagatttgtttttgcgatttttttagctcattagatacagttagtattagtgtattttatgtgtggctcaagacaattcttcttctagtgtggcccagggaagccaaaagattggacacccctgttctagatgaacctgagtacacattcctcatgaccatgctgaccatgagctccacctcaggaggagctacaccttcatcaccatcacaggcaacctgtgggctggcatgatggtgccctgcgtctgcagcagcggggcccctcgtcccctccatcactgcataaaaccctcctgtcactttccctcagggagacactgctttggagaatcctcccagggctcttcttacctgtggcgagtcataaaactcctactgatccaaacctgcgttctcgtggagagccgtttgagattcaccaggtgaatgaaccccggtttttttctgggtaacaggtcgaatgtgaattacttattttcacaagctcttgacatgttccgtcaaattgctgttccccaaagagtggactctggtgacatataagtgtgtgggaccattgcatcttaccccagagatccactcctgatctggcattattcaaaatctgctgaattcaaaacgatcctgtacttcctgctcaccaggtctgaaaagaaaaaagaaaaaagaagaaggaaagactacacctgacaaaagacagggggagacatttatattagtttgccagtttgaggaaatgccttacttggcaatattgtaaatccagtttacagctcacttaactggacagcttcaaaatgacttttttttggtatacattttaaaagtcaggagagctgagacaaaaatgagaatttatcagtatttaacatttgataaaataccttgaatatttaaaatgctcataaaatgctattatactgtgctttattttatgtattttatattttgagacaggatctcttctgttgcttaggctggagtgcagtgttatgattacagcctactgcagcctcaacttcctgggtcaagcaatcctcccacctcagcctcccgagtaactgggactacaggcatgcgccaccacacccggctaatttttgtatttttagtagaggtggagtttcgccatgttgcccaggctggtctcaaactcctgacctcaggtgatccacccaccttggcctcccaaagtgctgggattacaggcgtgagccaccatgcccggctgacactgtactatttctgcatggcattctccagcattgggcactattattttgttttgtttttcattctaaacaaataggatgtctaacaaccaagtttgtagctccaggccttgagatccatttgtaagagtggggaagaaggaggcaaagtaatatatgtgctagctaataattacatgttctgcttattaagaatttactttcttttgggccgggcgcggtggctcaccgcggattacagtgcctgtaatcccagcactttgggaggctgaagcaggtggatcacctgagttcgagaccagcctggtctaacatggtgaaaccccgtctctactaaaaatacaaaaattagccgggcacgcacctgtaatcccagctactcaagaggctgaggcaggagaatcgcttgaacctgggaggcggaggttgtagtaagctgagatcacgccactgcactccagcctgggcgacagagcgaaaaaaaaaaggaatttacttttttcttccaggccctatgccaagcacttgtgttatctcatttatccttggatccttttaatatgggggttcagttacccccatattacagacaaggaaactgaggtgcagatcccagagagggggagagagagagcaccattctggtatgtagcagggggagtcagagaacaaaaatcggactgactgataagaggcaaaggcactggtgcaggctcttccccagcttccagctctttcaaccttctgggcctcgactctgccctaaggagaggctgaggaccaggtgatgggcaccaatgtgtggcttcttcacatcccacaggccggaccccctgggcctcaccttccagtgagggaagagagaggtgactgccttttctttctctgcacagagcagcaggggagtcgtgacccccaggggctcagtagagcatgagcctggccattgccaagcggcccgcccatgcgtgctgtggttacacggtcttcatgctggctggggagccccgagaactcgggtttggttcgtcctccaaacacgtgaacacgtgttgagcactgactgtgaattcggcagctgtgatgggggctgaactcagggccaaggagccaggctccactccactgtgacaccaggtgtggggctcgggtaagtcacctctgtggcctctgaccgcagtttccttatctgtaagatggggatggtgatgactacctcggaaggttgttgtaaggcttaaatgagaagatgggcgtgtctgaggccagcatggggccctgtaaagtgtgagcagaaaggggctctccaggtgcactccgggtatgactcaggcgcccgctaggatgctcactggcccggcactgacatccagaatggaccacaagggagaaagtggcaggctagcaggagggaggcactttcactaggggctgggaagggtcctgggagggcttcctggaggagatagtgtttgcaccaaatgaaaaccggttctattcagtgatgagacttgctgcctgcagctagaacttccatttaaaaactggacagaagacttcccccaggaggtaactttagactgactcctgcacctagagagggcatccttagagcatcttaggggaaatctgcccacccctatgtattttcttttctttttttcttttcctttttttttttttttttttgagactatatctctctctgttgcctaggctggagtgcagcagtgtgatcatggctcactgtggcctctacctcctgggaccaagcaatcctcctgtatcagcctctggagtagctgggattacaggcatgcaccaccacacctggctaattatttagttttggtagagatggggtctcactatgttgcccagacttccctctgtcaatgacagacataattcaatcattcattcattcaataaatatttattgagcacctactaggaggtgccaggcattgttcttggtactggaattatggcagcgaatgaaacaaagcccctgctctcagagcttacatcctggtgggcatggagggaaactagacaataaacagagaaataaagatgtatcagattggtggagtgtccagggctagatgaggcagagtgagggagggggagaaggaccagtgggcaggaagtggtgccatcagggaagccagtgaagggccaccctttgagtgacatctgtaggacatgaggctcagaccctgtggacctggggggagtggagaatgttccaggcaggggaacagctggtgcaggaggtctgagtgctgggcagaggggatcccaggcgggatcccaggaaagctggagacagagggagggaggtcagaggcggtggtgtcggcctctgtgggccgtgattaggaccctggccttacccggagggagacaggagcctttggagagatcccttactggagcagaggcttggctctggctgtccgtgagaagggactggagcaggcccagggcagaaacagtggggcaaccaggaggctggggcagaggggcctcagcttggaccaggtgcaggcgacggagctgggctgggggacgagataggcttctgggtgtgtttaaagttggagccatgaggattgggtgatgagttagactccctacccctgaatgccctcacaggaccacaaggttcctggtgctctcaccaaataccatctggaagcctcctcattccacaggtgattgtgaaaataagaccttaattgtttcattttgtttttttcccccaaaacaaaaccaaatgtaatgactaagaaaagctccacttccacctccagggcgccgctccctctggtggagggttggctcctgatttagatgctttctatatatgaattacagggaaagggaggcctgggagcaggtccttctggccagctgggcggctctcaggggctgccaggatgcctggcttctgcctgaagtgagcagctctcagtccctatgggccacgcctctgcatcatcaggagagggcttgggagcacacagggactttggtctttctcctgagagcagtgaggagccacggaatgcggcaggcaggggaaagacaagaccggatttgctttttagaggagacccttgagcaaccccaggagatcaggttggaggaggcaaggccggaggccaagcggtctgggaggggccttcagggaggggaggagggaagggaagtggggcccactgaaggctggggagtagctccctgggctgccccctgttggtcatgactctgccctggggcccaggcccgatgtccacctcgagccttagctcctgcaggtgcagctagatggagtctgagctggtgcagctatgtggggcctgttctgggctagtgactcacttctgaacggctttggcagaatgaggcagttctccctttcacaaaattcatcacagttcaagcttttggccccaaacagcggcagatgacagagggatttcctgaggtggtttatgggacttttgctgaaatggtagcatgaacttcacctgggcctgcagggagccatcccctgcctccatccccttgctcctccttggcctgtcctaaatcagggatgggaccttggtccttacccagagcaaccttggccttcaagcagcatgcctgagctcctccctcaggttctgctcaaaccctttttcctcagaacctgcacaccccgctgggtcgtcacacagcaaggcccatgcctcctcctccaggaagctgcactctgcccagatctccttggatgatgctaactcatggggtgtggggagtgtggaagcccagcttccttgcctggggtttcaataaccctgagatgtaacttgcattccagagcggccctcgggatcacaatgaagcacctgcctgctggacttggccagacatggcactgttggtcttccttccctcccctctcctgcttcccactcctttcctggtttattctgggggcacttccttaatcaatcacttgctcacaaatcctcagcagagagcctgcttctggggacccgacccaagacacagcttccaggggtcactcctgctgtttctcagcttggacggatcctccttgactgcacccctataaaacagaatgcaacgcagagcttgtctcctggggagaagcttcccagtgggaccagtcctgcactgaggtcccatgacaccttggcaggccctgttcctggtgcccgaagactggcctcggtcctgggaggtagcccctccccttggctccacccacagttgagtctttgcacacaaagttgttctgcccaccttggctcttgactccaccccacctcacagcctctctgggcctccgtggctccatctatacaatgagggcacaggctctgcccctgtgagcggtggtgtgacgctggttctggattcctgctcccaacctcaccctgcggtagctgagccaggacctctggaaaagaggagcccagcttgttcaagaatgaacagctgggtcctggctcagagaatcaaccattctggctgttacaactcattactaaatcccagctatgccctgaggaggattaaggaaactgctccggtaaaaaatccccaacagaaagaatgcactccctcccagggagccctagaaatctgaccacggtcatcttctcctggcggtctctaaccaatgcacattccgggtgtttgcgtgccagaggggccagctgggcatctgcgcgattggccaatgcctggcagaaaagcagcccagggtgctagctttctgattcacgggcaggacttcaggtaatgccagctgctgagggagtttcgttaggctgcatcgccccagggaggaaacctgaggctggatggcaagaagcctggacagggcactgctctgcctcgaacttgctggtgacccaggcagggcactgtcccctgttaactctcagctttcctacttaaaaactgggaatggtatccccatttacagggatgtactcacttacacagaatatgtctatagagtgttcaccctgtggggacccatgttgggcactggaaccatgaaaaggcttggaccctaccctgtccttgccctgtgtcgctcccaggcttgaagctgggaaggttaaaggagagggtccgagggagaagtggggtatgtatgtgggggccacattagcacaaagccagaggcctgcaaccatgatgccttgaggctatggatgaataagcagatgtagctgaaggagccactggggttggctggcaggtcaggacagggcagccatgagggttgtggtcacatgcctcagtgttactgtcttaatctattttccgctgctatcacagaataccgcagactgggtaacttatacagaaaataactttatttggctcatggttctggaggatgggaagtctagaaaaatagtgccagcatctggagagagtcatcctgtggcacaaggcatcacatggccagcatgcacacaagacagagagagaaatggggccaaacttatccttttatcagaagctcactcctgccataagtaatccactcttacaataactgcattaatctcttcatgagggcagagcacctcatgacccaatcacccctaaaggacccatttctcaacactgtcacaatagcaattaaattttattttattttatttttattttttgagatggagtttcattcttatcacccagcctggagtgcagtggcaccatttcggctcaccacaacctctgcctcctgggttcaagcgattctcctgcctcggcctcctgagtagctgagattacaggcatgtgccaccatgcccagccacaattaaatttcaacaggcattttggagaggacgttcaaaccacagcagttaccttcacctggatttgagtccagctcaagcgtggtgaccttgggcaggtccttcaggcagaaggacttgaggctctctgagccgcagttatcttgacttgaaagtgagaatcctaacagtgcccacttgaaggcttgttgtggggtgaacaccacatagtttgaagcccgatcctgtctgagtagcggtggctctcttgcccctctgaatcttccaggctggggccctctgctccccagaagagcagactgaggggctgagaaaggggcaagtggctttctgtgtggggtgcaaggctgcagcaggctgagtctgggggcaacccaggtctgctgatgagctgttaccctgccccccagggccacacctcactgggagctgaagcctgagcacatttcccaggggtctgggctggccaaggggtcccgactgggctctctgctaccctctgtggccagctgctcatgtctcttgtacgagagcatcagcttccagcagtcagacaaaagcccaggcagggccggggtgaaagccacactgcgccttgcctgctgcgcgtcatcggaaaatgttcgccccatctgggcttcagtttccatatctgtataatgggcttccagcatgtgccctgccccacccctcaccaagcacagaccagaggcagggccccctcagagaggagacagtcagtcagatgatctctattcaaacccagttctgctccttaccagctgtgtgaccgtgggcaagtccctccactgacctgagcctcagtttcttcgtctgtaacttggggttcctaaaatcaacttcactggcctttgtggggattaaacaaactcttgtgtgtggagtgcctggcacggatcactcactctcagcgcaagttcccttccgttggggccgctctccgcctccttacaccctgatctaacctcaccttccactgcccatctcagctgctgctgcttctcctccctttggcgatgccgacgcgctccagcctccaggcctttgctcaccgtttgttctgccagaaatgccttttctccctctcgcattcctaccattccaaagcatattgtcttcattgctcagctcaaatgctgccttctccaggaaggctctccgaggagctctgtgcaagcagacaaaaacacggatacaggggcaccagaaggggcatctctctgcccacatctctctactttcggcctggatcaggctcaaacatggacatttttctcccccacctcgcagtacacaaaagtgcccactaggtggtgaaagaatgacgaagtccccgtggggatgggcgataagggaggccaaccaggcaccgcctgcatcactcattcgtttatttaacgaatattgactgagcacctgcatggtgccagactgtggggcaacccagcaacaaggcccgactctcaaggagcttgtgttctagctgggggaggctggactggcgggagacacaaaaaacaaggaaataaataaagcaggaaaaacatgggacagagatgaaggttacacagaaaatgctggcccaggatcacttgaggccaggagttcgagaccagcctggccaacatggtgaaaccccgtctctacaaaaaatacagaaattagccaggtgtggttgcgtgcgctggtaatcccagctatttgggaggctgaggtgggaggatcccttgagactgagaggcagaggttgcagtgagctgagatttcaccacagcactccagcctgggtgacagagtgagacccctgtcaaaaaaaaaaaaaaaaaaaaaaagaaaagaaaagaaaaaagaaagaaaggaaagaaaaggaaaggaaaggaaaaaaaaaaattccaggcccttgagtgtgtccaggcttctgactgagcattctttcagtgcagagccacactttgaacctgagagagtggctgagctggatgattctcaaagtgcgctctgcggaccagcagcagcaccaccagcagcagcatcacccgggaactcaaaggaaatgcaggttctctggcctctgccgaatgcactgaatcagaatctgcattttaacaagatccccaggtaattccttttcaagttaaagcgagaagctctgcccaagtccagaggcttagggaccaatgacacacacaagccaaatctggccacctattttcgtatgaatcccatgctaagaatgggtcctgctcagaaaaaaaaaatctagagagtattttgtgataaataaaagacatgcgaattcaaattttaatggccatgcataaagttttattggaagccggctgcaccctttgtttatgtattggctgtggctgctcttgtaccagaatggtgacgttaaggagcagcaacaaagacagtatgggccacagtgttaaaatattgactccctggccctttgaagaaaaagttggctagtccctgctctagtacatcttcctcacactttatgaatgaagaatcagggccccgggggaggggggcagtatcttgttcaaggcatcatgggagccctgctttctctacacgctcagggtcctgtttccacaggctcaggcctgaagagactgaaagcccccactttttctgtctcttgggttggcccagggttgaaacccaggttccaggctgtgaggaagtccaggacacactgagaggtcatgtgtaggtgttcaggccaacagcacagccaggggctcagctgacagccagcatcaatgaccagatgtatgggtgaggaggtcttcggatgactccaggccaactcctatctgactacagctacaactgcacaaaagagcccgaacgagaaacactggctgagcccagtcaaccctggaaccagaagagatgataatgccatccagccctgagatttgtttggagggtgacgcggccaaggatgacacccactgccccagaggctgggggactggcaggtatatcttagggtttgggggtgggagtgaaggtcatcctgaggagagtcctttttgagtgtgttaaggtgtctgtgtccatgtggacgggctgtcagaatgggctgggggatgcggtcagggaccactcccattcccagggcctgggtgtcctgaccatccatgctaggtctgttccacgttggccacactgttccaggcaagcgcctttggtcacacggactggtctctgagactggtctgatgtgtgtactctcaggagcctggacaggggcagtctcaatccagaaatgacctcttcaatacttggtgtagttccctgtatgaaacgcccaatattatgagccacccaggcctgggtcacctgctgactggctggaggaagtgcatgggaccatgtgaggtcacggcagccccagggtttgcaggtcgtctgcatcctggctcccccgcttacaagctgtttgaccttggtgaggttagatcatcttcctaagcttcagtttcttcagccacacaatgggtataacacttacccttgagggttactgcgattgtcacacaaggcagcatttgcatgggccctgggccatgctagacattcatcaggcactgaagctatgggggagagaagtgaggggcccaggctctggagccagtgggtttaaactccactctaccactaacaagacattattaaaaacttctgtgcgcctccatttcctcatctgtaacatggggataataatagcacctgcctcctggcttgttgagaggatatatgtagtgcttacaacagcacaacacacatatatgggtacttcacaaatacaaatccattcaaggaaaccaaccctggtgccctgggatggccgttggtcagagacacagaagccgaagccagcttaggacaagcggaggggcccaggcctgcccctcggttccgggggcctcacttctgttccagggctgttcagttacctgctcctaggcctgggaggcccagtggacaacagagtgacctcttctccactgatttgatctgaatacattctgccccatgagggcccaaatgagggaactggtatgatattcacagagaggtgacatcacccgctgaagatcacacagcaagtccctgggccacctggatcccggccacagctccaccctgctacctccctctcttaagtaacacattaataagtgtcttaccctcaggccattatctgtgttcccaggccagggaacatttctgaaacacatcaaacattgacaaaaagaggtgtttttctgtccccaggccaggcccttcggcctctgttaaccagtgagtgttctctgttaatcctgagcccagctcctcctacacacaagtacaaacaagggcattgggcatgggagaaacctgtccaccagggccaggaggggacacggaaggttaatgggtcccctcccccaaagcaatgcacacagctggggctcaataagtgctactgggtggtaggaacagagccagctgagggcacaggaagagggatctgctaagcagaggaggcctgacctgggcttcattgggtaaaaccagtcatcataataagtagctggcatttcgggagctcttagttagttccagacactgccctgagcactggacatggtcactcactaacgtttccatgtttcagtatctgtggggtgcatatgttgctctccccagtctacagacaggaagctgcaggcaagaaagatgaagtcatttgcttaagtcacaccattaccaagaggccgagcttggattcacacccagcaccctggctccagacccaagctctcaaccacaatacaagcctgtggagtgggaggggtgaaatacatgagtgaggggtgacttctaggtattggcttggggtggctgtccctttgatggatatgtgggaggagcgcaggtgtcaggtgaggtattggggagaaggtggatgaattgggtttggcaggtgttgagttccagatacctgaggatgctcaggtggaggaggcaggagagaggcggcttatggctctgaagctgggtgatgggggctggagctgctcactccagagtcatcagcgtagaagcgcagcctgggagacacctgagcgatgaaggggcaaggccacagctaaggcaggggaattgatatttagtgtgcaaggattcaaaatgacagcaagaaaagaagtgttttagagactattactattattattattgagacagagtcttactctgttgcccaggctggagtgcaggggtgcaatcatagcttactgtaaccttgaactcctgggctgaagtgatactccggcctccgccttccgggactcagccaccacaaccagctaacttttaaatttttctgtaaagacagggtgggggagcctccctatattgcccatgctggtcttgaactcctgacctcaagcagtcctccagctttagcctcccaaagtgctgggattacaggaatcagccaccaaacctggccaaatgctatttttatttattttattttatttatttatttttgagacggagtttttttgtttgtttgtcttttgttttcttttgagacagagtctcgctctgtcgcccaggctggagtaaagtggcgtgatcttggctcactgcaacctccaccccctgggttcaagcaatttcctgcctcagcctcctgagtagtttggattatgggcacctgccaccaagcctggctaatttttttgtatttttagtagagacggggctttaccatgttggccaggctggtctcgaactcctaagctcaggtgatccacccgcctcagcctcccaaagtgctgggattacaggcgtgagccaccgcgcctggccaagtgctatttttaaatgaatgttttctttattttgagggtagataataaatgcacaagatgcaaattcccaaagggtgaaaattgtgtctctcttactctgtcccagttcaccaggtcttctccccagaggcagccactgtccccagtttcttcttttttctttttctttttttttttttttttttgttagagacagggtctcactcactctgttgcccaggctggagtgcagtggcacaatcacagttcactgcagccccagcctcccaggctcaagcaatcttcctacttcagtttcccaagtaactgggactacaggtgtacaccactacgcctgggtaattaaaaaaaaatttttttttgtagagacagggtctcgctatgttgcccaggcttgtctcaaactcctgggctcaagcaatgctcctgactcagcctcccaaagtgctggaattacaaaccatgagccactgcacctggcctgttcccaaagaaacaagaaagatgtttcttgtacatctttccagggatatttaacacacagaaataggtggccaggtgtcgtggctcacgcctgtaatcccagaactttggaagtggatcgctttgagcccaggtgttcgagacaagcccggtcaacataatgaaaccctgtctctacaaaaaatacaaaacattagctgggtgtggtggcacatgcctgtggtcccagctgctcaggaggctgaggcgggaggatcattggagcacaggaggtagaggttgcagtgagccaagattgcaccattgccctccagcctagataacagactgagatcctgtctcaaaaaaaaaaaaaaaaaaaaaaaaaaaagaataggcatatactttctcctataaatggtaacatatgcactttgcatcaccctgttttctcactggacagtacatcttggagatcattccacactggtacgcacagagctgcctcactcttttgattgatgcagagtatttcactgtgggaatgaagcatacgtaatgaacagtcccctatgagtggacctttaggttgtttcccatattttactattccaacaatgccacaatgaagagcctttggcagatggcattttgcacatgtgtgaacgcgtctgtaaggtaaattcctaaaagcaaaatttctgggtcaaaaaagatgtgcagtctaaactttgatagctactgccaaactttcttattgaagttgctgatttacactcctaccagcaacgtatgaaagcacctggttccccaatgtattattttttacattggtatcttgctgtaattttaatatgcagttcttttgtgagtcaagttgagcacttttcatcttttgttttttttttttgtttgttttgtttttttttgttttagatggagtctcactctgtcacccaggctggagtgtagtgatgggatctcggctcactgcaacctccatctcctggactcatgagcaattctcctgcctcagcctcctgagtagctggaattacaggcatgtgccaccatgcccacctaatgtttgtatattcagtacagacagagtttcaccatgttggccaggctggtctcaaacttctgacctcaagtgatccgcctgcctcggcctccgaaagtgctgggattacaggcatgagccaccgcgcccagccatacatttaaaggccattttcttttctataaactgtccattgatatcctttgcttattcagataagctgggcatctttgtcttaggaactatttgtgcaataagtaaatcaaccccttgtctataaaatgagttgcaaatatatggtatttttcccggtttgttgtcttatgattttgttaattttttttttttaagataaacataagcctggtatttccaggcacctggtatttccaggcagtctcccatacaagccctaaccaggcttagtttccaagatcagatgcattcaggatggtacggttaatttttcaatggagaattagttgtactcttatggcttctggctttcgcacacatagcgtatcacttatttattgctgcataaagaattactccaaaattgaacggcttagagcaacagcagtcagtgcattatcatctcttatggttccggggttgactgggctcagccagtgattctcctaaaggctctttcttgcagttttagctgtagtcaggtgggagttggcctggagtcacccgaaggcttcctcactcatacctctggtcattgacggtggctgtgagccgggcccctggctgtgctgttggcctgaacacctacacgtgacctctctgtgtgtcctggacttcctcacagcctggaacctgggtttctaccctgggccaacccaagagacagaaaaagtgggggctttcagtctcttaaggcctgagcctgtggaaacaggaccctgagcgtgtagaaaaagcagggctcccatgaggccttggacgggatactgccccctctcccccggggccctgattccccagtggcacgaggcgcacccccccacacacacacaaggacactgtgtagggtcactgttactgtcactccccgagcacgcacagtcaccgctcagccgcaacccggcgctccctctcgcgaagccacaccccctgcgcacgccgcgcgcgacgtctctcccgcccactccagcctggccccgccccggcccagctacattcccgggccagcttctgtactgccaggtccgggtcggcggctgcactgcggatgagaccggtgcgactcatgaaggtgttcgtcacccgcaggatacccgccgagggtagggtcgcgctcgcccgggcggcagagtaagagcctcgcgcgccgtggaggagggagcagggcggtcccagggaccggagagccgggcggggcgtttgggccttgtggccggctggggcaggcttggagttttggggagtctcggagaaagttctctggggcccagttctcctcttaagacgacgctgggacctgcagttccggctttggagaggggagattgcccctgaggcaaggtccaggctaattctccacgctcccacaggacatgtggggtcagggacatggcggtcactgaccaggcccttggacgtttggcagggggctttgatgactcttcttctttatatttacttatctttttttttttttttttgagacagtctcactctgctgcacaggctggagtgcagtggctcgatcgatcgtggcttactgcagcctcgacttcttgggcccaatcagttctcccacctgagcctcccgagtagctgggactacaggcgcaaacaatcactaccggctaattttctgattttttttttgtagagatgggggtctcactctgttgctcaggctggtctcaaattcctgggctcaagcaatcctcttgcctcagcctcccaaagtgttgggattacaggtgttagtcaccatgactggcctgaggaccctttaatttttaagacagggtctcactctcatccaggctggagtgcagtggcaccattatacctcactgcagcctcaacctcctggactcaagagatacttccacctcagcctcccaagtagctgggactactacaggcatgcactaccatgcctggctaattttttatttttttcaaagacgagggtctcactgtgttgcccaggctggtcctgaactcctgtacgaagggatcctcccacctcagcctcccaaagtgctgggattacaggcatgaaccactgcacctggcccacccttgctaaatggaaccctttttgtgggccaaccttgccaggtgcttcatatacataaacttttaatcctggtagcactgtgaagtcagtattataattcccattgcacagattaaaaactggaggctggacttagggttaagtttcttcccaaagccatgcagctcccaggtggaggagctggggcttgtactcagaagtgtctgactgctgtctgatcactgcatttgatcaggtttgtgtttccaatgttagataggaagaggatgcaatccagcctcagcagccagttctag

SEQ ID NO: 395 - DNA, 49504 bp, Homo sapiens
tcagccctgatttcatcagggagatacatctgtatcatgtgaacttcagtggtactgtttttatttccttccttcccgtcttctctccttttttccttcagtaatagtataatggttaaaagcactgactttgaagtgatgggcataggccccagttctgccacttacttgctgtgtgcccttgggcaagatacttaatttctctgagcctcagctttctcatctctaaaataaggatgatgtgaagtgaaattagatgattcatatatggtccttagtccacagcttagcacttgattcgagctttaaaaaaatgttaataatgtgccaggtgctgtgttagacactgaggagtgggtacaaaggtgactaaggcacagttcctgcccctgtcccctgaacttaaccttctgcattgtatgacaatttctggagttcacggtctgtttcagtacactgtatcacaaactgagtggtaatcataatcctaaatccttttgctcttacattgacctagcatccagccccgggtagagctggaacttggtaaattataggttctcagaatagcagtttcggaagtgagtggaggctgaatagctcattgcgtagagatactgtagctgtaggtcagatgggagcagggcagggggtgggggatgggatggtggcgtgaattaagatcacatcctgtcacttatacattcaaaagacatttgagcacccagctttatgctgcagaaggagattactaatatgacccagtccctttcctcaagttgcttataaactactaatagaaacagacatgttctactagtagttgcaaaccactataagccaagcacaagattctgtgactgcataaaggagaaagtaggcaggaatcaggagattgctgaggaaaagtgggtgagacagttcatggttacttgtgtcccatgaagacagagctggtgttttattcaactcattcaacaaatacttatgaaggatctactgtatatggctgccactactctaggagttttggttacattggtaaattaaaaaaaaaacaaaaaaacaacaaagacaccagctctcatggaacttatgttttagggaagcagacaataaataatagacataaagagaatgtcagaaggtaagatgtgctatggggcaggaggactgggagtgtgggagtgattttaattttttaaaggatggtcaggaaacagtgtctaagtatcaaggaatagtttctcatgtttacttgcatttttggaagtaaagcaaaccaattatttttcatattcttatctaaattcttcaaggaacactaacagggattggcaaaccacagctcacctcctgttgctttaaataaagttttattagagcacagccacacattcctttatgtcttgtctatggctgctttcatgattcatgatacagtggcagaattgaatagttacagcagatatcccatggccataaatatttactaaatattatctggccctttacagaaaaagcttgtcaacctctggttcttaaagagttgaggttctgtctgtatttcacattttagaaggttatatacagttttatgctatttttaagttaaaagttttttcttaatgagatcatttaaaagatctttttcttgtattcttcacagggcctggacgtagtgtcttcaacagttgtaacagcagctgccatttgctgaatgacagcatgtgtcacacactctgctgagtattacaggcatttttttctaatacaaagtcttgtagtgtgggtaggtatcacaattttagtgaagagggagtttaggctcagagtggttgaataatttgcagagagcgataaagatagtatgtgtcacagttgtaatccaaccctaaatgtagtcagtacccctttctttattctgtgtttcttttttccagaaatacttgcagacttgaaggaattatcagtctttcattttctatcatcagtgtcctatgatagtttgtgcttccctccctcatccctttgttcatgtcactctgttcaccaacccactctgctgaaatgtcgttatttcttcaaggcccggaggaaatgctaccactctcatcagaggtacttttccccccaactctttccctgtccttggctgtaggaacccaaaggagtctgtgcagcttagcacacattagtgatgtttgcacaaatcaggacctgtactgggcactcttatgtgtttagttttggggtggggtgtggggagtgtggtttgtgtgtctgtgtctgtgtttatctttgtgtgtacttggtatgtgagtgtgtgtctgtgtgtggtgtatgggtatatgtgtatagacatgtatgtagctatatatgtgtgtggctgtggtatgtggctatatgtggtatgagtgtgtatgtagtatgtatgtgtgtggtgtgataatgtatggctgtgtgtggtgtgtaggtgtatagctgttgtgtgtggtatgagaatgtgaccgagtatgtcaggtatgtgagtatgaccgtgttacgtgagaatatggctttgtgtatggtgtgactgtgtctgtgtgattctgcttgcttgtgtgcatgcatgcgtgtgtgggcggggggtgtgggtggggctttgtatggtgtttgagaatgtagtggagggcactgactgatcagaagaaacacagcccaggccccacagtaggtcctggaggtcccaggtattaacccagatgtttacttgctagattctggtgtgggctggagaggggtagagtggcagaaatctcaagaaaagccaaagctgggccttgtcacctaggaaagcctcaagatttagaggttttgttttgttcattttgaaagcaggcatataggtagatacttgtaaggaaggtttttcaaaaaggattaaacataaaaagagttacagttaacttacagttaggcagaaaaattgaacttatcccaaaatgaaagctcttttacttgcccatgaattatagtctggattgtcattgcttagtggtttcaagaagagtgacattattcaaatggcacaaatatcatctggtggtggtggacaaagccggtgccttctttttgctctggtgggtagctttaaatatctctgaaagtttgtcacttaaaaggtagcaagtaaaggtattctatccaagtattccagttgattgaggttatttctaatggatggtcccatggggaaggtgtatacccttcaaactgaacaaaagattccctgtgatctggcccaacccaaagaataaaggtgttggccatttgtgttcattctcagggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatgaaaaggacccgtgtacttatttggggaagtggggagctggggagattgtcccactgaacccactctggaagggatttgaattctaagaaagacagatgggtagatgctctgaaaagcaaaggaaagcagactgagtttctggggcctttgaggagaagggggaaaggaaaggaactaacattaattgagcatccactacatgcgattaattctgtcagtcacatttacattcattatctcatgtagttctcacagcaactctcaaaggaataagaagaggacatgaaagtgagggaagataaagtcacttgctgtgaagtcatacagcaagtacgttgtggagcagagttcaaacttgggcctccctgactgccagctgttgctcttttcactacatttaccttttggcttctgaaggaggagccacttaggagacttgcctggagttaggagccagtgtggcctcttcatatggccttgggccatttgctctatggcaagtcagtgccaagcatgagaacgttttcaactttattttattttgaggtcaactttattttattttgagacaggatcttgctctgtcgcccaggctggagtgcagtggtgtgatcacagctcactgcagccttgatctcctgggctcaagtaatcctcccacctcagtgtatggagtagctgggactgcaggtgcacaccaccacacctggcctcaatgttattgattgagcacttactctgtgccaaggaaaaacggcagtgacggggagtacagggtgaagggtgggataaggtgagagaaatcttaaaacccataatgagagtctttgcttttagtagcaatagtttagtcctcaaggctggaacagcttagcagggattatgtctggtttcctgtcctcctggtttaggcctggctccacatggcagatttcagtgttttctacatggaagtttagtgttcacccagttttcctctaacaaatacaaaagaacccttcctctaacaaatacaaaagacccctatctacctctcttgtgaatctggggccctactcttccagagtgaggggccctcttcatttgtagccagttggcagagtgtgattctggcaccgggcttggaactgacatcacccataaccttacctaacatggggaccctgccgttcaccagtaagagatgtgccaggaactttacactcattattgaattctcacagcaactaagagtgacttgcatttgccgtatgtagaaataggctgataaagaaagggacttgcccaaggttacagagcaagtaaatgcggggtgtaggacctgaactactgcccaaattcaagtcctgtattttatccaactataaaagacttcccaaatgattcatttatatttatagggtactttactgtttaccaagcacttttatttcatacacattttctgattccttgaaaatctccacacaatatattttaaacatagtcacccaaacttgtgtgtgtgagttggcacacaccctaataataaaaatcaccatcttttaaatacctactaagtgccaattattgtacaactcttatctctagtcttcatactatcctgtaaggtagtaatgtccccatgttcaaggcaagaaaattctgtgagattaaataaccagacctattggcagagtggagacttaattcaggtatgtctgatcccaaggtcaagctcttcattatacccactatcaagctaggtctacagatcccctctcagtctgggaagcttagtctgactccttcctgacttggagactttgtgacaaccactgtgatttttttttttttttttttttttttttgagacagagtttcattcttgttgcccaggatagaatgcaacggcgggatctcggctcactgcaacctccacctcccaggttcaaacgattctcctgcctcagcctcccgagtagctgggattacaggcatgtgccaccatgctcggctaattttgtatttttagtagagacggggtttctctatgttggacaggctggtctcaaactcccgacctcaggtgatccacccgtctcggccttccaaagtgctgggattacaggcgtgagccactgtgctgagccccactgtgacttttataattatgagtgtctgctgccagttgggcctacgaccaatgtaccaggctcctgctttgatcttggaacaaagctccccagccaatctcacttgtctctctctcttttttttttttttttttttgtgagatggagtctctgttgcccaggctggagtgcagtggcgcgatcttggctcacggcaacctctgcctcccgggttcaagcagttctcctacctcagcctcccgagtagctgggattacaggcatgtgccacaacgcccggctaatttttgtatttttactagagatggggttttgccatgttggccaggctggtcctgacctcaggtgatccgcttgcctcagcctcccaaagtgctgggattacagatgtgagccactgtgcccggctcacttgcccttttttgaccctaacttatatgctaacattttttgttttagtcagtgcttttgagtcctgactagtccttttattcactgtctaacttccttttaaactttattttatccttcattccccttattttttccctttctccctcattccatctactctttcttctcttcctctccctcttttcctccttccctcttagtaacttgtaatactgacattgaagacaatgtggcccctgatttctagtgtaggagattgccacacaaatccagagttgcaatgcaggatggtaggtatcattacagttgtacccaggatgctgtagaagccgggggagtgccttaacctggcctgtactggacagtggggcccagaagtgagtaagacatagtccttcctggctgggtgcggtggctcactcctgtaatcccagaactttgggaggctgaggtgagcagatcacgaggtcaggagattgagaccatcctggctgatacggtgaaaccccgtctctactaaaaatataaaaaattagccgggcgtggtggtgggcgcctgtagtcctagctactcgggaggctgaggcaggagaatggcatgaacccaggaggcagagcttgcagtgagccgagatcgcgccactgcactccagcctgggcgacagagcaagactccatcacaaaaaaaaaaaaaaaaaaaaaaagacatagtccttcctgcaaggaacgcagaggaagtgaaagtactctgaacaaggtgctgggggaacacaggtgggaatggttaacttcacaggagaggggaatctgaaaggatgattgaatttggtctgaatgaataggtgtttatagcagagaaaagagaggaaagggaaagtttatttcagacagaagggaaggcttagtgttttaggaaataatgaaatgtttgatagtgtgccctgtgtgaggaggagaggaagcccttgtgttggatgccagggtaagaaattttggattgtggacaataaggaattttaaagctggggaatgacatgataatattcactctttatttaggaaaagcacttgggctagtgtggaggatgaactaaagggggatgagtgatttggaaacatgctgtctgtgtaaaccaggtgccaattaggaccctcctgatccacagagagttctgtatgattgcctcagagcattgccaattccacaagatgggaaagttcaaactttccacacaatttctgcagattccttgggtttatgacctcataatctcttgcctgagattcctgtgatctgtacaaaccttttctattttgtccccattagtcctgtcacagaactcagctcttttgataagtttagaatccttcctagagattgagaatcttagtgaggagttacattaaggcatgtgagtagcttccaattctgtcatctctgcttgcctccccaccctctctctggattgccacaataagactagggtgcatcattgttttttgtttgtttttctgagataaggtctccctcttgcccaggctggagtgcagtagtgtgatcacagctcactgcagcctccacctcctgagctcaagcaatcctcctacctcagccaccccagtagctgggaccacagatgtgtgccaccgcacctggctaattatttatttttgttagagatggtctcactgtcaggcctctgagcccaggctaagccatcataacccctgtgacctgcacgtatacatccagatggcctggagcaactgaagaaccacaaaagaagtgaaacagccagttcctgccttaactgatgacattccaccattgtgatttgttcctgccccaccctaactaatgaatcaaccttgtgacagtcctcccctggacaaagagtctcaggagctccccaccgagcaccatgtgacccccacccctgcccgcaagagataaccacctttaactaattttccactacctacccaaatcctataaaactgccccacccctatctccctttgctgactctgtttttggactcagcccacttgcacccaagtgaaaataaacagccttgttgctcacacaaagcctggttaggtggtctcttcacatggatgtgcgtaacgtttgatgccaaagaacccgggacagggggactcctttgagagattggccccctgtcctcaccctcacttcatgaagagatccacctatgacctcgggtcctcagaccagcccaaggaacatctcaccaatttcaactcaggtaagcggtctctttgctctcttctccagcctctcttgctacccttcaatctccctatctttccaatttcagttctctttcctttctagtagagacaaaggaacacattttatccgtgaactcaaaaactctgacatcggtcatggatttgggaagacagtcttcccttggtgtctgatcatagcagggacgcctgccttgatcattcacccacattccattggtgtctgatctccatggggacgcctgccttgatcattcacccacattccactggtgtctgatctccacggggatgcctgccttgatcattcacccacactcccttggtggcaggtcaattgcagggatgcctgctttgcctgttcactcacattacagcccaggactcagtcaaggatgcctactggaagcctggtaggtgcccacctccatttctccatgtctctaccttcctctttaaacttaccttctccattatgggcaactttccaccatccattcctccctcttcccccttagcctgtgttcctaaaaacctaaaaccccttcaactaacacctgatctaaaacctaaacatcttattttcttctgtaatactgcttgaccccagtacaaacttgacaatagttccaagtggccagagaatggcacttttgatttgtctatcctacaagacctagataatttttgtcaaaaattgggcaaatggtctgaggtgccttacgtccaggccttttttacacttcgctctctccctagtctctgctcccaatgcagcttgtcccagattttccttctttctctcccgtttgctccttcagtctccatcccaagttcagagtcctccaaatcctccttttccactgacccctctgacctctctcctcttcccctggctgctccttgccaggctgaattgggtcccaatttttccgcagtctctgctccccaaccctataacccttctattacacccctcctcacacctggtctggcttacagtttcgttccgtgactagctctcctccacctgcccaacaatttcctcttagagaggtggctggagctgaaggcatagtcagggtacatgtgcttttttccctattggacctctcccagatcagtcagcatttaggctctttctcatcagaccccactaaatatatacaggaattccaatatttaactcagtcctacaatttaacctggagtgacttaaatgtcatcctgacttctaccctctccccagatgagcgagagtttataccctagcccaatctcatgctgatgactgccagcgtcctgagccaggcctccaagaagacaccagggcagttccccaggaggatccccaatggggataccaaacaggctcccaagatacagctaggcaagattacatggtctcttgcctagttgaggggcttaaaaaggcagcatacaaagttgttaattatgacaaacctaaagaagccacccaaggtaaggacgaaaacccagctcagttcatggcccgcttggtggctaccctcagacgctttacagccctggacccagaagggccagaaggctgtcttattcttaatatgcattttattatccagtctgctcccgacattaggaaaaaattccaaaaactagattccagccctcaaaccccacaacaagacttaattaacctcgccttcaaggtgtttaacaatagagaagagacagccaagtgacaacgtatttcagagctgcaactgcttgcctttgctgtaagacaaaccccagccatgcctacagcacacaaaaacctcaaaacaacaaaactgcagcctccaggcactccttcaaaacctccttatggaccttgcttcaaacgccaaaagcccggccactgggcctcggaaggcctgcagcccaggattcctcctaaggcttgtcctgtttgtgcaggaccccactggaagtctgactgtccaactcagattaaagctgctcctagacctgctggagcaaaaacccagggctctctggctgactccttctcagatctcctgggcttaacagctgaagactgacactgcctgatcatctcggaagccccttggaccatcacggacaccaagctttgggtaactcttaaacagtggaggaagacaggaatgtcaggcctctgagcccaagctaagccatcataacccctgtgacctgcacgtatacatccagatggcctggagcaactgaaaaatcacaaaagaagtgaaacaaccagttcctgccttaactgataacattccactattgtgatttgttcctgccccaccctaactaatgaatcaaccttgtgacagtcctcccctggacgatgagtctcaggagctccccaccaagcaccttgtgacccccgctcctgcctgcaagagataaccacctttaactgtaattttccactacctacccaaatcctataaaactgccccaccccatctccctttgctgactctcttttcggacacagtccacttgcatccaagtgaataaacagcctcgttgctcacacaaagcctgtttggtggtctcttcacatggatgcatgtaacactcactatggtgcccaggctggtgttgaactcctgggctcaagagatcctcctgcctcagccttccaaagtgctgggattacaggcacaagccactgtgcccagcctgcatcttactatatacatggtgtcttactatcaccattgatctttttttttccacattgcaataattactccaatattgcagtgtgtcttacaattaatgttttggattaaatgaaatatcacataagaaagagatgacatggtgatgtcagcaagatggtacaataggaggtaggtgtcagcctccatttccctcacagagacactgacttaacaatatacagaccaaaatacctttattttggtagaattctaaaaaccaattaggttttactaccccaggcaagcacaaagccaaaaagaaccacactgaaacaggtaaggagctgtttcactttatctgtgattgtctcttcctcaaaccagcacagctcagcttgggtcacaggttcttccttgggggaaagagaagagcagaacatacatttaatgttctggccttttagaaggctgcccacggactggtttattctcttgcctaacttgatgtactaatggaactggaatactctggatgcccgggggccactgaaagcaagggagaacggggttgggaagtacatcttgctgcaacactggagggcctgtagtgccagagacagaggtcagcacactcagcacaattgagagaaggctcccaatttgtggcttctctcttgggaaggaaggagaagagcagaacatgtgttagtattctgccttttgggagaactgcctaagggactggtatttgtcacctaatttggggtgctaatggggagccaacataatttgaatgcctgggggccactgagcacaaaggagagcagggagacttgctgcagtactaccagagaacctgcagtacctcagacagacactagaaagaacagaaaattatgcacttctgaaagtaacaacaaactggcaaaggtctgtaattgggaaattagaagcatgagcccagagaagtaacatcccctctgaaaggattcggaggttcccagaatctatcttggctgcttattgaagccaagaccttactgaaggtctttctctgtatgaagccagtctgtgaaaaatcagaaaaacaatgtgtgaatgaaatgagaatgtcagtagagacagaaacaaataaccaaacaaattctgaaactgaagaatacaataactgaattgaaaaattcactacaggggttcaacagcagacttaagcagaatgaagaatcaggtaactttgaagacagattgaacttagtgagtcagaggaacaaaaagaaaaaaaagaatgaagaaaagttaaaaaatcccaagggatttatgccacaccatctagtggatcaatatacacattatgggagttccagaagaagagggagagaaagggattgagaatgtaattgaagaaataatggcccaaacttccaaaatctgagaaatgaaatggatatccaatcccaagaagctcaaagaactccaattaagatgaaccaaagaggcccacaataaggagcactcattacaatcaaactgtcagcagtcaaagacaaaatcttgaagctagcaagataaaagcaagtcatcacatacaaggaaactttataaaattatcagggagtttctcagcagaaaccttataggcaagagggagtgtgatgatataattaaagtgctgaaagaaaacacacacacacacacacaccctgccaaacaagaacactacatccagcaaaactgtccttcaacaatgaaagagaggctgggtatggttactgatgcctataatcctagcactttgggaggctaaggcaggaggattgcttgaggtcaggagtttgagaacagcctggacaacatagtgagaccctgtctctacacacacacatgcgcgcacacacacacacacacacaaagctggtgtgatggcatgagcctgtactcctagctattcaagaggttgaggtgggaagatcactcaagcccaggaatttgaggttagagtgagctatgatcatgctagccttccaacctgggtgatggcaagacgatgctaaaaaaaaaagaaagaaaaacttactaagataagcaaaagcttagggaattcatccccacaacacctgccttacacgaaatgttagggtgagtcctcaggtttaacctaaaggatgctagacagcaacacaaacacatacaaaaatatatgactcactagtaaaggtatatctatagataaatacaaaagactataacactgtaatgttggtatgtaaatcccttaataactggtatataatttaagagagaaaaacataaaaactcaaactgcattgatgcatacaaaatataaaaagatgaaatttgtgacattgataaagtggaggagacgtaaaggagtagagtttttgtatgtaattgaaattgttattagcttaaaatagattgttataattataagatgtgtatgtaaatctcatggtagccatgaagaaaatatccatagaagatgcacagaaaaaaatgagaaaagaatcaaagcaagtcaacacacacaaaaatcagtgaaacacaaaggaagggcaccaagagaagaaaagagagacaaaataactacgagacagacagaagtaataataaagtggcaataataagttctttcctatcagtaattattttaaatgtaagtggattaatctctacaatcaaaagacatagtgtagctgaatgaataaaagtaattctggttactagttccacgtgtaaggagcttagaagtcacccctctgttttagcaataagtaaaagctgaacgaactgaaagatcaacaactcttcttagatccataaaacaagtgaggtcacagggcaaatcattgccccccaaattggagagacaggtagatacagagaatcacaacataccagaacagaaacctgtgtggaaaccagtgccagggtaggaaaacctaaactgtagctgatcaacttctggaacatttggagagctcacaagggactggtacttgaaattctgtagagctccttgtttcatttaggacttgtactccatgccttttctgagaagggtctttctctttcttagcagtgaaaggaactagtctgtccttcctggttttctgttaaactaagcctatttcattttagctccttcttgaattccagccagctaagactttcctctggaataagtctcagagttaaaaatgtcagaggactgcagtgtcctgacactagctggaaccagtgatgtggccatgttcctggcacctgagaccactcagtaccctacaccccagggaacagacagcccagcacatcagggagattgcccccaggacatagggagccaaagttcacacccctcagagtctgagagctgcctgcctagggccaccatcactgatagcaactctgccccctttagcagaggggtcacacactgcctgggggcccaaggactgaacttcttggggctgctgctaccactgccaccatgggtgcctgtgtgcatgccatcttggggccaacgaccggcccaccaagggcaaccatttccaccaccagcacctgtgcatgctgtccagggaccagaggacaatccatttagggtcactgctgccactactgatacttgcatgcactgcctggggatctgaggactggcccacacagaatctatatctacagcaaagcttcaccacagccttcacaaacaactgcagcctaagccaatgaggaacttggagatactggtgacactgattacagctgtaggaatcatacagacactacactataatgctcactcagaaccaaagctaaacaaccctacccaattgatactatagatacatctacaggaaaaagtcttcccctgtgaaagctacttcataaaattggaagaagtgactattatactagatgcatagatatcaacatagagacacaagaaacaaacaaaaaaggcaaggaaacatgacacctccaaaggaacacaataattattcagtaatagacccaaagaaaaggaagtctacgaaatgccttaaaagggattcaagccgggcgcggtggctcatgcctgtaatcccagcactttgggaggccgaggtgggcggatcatgaggtcaggagatcgagaccatcctggctaacacagtgaaaccccgtctctactaaaaatacaaaaaattagccgggcgaggtggccggcgcctgtagtcccagctactagggaggctggggcaggagaatggtgtgaaccccggggggcggagccttcagtgagccgagatcgcgccactgcactccagcctgggcaacagcgagactccgtctcaaaaaaaaaaaaaaaaaaaaaaaaaaaaaagggattcaaaataatgatgataaggaaattcaggaagccgggcacagtggctcatgcctgtaatcccggtattttgggaggccaaggcgggtggatcacttgaggccaaaagttcaagacctgcctggccaacatggcgaaacctcatctctactaaaaatacaaaaaaattagctcggcatggtggtgcatgcctgtaatcccagctacttgggaggctgaggcacaagaattgcttgaacccaggaggcagaggtagcagtgagctaagatcatgtcagtgtactccagcctgggtgacagagtgagactcaatctcagaaaaaaaaaaaagaaagaaagaaagaaaaaagcctatatgacatataggacaccatcaagaaaataaacatttgtatttttggtatttcagaagaagagatggcaaaggcatagaaaacctacttaatgaaataatcactggaaatgtctcaagtcttgagagagaaatatagacatccagatatggaaagctcagaagtctccagattgattcaaccccaaaaggtcctttctgggacacattataaaactgtcaaaagtcaaagacaaagagaattctaaaaacaagagaaaagcatcaagtcatatatataagggaattcccatcacactaacaacagcataaaccttacaagccaggagagaaaggactcatatattcaaagtgctaaaggaaaaaaaaacaaaacaaaactactagccaagaatacccaccaaaggtatccttcagaaatgaaggagaaataaagtttttctcagataagcaaaaattgagggacttcatcaccactagactggtcctaaaagaaatgcttaagggactcctacatctgcaagcaaaaagattatatcaacacttatgaaaacacagaaaggtataaaactcactggtagagttgatatacaaataaaaaaaagaatcaaatattatcactagagaaaaaccaccaaattgcaaggataaacaataagaaaggagtaaatgatatataaaacaatcagaaaacaattacaaaatgacaagagtaaatcctcacctatcaatagtaaccctgaatataaacgtttcaaattcctcaattaaaagatatagaacagctggatggatttaaaaaaaaccaaactatatgctgcttacaagaaagtcacttcacctttaaacatataatagactgaaagtgaagggatgggaaaagatattctacacaaatggaaaccaaaagcacgcaaggatagctatacttttatcagacaatatacactttaagtgaaaaaacagagacagaggtcattatataatgataaagggatcaattcagaaggaggattgtgaatatatatgcatacaacaccagaacacccagatatgtaaagtgtattagagctgaagagagaccacaatacaataatagatggggactcccacaccccactttcaacattggacagatcatctggacagaaaatcaacaaggtaatatcagaatcggaaattcatttttctatttttttcctccttcttcctttacatagaaatatgtttttctatgtttaactttatctattaacttttatctatagctggttagatttttctctcttttttttctcttttgttttttatgaccacaaagatccagaagatatctacagttggtttgaaagttatattttatacttctggaggtttccctaacttacctacactcacttttatactttttacatacataatcacaaggtcccacaataggctgtctgcaagctgaggagaaaggagagccagtcaaattcccaaaactgaagaacctggagtgcaatgtttaaaggcaggaagcatccaacacaggagaaagatgtagcctgtggtcatttctccagtgccagaatgcataattggcatagacatacttaccagctggcagaacccccacattggctccctgactggtagggtaagggctattacggtgggaaaggccaaatggaagccgttagagctgcctctacctagaaaaatcaaaaacaatatggcatccacggagggattgtggagattagtttcaccatcaaggacttgaaagatgcaggagtggtgattcccaccacatccccatttaactctcttatttgacttgtgcagaggacagatggatcttggagaatgacagtggattatcataagcttaaccaagtcatgactccaattgcacctgctgtaccagatgtggtttcattgcttgagcaaattaacacatctcctggtacctgatatgcagccattgatttggcaaatgctttttccccattcctgtccatgaggcccacgagaagcaatttgccttcaattggcagggccagcaatatacctttactgtcctacctcaggggtttatcaactctccggctttgtgtcataatcttgtttggagagacgttgatcaattttcttttccacaagacatcacgctggtccattacattgatatcattatgctgattggatccagtgagtgagaagtagcaaacacgctggacttattggtgagacatttgtgtaccagaggatggaaaataaatctgactaaaattcagggaccttctatctcagtaagatttctaggggttcagtggtgtggggcctgtcaaaatattccttctaaggtgaaggataggttgctgcatttggtccctcctacaaccaagaaagaggcacaacacctactgggcctatttggattatggaggcaacacattctctgcgtgggtgtgttactctggcccatttattgaatgacctgaaaggctgccagtttttattggggtccagaacagagaaggctctgcaacaggtccaggctgctgtgcaaactgctctgccacttggaccataagacccagtagatccaatggtgcttgagatgtcagtggcaatagagatgctatttggagcctttgacaggaccccataggtgaatcacagtggagacctctaggattttggagcaaggccctgccatcttctgcagataatgtctcttctttggagagacagctcttggcctgttactgggctttggtggaaactgaacatttgactatgggtcatcaagtcaccatgcaacctgaactacctatcatgaactgggtgctttctgacctgtctagccataaagtggggcatacacagcagcattccatcatcaaatggaagtagtatatatgtgattagggtcgagcaggtcctgaaggtacaagtcagttacatgaagaagtgtctcaaatgcccatggtctccacttctgccaccctgccttctctcccccagcctgcactgatggcctcatggggagttccctatgatcagttgacagaggaagggaaaactggggcttggttcacaggtggttctgcatgatatgcagtcaccacctgaaagtggatagctgcagcagtacagctcctttctaggacattcctgaaggacagcggtgaaggaaaatcttcccagtgggcataactttgagcagtgcacctggttgtgcactttgcatagaaggaaaaatggccagatatgcaattatgtactgattcatggactgtagccaatagtttggttggatggtcagggacttggaagaagcatgattagaaaattggtgacaaagaaatttggggaagaggtatgtggatgacctctctgagtggtcaaaaactgtgcagatatttgtatcccatgtaagtgctcatcaatgggtgacctcagcagaggaggattttaataagtggataggatgacccgttctgtggacacactcagcctctttccccagccacccctgtcattgtccaatgggcccatgaacaaagtggccatggtggtagggatggaggctacacatgggctcagcaacatggacttccactcaccaaggctgacctggctacagccactgctgagtgcccaattgccagcagcagagaccaacactgagcccttgatatggcaccattcctcggggtgatcagccagctacctggtggcaggttgattatattggacctcttccatcacggaaagggcagaggtttgtcctcactggaatagacacttatttcagatatgggtttgcctatcttgcatgcaatgcttctgccaagactaccatccatggattcatggaatgccttattcaccatcatggtattccacagaggattgcctctgaccaaagcactcactttacggctaaagacgtgcggcagtgggctcatgctcatggaattcactggttttaccatgttctccatcatactgaatcagctggattgacagaatggtggaatggccttttgaagtcacaattacaacaccaactaggtgactgtactttgcaaggctggggtgaagttctccagaaggctgtgtatgctctgaatcaatgtccagtatatggtactgtttctcttatagccaagatcatgagtccaggaatcaaggggtggaagtggaagtggcaccactcatcattacccctagtgacccactagcaaaatttttctttgtgttcctgtgacattatgttctgctgacctagaggtcttagttccagagggaggaaggctgccaccaggagacacaacaacagttccattaaactggaaattaagattgccacctggacactttgggttcctcctacatttaagccaacaggctaagaagagagttacagtgttggctggggtgattgacccagactatcaagatgaaatcagtctgctgctccaccacggaagtaagaaagagtatgcatgaaatacaggagatccattagggcatctcttagtattaccatgccctgtgactaaggtcagtgggaaactacaacagcccaatccaagcaggactacaaatggcccagacccttcaggaatgaaggtttgggttactccaccaggcaaaaaattatgacctgctgaggtgcttgctgaaggcaaagggaataaggaataggtagtagaagaaagtagtcatcaataccagctatgaccacgtgaccagatgcagaaatgactgtagttgtcatgagtatttctccttcttttgttaaaaacatgtttgtgcatgtgtacacttgtactaagaaaattttcttcatttttatttccttttttcctttatcatgtgatataagatttattgacttcatatcagcatttaagtgttgttaattttacgtaatagcatttgggttggggattggtgcccaaaagatagttgtattatgttaggtgtaattatgtctttatttgaatattatgtttttattgtcttatttgaagattatgtatgatctcaggagatgtgtatgggttcaagttgacagggggtggacttgtgatggttaatactgagtgtcaactttattggactgaaggatgcaaaatattgttcctgggtgtgtctgtgagggtgttgccaaaggagattaacatttgagtcagttgaccgggaaaggcagatccacccttaatctgggtgggcacaatctaatcagctgccagcgtggccagaataaaaagcaggcagaagaacatgaacagagtagactggcttagcctcccaacctacatctttttcctatgctggatgcttcctgcccttgaacattggactccaagttcttcagctttgggactcagactggcttccttgctcctcagcttgcagatggcctattgtgggaccttgtgattgtgtgagttaatattccttaataaactcccctttatatatacatctatcctattagttctgtccctctagagaaccctaatacacatacaatggaagattatgcagcctttgaaaagaatgaaatcctgtcatatgctgcaacatggatgaaactttgggacattatgctaagggaaataagccaatcacaaaaagcaaacactgcaacactgcatgattttactcaaatgagttatctaatgcaatcaaactcatagaagcagaaagtagaatggtggttgcaagtctatagagtgagggaaataggaagttattattccatgggtacagagtttgagacatgtgaggtgaagatgttctgaagatctgtcatataacgatgtgcacatagttaacaagactgtagtgtacacttaaaaactgagagggtaggccgggtgcggtggctcatgcctataatcccagcactttgggaggctgaggtgggtggatcacctgaggtagggagttcgagaccagcctggccaatatggtgaaactccgtctctactaaaaatgcaaaaattagctgggcgtggtggtgggtgcttgtaatcccagctacttgggaagctgaggcaggagaatcgcttgaacccgcgaggcagagtttgcaatgagccgagattgcaccactgcactccagcctgggtgaaaagaacaaaattccgtttcaaaaaaaaaaaaaaattgagagggtaaatttattttatgtatttttttttaaccacgaaaaaataaaaagaaagaaatgagctaaggcaagaattggcttgaccgtttatgtcctagaatgcacagatttggaaggaaagatatgataggggttcaggagtctcaaacagcaaaacaagactgctcaaaacttttgtaaagcaccctttacacttctcagttatgtaatgggaaataagtctgtgtcttggattagaccagggatattgctttttcactcagtactattgtttcagttgtcctccagatagcagccattaaactgaagaatagagggatgggatggatggtataaggaaattagaaatggtctttgttgtctaaataattaaatgccattttaaaaagattagatttccctaacaatctagagttaaagcttccaatgatttcaaagtgtcagggaggtaatcaagagacagagagagagaggtaaatgcatgccaagattgttaatttgtttggggtaaagatttagatgccatgagttttaggcaatcataagaaaaaaaaaagtataaatgtgagtgtaggtaagttaggggaaacctccagaagtataaaaatataactttcaaaccagttgtagatatcttctggatctttgtggtcagaaaaaagaaaagagaaaaaagaaaaatcaaaccagctatagataaaaaattaaacatagaaaaacatatttctatgtagaggaagaagaaggagaaaaacaaaaatgaatttccaattctggtaattctgtggactaaaaaaccgtttataaagcacctacagttgtgcaattgctacataaaacacagcaaatatccacttagatgcatgcaactttttttctttagtttacagagactcagtttgtatttatttattttttgattatacaagtaaattttaatgaaaacagtgtgcatacattttgtggctaaatctaattataatgctcattattggcatagaactttccagtttataaagaacttaaaaaaaaccttgtagttatgaggtacatgtgcaggtttgttatataggtaaattgtgtgttgtaggggtttgctgtatggattatttcatcattcaggtaataagcatagtactcagtaggtggtttttcaatcctcatccttctcccaccctctactgtcaagcaggccctggtgtctattgtttctttctttgtgtccatgtgtactcaatgtttagctctcacttattagtgagaacatgcgaacatgcagtatttggttttctattcctgcttagtttgctaaggataatggcctccacctctatccatgttgctggaaaagacatgatctcgttcttttttatgcctcagtagtattccatggtgtatatataccacattttctttatccagtctaccatgggtgggcacttaggttgattccaggtctttgttattatgaatagtgctgtgatgaacatatgcatgcatgtgtcttttatggtagaacaatatattcctttgattatatatccattaatgggattgccaggtcaaatggtacttctgttttaagttctttgagaaatagccaaaccactttccacagtggctgacctaatttacactcccaccagcagtgtgtaagcattcccttttgtctgcagccttgccaacatctgttattattattattattgctttttaataaagctgactggtgtgagatgatatctcattgtggttttgatttgcatttatctaataattcgtgatgttgagcattttttcatatgcttgttggccacgtgtatgtcttcttttgaagtgtctgttcatgtccttttcccactttttaatgggattgttttttgcttgttaatttgtttaagttccttatggattctggatattagacctttgtcagatgcatagtttgaaaatattttattccatcctgtgggttgtctgtttattctattgatagtttcttttggtgtgtggcagctctttagtttaattaagtcccatttgtcaatttttgtttttgtcacaattgcttttggcatcttttcatgaaatctttgccagggcctatgtccagaatggtatttcctaggttttcttcaaggatttttatagttttaggttttacatttaagtctctaatccatcttgggttgatttttgtatatagtgtaaggaaggttccagtttcaatcttctgcatatggctagccagttatcccagtactacttattgaatagggagtcctttcctctttgcttgtttttgttgattttctcaaagatcagatggttataggtgtacagctttatttctgggctctctattctgttctattgggttatgtgtctgtttttgtaccagtaccatactgttttgattactgtagccttgtaacatagtttgaagttgggtaatgtgtcatgcctccagctttgttctttttgcttaggattcctttgtctattcaggctgtttttttaagttccacatgaattttagaatagttttttctaattctatgaagaatgtcattggtagtttgataggaacagtgttgaatctgtaaattgctttgggcagtatggccattttaacaatgttggttcttcctatccatgagcatgaaatgattttccatttgtttctgtcatgtctgatttttttcaacagtatcttgtaattctcattgtagagatcttttacttccctggttaactgtattactaggtattttattttattttcattttttgcagttattgtgaatgagattgtgtttttatttggcactcagcttgaatgttattattgtatagaaatgctactgatttgtgtattttgattttatatcctgaaactttgctgaaattgtttatcaggtctagaagcttttgggcagagactacagggttttctaggtatagaatcatatcatctgcaaacagagatagtttgacttcctcttttcttatttgtatgccttttgtttctttctcttgcctgattgctctggctaggacttccagtaccgtgttgaataggagtgtgagagcaggcatacttgtcttgttctgattctaaaggggaatgcttccagctttggccccttaattatgctggctttgggtttgtcataggtggctcttattattttgaggtatgttccttcaatgcctagtttgttaagaatttttaatatgaagatatattgaattttattgaaagccctttctgtatttattgaaattaacatgtggttgtttttagttctgttttcatgatgaatcacatttattgatttgcatatgttgagccaaccttgcatcccagggataaggccttcttgatcatggtggactagctttttgatatgctgctggattctgtttgctagtattttgctgaggattttcacattgatgttcatgaaaaatatggtctgaagttttctttttctgttgtttctctgccaggttttggtatcagaatgatgctggcctcataggttgagttagaaaggagtccctcttcttcaatttttttgaaataggtttagtagtaatggtactagctcttctttatatatctggtagaacttggctgtgaatccatctggttctgggctttttctggttggtagacttttttttttttttttttttttttttttttgagatgcagtcttgctcttgttacccaggctggagtgcaatggcgcgatctcagctcactgcaacctctgcctcccatgttcaagctattcttctgcctcagcttcccaaagtgctgggattacaggcgtgagccaccacacttgggtggctttttattacttacttaattttggaactcattattagtctgttcagggtttcagtttcctcttgtttcaatcttgagaggttgtatgtttccaggaatttatccctttcctgtaagctttctagtttgtgtttgcatagaggtgtttgtaatggtctctgagagccttttgtatttctctggtgtcagtgttaatgtctcctttgtcatttctgattgtgtttatttggatcttctctctttttctttgtctatctagcagtctatcaatcttatttattttttcaaagaaccaacttctggttttattgatcgtgtgtgtgtgtgtgtgtgtgtgtgtgtgtgtgtgtgcatgtgtgtgtgtttcattctgttcagctctaattttggctatttcttgtcttctgttaggttcagggttggtttactcttatttttctagttcctctaggtgtaatgttaggttgttaacttgacttacatctttgtaactttttgatatgggcacttaatgctataaacttccctcttaacactgatttagctgtgtcccagaaattctggtatttttatatctttgttctcattagtttcaaagaatttcttgatttctggctttatttcattgtttatgcagatgtcattcaggagcaggttgtttaatttccatgtaattgtatgactttgagtgatcttagtattgattcctatttgtattacactgtagttcaagagtgtggctggtatgattttgctttcttaattttgctgagaattgttttatggccaattttgtggtcaattttaaggcgtgtgccatgtgcaaatgagaaaaatgtacattctgctgtttggggtagagagttctgtagatttctgttaggtccatttggtcaagtattgagttcaggtcctgaatatctttgttagttttctgcctcagtgatctgtcttatactgctaatggggtgttgaagtctcccactcttattgtgtggttacctaagtccctctgcaggtctctaagaacttgttttatgaatctgcatgctcctgtaatggatgcatatttatttatgatagctaagtgtttcttgttgaattgaaccctttaccaatatgtaatgctcctttgtctttttccatcattgttagtttaaaatctgttttgtctgaaattagaatagcaacccctgcttgttttttttcctttgctttgttgtatatgtttctctatccctttactttgagccaatgggtgtcactgcatgtgagatagatctcttgtagacaacatagatttgggtcttgcttctttatccaaattaccactctgtgccttttaactgggggcatttagcccacttacattcaaggttaatattgatttgtgtttatttgatcttgtcatcatgctgttagctggtcattatgcagacttgattgtgtaattactttatagtgtcaatagtctgtgtgtttttgtggtggctggtaatggtctttcctttccatatttagcactctcttaaagacctcttgtaaggcaggtctggtggtaatgaattcccttagcatttgcttgcctaaaaaggatcttatttctctttcagttatgaagcttaatttagctggttatgaaattcttgaatggagtctcttttctttaaaaatgctgaatgtaggcccctagtctctttaggttaatagaatttctgctgaatggtccactgttagtctgatgaggttccctttataagtgacctgccccttctttttagctgcctttaatattttttctctcatgctgaccttggagaatctgataactatgtgtattggggatggtcatcttatatagtatcttgctcaggttctgtgcattttctgaatttgaatgttggcctcttttgtgaggttggggaaatttctgtggatgatatcctcaaatatgtcttcaagttctttgctttctctccctctctttcagggataccaaagagtcatagatttggtctctacataatcctgtatttctcagaagttttgtttattctgtgttttttttttctgttgttgcctgagttaattcagagaaccaatcttcaggctctgagattctttcctctgcttggtcgattttgctgttaatacttgcaattgtattatgaaatttttgtagcgtttttcagctctatcagattaagtgtgcttttttctttaaatgcccactttatttttcagctcctgtatcattttattgtgttccttagattctttggattgggttcaactttctcttgaatcccgatgatctttgttcctatttatattctaaattctatgtttgtcatttcacccatttcagcctgcttaagaaccattgctgaggaactagtgtggtcatttggaggtaagaagacactcttactagggtttttgtgctggttctttctcatctatgtgggctgatgctcctttaatatttgaatgtgctgtccttttgatggggtgttttgcttttatattctttgatgcccttgggggtttgataatggcataatgtgggttcagttgacgggctttgtttctagaagatttcaagaggccaaggcagagctcaacactcctgggctttgtactctaactctgggggcgtggtactgagcccccagctttgttgtctggtcccccaaggttaggaacttgttacactggagaggctgaggtattcccagactgctggccacacaacattccagtggagagtgccagccaaagtacttcacaggggcagtggcagcaggatctgtgctcacttgcacatgctagcagctgcagaggcacagtggggtgcacgcacattagctgggatggggcactggcaggagtggagcagcagggtctgtcattaccagctttcaagaaaataaggaaaattcctagaggtaaaaaacaaacagaaagctgaaaaccaagtgataagtgggtgctgacactttggatgttctgagcatgtttactggtcttgtaagtcagggctgtgagtctaatgacaagacaatgacaagaaaatggggacttggatttatgcagggtgaagatttgtaactgagatctctggacaaagatgataccctcaattacctacaccttagtgaaaaagtgatctaggagaaaaagaaaaccaaaacactttgcttgcttttgtgggcttgtgttgaatggtattgatctggtttatatattgaaataattagaagaagatgtttgcagtaaggcatttaaaattctgtaattattcaggtaaagggaaaaatattaatttttgagattaagcattcctgtgaaaatggtaaggaaggcactaaagcaataaattgaattccaattagtaaaggggaaaacctggattaatgaaaacaaatcaatcccaaagaaaaataggacaaatagaaatatttgtctaaataaatgtgaaatggaatgaactaaccagttaaaacacaaaaatttttcagattagttaagaaaacccctgtggcttactcctgtaatcccagcactttgggagactggggcaggaggatttattgaggccaggagttccaggccaacctgggcaacatccctgtaatccgagctactcaggaagatgaggcaggaggatctttttacaggagttcgaggctgcagtatgctataatcatgccactgcacttcagcctgggcaacagagtgagaccctgttgctaaagaaaaaaaggaggaaagaaagaaaaaaagaaaccctcaaatcctgttatatgttatttataagaaataaacctaaaatgtaagcacacagaaaggttgaaagtacaagaatttaaaaaattatcccaaggaattaccaattaaaagaaatttagtgtgtagaaaatatagactttaaagaaaaaagcattattagggatacaaatggccacataatgaggagttacaattcactagtaatatatatttccaaagttataagcacctcaaaagttatgtgtagccttgtttctttgagtggaagctctaagaatcagtgtgtattttgccacagtgctcttttttccactgctatggcaaccaggattgttctaggtagtaccttctccatcagcccaggtcccagactgaggacgaggacaatactcctagccaattcatgatggacatgtgtcatgagcaagaaataaatctttggctgggtgtggtggctcacgcctgtaatcccagcactttgggaggccgaggcgggtggatcacgaggtcaggagatcgagactatcctagctaacatggtgaaaccccatctctactaaaaatacaaaaaattagctgggcatggttgcgggcacctgtagtcccagctactcgggaggctgaggcaggagaatggcgtgaatccgggaggcagagcttgcagtgagccaagatcacaccactgcactccagcctgggtgaaagagtgaaattccatctcaaaaaaaaaaaaaaagaaagaaagaaatcttttatgggttcttcttttttgacagctttattgaggcacagctgacacaatttgataagttttgacataggtttgcacctataaagccatcaccacatcaagataatgaacacatctatcacacctaaaagtttcttcatgccctttgtgatccctttccctcatccctcttctctgtccattggctttcaggtgaatgttgaatctgcttttgtcaccgtagattagcttacattttctagaattttgtataaatgggatcatgcagtatgtattcttgttttggttggtctgctttctttcactcagcataattattttgagattcatgcattatgtagtgtatataaatatttatccatttttattgttgaattttatttcattggatagccatacatttatatgtttatccattcacctcttgatggacattttgagtgtgtccagtttggggttattacaaataaagctgctatgaacatttctgtagaattctttgtatagccaaattgtcacaggatccttagggtgtcacttttccagctggaagcctctgtggccagtggcacctttgcccgagttgtgcttgggtctactaggctcattctgcccactcaacctcacaggctgtgctcagcttgttctactggcccggatcccatgcctgccaagggtgagccaggtgcagagtgatgagaggtgcatgagagaggtgcatggggtccagccactgcacacagccaggcacaccagctgctgtgggtgggcagctccaggcgctggcccaggtgctggctccatgtgaggctgtggctggaccaggcatagtgcatgtggcttccactgtgggctccagggaatgtggtgcctccaggaagcttggagataccaggaaccacagagccccaaagagggtgtcacagccctggctcagagagcccttaggtttggactccctgaaggactgcagctcttctctccttctcatcacttgcaatgtggcaagccagtgggagggggtgggatgtgtttcagccctgtttgtgttacagctctttcagccctaccatttggcgggtcccgagttcttgtcctgcatccaggaagaatgaggtatgcagacaactggaaggtaagcaaggcgaaaaggtgctttattgaccaacagtacagctctcaggagacccaatgtaggtagctcctttccacaggcagttcatcctgtcaagtgcagccctcagaagagaggagacccagagtgggtagctcctatctgcaggcaggttgtcccaacatctgtgtgactctgagtctggctgagtctgggttttttatgggcttcagaagggaggaagtgtgtgcttattgatccatgggtggccacacgtgggcccagaaaaagcaccataagttctcattccaggctgcagactccatccagaactgacagccgagttcccatgctccaggacgtttctggcatgaagatggggcttcaccggggacctgcccagaatcctgtcagcctcctgccaccatcaatcatgtcatccacagtgcccaggctgtttgtgctgaagggtgcctgcaggcccatgcctagatgccctcagaaccccctcaatctcaaagtctggaggtggccgaggcggcagggggctggtgtgtcaacgccaccctgagtgcactcccacaccctgctgggttgtgacagtgcccaggcttggcctcaactttgttccaaaatcagagcatgcactggatacagggataggccaggcaaggggagcaggtacttccaagcctgcaggggcaggggggcttcctgggcccccgagagtgcaaggatgcctggatccataaccacagctgggtggctgcagctgtgcctgggatagcaggtctcccaccctgccaacttggaaaaaggtggggctcctacctgtttccagctcccagctctttggtgcatgcagttccagctgggtctcctccattgcaaagccagcaactttgcagtggccactctagatgggctgcagctgccatcaatatgctttcatttctcttgggtaaataaataactagaaatggctggctcaagtggtaggtatatgcttacctttttaaaaaactgccaaactgttttccaaagtataccgttgtgattttcatgtttgtttccctagtggccaatgatgttgaaaatatttttatgtgcttatttgcatccatatatcttatttggtgaagtgtctgtttacatatttttttccattttttattgggttgttttctttttcaattcaaaatttctggtctttgaaagatactttaaacagaatagaaagacaattgggtatgtgtgaatataaatagtagcacagggagatctttataataatataattgttctgtatcttgattgttgtggtggttacacaaatatacacatgtgataaaatgatatagaactatacacatacattgtatccatgtgttattcctggttttgatagtgtaccttaattatgtcagatacaaccattgggggaaactgattgaagggtatacagggactctctactatctttgcaactacctctaaatctaaaattatttcaaaattaaaaattttaaaatagacaattcacagaccttctaaagtaaattgtatgtggatgattgattataaggggaaaaataaaatggatccctatcttacaacatacacaaaagtcaattcctagagtatttgagacctatatataaacagaaaaattgttatacaagacaatatagaagattatctttttgactactggataggaaaatatttcttaatttggtcaaaaatggacaaactaaaagaaagaatatcaatgaatttgactacattaacattaaacatttcacataaaaaaagtgaaaagggccgggcacagtggctcacgcctgtaatcccagcactttgggaggccgagatgggcagataacctgaggacagcagttcgagaccagcctggatgacatggtgaaaccctgcctctactaaaaatacaaaaattagccgggcatggtggcacatgcctgtaatcccacctactcgggaggctgaggcaggagaatcacttgaacctaggaggtggaggttgcagtgagctgagattatgccattgcactccagcctgggcaacagagcaagactctgactcagaaaaaaaaaaagaaagaaagaaagaaaaaaagagtgaaaagatgagctacaaaatgagagaataattgcaacacataaagctaagtaagatttgatatgtagaatatgtaaataatttcttaagtcaataagaagagacaattcagttagcaaaatggacaaaaaaaagcattatttccactcaataaaaagcataaacaatatgtaaacatattttaaaatgttcaggttcattcaaagtcaggaaaatgtgtgttgagaccacagtaaaatccagtttcacaaccgccaaatataaaagttggataataccaaatgttaacgagaatatggcataataggaacttttgtatgtttctaatattggtataaattggaaaattcccataggaaaattgtatggcattaccttaaaaagttgaacatgcatgtaccctacaatctagcaattctactacaaggtatattccctagggaaactcttgcatgtgggcaccaagaaacatgtagaagactgtgtatagtggcattgtccataatggcaaaacaaacaaaaataacaaaagcaactggaaaaaactgaaatgtccaatattatagttttgagatttatctatgttgtcacatgtattctttgatttttactgctctatagttttatagagtatgaattttattgtattctttttaggggaatgcttcaaattatttattatcattaaagtcactaaagccagaccatttgtttttttgtttttttttttgagacggagtctcactctgtcaagaaggctagagtgcaatggcacgatctcggctcactgcaacctccacctcccaggttcaagccattctcctgcctcagcctcccaagtagctgggattacaggtgcccaccatcacgcccggctacttttttgtatttttagtagagatggggtttcactatgttggcccagtgggtcttgaactcctgacctcgtgatccgcccacaagccagaccattttactagtgagcttttactaaactttcaaaggaactgatgattcttgtcttatacatgttgttccaaaggggaaaaaaattttcaactcatttttaagaggttgaaataatattgataacaaaaacatttaagggcaatagaatggacaatcttatttatgacatggatgcaaaaattttaataaaatattaattttaagtccagtattaaatttaaaaataacgcattcacaaagtatagcttattccagaaacgtaaggagttttcaaaattagaaactccatcagtgcttttggcttcccagcctagtctcattacttcatctgaggcaatggcacaggcaacgagaacaatgtaagcaatcagccactacaattactctgatccaagccaaattatacagaggactaggggaatgaacatttgggttcattccagacaataaggctaatgacttcaacacagagataaaacagatgtgtaactgcatgatttatttatttattcattcatttttgagattgagtcctgctctgtcgcccaagctggagtgcagtggcatgatctcagctcactgcaacctccacctctcaggttcaagcaattctcctgcctcagcctcccgagtagctgggattacaggcacacatcaccatgcccagctaatttctttgtacttttagtagagatggggttttgccatgtgggccaggctggtcttgaactcctgacctcaggtgatccgcctgcctcagcctcccaaagtgctgggattgcaggcatgagccaccgagcccagcccaactgacgatttattaacataaactgacttggctaaagttgacaggagaaacaactgtcctatggatctaaaacctagaaactttcttgactgtagaaactcaagataatcttttcatttatgacattatctctttgtcttctgcttgaatctcttgaaaatgcctccccagtcctcctcctaaggtagagctaagttctctaatagcatttgcatgtggtattgccttagaagatcactattttacaatcatgagcgtaataagcagattcaagcaagaatcatcaatggatgctaaaaccagtgggtgaaagattgttgcagaagaggatgttcacacagtttcgaagtatattctataggttatgtgattaattacaaacaggaaaacatgtttgtaatggagatctgatggacactaccttaaccaagtggtcaaacttatcaccaataatgagacaaactgacattaggtgcctcttgatgtgaagtaataggaagtatgcagcatcatgtatgtagtatttttgccaaaatgattaacctgaatctaactatgggagaagagtgagatgaatccagattgtagaacattcaacaaggcaacttctttggacttttcaaaaatattagtgttatgaaaaactatatatatgtgtgtgtgtgtgtgtgttatatgcatacatgcatttgtgtgtatactattctagattaaagattaagattcaagggctaggcatagtggttcatgcggtgtagtggttcatgcctataatcccagtactttgggaggccaaagcaggaggattactggagttcaggagttcgagactaacctaggcaacatggcgagaacttgtctctatttttcaaaaatgtaaaaagaaaaattaaaggatactaaaaatgcctgataaccatatgcaatgtggtatccctaattagaacaaataagaaagaagttagaaaagaaattttggggagaattgatgaaattttaatatgttatataattagatacaattatattaatgttaaatttattggatgtgataatggcattgtggatatataggagaatgttcttgttcttaaacagaggcatgctgaagtgttttgatttaaaatgccatgatgtctgcaactctcaaatggttcaacaaaaaagaaaaaattatatagataagtaaaatgtggcaaaatgttaacaatcagtgaatttaggtgatggagaaactattaattcattatactataatttcaccttttgtggagattttttttgttattattttattttatttgagacagagtcttgctctgttgcctgggctggagtgcgatatcgtgatcttggctcactgcaacctctgcctcccgggttcaagtgattctcctgcctcagcctccctagtagctgggattacaggcacgagccaccatgccaggctaattttttgtatttttaatagagacaagttttgccatgttggccagcctggtctcgaactcctggcttcaagtgatccgtccacctcggcctcccaaagtgctgggattacaggcgtgagccactgcacccggccgatattattttccaaaataaaaagttggggaaaaaaaactgaaaacaaaacaaaacaaaatgcaccctttttctgacaccattcacttgaaaaaaaaattaacaaaatagaatcttattgtaattggaaagaggcaagagcagtaaaagatagaaagaatatatgcagtgcagccatttcggagacgttaatcttacttggttgaccacccactgtgttcttgaaactctcacagtgatggtcacaagaatagaaacattccataacttttgttcgtttctctcctctctcttcataagatctagctgatctgtatagtttctcttgaatttgctgacttaactaattttatttcttttagttaatcttgatgcctttccctctttccctcttcttatatgataaattcaccttcttaatgatgtcttttcttttctgcaaaacccctttaatcagaataaatagagtcccaggcagggcagagttcactgggggtgtccaagtcggattcacccaccctttcggttccagcctaggcacggctacagctttcgagaggagaagcagactcttccttgtcctggtgtcccagcggggtcactgggagggaccagtgtggtctcagggcgctgggcgggcctgcgaggcccattgccggccccctaggcatcccgttcgtctgagcagggcagggggtgccgcagcctcctgggttgtcccaaccctgctcctctcctccctctccttcttcttgtagatggagtgaagcttgttgattaagaagattttgtcttccccctcgttgctgatctgctccttgagcaggcagatgaccttcctctggtccagcaccacctggatgttgaggtagatcacagccagcagcagggccaacaccaggaagacgaagaaggtgttttccaccaggtaccggtgcgcccagggcagccaggagcccctggggcccgctgcctccagttggggcacccacatcctgcgggcctcgtacatggtgtccagggtccggaaggggccgcagatggctgagggtgtagcagaggccagacggcatagcagaggaagaggtggcgcccaggaaagcggggaagcagagcagcgtgaggaagatggtgctcacgtgggaggccagccaaggccggagcagtgcctggcagttggccaaaaggctggtctacttgacgtagaagacgagcagcagcttgatgatctgcaccgcgtggaggagcggcgagaaagagcacccccagccaggtcagagtcggcccgtaaatcagctccagaacattccgggcaatgtcaaactcaggcttccgtctcctcttcagcttcttctcggagataatcctccacatcaattccccgaaaagcgtgtccagcacgtgaggacgagtccatcaccaggaacccatacagcacgggttcctcccagcactggccctgcagggcgcccaccctgcggccctgccagtggtagcacagtgtccccaggatggccagcttgaggatgaagttcctgcagatggccacgtacaactccagcaccggggagtcatgcagctccagggcggtcaggccaaggcacgggtaggggccccccaggttgagggggccgaccaccagaggcaggaccagcagcgcgggctcctggccagcagcctccggattctgcatcatgaactccgagaagatgtggacggccacagcgcagcccagcgcagtccccagacacaggagccacatgagccccagcatggccgcctgccgcagcctcccgcacacgctcctggggctctgccgcagctgctgctcgggccagcagctccttctcccggtgcgaatgttgtctgttgtcttgctgagggcggggggcccgcttctgcctcaccttgcagtcccaggagcagaagatagtgacggcgtggatgccagaggtgctgcccacccggtattagcattagcttagcattactgtagtggctgtaatacatgatgatgtgggtgaagcagcctgtgtctttgaggagctccaggccagagcagatgcgggcagggcccggcggggcgggcgtgaaggcggcctccgggcccacaatgaaggccacgagcagcagcagcaggaaggcgttgaaggccagcagggtcttaaggaagaggaagtaggagagcacgttggagctgaactagcccctgatgcgcttcaggacgtagcgccacggcttcagggcctgcaggcccaagagcagcgccagccccaggctgtgcaaggccagcacacagacatatctgagccaaccacagcaggagcagactctgccatggccccgcaggctcctccacttcccgctctgggttcggctcttctctcgcaggccgcgtttctcagccaggcttaggggaatccctcgaagcacgtggtcccgctgcgccacagccaggccctggagctccttcaccaggaggctccgcttctcctcctcttcctcccaggacgtggggtccagcttcaggtcgtacagacgcaggctgtgccgggaggagcgcaccaagtctgcgagcaggggccggccaatggtgaggctgggaatgctggccaggacgcagagtgtggccgtgctgtgggtgccctcgggccccaagagtgtctgctggccactcgctgtggccaccacccctctccctctgctacagctccagcccctcctgggcctcccagcggctctgctcttggatgagcaagtggaaggagtagtgcatttcagtctcatcgtaggggctgggctcctggctgggaggcgccaaggtggagggaatgatatcttttcaacaagtggaattcacgttaataaatcaaaggaggaaaactgtatgatcatctctcttaatgacagaaaagcaagcaataaaattcagttcccctttaaaaataagaagagaacctccttaatatgaaagagggtatctatagcaaaacctctatcaaacctcatactttaatgtgcgaggaatgcttctaaactttggaagcattttatttaacagtagtaactaaacgagccaataaaatgggggtacttctgtcaccatcaatgctcaccatgatattagaggtcccgatcaatacaataagatcggaaaaagaaagagggagtataaggattggagaggaagagatttattttcagattacacgataattcacatagaaaatgatgataagaatagctaaattttttttttttttgagacagggtcttgttctgttgcccaggctggagtgcagtggcacaatctcagctcactgcaacctctgcccactcggcgggctcaagcgatcctcccacctcatcttcctgagtagctgggatcacaggcatgcgccaccacccccagctaattgttttgtattttttatagagacggggttttgccatgttgcccaggttggtctggaactcccggactcaagtaatccactggccttggcctctcaaagtgctgggactacaggcctgagccattggcacccagccaagaatagctaaaatttattgagcacctaatatgtgcaaatgctgtgcagtaagcattacatgtataatgcctttaatgtataattaatgccatttaaccctacttaaaaaaaaaaaaaaccctagaagataggaacaattattcctcacatcttacagatagtgactattatttgaattgttttatttgggaaaagtgcttcttacaaaaggacagctgcaaaatacagagacctctgcaacaattatttgtattttcataaagtgaaagaatgggtgggatccaaggaatcaaagcagtaaatggacaaaccaggagcatccccgagttactttcaggaaacaaagcgacaaaacacaaaggtaaaatttccaatcaaggaattcttcaaataacttaattttagctagtcttagggattcccaagccctccccttcagtggaaaagtatgacttattactgcaaacccattagtccactacaatagacaccttagaacagagttttgtatcacatctgtctatgtgaaaactcaggggtggaatgaggcaaatacccacaaaaaaaaacacaaaaactcgacaacaaaatgccccaaatgaagacaaaggtttttcagaaagtgcctgtactggaaaagctagatcataaaacattaaatacacagtgtatccaagacccagtttgtgttaacatatgggataaccaggtagttttaacctctatggctaaccccatttctctgtttatatagacagagctagcactgctatattgacaactaccaatatagtgctttgccctttaagatctatcctgctgtacaaggcttaaaccactaaaccacttttttctgctaaggctaagaatactgcatctatgcagggatgagaagcttttcacacacccacactcatacacattatgtcagcccttgggagtcaacttccaactctgcattgatgttatgcctctgtatcttttatatgtattctttctcaattttcctaacatgcaaaacagtagaaatctcaacacatttgcacctggttctggttacccagtagtatcacttatgtacaattaaacaagagaccaaaaaccacagaacaagtgcacgtggtagggattacaggatagggaacagatataaaaacacagatgtgcagatttcaccagaaacctcaaggatccacgtcccatgtctggagcagaaggctattggccagcttaggtcccttcacccatcactcctattcttggaccccaaagcaggaccactgcttttacttttgaacctggggtcctcaaaatgagtgtgtgaaaagtccataaacacaatctggttgaaaacagatggcgcaacacacctacactaactgacggttaaattcatgttacaaaaaactaactttaagatttatttttgtaagttttttcaacagggaaaacacactcctcgcggaaagggtaggggttgagaagacaggccctgggtaaaaattcttaccgcagcacttggagttgataggcctgcctaggagagaacacaggcactgccacaccaccacaggggacagctgctgtctggggtcagcagaccagttcacacgccatgcaaggttgttatagatccaagtcataaaaatcttccagcttatcatgaaacaagtcccactcatcttcagagtctgtcagtctatcgtccctacctgcagcccaaagcataagcaacatcttgcccagctcagaggtgacaacctcttcttcatcgttgtcagaggggttgctgttctctctttcctcaatgagttcccagaagtggttcctttgttgggcccagtatcggcttgatgttcccactttctgtctctgtggctcctttctatggccatcagggtacacatgcttgtaaaaacagttccctccaaaagggcagctcccatgctctttatcaaaatacctgcacgccttgttcctcatcgcctccttgtatttctgaatgagtttctgcttctcttctttctcctcctcccagtactcacttggaatgacaaagttagatgtgatatggcattctgggcaggactttatgatcttgctctcaaattgcttagcacttctccacttgcaaatgcacttgagagagtaggtgtggttgccgttggagaggatcctgaagtggcacttgctggggttggctttctcatagactgcctacctccatgcagatcccacacaccaagtccttgctgtgctgcacagccaatgagagctccatgtccttcttgtgagcctcaatgcacgattttacatgctgtgatctctaggcagcaaccatcggatgcagtacctgcaccccacacatgtcacatgaatctccgtggagataacacagagttctccccatattggcactctcccactgcagcataggggcacagctgcttctttgtttccatagcagtttgctctttctctgattcttctgagccctgcaggggagcttcagtgcaggaaggcacagtacagccacagtagggttgcccaggaacaaactcaatagtattcacccagtcctctgaacctgctcatatagttgcaaagtttgaatttcttgactcagctttgcctgtatttattttgacaagtggtccaactatcgatgagagacttgaggaagcagcaagggacaacattttagttagctctgtagcagttgcttcttcctgtttcagtggcttgctatgttcatatctgcagcggtctccataaatgcagtacccttgctgaaaataattgcacactacaccatacagactgtcagagaggtcatatgagtagtgacagttatctccttcttacaaaccccatgcataaaatacctgcaggtgacatgccatcactgccgctcctgctcctgatattgtggctgtagttctgggagctgcagcatccaccattattgtttatgatagcacaattattattcccattttacaattagtgacgctaaggcacagagaaggtaagaaattcactcaagatcaaacctaaacagtttgtttctagggcctgaagtttcaaccactatcccatattataacttactgtcatcaacacaatttcgtggcagacaaagaggtatgaaaagtattcaagctctggtggaataaaattaatatgtctttacagctgaaggagaaggcatatcagtgattctcaaccttggctgtatattagagccaccagaggagatttgaaaaatcctgatgcctaggctttagccagaccaattacagcagaattttgggagatgggtggaaaggtcacgcatgtagttgttaaaaaacaagtacattaaaatatcataagatggccaggcacagtgactcatgcctgtaatgctagccctgtggaaggccgaggtgggcggatcacctgaggtcaggagatagagaccagcctggccaacatggtgagaccccatctctactaaaaatacaaaaattaactgagttgggtggcatgcacctgtaatcccaactactcgggaggctgaggcagaagaatcacttgaacccaggaggtggaggttgcactgagctgaaagcattccagcctgggcgacagagtgagactttgtctcaaaaaacaaaaaaaaaattcttaagaggctcacgtatctactcaaattgtggtagaagtttctattcttgcaacctgagtgaggttgcaaactttgaccagatgaattacagaagggtgtaatttgaatccagtagaaggatatggactagaagtcccctgttgtcatggtgactacaaaaaggactcactgtatccacatgtagctcaggtagaatcattctggaagcctgcaaagttcagatcctgttccccaatgtcaaatctctaaccgataatgaccttattgtgttaataaattttcaactctatagcttcaacttgtttaagatgtcaaccccagttttcctgacaaggtaactatctcacagccgtgaactgttgagccagtcacctcaacttggccccctgagatggtaactctatcatggttgtcaattcttgacctagtaatccgaactccctggagatgctagaactcagtgagtaagtggcttttcaaacctgaaaaggctagaattaaaaatagagatgataaataaatcaaacctattatgttaataattttatgtttataataagttcatgtgtggaggagtatggtacttaaagtgcaattttaatataatatggcatattgaagaatccaatagattagcttaatttgatcaattagacctgtgaggtgtatgaaaatttaattagggttataaacagtattgaaatatttgacaattagacctaatagatttacatgtttaatatacataataatttttagttgagtacttgggaaggatttgcttatcagggatggaaaatttttgttttttttttaaatttatatttattttaaaaaatttcccacaggttattggggtacaggtggtgtttggttacatgagtaagttctttaatggtgatttgtgagattttggtgcacccatcacccgagcagtctacacttcaccctatttgtagtcttttatccctcgccccctcccacccttctccccaagtccccaaagtccattgtatcattcttttttttttttttttttttgagatggagtcttgctctgttacccaggctggagtgcagtggcgcaatatccgctcacggcaagctccgcctcctgggttcacaccattctcctgcctcagcctcctgagtagctgggactacaggcgcccgccaccacacctggctaattttttgtatttttagtagagttgcggttttaccgtgttagccaggatggtctcgatctcctgacctcatgatccacctgccacgacctcccaaagtgctgggattacaggcgtgagccaccgcacctggcccattgtgtcattcttatgcctttgcattctcacagcttagttcccacatatcagtgagaacacacagtgtttggttctccattcctaagttacttcacttagaagaacagactccaatctcatccacgtcactgcaaatgctgttaattcattcctttttatgggtgagtagtattccattgcatacatatgccacagtttctttattcactcatcaattgatgggcatttgggtttgttccacgactttgcaattgcgaattgtgctgctataaacatgtgtgtgcaagtatctttttcatataatgacttcttatattgacttacccagtagtgggattgctgaatcaaatggtagttctacttttaattccttaagaagccttcgtactgttttccatagtggttgtactagtttacattcccactagcagtgtagaaatgctccctgatcatctcatccatgccaacatctactgttttttattttttgattgtggccattcttgcaggagtagggtgatatcaccttgtggttttgatttgcattaccctgatcattagtgatgtcaagcattttttcatatgtttgttgggtatttgtatatcttcttttgagaattatctattcatgtccttagcccactttttgatgggattgtttgttttatttcttgctgatttgtttgagttcattgtagattctggatattagtcctttgtcaaatgcataaattgtgaagattttttcccactctgtgggttgtctgtttattctactgaccattccttttgccatgcaaaagctccttagtttaattaagttccagctatttatctttgtttttattgcatttgcttttgggttcttggtcatgaaatccttaagccaatgtctagaagggtttttccagtgttatcttctagtatttttctagtgtcaggtcttagatttaagtccttaatccttcgtgggttgattttggtttaaggtgagagatgaggatccagtttcattctcctacttgtggctagccaattatcctggtgccatgtgttgaaaagggtgtcccttccccactttatgtttttgtttgctttgttgaagatcagttggctgtaagtatttggtttatttttgggttctctattctgttccattggtctatgtgcctatttttatactagtactatgctgttttggtgactatggccttatagtatagtctgaaatcaggtagtgtgatgcctccagatttgttctttttgcttagtcttgctttggctatgtgggctctttattggttccatatgaattttagaatttttttataattctgtgaagaatgatggtggtattttgaaggcaattgcattgaatttgtagattgcttttggcagtatggtcattttcacaatatttattctacccatccatgagcatgggatatgtttccatttgtttgtgttatctatgatttctttcagcagtgtttgtattttccttgtagaggtcttttgcttcattggttagatatattcctaagtattttatttatttatttatttttgtagctattgtaaaaggggttgaggtcttgatttggttctctgcttggttgctgttggtgtatagaagagctactgatttgtgtatattaatcttgtaaccagaaactttgctgaattctttgatcagttcgaggagctttctggaggggtctttagggttttcaaggtaaacaatcatattgtcagcaaacggtgacagtttgacttcctctttaccgatttggatgccctttatttctttctcttgtctggttgttctggctaggacttccggtactatgttgaagagaaatagtgagagtgggcatccttgtcttgttccagttctcagagggaatgctttcaacttttccccatttggtcttatgttggctgtgggtttgccatagatggtttttattacattgaggtatgtcccttgtatgctgattttgctgagagttttaatcacaaatggatgatggattttgtcgaatgctttttctgtctctattgagatgatcatgtgatttttgtttttaattctgtttatgtgatgtatcacatttattggcttgcccatgttaagccatccttgcatccctggtatgaaacacacttgatcatggtggattatctttttgatatgttgttggatttggttagctagtattttgttaaggattttagcatctaagttaagcagggatatcagcctgctgttttcttttttggttatgtccttccctggttttggtattagggtgacactggcttcatagaatgaattagggagggttccctctttctctatcttgtggaatagtgtcaaaaggattggtaccaattcttctttgaatgtgtggtagaattctgctgtgaatttgtctggtcctgtactttttatttgttggtaactttctaattaccactttaatctcgctgcttgttattggtctgttcagggtatctaattcttcctgatttaagctaggcgggttgtatttttccaggaatttacccatctcttctagattttctagtttatgtgcacaaaggtgatcatagtagccttgaatgatcttttgtatttctgtggtgtcagttggaatatc

SEQ ID NO: 396 - DNA, 67901 bp, Homo sapiens
tggggagagtgacttcccagggtatccatgttggaatctctcatttgattcttattcaaatgtaagtcattctccgaggcccatataaagtcaacctcatccttgaagctttgggttttatttctttaatgtgctttgtgtatacattaatacttaaaattgaaatctggacaaaagaaactgtgtctctcgtaatgtagtgattcacatataataggttcttggtacttactgaatgacgaatgattgaatcaattagcagatggatggatggatggacggatggatagatatgttgtcatcattctgttcatccagctgtctcagcatggctaaaatttacctgcatgtcaggagcctgatatttcccttttcttcactatccaaatgaaatggctcaagcctctacccatgtcctccacactcttcctgaaacctttgagcattcccaagggaaggctgttgttctccagggtcagtcattgggcagcctgccctaaattatctatctcagctcccataaccaacatcctctttctacactactttgacccagacttaagcactgctctactctctcccaacactcaacacatctctgggcagatcttaactaaagctttaaagatagaagtgaatggtttcagcacagctcagaataggaaacattgacaactgaatattaatcaccactactcttaaaagcccctcagttatccactccacctggatgtctgcatggctgtcttttctttctaggcttcttgccagcctcttgccaagttgctcagccctctccaaccaccagtgaggcatcagtgaccagttcccaaagtccagttaactttttatgtagtgcagcttagctctctctctctctcttttttcatcctatcttttaagatagcaggggcatcgtttacaaaaaaaaaaaaaaaaaaaaaaaaaaaagcatatcagaatattttcctaaacaaaaagctatctcctctgagatcaatattttcacttctctgccaggcaaaagtaatggaaagtcagtgttttgtttgaaatagtaaatatttcctgaatttgtcatttttaaagtttttttcacttgagatttccagaatcatggaagttaaacttatctcctcagtagccttctctctggtaatagaataccctcaggactattcattccatctacttccagaagccatcaccaaaaattaacttctcaccttctcggaatgccacattttaatgaacattaacaatggcataacgtttgttccgtcttaaacatattcagtaacttattaatgcataccggacacttgagtgcagactttttttcacatcataaacattgattataagaaaagcttgaattatcaccaaactttgagcttaccagttagtctccatctgttattgttatttaggctttaggacaagaagttcagcaatgtatatgttgggtctaccaagtcttcaatcttaaactgcttattttttcctcattttctgctttctagatgatccagctcctccattgtctttcatgtgaagttttgtcttgtaactaatcccacagccctttttccttgaaattgaatgccctatctgcctatatgcagttactaccattctactccagattttacaatgcctctgctatgtgatatcctggctccacaaacaaattatacaatttttattggtgggaggcaagtctcacatttatttatgaatccatcctggtgcctacccctgtgctaagcaccatagaaaatactcagcaaacactgttgaacatttaaataaaataaagaattgctaaaagtctttttaccatgtaagagttcaatatagaagcttaaagcaggaagaaacttagacctccctcttatgccaagtagagaatttgattaacttggtcattagtcaatgaatattgagctctattggcaaacagctgtctgttaagcactatgggagacacatatggtagataaagcaagttcttgctctcatgaaagttaagatttctattaaacattttccttttgcttcattgaaaagacatttaatttgtcatacatttataagatatgggtcaggaaacaccaacacatttaaactcaggtaactatatggtaaacaaaggtggaaaaaagaggtagcttccattgaaacatctaataattactagctctttcaaggctaaaaacagtttgtctccatgaagtcactttaatctagtccaattgttagacaaaaacattttacaatgcagacatttttggaaggcaattgaccatgtataaaaaacatctgtatttttcaagcaagatagtggagtgttaaattttctgttgaggtcagctctccagcagtgtatttgatgatttcattgacatcctgctgcagtttcttttaaggactggtaatttgaagtttttggtttctctttttaaattttcatcacttctgttagagacaaaaatatgggttccccttacaagtgattgtttaaaaatgtgaaagtcaaacaaacaattagtgtcctaccagattgtcaatactaatggttatgagaattggaatggtgaccccaggacaagcagtctttttggaaacatttgcagtgatggcctggaaaatgtgaggttaagagaatatgagaggtaatcttctatggcaggagagcctgcttggaatcttcctaaaaaaataagcaaaatcaaaggccaatcctgtaaaatttccaaaacccttcactggagtggaatattgcaatcatgaagaaagtcgcagtagagaaaaaaaacaaacaaacataaagcatcaaatcttatccaactttttgacagctaatcacagccatgttaaatgttactgggactaagagcttgaatggtgtcattaatgttttggcctatgaaatgttggcagataatttatgtatttcatgtgtaatgaagcaaaccatcataccaccctacctaaggacgttcttctatgaaatcacctaagaattagatgcagacgacgccaaggctttctggatactggcagaatcaagtttttttctatgcaatgtctgtcctcccagtcttgccccacagtaaacacttcagcctcacttaggtataagccagtcagggttaatccaactatcccaaggagggcacagtaaaaaaatgcctcatttgccaacttctgccctcatttggtttattttgagcacttcattaaaaataaaatgtattatcacctcttcatttatcttccctatccagaaggtttggctgaaagattgatctgattccagatactaaggaagtatcactttgcagccaatcactctgggttttctggtatcctaacccaatgcttttaatagagatgtgttttccaatgcagactctccaaatgctatttcctaccagtgtgcagagagaggcaatgctgacaatatttctactcatcttttaagttactggaaggtgattctatagcatatggctgttaagtttaacaaaagtagggggaggaggagaaaggcctggccatgaacattcaggaagctggaccagcgccacctgaaggagccaggaggccaggaggccggatgtgcacagatccctgggaggaaaaagaagccagaacagcttaaatggtcaaagaatcaaatgtaaagtgagctgcaagggtcagatctggatggaagcccaaattctgagtctccgcatccgtccggggataaacttggctcccaatcagggctgacaattaggccgtacagttaatatttttacagctgttttattaataacacatacagtgcatccagccaggatttgttggagacacctcaggaaaacgaatgatgtaaataacagatggatgtagaatatccctacaaacaggcataaagatattcccttcttgtttaaaaagaatttaaatagacagattgtagataaacaggcagacagaaagggggagagagaggatttatgatatttgaggtggtggttgcatgcgttcacatggcgaaagacatggacgtaaacatatacactctctacatgggaggagatgctcaaagctttggcttctggaaaaaaaaaatgtttcatagtgcaagggctgagcaccacagcctgggggcccacagaagcaggtatgctgatgtggctcctcaaatagctcctctgatacgtggttcaagtccggagacaacttgcatggcttgtccaggcatgcctgagcccagccttgacccccaggctgtcctggggcatcctttcctctttctccttgtcaatatgccatttgaagacccagtgcactcttttcaattttgcatcagaactaggagcagtggtatttcaatctgaaaagagaaattaaaaattcaggatcttcatgtcttttgttttcactcctactattttttttttttgtactgctttttcatgtgcctgctgcactgtgctcctaccatactttgcaaccagatggctcaggaacgaagaacaaaggccactaaaaagtgggcggggagaaaaggagaaagaagcagaggactgaaagtcaaggcgaaatcagagatgggagcaaagctcaattgctttaatcactgatacattttggttgaattatgaacctagaacagacactcttcccagtgatcctgtatgtgtgctgtgtgtgcattgtggtgtgtgtgcctgtaccacacgcagccacatctccagtcttttatttcactggtaggcattaaagccagaatgtattctttgatgtatctctgtgttccctgacatgtgtcaaaagtggcatgagatgtctttttccagagagagaatggttgagctcagatctgggcactgagaatgagcccatctgcctgggaagaaagtgtggttgattcagaagggctcaggagttgtatgacctgccatttcacagtgggtgacctcggtcgagtcacatcccttctctccttagtttcctcctccagaaatatctaccccaagggatgctgggagtgttaaatagaataacatgttataaactgggaagcactgtatgaaaagattgtgattattctggagtattgcaacttcttgcaaaattttacaagtggctaagagttgtcttcgatgcttttctgtgaccctcccgactgtatttcatgctttacttagacccccaaccaagcttgtctctccagatcatgctgtacactgtgaatcttacccatggttcccaattgaacttactgtttgtgtatcattggaattttattcaattatagaatgacctaattgtcatttaggcgattaattattttgctcgtgaaccatagaaaggtttaatttttaatcaggaatttctgcagtcccaaagccttcaagcaaaaggaatgactatctaatggtgaaatttcacatagatcaatgggactcaataactttagaaagaaaatatttgttttacttctagtcaagaatacacacagaagcctattctgactcctgataaagttaagccagcatccatgcattaaagggggtatgagctaagaaagaagaaagacttcatgtggggttcatgagcgcttctgctgaaaccttacttgtacctttacatcctccaattgagctgaaattttcttctcactgcagtgtgcatagctacactcttcttttcagcctcagacagtgtggggatacttgtgaaaatgacactgcttgatattttcattttaaatgaagccacgtgtacagattatgccttctctgatactcgtgaggactctggaagacactgagggaaatttgatttacagatgagtaaaatgaaatgcaaagagataaaacgacccccttatctccccgggctaggcaggcttttgaaatgcacaatgcaccttcccctagtcaagaggaagagaaatgattggtcatcctccttcacatggaaattcaggcaaaagacctgcgcccatctgtaccagaggcccagttactaactgatgctcacaatctcacgtgtttggcagcaaatcataagaaaaattaaagacttgggagtcagcctgtaagtttcaaatcttggctctcctgctaactctatgttctgaacctctccaagattgcttaatttcctcagtctttgtaaaacagcatcatgattacctaacacatagggttgttgggagtgttcaatgagatgatgcatggaaagcaattgacacggtgcctggaaacgtagtaagtgctaaaaaatgttacatgagagtattatcattacggctcagtgagcaggtcccttctatctttgggaatcatagaatattagagctggacagaaacttaagaggggtgttttttaagcctcttgaccaaaatctttattaagaaaaacactttattgtataacctagtacagaaaaatatattacttgccagcaaaatggaaagttaatgtttttcagaaattgttaaaaactggggcttgtttgtgattgcttccggcatttacctctttatatttttttcatttttaaaagttaataagcatgttatagaggaacaaaacaatttcaatacacacacgtattgaaacagaaatttcctaaaacaaggcctattttcgctacttgtaatacactctgatattttctctttggttggattctgttttgttttcttctaaaatattggtatgacccactaaattgtctttaaaacctcttaatgagtcactgctaatggtttgacaaagcatttcttttcatagataaaaggctaaggctcaatgtggtttgtccaatatctcttatatgactaggcgcagaagttggtcttggaccaaggtctctgggcttccaatcttgagagacctagagtcactaaagggcaccaagatgcaaggacttgcttttgatgcttttgtatcctgaaagtctggagcaagagcttctccgtgaattcactgccactcagaacatcccaacagatgtgtgtgggtcactctgacacacttgaaaatttcccgaaccttaagaaagatctgttttcctcactgcattggcaacacagttggaaagttacttgaatgtttttcaaaaattgtttatagatttgaaaactgttttggatttgtgattgcttctgttgtttgcctctttgtatcatctcgtttttgaaaatttaataaacactttgcagaggagcaaaataattggtcacacacttgtgggttcccagatttgttttacatgtgtatgcaatacagagtaactcaaaacatgttcaaacccaatgcatcaaatcatttctgatgctgtggtcaagaccaaagcagaatgtgagtgagcatccacggccctagaccacatcactcactgggcctctgaccgcagtgcttaggggacagatcctagccccattgacgcatgtggcaccattacagcccacggctgaaagctggcgtgaaaggctccctctgaaagctggagcacagtctggggtgccttattgttggaggatttgcccaatttgtgacatcgaaggaagcagcagccactctaggaagctccgcaaggtgggaacatctccactcgactccattcactcagcttagcctcatccacaaggggctgctaagcaggggctgtctgtttgtaaagcaggtggaggttgatggatcacctttccttctttgtctggcatctccaggagcttcttcctgtatcttgcaaaccctatgagccccattgttcataggaagagggttgaaagccctgtgggtttaccgttccttccaagtcctttgtagagcattctgtatagagatcattgatctgctcttgctatcttggattactcaggtcttgaatgctgacatttgtaagatgatttcagaacaaccttctacttccatcccacctcactttccttgcaacaatttgtacctaataagacctagttaacttgaaggcattttcattgcttttactttcccatgaagaagaaatcagttgagaaggttttgtgaaaattctaacagacctttaagtggtgacaatctggttctcagagaagccaagagatatgtaagcagcctgaatgtaggatcaatgtaggcaaagcatttgagtcatttaagctccaaatctggatttacctgaaatctgtaacaaaaatggatcagatattcattttctaaatcattcatctatacatttatgtcagatattttacttaacaacacagtttaagttttcactgtacttcacactagactcagattcaggtttacactgataaagtggattagcctgagatatttccagttcacatggggatatctgtatggctttgccacagagcaaatgttcagaaatccaagtcctgttgctcacggtgtctatcagttgtccatggggaatcatggcagcagatattttcttcatcttatactaggctggaagattttgtacacacggctagctaaaagcttgatgtgcaacatctccgaaacagtgtcaaatgaagaaaaaaagtttatcagtttggtacaaataaacttttaaaccaatttggctacattggtttggttaatggtttgattatcttagtccatggctatagttatgtacatataggcactgtgtgaatggtttggccacacatgctccttacatgtaactgccaactccttcatccctcactcgttgtgcagtgatttagttactgtctctcattccaaacctggccttctatgatctgttctgtgatactgcaaccaggactctgaaaactagttttcctttatttccagttaggttctgtcaatagaagatactaaagaaagaaagccaggagaagaaaagggacttctttcttcaaggtctaagctgttctaatagcattattctgggaatggcatcttccactcctcctagtacaaagaacctgcttcctcataccccgtcaaggaactgcagcatccaggtactttctctgcctcaaaggtctgcatcccattctccatttggcccctcctttgaactaccagatctccggctggattgcctttttgttctggaattttctaaatttctttattaaatttcccagttgaaattcccaatgtggtttttatttctctcatggaccctgaatgtacagtacttatatcaggagtagtcccagaagagaggtcctccaaatggagttatgggattggtttaaatccctgggcttgagtgcaatgctgcaccctgctaatggaaatgaaatagtagtattttatggcatgcagtggcatcttgactaattgtgactaattgtgataaagtgccaattgaaccagtgtcttaggggaccaaatagctgctgaacttggccttcaaggaagtagtaaaggcagtgatgatgatttcaagaactatgaggtatgagggctgctttgaatgaactgggggacttattggaggacaatgacaagttcaaggctttaaactctctgctcaaattatagtaagagaactagaaagcttttgctctggcgattcctaaagattctcttcctataaccatagagctgacctaattgagaatcaaactcagattcttatgtggattgcaaagtcgcacagactcaccaaccttcttatgtgaaatttagggtattgactggggagaagtgggaccttgactctttggatgtggcatctggatcaattgagtcaaagctgagaatcttgaatccccaaatggctatgagcctcccttcccagtagaagcagctcattcccctctgttcgagaagactagtttccctttgcttgaagaccctgtaataacctcacttggggcagctgccttgcaagagaatgcctattctccttaaaacttaccccaactaccacttactatctctacacctataaccaggatcatttcttagcaagtgccgggggtacaaaatctgatctgggaagagctagcttccacaaaacaaaaacaagtaaaattttgttaatttataatgatagaagcctagcatgtgtgtgggaatgacttctaagggttagatgatggaatgtaacgttggattgaattgaatttcttgatatgaatgcacttaacagagagtctggatttgcaaatgttcagtcgtctttcggtgccgtttatactgtcttacttcacttccctcttactctcacttccctcttacttgatatagattcaccaccagcactactctatttttcttcttgagaaagagaaagagaggtctctttaagtcagctctatggttataggaagagaatctttaggagccaccttagcaaaagctttctagttctcttactataatttgagcagagagtttaaagccctgaacttgtcattgtcttccaataaatcccccagttcattcaaagcagccctcatacctcatagttcttgaaatcatcatcactgccatcactactaccatgaaggccaagttcagcagctatttggtcccctaaggcactggttcatgtgcatcctcaatttctccaactaccacctccatcttgtcttgttcctcaactcaccacagactcttctacttgaccatgtttttatccatttctctttctcttcctcttccttgctttccctctccttctctttctcaagaagaaaaatacttagagtagtgatggtggtgaatctatatcaagagaaaggggatttatatactttaaagggaaattaaacaaaataaaagcccacatcatcaaattccaagtgcattcatgcaccctaaactcccccttcagatttcccaccacaatttccatttacttccttattctcatcttatttggatcttagggacagctaggatctttcacaaataagataactgagggctagaaatgttcaatcgtcttcgtggtgtcatttatactatcttctatggtacttttcttctttagcattacaaatatataatattttatttccatgaaaggtttgatttttatttatatgtttgttttttgttaataacctggaatagatgcattgttttggtagcacaattttgggataaaataaattcaaagtggcaaattaacaatttcaaagggaattttcaaatggaacctatttttaagctgaatattgcctgtataatccttcagataagaaatgaggaaggaaaccagtaattagactaaatagttaagatcatagactttggggtccgactgcctgggttcagatctcagctctgccacttactagctgtgagactttaagcaaattataagaaacctctctaagtctgggtttcttcatttgtaaaataggatcaagcacatagtgttgttgcgagaattaaatgagctaataggtgtaaaaagtagaacagtacttggcacatagtaagctatatatgtgtgagctttgttcttaatagcctgctgaggccttttttaatcctgattttatagataggacacttaaaggtatcaactaacatgctccaacagcatggctggtaaatgaaagagctgaggtttgaaacccctccattggattctaaagcccatgccctatctcttacaccacgtggctttgcttttaatagtcaaacatacaggaatgcatgcaccacatcatagaacccacagactaaataacttccaatgtatgagagtttcattcacaaaagtagcttttttttttttttttttaatttggaaggcatttttctaatcactaaaggtgtaaataagattaaatagttttggacaaaaaaagattgagctattgactgtatataagaaaagaagaagaaaagtgacaaagtcggcctttcttctaggatgatcctcccaaataagccacaaaacttcctgatgtaatctcatcctttttcacttttagtctcagaagtggtcccttgctgatgttctaatctctgccatttcatctcatgttttggggaaagaggaaaaaactccattcttccatctaatttataacttatacaaaaaagaaagctttaaatgttatgaatttttaatttttgtttcatttagttcattctcttgctgagaaaagtgactgccaaagaactgtgcctagtatgagcaataaacatcaacactatctgctgcattaataatttaagcataaataatcaaacaaaataatctggcaggtcccacaggtgaatcatacagagtttaaaaaatgttggtatgtttaaaccaggcaacttttaaatgaaaatttactccagtgtggacagaggtgtgttagaggggccactgataacatccattgatcttatgttttttaccagaatacattcatacctaacacctcaatagatgacatgttatccatggaatcgagttcaaagccctctgtaacgtggctatatcccatctactctgagctgatgttcagcaggtacttttgattggttgggcattcattctgactggtcagtagccataccttatttttttattaattgttttaaataccattatacttgtttcctgttgctgcagtaagacattgtcaaaagcttagtggctccaagcaacacacagtgagtatcttacagttctataggtatgaagtcgaacacagatctccttgggctaaaatcatggtttgggcagagaggtgttccctacggaggctacagggaagtaagaatccatttcctgccctgtttctattttagaagctgctcacatttctcattttgtggtgccattcctccatcctcaaagccagagctgcaaagcaaagcttcaaagcatgtcgctgcaagcttctcttttgcctcctcttctacttatagaacccttgtgacacattgggcccaacagcataaactaggataatccctctattttaaggtcatttggttagcaatcttaattcctctttgtcttgtattctaacatattcatagatcctggagattaggacacacactcctttacgggccattattctgcctactacagctattcatgcaattctccctgcatgctttctaccgatctcccaaacatgtccttttctgacatcaagctgagctcctttttgatcctcaaggtgaatgtttttttccatctctatgccttacctaattcacttcttctttccaagtccttttccttttcttcaaagcctgtccacacgtttaggtccagctcaagtttcacctcctacgtggagcttttcccattgcagagtgctcatcttgtttttgtttctgtttttcccttcttttcttatgttccattagaattccattacactaacccacatgaaattgccaatagtttttttaacttatgaaaagagaaattgcatatgatttaacctaatacttaattgtccactacttatcacttagttgttcctgaattaatttctatccatatttgttttttctttctatttgaattgcaatctcttttaaaccagaactatgtctcatgcttttttgaattaccttctaccttccaattctcacttgctcagaagatagttagttgttcattcagtgttgatgtagctgagcaatgttttacctgctatggttactttgttgaaagccacagaataacaatctggccgaatttaagggaaaggattaacttgttagaaagatagtgaacttaaaacttccacaattaaagtaatagtcaagcaacagaacatagagagctaaaatcgcttctgagatacgtataatattgactatgagtgagttagtatcagtagatctggtcctgtgacaaaattctagaatagagattatcctggcttagggcatgtcatgtccctactttgtgaatggaagacgtagctagcaggacactgtgattgacaagtccattaggaggaccgcataaaacgtagggatagtaatttctcaaaagacagctagaatgctcataccaaagaaaagatgtagaaatactgggtagacaaaatgaccaatgcacatgaatgaaatctaaaatgaaatttctatgctaagtggtattgtcaatacaaatccaataaaggcaatagtaaaaagggtaaaacaaaacatgagtaaggatagcttttaatttgctataggctacatcaaaacactgaactgttaaaaaatcgtccttatgtagtagcaacaccaacagccaataattatggagcatatattataactcaggcactgtgctaaaatggtgcatgcattttctcattgaatccttgttgtaacaagtccctgggttgagttctgttctgttactcttcttatttaatgataaaggaagtgaagcatagagaaattatgcaagttacccaccttttatatctactaactgcaaaggagaagcagtaatgaggtgaggcagaagaggtacaaagggagagatacacctatattatttggacatcagtgacacttgagacaaccagggttaagggagaggtttcaattgatgatgcatgtaactaggcactgtgtcagcctgtgctggaggccagaaaggagcagaggaaagaatgtctactgtctggttgagaaggctgacacttggacaaataattccaattcaatgtaagaagccctacactagaattccctataatggttcagaaagaactcagagcgacccatgactcaggggacaatagaaaggagaagacggggagagtttctccgagaggaggtagatcttgaagaatacacgtaaaaaggtcaagttcaagaaagcaatcctcaggaaatgcatcgagatgaatgaaaatccagaatatttagggagctaccagcagtgaaggatgatttaagttatgcaagtcatgatgagaatttgggaatgagagtgatgggagacgagactgaaaacataggttagagccagtttttaaagagctttgagtgccatacaagacatctgctttttaaaccgcaagcaacggagaagccctggacgtgtttaaagcctctgtgttaatgataagatcagatttgcttgggagaggagaggcagttgaaagctgaattggagttggggaggacttgtgggtttctgatttaggtaactgggcaaataaagtgccattgaattcaggacaggattcttgaaggaggaaaaaatttgaggggaaataaaatgggtttgctttgggaacttcctcatggcagtgtccagcaaacatgtgaaaatgtaagacagaacccaggaggcatcaacatttgtagaacaggaactcataataattagaagattagagagagaatagtggatgagataagccaaagagagtatgtaaaataagaagagggataagaacaggaattctggaggcaccaacatttaaagggaggaggaggaggaagataaaccaggcaagaagactcagaaagaatcaaagggttaagagaaatacaaaggaacagttgtaataaatcaggagagaagaaagtatcaagaatgcaagttgtgacacagccttcatgtaagaggagaactcaatatttcccttaggatttggctattgaaaggttattcatgatcccactggttaaactgggtatggcatggtgcagccaaagtcagattgcagagagttgagtgtaaaaggcagtggaaacctaggggcatgagggtgttttaatgtgaataaagaagagacataggtggtattgggttgatgaggagtcagatttttagtgtgcaagagggaaagaaagaagtggagaaaagaggttggaatgtgaatgaagggagaagttgctgtcccagtgggaagggacagataaaggcccaggtggaattctgtaagaggtgtcatagctctttccttgagtcagaaatattcatttagcttccccatcatcctttcttcttctctctttttcttaacttctgtagccttttaaaattcaatcctaatatggggattggaactgaaattggtatacaaagcacctggcactgtactggttacataatagaagcttaaaaaatgttatatccctctctcctttattttcccctctttgggttggacagttcccctttccattctccctttgctcatgaagaggatgaatcttcccagaactcagctgctgagactgacatatcaaatagctgtggcacactgattgaaagaaaggcttaagaaatctttggctacagctcctaaatttcacctgtgacaatgaactcctatggaaaacatcttcatcatggggtacacagagttagcctgaccaccagatattttccttctctcttctgcagtcccattgtttcaggtcagaagtgaacagacagtgggtgagacatgaagctctagccagaaagggctaatgtaagtacaggccaacctctgatgaaataaatgaggactgtaattctgagttggtctgttccatttgcctttctccaatcccaggtgatggccacagtggcagaacctaggaagccaagaagaaaccagagaatggagacacatggcagcaatggcaagtcatcagacccaggatttcccaaagaacactggtccaggaagatgctctgtgaaaaagtgttccctggtcggagaaatttgtgaaacactttgcataatacttaaaagaatgtatggcacatcaaaggtaatatgcaataaaagaattcatttttttaaaaccaagcatatgcacaacttatttaactatggattcgatttttagattcatattttttgacccacatttgtggagccacatccatagaacagatttgaccatgcttatggttatcattaaaaaatttttttaaattcagattgattttggaattggtttcccatcatagttcaagtagatactgtcccaaacaatctgaaatcaagaaattagcaaatgggcttgttgtttgtggatttgaatggattgaattcctacagcattgaagaaagatatattttaaagcctatttttggaaaaatactcttagttgggtatttcatttgatttggtacacagtagtcataaattgccatctttttctgctgtactttatcctaaatatattccatggtatgttttcataattaacatgcaaatagatgtatagtttataattaatttcaactgggcacagtgaaaatcttgaaaacctcagcatggaggcatctttgttggtagaaattcaatgaaatccccaaacatctttggttttgcaatccataatttgcagattattaatacaataaatccttgttgtctgtgagagttggcatcgtacccatgaactcctgtgtagaaagcctacaaactaaaagtccaaatggaaagaaaaaatcacgtggtttctgtgtatgctcattacctgcttctgaaaccataatatctcggccttttatagatcttataacagtctccgcaggaagcagctgcagtcattagccataggacagactaaacacacaatctgcatggaaggaggcctggatcagcttggtctttcagatctctaatctcaggcacaggaaagcaccatcaacagcaccctttgtatatatacataaaggtaacatattttatcatttaaagggatttgagaaattgaagaggcccaactctttttctgccttctttggtttgaggcttagattgcttaaggggcttgcccaggatcacatatcttgtaagagacagagcaaggattcaaagccagtgctggcttctgtgtctccattctttccattctcctccagtggctcttttgggaagctgagggaggaacagcagcagaattgggtggcacctgcccatgcccatcatgcactgagcatcttcaggtctggccatggaccccttaattcctaatccagaattcctcccatcactctttgctgagaaaagcactaaaatggagatatttgttccaaaatcccaaattttaattccatagagcaaagtgtctttatttttaaatcatccaactcatcataaattcagctggattcattagagttaaagaattgacaacaccaaacattttgtaacagaagttactgctgcttaaggagttagggttcaccttttccagagctcttcagtgccaacccagcaccaatatcccagcgtcgctggagggaatgatggcgccctgcatttcagagaagatttaaaaccgagatcctaactgctcatcatcattaaaaatctccaggcagttttcataagagcaagggggtggttgcctgaggttttggctgacagtcaacccaactaattacattctgtctactgtgtcctcccgcagtttcaattggatatgtttttttttttatttcctgtcctaatctgaatgtagggttgctatgtgttcttaagcagatgctgctgttcttgctggtagaagaggcttttcagatttgtttttttcctcacagaaagtttttgagactttaaataaaataattcttctaaatgttcctaagatcctggcaccaaatacattctaaatgcaatgtgtgcaggtaagaatctatttatattgttattttccctcatcaagtattgacatgagcagacatgcttaaccctgaggtgataatgtcctacttatagacagtcaggtcacagcagtgccccttagcattctcatctcctcttcttactgattacacgttctcctgttgctcctattactggtggatttcatgaacaactcacacattctgtggcatagttgcaatgagaaagtcttaagttagtgttctatctatctacctatctatctatctatctatctatctatctatcatctatctatctatctatctatcatcatctatctatctatcatctatctatctatcatctatctatctatctatcatcatctatctatctatatctatatctctatctatctatggtgctggaagtctaataaagaagaaggagaaaaattgttaatatgatattttctggtcaaattcctctgtgaatttcatcagatgtggccatcaatagcgcaagatagagttctttggtggaaagtcaggaatccagaggcatgaattttatttctgccctcccacccaccttgacttcagctctgtgaccttcaacatgggctcccaccttcctgagacacacagtgaggagaaaaaagaggatctctaaaactcttggaacctataattttatataacttcacccatgtttgagagagagacgatatgagcttgcacataaaacattcaaaacaaagtttaatgatgggctttctttttgctaaaataattaccaaaagttgtcagatttttttagttgatcagattagaaaacagtgataatgttttgaaaggcttgtgctatataccaggcatggatctgggccttttatttctgttaacacatctgatcctctctataacccttgtttgtattctcattagtctcacattaaagatgaaggaacagagacataaaaacggtgattaccccaacgtaagaagtgagagagccaggattcacaacccagcagtccaattcaagagtccacactcttcacagttctgcagcactgcctctgtgggggacaggcactttataaatttcaccttgcttcacacattcattcattgtcacagaagtaaaaaatgtggttccttcccaccttcatcctcaaagatttaaaagagagaaaaatagaatgtcttctgaaagttaaattctaaatctacacttcaagaaacaaagcaaagatattcagagtaattaaaaaaaaaaggagatgtccaaatttgctcttttcagtccagcatggacctgatatttttaatcactctcccacttttcagcaggacattggtcaagacttgagtctcctttgccttagggttcacccacattctctctgcttcctgggtgggatgccaggagagaattaactatctaaaggctaacttatcttaagaaaaaaaaatgcatcattcagaagaggttttgttgactttcagaaacattgaaggtgtgtccttgagtcaaatgtcaccagaatccaagccaaaggggaggatcgtaaggggcagaattccacttggttgttatgggtggcgtgtgtgtccctgtcaagggaatgcatgtcttgggctttttggctggaaagcagtccatctttagaccatatatctatttcccttcacactttcttcaagtctattaaattcccttctgatgactacctagcctgttacagcaatgccgatgggggataagatgctgccctgccgactgctccgcttctccttgcaaacaagttataggcatagcctcgggagctgcagacacatgagtctgtctctgacaccactccccatgagtgtgattgcaaagctcaaatcctgatccccaatactgagggccacacctgaccccatagtaggtccattatgcaaatgccccctctcaaaagtttctttggtttctcttgatgctacacctctgtctgttggaaattcacacatttgtctttaagcccactcatcaatgttatgaaattttctaggactccagtagaaagttaccacaggtgtgtttctcaatcacagctttacaccctcagtacaatgagctgcagttttcagttgggaagagcatagtcatgcacatttattcccatgggtgcatcttggtgtttagattcacgtgcgtgcccctatttgcaagataaaaacaagtataaaatatgaaattgcagcaaaattcagagtgtggaatttctatttatcagaatgtgataaatgtcaggataataagcctctcgagggaacaaacagtttccttgagcactgctgcgagggctattatgaacagacactgccaggccatgtgtgaggcacagagcaaaatcccccgcctctccttaggctgagcatcactagtgatttaaaattcagaacatcatgacaccagtgacaaagggatcgctagaaagaagtcctcagtgcatttgagatatttccagttcattgtaaagaagaaaatgaatagatggcaattaaaaccaaactttatatatcccagctattgtgtgaagtatgtacggaattgtgatcagagaaaagacaaaaataaccccagcttgaattatgttatgtattttaagaaaaggatgtgttttgaagtaattgacatttcaaagcttagcaggaataattagtcttgatgtcacctttatttaaatcaattttagtacaaatcagaaattaaaatattaaccaactagcttgattgtctgttttgagttaagcaataagtatttaagtgaagtctgaggatcaagcactgtgctggtgggtgagtgggtggtgtataaaggtggtccctgcctgcgaattcttagagtctaataaaatagataaagtttacacacaagaaagtgctagaataagcaactttcatatccaatatcaggttacatcagtgattctcagtcaggggccatcatgccttcaaggggacatttggcaagatctggagacatttttgggtgtttcagctgagggtgtgctgttggcatctagtgggtagaggccaggcttgccgctaaacatcctacaatgcacacgacagaattatccacatccacttaactggcatcaaatggcagttgggctggggccacatgcacgtaccctacactactccagcattgatttgtactagagaaacagagcaaaacatatgtcagctgtggttcgttggtaaagtccccaaagagttggggcttgaagctgggaagaccaaaactgtccatgcttgtggggccagaaagtccccttgtttgaccaccagaattcccagctgctgctggactcatggcactcagccttcggctgagcctcctcttcctgttttgtactgccgggtacatatcaaggctttattaacatttaattaagcatttattatgtgccaggcctgtgtaaccactttacaggttttaaatcacttagtacttctaacaatttttaaagcagattctattattatccccattttaaagatgagacaactgtggcccaggagactaagcaggtttttcttgtatcatacaaccggtagatgcagagttgtttaaatgcaggtagtttaacctcaacaactatgctataccgcttctctgtcatatgactttttacctctactagcagtagtgatccaatttctttcagattcctttcataataaagtgtgcacccacagaaactcatactcagaagtatgcagacaggcagcacatgcacccggaaaatcctgagagtagatgtgtgcaccctcctgtcttctggctccaggaatctcccttgtaatctcaaggaaaactgttggctggagggaaggctcttctctcttcatacctgagctaaattcttgataggaagaactggactattatatttgaaatcatagagcttgaaatatagttgataaagcaaatttcagattgttaaaataaattacatactattctacagtggagttatttttaagcagttatatgtggaatgtgtccacatcacattgttcattaaaaaccaaaacgattgtacaccagtgcatataatataatcttgtttttattagggtaaaattatgctattatatgtataaaaataagtcaagaagaatccatgccaatctgtcaacagcaatggtagaattgcaaccttaggaggtgaattaaaagaaattaaagaacataaaaagcaaaaaacttctttcccgagtcccagaggaaagttgactaagataccataatctaagggtagagatcatttccttggagagcatgctcaaagccagtccagggcagaactgaggagtgcagaaaaatgtgtctccatggagctcagctttgacttcactgcctgtttcgctactgacaatacttcctccacccagcaccaaacgcttcccatcacactgcagcagtaagaaagagggtatagcaattccatcctctcttacatctatctcaaagaaactagtatcattattttttaccttgtggtatatttgaattaatgaagattccttttccaagaatgttttcaggtttaaactctatctctcattgtagcatgaaggaattgcaaagatagcaagtagataaaagacgtacttcacaggagcatccagcctcctataggtaacgattttcctatattatcctttttattcaggtagattcaattaaaatcacacacatttattttctttatatacctaacaccaaacagtattcaggataccaaagggaatatagagatatgaaattctaggttctgccattaagcagttttctgtttgtttgtttgtttttgagatggagtctcactctgtcacccaggctggaatgcagtggtgcaatctcaactcactgcaacctctacctcccaggttccagtgaatctcctgcctcagactcccaagtacctgggattacaggcacatgtcacaacgccctgctaatttttgtatttttagtagagatggggtttcaccatgttggccaggctggtctcgaactcctgacctcaggtgatctgcctgccttgacctcccaaagtgctgggattacaagcatgagccactgtgcctggcctcattaagcagtttttaaaagttagttggagaataagcagatgtgtaaatgagctactctaggtgctatagtcaaggggaggaggagaaggagagaggtcagaggaaggagggtttatacctccttcagagagtcaatgttggcttcatgacgaaagaggtattggaggtggactttgatggagggtagaattttaacaggtggggagtagcaggtgaggccaacttaaatagtggcagcaagcaggaagcctctgaagcaggacatcatggggcatattctagaaaaacccagagagcaggatggctgtggcacacggtattgtacaagaagagtaggagatcagtttgagaagggtcagtagcatggttgtttaccagggtgtctgagaaatgcctgcctaaaactgagtacacatatataatatttgcttcaagcaacagaggagggaatattgcctgaataacctgcctctataacagacatttattttaagccataactaactgataggaaggaaagaaggaaggaaaatatgaggaaggaaacaaagaaggaaggaggagggaaggaggggagggggagagaaaggaagtaatggaaactgtagataccgaaatgaagaaggaattaaaaactagagtatttgaggggagtaactggtggaggtattgaatttagtaaccttaaagtttgaaaccctcaagaaattaacataaaattcagacacagcctggtaaaactgcttgggcaccaagaagaagtaaattcaaaaactctccaaaaggacacaccatctaaccaggtacagacaaatccctgctgaagaagagcttacaactcaaaattgtaaaagtgagcaaacaatcctatatgagggtgagtaaaaagacagaggaaacagtaggattagaaccccaagaacatcagataacaagtatttgatagacactataaaataagtatgtttaaatgattaaagaccaaaaaagaaaggaaaagaaaactatacaaaaaagatactatggaagaaaaaagaaaatgttgataaagaaccaaatggaagttgtagaattaaaaaattttaatccttgacattaaaaatcaaataaattaaacaacgggattagatactgctaaagagaaaattaatgaactagaagatagagcagattctattttctggactaccacaacagagagataaagaagtggaaaatatgatagagaggttatgagacttggaggaaagcatacatctatgatgagtcctagaaagggacaatagggttattggaagaatagtaatatttgaagaaataatggctgtgaattctcttgtgtaaatgggaaagacaaatcatcaaattcaaatgcacatagatgatatgtcctagatgcctctcttccgactctagcatgaaccagaatgaaacatgagggtttattctgcaagtttgaccacagtataagaaaatgattcaaataggaagtgatggtatctgcagatgaactggcttctgcccttgaggatttccactttgtcagctttgatcctgcctcttcccttctccactccctgtgcttgagctttggtgttttgtttgtttgtttttccaccatacctggcttttggagatacgtggattcaagccttcttttcattatgattaaatactcatgtctttaatttcaactgagactatataagaattgacaaatggaaaaaaaattttaaacacaccaatactccccgtattaccaaatcacacaatgcaaaaacaatttttttaattcaaatttgggtgaaggacagtttcaatggacttgtctggcacagcttttgggtactccatcttcaaattattttattctttcctccacttctaaagtatgttctaaatatccatgtatgacaaattgtggaaacaatcctggtttgaaggtcacaaaagttcagggcttagctctgtcactgttctgaccttgggaaatctcctgacctaataacaagtgtgttatggtttaattatgccacccaaaaagcatgtgttgaaacttaatccccaatgcaaccagtgttgaaaggttggacctttaagaggtgactaggacatgaggggtcttccctcatgaatggatcaatgctgttatcgatagagtgttttcgtgataaaagggtgagtttgaccccctttccttttcttgctctcttgctctctcacactcacttgcctttttattttcctccatgagatgatgcagaatgaaagcccttgccagatgttggtgccatgctcttgaacttcccagactccagatctgtgagccaaataaacatccattaattataaattacccaggccatggtattctgctacagatgcactaagcagactaaaatgaatggcaacctgctctgaatgcatgctgtgaatcaggcaccatgccagatgcctcatatgcatgttctcacttaatccttacaagagcaccatgaggtaggttctcttagtaactccatttatagctgaagccattgaggtcacctgcccatagccaagtgattagaaaaaggagaggccctctgactgcagagcccaggtcctttaactgcaaactcttttggaaatctcaaccactttgacctccagcctcattggccactggtcttttgttttctcctatctcaaatgaggccaccattacattaacattctataatgagtttgtgtgtgtgtgcctgtgagtgtgtgtgaaatttaagttccagtgaagacaataaggaatttgcatctgcttctagggaaaataaacaaagatactattctaccatagttggagataatggctgatcatttatacataaacatggttttcaaaattaaaaaataaaagctgttattgtgcagattttattatttctacaaattaccaaaatattagtatctattaaaaaagtcaatcagcttagtaaataagccttaccaatccaatcagtttgaaattctacattagaaaattaagacgttagcccacagagagctgccaactcagggatattgggcctccctgcaaagaaagaatgctaaaaacatgtacatagcagtttgcaatctgaatcttctacatagcaaggtttttaaatcacttgccaactccccccaaaacaccccatagccttctcatttacttctttttgtttacttctttctctttcttattcttgatgcctgcctaaaccctacttgtttgatttttgggatgtaagacacagttcttattctccttctcctaagtctctccctcagttgaccaacccagtctgtgggatatgtaagcttcctcttccaaagtctttggagtctatgcagtggtttcctttcactgagcactcattcttcactgcctgttttgttaattgagagtcatatgaatgtaggaatcaactctttgtatttgccactgttttaaacttattttcttgcatatagcatcaatcatctatgaatatgagtgatatctacatgtgcataaatatagggcaaatatagttgcatgctccatataattatgtgtacattttcttagtatttatttgggttcaagaaacagaaatctactctacttaatttaagaccagagggatttgttataacgatacagggatatcacatagaaccttagtgcaggaagtacagccagtcctctgaagactgaactggggcccggaaaatcatcaggagctaaccagctactttctcagtctcttttttctctctggggccacatgatctaccatctgctccattctcttgcttttctcagcagacagtctctctctgcaccaagttttcatgggccagggagcaccatgacctctagtctcttgcctcatggttcatattcttaagagaaagaatctgaatggcccaggtcataggtcaggtttgcagccctggtcccccatcaactgtagccaaagaggagtaaaatctcatgacaagacaaggcaggagaggcccagaccttcagcagtggcaaggagttggtaggggtgctgttcgaaagacaggaatatgtagacatattgctttcttttaaaaacaatgttgatcatatacagtgtgtgtgtgtgtgtgtgtgtgtgtaaaatgaacaagtgagctagttaatacttaaaaattttgcttgtaagttttatgctaaagaaaaatgagaaacgagttttttttctaatgggaaaataaaagagattaagttgttagaggcttgtaaggacagagagatgaaaataggatataaaattcaatagaaaagcactctttttgaaaatgttatttaagaaagaaaattctgacatctacatgcagggtaggaaggctctggaaacaacagtgggcaggcagcccatttggagtttaaattttataatcttctgttcataatatagaaccagaccacaaaggtttaaagagtgtgggctaagtgtccctcactcagcagacagcaactcgttgtagatatttaaagattaaaagcagaggcagttagtcaactgtgtaatatttactgatttgagcagctctaccatacagacatcttacacataaatttaactcttattattgtgttgcccttttccaagaaagggtaaagtggatttgtaggagcacttaacacatgtaaattccccactctttaaaccaaagcgccttgtattaaagagctacataaattttacaagtattctgtccttttgagatcatagatctattctttcctgtaccacaattaaagcgatgcctctttgtaagccagttccatgaaacttgttggaagatatctcacaaaagacaccgcttttgctaagtgcataattgcaccgaggatataaggatgtgcagaggttccaggctggggcattctcaagcctctgtcagcaaagagctcactgtttcattggccactgcagccttctttgaactttatttactcatttaatgtgcttctccacttttcttaaaactagctttaaaaaatgatttaaagcatgacttccttcacacagctaatagtccatgaaacagcttagtacttataaaggaatgctcaaattgatagcgaaagaatctgaaatgctatatttttccactgataagatacaacctagccagagatcatgtgatttttatctatctcatcaacagtatgttttcccaaactttgttccaaaggaagcaaaagttgtattttaaattgaaagtggtcagtgccaaatgatttgatggatcagctggaatgattaaaaatgtattttgtgaaagagattaataacaattattttgaccaaattcttggaaaatcatatagtgactgcatacatttctaccggaaaaatagcaagtaagagatttaacagttttatctaatcaggcttagatagtatttatgagaaaagttggtttcggtttggcaaagtcaggtttgaatttcaactgtttctagactcaatgatttcaacttgtgctatgtgatatctcccaagagactagatataaaatcatgagctttgaaatatgtttcctaaataatattccataacagaatttttgttgagtacacagtgtttcatcatatggttctttgtcttaatttattattattatttatttagctcatccctgattgttagacatttttatatttgctaatctttcccttattataaataattctgtagtggacatccttgtagataagtaatgtcctttaaacttgtgcccctggctcctctctccctcggctgcagtcaatctattccacgcccctgacttattaatcatgaagatcattcttctggaaacaacattttgttgaaaacaggatggtcagatattctggctgtgcccagagcctccacaatgtagttttaacctcctgtttcttcatgattgcctggtgatttcccaaggttctgctacttgaagtttggctacaactaccagctaatttttacactacaatccaaaccactttttctcagagggagagggatttgttgggagaagggagtccaccagagtccttcctggagatctttggaagagaagaccatgaaagaaaaactgttctctctccagagagagaacagtgaggatgtaatatgtaaactttgacaacttaagcagccatgttttctgccaggtgaacactggaagaggagaaagtttgcctgcagatggagaagaacgagcacaggtagagaggagtgtgtgtgtgtgtagggtgagatacagagacagagacattctgataaacattctaacagagatgaaaagaaagagaaagatgaattgaagtggcccttccctggatgaatacaaggagagaggagcagcagggatgtgggaggggaaattcaactcctgggaagtagtggaatgagaaaattagatctgctcacctctttactgctgccctgcacaccaagatcagagttggactgagaagtggaccactcaaacgggtacatggtacaccaatgcacaaatgcatttaagtgctcttaggaatatcttactgacactggaaaatccccaggggtattccaatgacaccagaaatgtcgcaagatggagcaaactgcatttctaatactcctctcagggagactctgacatgcggagggaagggattctttggtgagctgcttggaaggcagatgcgttcccctatgagacatgcttgaggtcaacagatggtctttaagtaaccttcaaacgagactgggtcatcttaaaatcagggttctcatggagcttggggccaaagctgaatttatttgggaaggaagatctttgagtgctgccacccactgccttttctctgcccttcccttcatataacatcctattcttgttcttttctgaacatatttagagaccatcaatttgaaggcgtgcagaattaaaagcctgcctagagcccccctcttttatcctctggaggacacccacatgtctggccttgagtgattgtttcctcttctatattttttcttaggctcttctcttatctctgcatgatgcttttttcaaggactagtttacattctatatatgttagcccagtggttccatctaagccaccacggacaccaaccttgaaccctctgcagaagagctaatgagaactagagaggcaacaaatctgtactctagatgtgattcctgcaaaggctagttggcacaagggcatccatgctattagctggcagtgaaaagcaggtgtatctcctgtggagtaaggtgtcatatgaacagacaacatctatggccacaggacactttacttcctctggaagacccagaccagaaagtttgcacaagacgtctacattgtcacaatcaggtgccattcttattatttaaatcaacttctaaatggccacttgagttttgacagaaatctgttctagaatttagcaaatgcagagaatgaaaagaaattctgtcgcagagcccagtctctaaaggcagcaggtgggagccagttgaatggtagacaccccctaattctgggctgtgcccatgctgccaactcctcaatattatcatgaagagggcgaaaagaagaaaatacatttggcagtttaaatcagataattattttttaaaaaggtatgctgaatataactcccaggtttgatccatctgtttaaacttaagtaaaagagcgtcactcctcaactgaccatgctacgtgatgaatatgctcttgaaatgaatgctttcagatggtttccttttatgaaacgtgcacaaagatgtgtactgtggtggtggagttggccttgtaagacatctggctacaacatgtgcctcattaagttacacctgtaagtgtggggtcattttttatgccagtaatattaataataaagggttcattgaataggattattaatggtgccaggtggaggatgtagtattacttacagcctggtaggggattggctaacgtctcctcccaccaacgtttctggtttcatgtttatagacagagccctccagatgatggctggcaatgtagccattgagaaaatgaattctccgtttcccatcagcaagagcatgtacaacagttggtagagaatttgaatgaatctattttctaattttgaatgtataatcttgtggaagagcacgtaagatatttaccaattaattcaagaaattaaaaagtcactttcaaagtttcactttcccctaacttaaatggaaacttttcagccctagccatctcctatcatttcttatttcaagagacattcatctctgcattttccctttgtggtcacaaactgcaaatcaaaaggaaaaaaactgagaagaaatctaaaacctttccttccttctgtggaatgtttgcctttgctgttttacaatgcaagacttgtaacagaaggaaatggaggctcaagatagggcactttttaatgtgcattattacaggtgttataacatgtctggtaaattcaaagtattgtttgatttgacaaccagatcccaagacttagaataccaactcatgttttagcttcagatcacatgcaactagaataaatttttaaatttaacaaggcagttgttgaatgttaattaaattgcatttgagtaataaaatccaattgattgctaagagtatgctaaggcataatagaaaaattgtcttttacatatctttagccattcataaatacacactcacatatctatttgtgcagaaacaataaactaatgaaaacagttaaaaatctatttgtatcgcactttacagtttagaactgatcttttttacatacattatattaacagctctgtgaggtaggtggtggtgttatcttcattttgcagagaagaaaactgaagttcagagactgatattctcaagatacacacttagcaagtggtctctgcaaaactgaaaccctccctcattgaatctaaacttttatgttgttccactccaccatctgtttcccctttcccagccaattaactcccctcgagaaaaatcctaaaatccaggaacgacttccactgccacctcattttagtataaagacatttacataatctggatgaatctcatcgagttaatgatgagtggagaaagacagccacaaagaatacatacggtacagtttcatttctgggaagttgaagtcagtcaaaactaacccaaggtgacagaagtcagaacagtggttacctctagggagagggtattgactaagagcacgagggtgccttctggggtgtgagaatattctgtatcttgatatgagtggtgatgactcacatgtatgcatgtaaaagcttagcagaacacaagatttgtaaagtttgttgtaactctatcatatatcaataaaaaattaattttaaaaagagcttattgcatcaaatatgtactaaatgtccctgaaatgtgtccccttatattttttattttgggaaaaagaatcataccctattctagattccctaggctttctcatgcctctactatctgttcttattgtgcctagctatttcttctatcattaatcatagtattttataattgtctgaatacatggctgtctgtttctcaatgggcagagagcacttgttccttgtgtccatgttcccagcatctagcacagtatctggcatgaaatatttactcaataaatccttctcgagcagtgaaaaaatggatgaatggatgggccaaatgacttttcattttgttgttttataactcagacctaggatatgggttatattaggatgtactgtaagatcaggaaataggacatcagatggggctttccaaaaagtcttgggtcattgcctttcaaagctggctatagttaaaccaccatcaccacaccaccaatccagagatataagctctaatgagaccatttccactgttgggatctgattgcctcctttctagacctttctattacatggcttcccctgcttatgacaaagaggagccctcaactctattcttttctgtatttattcctgcctagctcccagccctttgtccaattctcttctaaatttctttgtaggggaaagtttgttcacaccccgcccaaaacaaagaggaaaccagactcctgcatccagcactccagcttcatttttgtcagtagctttcatcagccttttttatttatctgagttccaagtttagaatgagtaaatgtcaccattatcctaattttgaatagtagcctctcctgttgaaggtttccaatttctgctctgctttgtgtttgcttcctaggtttgtggttttccttctatcgagactggcctttaacataactgtgaagaaagcagcttgtcctgggtacctcctttcttttccttttctccaactgttttattctgtgagttgcagattatgtcaaaagcacgccaaatgagcctgcccaattccaggagaatacttgggttaggtggtgctctagtaagagaatagttggactgtgcattttatcttcttggctcaagcctactcagttgacttgtttaccattgtcatctctacaacctgctcttcacttggagtgaaaattctctagattatgtttcttttgagggtctggtatgaaggctctgttgctgttttggagcaaataaacagccatcaacaagtactagcattcacctgtctggtaaatgcttctgaagatggtgattctccaaggccatgcctcctaaaacactgtgcttttgttctgctctgatagtctccatgaagttgctcgggttgtgtatatattcagcactttatggggtttgtactctttgtgctctgggcagaaataccaggcagtcaaatgcagaaatcataaaaatgccctggagggtcatagaagtgatgggatttggggactgaggataaacctatctgctcttctttttccatttatactctttaatgacttatctgggcactacaatgggggtaaagaaggacagaaaaaagcaagtaggaggtaaattagcacagaaaagagaaggaagatatacttcaaatataaatgtcacaattttgtgtggtgctcgttccagagtctggttagcccagagagcatgttgggtttgctccctccactccatttaagcaaaaccctcaatatttgtcccacacatctgagctagggcaccctgtgaagactgaagactatagtgtcaaataatcaagtgcaggattgagagtcagaggggattgtattcaagttctgacaacttcttcctctctaagccccaacttcctcatcgtaaaattagaataataatataaaagtcaccacaaacctgtttttaagtgtcagttgagatgttatttaagaaaaagtactataaatggaaaaacatcttcaaatattaattgtgattatcctgcctcttgctggctgcttacagtaattcggaaaattactaagaattttcctttcactggtcaggcatatgcgagaatgattccaagccaggaaattattctgcctagttaaatgtggttgaatgtgtaggctggtggggtagtcagagatgggggcttgggggttacagacagtggtattaaatgaggtagtctagtattttctctactctggggctaaggggtttccttgccagtcattaggcatagatccattttctagacaccgggatatttagtcactctgtgattcttcaaaattgatggcggctaattcttaaaataacactttaatgggttaacagccaatgaaggagagctatgttgattaaacctcccttacaaacatgtttgatgattatgagagtaaggcactgggtagattgcctttagggtattgttaaatctaaaatgtgtgaaacgttgtctgaaagaggaacccagtgcattctccctgctctgtgctcctccagccctgacttgaaatgagacatggcttgattgttatggtggctgcacagtctttcagcacatcttctaccctaaagatggaggcagcaggaaccccagaatgtcaaaccaggaaaccaaatccagcttgaagccattctgttatcaaagtgatgcttccttgctcacaagaatgcctccaggccagcaacgcagatcttaagcagaggtgaaaccacatcctcccaacttctgcttgtccggtgggatcagtgcacagctgaatagggtgagtatgagaggataaagatgcacaaagaaaagagagtagggtctggtaggtgctccaggataagcactagaggagactctatgactggagggggcctgatgagcctgcctcaacttgcttcttccctttggaaagtacagcaaagaggaacagggaagagaaaggttaaaaaatccatttgtggatggatttttaaaaaatattggggagtgagtcaaagatgatcttaggaacagagattacttccttcttttagctacattttctaaaagtcagggggcggaagaaaagggaaggaacatttattatgtgccaacttggtgccagacattctgcttgcacttttaactttacctcatttaaacttcctaggaatcatagtaggttttttaatccccctgtttccatatgaagaaaccaaggtccgtggagtttcagttacctaaagtcacatgtgctgcagccaggtcctaccagatgtgcctgcctgcaaggcactctaccatattgcccctccgtgcttatgacttccctggtatttccaaaggtctagaaatagggctaggaacatatgctttgatatgttgttccttaggattttcagggactaaaaaagggcaaaccaaacattcataaatgcaaattatttatgtagataaaccaaatgcatttttgtgaaaatcaattaaaattctacaaggcaatgcttttctgaacagtagtgtgtaactaacaactgctaaaaaaaactgatcgtataaattaaaacctagccctcaaattgggctgacttctaacagcttcaaggtggccccaggatttacaaatcgagtgaccaggtttcagagacctcttcaggttcaaataagatttacacccagacttaacacataacttatgcctggagatagaatctcatttggggtgggggatgggaaatgtgtgtgcacaaaaattatatttcattctgggtttaccctagaggcaatttttggagttaaactaccttaatatatttagaagaaatttaactctactcctgtacaagtcccagctttgctgaataccatcttcaagcgtaacctcagttgtgggaaactaaatacgtaagtgaccaatggctagaccatatataaaattagaactttgatccacaatctggagcaagctctccaggaaaccaaccttttatctactataaacaacctagaaagccagcctgctagaagtcagacttgcaggaagccagtctgctgtctctagtgacaatctaggaagctatacaataacttctgtagcaatcagctccaagtggccagaatttgtttaataactggcagctttcctattttttgtccctgtttccaacttaggaccaataagaggaagccaaatatgcacctctaattaatcacatagcacaccccacttctagttaggctgcttccaacttttccatttcaacaggctctaatcagggcatacctgaagctttccctgttttccactctaaagctttcccattcctgcctgccttcgagtctctgccaaaattcaggtgcttgtggatgacccccttgctgtagcacgctctcaataaagagcctttgcttttctcttcttgttgcttttctctttttgttacaacttgcacagttgcatcatcccatcttcacgtggagcagctcctttgatataggaaagactgaagacatacattgcacattgcagatgaggaaactgaggtccaaggaggtcagtgattctctttgagtagaacatggtatagtcaggagcccaccccagaatcacaggtgtcctgactcctgcccattatttccccactactctctgctgcctcccagctgagcttttaaggaggtgggaggaggagtcgatgagaaattggagtatgaatagtgattctgcggaagataacgctgtggttccattcaccacatttctaaaatggggtgaaaagacctctttgttggagagaacagaacccaaaaagtaatcccccctcctcttcccctggcagagaaaatgtagaagtgtctcttggggtttatacgtcttctaggcctgcaagccaaagctggttctccaccctgcaaccaattttcaagagcaaaatatttctttcctgtttgcttgtttgtttatttgcctcttaaaaagacaaacaagcaaacaggaatgaaaaagaaatcctaaattcctgcttttaggttagccctgaaatgcattaatctctttcacttgatgtagctcactttcattcttccattttaatatcttagggggaaaaaacccaaataaccaataacagtttacagctttgacgcagagcactaaagttgtttttctatgaatatagattattacatttttttgcaaagcaagtaaacagatgcataaaaatgcattatttcaggagcataagaaaacctgcaataagtatagtgcttttaatttgtttttatgattacttgtaattaattagcatcaaaagtaaattatcaacatttgaaattgtactatgagatgtgagcagggtactccatgaatgattgactggttcatctttatatcaaggcagggaaaagaatgatcttttctttgaatttttttttaaactatgcttaaatgaaagtgccaaaagccagtagcagcacagaggaagaaattttaaaacaactgataaggaaggcccagtttgtcaaatgaaaaatgatgtcaagggttaaaaatgatacacattaccagcctcataacaggattagggttgtctaagaatgaaaatttctcttttagaaaatatgaataaaaatggaatagctctgctaattgaaggaggttcacatactttctccaaaccatcactttcagccataaaaaggaagacattttacagatgttggtttttttttttttaaccaactctggttgtttgtcaccatcccttttccttttaagattaatgatgaaattacttgctgtagctttggtcaactcaaaactaaccaataggttccaaggagtgatacacttgacctctttctgcaccctctgacatttgctgccccagcgcactctgccctgagctggttcttcctgagagagtgccaacaagaaagaaaaatggatatttagtaagcagactgtttttttcatctgagaagaatatgtgcagggatttagaggactcacccatgtctcttttattaacaagaacgtacttgaactgagaattcaatctctgcaatacaaatagaattcaccaacagaagggaagggaggggaaaaaataagattaaaaacccacagtcttccttcttgcttagcagccctcctaagagttaggggctttcacaatgggattatggagcttcgaacaaaattaaataaaataaatagattcacttctaacaagtttcattccatggcagaccctcaaaagacacacatttttaaaattattattttgagaaagttatctgaaatgaaactctggctgtatttttctaaataatccactgggaagaataaaaagcgttccacgttcatagggagctggggatagatttacacttatggttacttcaatattgataagagaatataaagtaaactgcttcccaatgaagacatagtcaaagactcagggtcattcttgattatcttgtcgtcttcctctagggattctagtccaggtaactattctgttactggtgacctatggtggttactaaggaacaacatcagagttaacaatccccaaaggcaaagtgttaaatcaaaccaaggatatctgcattgcagttactgtactagaaaaattctctactaaatcccactaaaataacaaatattaatcaaagttcaagctatatcaacagcattcttgcttaattgttgaaattaatagtttatcacaagcattgaattgctctagtctctctcatccaccactgctggaagtgggaattggagaaaactgaagaatccataaaattcctagccagatgatttttacactgagattttccattctgtgttaccaacagtgaacacacattcccttttccccaagattgctacctgccaaatctgtctttgggaggtcacagcaccctttctcaaatacagcgttcaggggcacatactgagaagatactggttattattttcagtgattggaggaaagtggaaatgttattcaaggaaaaaacaaggagaaaaaacaacgccatgatttgttgaggaagtgtgtccacgtgccaggcagcattcactgaagtcaccaaaaagggggaaagcccctgttttacttcctatcattatttctattttggaatgtgggttcccggtaagagcatatctaggcattacattataaagctcttctcctacagatccagtggggccatttagctcattggtcactggatgcacatctctttttagctattggtccttgactattatttcttatacaaatatgtgtgtgggagtgggaggtgatggtggagtgaataactcaagtcttgacctcctagatccacctgaatatcagaccccaatgatgggtcaactttcctagctacaaggcagtgtccaagcattcagtctacttcaaggcctttatgatacttcagtagtagggtatgtttgcatgaggactaagacagaccaaattatccttgatttatagtgactaagattagaataaggttccagaaagcctagcagggacatccctggagaatattattaaaaaggcaaactgtatttatcactccatactcttctactgggccctcccctgcaaatgctctgtgccctaaggaagccgcatctgaggtccaggattctggctttttcctctctgagcaattcactcaagtctgtaactcttgaaatattcttcctctgtaaaatggctctatccttttactataccctctggattctgcacaaaaatttccaggtttacctaagattttaactagatcaacttaatgcaataatagatcatttttgtattgttgtgttgcctgcatgggtagctgatatgtattctagcaggagctgtctaaatatattttaatttaaaaaagtggtcctcacaggtgctaattctaattcagaaagggagttatttggggtagatgagctcttttagtgccccgtcaactacactgggataagtcagtgattacatactctgaatctacaaagtcttgccctaccggttgatgctctattaatgtaagatgcatgatttctcagataattgcttttatccaccacttgatatttgccatagaggcatggtctcaagaattgctttgagcaactgtcttgtttaaaaccaacattgctttaaatctacatattttaaaaagcataaaagcatacgagtcatattttacccatttccgatttatgaagtgcctggaggcactttttaccataaagatttttgcaatacagatatacaagcttccttctcctactttagaataaatgactggtggctgagactttcttccaaatacttttacataagcattttataatccttttaaatgttcctttttacaaaatttctttctaagttacacttctccttcttaatcgtatatgaacctcaatatgaacatttgaatacttttttccttgctcttcaattttcatacttcaactggtaatttcctatacctttctgctttctcctctcttttctccttttcttcttttgatgacttctgaaagacactgatgataatctttctcatttctccaaacagtgttctttccttggtgttaaattgtagatagttgaggtatcacaacttgcttgacattgcatcctttgctctaaggaatactagagacagagagaatggtgatagagcttagggctccattggggagaaaaatgaagaacattttagaaagagtgtgtgatctgttaaaatatgtagcactgaaacacatattttgagagttaggaagattaatgtctttcaatactagatacgcaaactgtcaaagaacacttacggttcttccagccttgatccttatggttttgattgattggggtcatagatggcttccttgacaaaatcctaaaatcatgtctagcaaacaaaacaacaatctggcaagggaatatcacaaggtataaatggattcgaagggcttcagcttcaaaatgcaacttgatgtgatggtaaaagaacttccaagaattttaagtgtggtttccttggagtagtattaaccagttgctagaggcaagctgactgggtctgctttgcaccagaagtcataaaatttgttcagggctcagcatgctatctgctgaagggtaagaacctttttcttccattatcctaaagagaaatctctggcattaaaattcagacagtcatttactcatggtacaatttttttacttattctgatttagataaagaccttaatgatatatttccatgtttttactggtatgttcttaattttgttttcctttgttctaaagactaaaccttcagtttcttttgttttagtcatttcaacattaatgaatatcatctggattaatgacactatttaattgtctaagataggaatcctggactcattcttgcttaaaactaatttattaaatcttataacctttttttccaccagttaaacttcttgtttgttctacattaagcaatacctgaataggagtaatccattggatgctgtatgtcatctacaaattctgcccattgacacctttgagcgttctgtcttctggggctacagtgtgatgacatcaaaatccctcttctgttgatttaggcacatccaattccatgctcatcaattgtagaagtcaatcctcattagtcagttgattatcagctcttgcccttgcaaggaaattggtgagccatcatcatctaggctagtcctatcaaatggtgttgggtaattggtaaccatagaaccattcaattctaaatttcaaacatagataactgcattttgctttcattctgaggattcaagggaacataatagataccatagcaatcaaaagctgtcttttagacaggatcaagaactaaaggcaaatattctaatttggtaatcatccttatgacctttaacaatatttattcacaaaagatttgttttaggagactaatttattgtcattttgcattttaaggttttttgtggtggtggtggtggtattatttagcaactggacaatttaactttggtaactgtaagagcaagctggtgaaagtgattttagttaatgtcagtagggcattataaattaagggtttattactcttagtcctaacctgattcctttaaatgagcaacttggatggttgatacgaataaagaggaaagaacacaggttttgtgtctgtgatatatgtagattcaaattaagattctgcccctaactccctgaattagtctcacctataaaagtgaatattcaaacctgtatctcagagttaaacagtcacaggtgcatgataggagatcaaggatagctttcattatcattattgtgatttctccttctgtataatttcaccaataagaagcctaggacttcatcagcagactaatctgtacttgaaatctcttgaacccaggagccaaaagactcatactgtcaaggtgacataggggtttgctgattcataatcatcataagacctaaaagggatagtttaattttgataggctatttttctaagggtggctattggctcacattattagataatcatggttcaatactgttcaattgctacctatcagagtcattctttcatatacatatgttgtatttcttactacgtgccagacactgttttagccattgagaaacattaagaagcagtttactttcattttaaatgaacacttttctatagaagttactgtttattcttgtttggtttttatcccttctttatttaccattttcaggaataaagatgtgagggttacaagtaaaaatattccatgaaatttgcattttcttcaagtttaactgttttaaaaactgtgatggaaaaactgggagttcaggaggattgaaccagaggcaagagctctgtgaacacataatgacctccatgattcaaacacacaagtctatctgtcacccaagagaaatgtttagacagattagatacaaatgtgccatgaatgcaccttgtgtaggcaaatggtaagactgattttcccttttttcttgattggtaaagcctagagaagttatcaatagaacttcatctcaaaggaagtaatatttttacacagacatacattgcagcaaatcctgaaccttgctactgaggcacacaacagttgcagatttggacacctctcttgttcaatgcttggctctgagtgagcaacttctctgatgttataggcccatagttttaaagaaaattagaaacatataataagtcacaggaagaggaagaaaatttaacccagtggtctctaagtcctcctctaagaactataccctaatcttgcataaagatttacttctaattaacttgccagttaagagacattctccctttttggcaaaaatctgaccaaacaatcagctggatatcctgtctagacttgactccagcttctaccctcaaaaaggtctgtccagatgctcctgacctaacatgtgcctgatgaacaaaaatactttagcacaattgtagttctgttgaccattgtcggtaatggagctaatcaagagaaccaggggactcattaaaactttctgctgtatattcataggctgattcatttaagagaatttttggaggagtaataggtagatgaaaggctttagaaatatgcagatgactcaagtctcataaccctgggagtcagacatgcacgcacaaattcataatgtgaaatagcatgtctaatggaagaacattcattagttaagttcaaaggaaagactcagatttcacttggaagaatgagggaagactttgtatttgctgcttttcattgtgagctgaagagttgccccaggaacctgagactttgagcccttacccagggatgtgaagtctgcatggtacacacaggtacctgggcctcgtagaggggaaggggggcacatgggggttttctgagattcattccatgctccactccgttaaccatgtgccctggcaggaagggctgtccacctgaagaaaaggccatggaaccatgcagccctagggtttctaagttggctctcccttctgggcaactttttaaaaattaagttttggggtacatgtgcaggatgtgcaggttttttacataagtaaacatgtgccatggtggtctgctacacctatcaacctgtcacttaggtattaagcccaacatgcatcagctcttttccctaatgctctcccacccctgctctcccccaataggccccagtaagtgttgttcccctccttgtgtccatgtgttctcattgttcagcttccacttataagtgagaacatgtggtatttggttttctgttcctgcattagtttgctgcggataatggcttctagttaaagaaaatgtacatgtataccatgggatactatgcagccataaaaagtaatgagatcatgtcctttgcagggacatagatgaagctgggcaacattttctaattcacacaaaggtacaccgatgccctcctggagttgtagtatctgttacaaagagggatgatctgaaaggctacttttgctttggggagaagccagatcgaaagccaacaggctgctcacaggaattttccatctagaagtcccagagaaagaattgagataccaggccctgaaactgaagccagataggagcatacaggtttaaagctgtggatagaaggtagaaggggtgaattctctgaactgattgctgagctgtgactataatgggtgtaggtggcctagtttgtgggtgggatgggaggtatcagagagccagctcagtggggtcaggtataaaagaggggctaaatttggactgtgtgatggaggaagaaaatgaggagagagaatttcacgcagagggttcacctctgcaaaaactccatgggatggaaggctatggcttgatgagtgcacaccaagacttatgcaatagctgggacatagggcacatggatgaggagggtcaggagctcaggagtgaagatgaagagggagaggaaggtcagctcctgaagacaatgcccatcctggtgttcaaatctctcaaatgattatcaggattattattttctcttagagtgagatatttgtttcctgtgtgcttccttttattaaataattgaatctgtgcaacaaaccagtttccctttttgctttggttgttatgatgctctgggctctgtggtagacagaccataatgtggcttgccatgtttcattactattaggttggtgcaaaagtcattgcagtttttgccattactttcaatggatcttgtattattgcccttgacctaatgcgattccaaggcatccattgtcctgtgtgttaaatcaccactaatcccttttaaaaagttgtcaaaatatgagtgatacatagaaataatatataataatatcttctagttgacaaccaaacagcaaatggttcttgaacacctctgataactgactctattacttcgagaagtcagaagcacaagatttagtttcaacattcaattaccagcttgtgacctacctgagaatatgccatgtgcagataacatgttaagtagtagtacaaggcattatatgcagggttaatatttaacttatttctactgctacaaggttacttgcaattaaaacattttagttcgtctcctttgggtggtatataacttgtgcctgaagccagctgagtacccagcttgcccctcacatcccttccaactctccctgaaacacccacctccattccctacaatctagcaactgaggggttaatgcagggcacagcaggaacctctattcccaggaccaggaccatcatttgctctggtgagatgaagtctactatgctcagacttctattaaacattttgaacatcactcttgagtaaatgttaggtgctaagtgatctgtctccttgttatcattgcaataaataataagggctactattagctaatcactttctatgttccaatttaacatttataattagccactaagataatctttactaatctcattttacaattgaagcaacaggctcacggagtagaaatcactccatccagagagggcacctagtaagcagagaatccaagttcccaacccagctcagtaggacacactccatgtttgggagaaggctttgttatcctgcctgggacagcagagaagcagcatggaaaagagggaggagatggcttaaagggtttggccaagcggtgtggctggaaggacaggggacctaaggcacgttaggtgggtagttgaatctggcttacaccctcttaacatgtgtttctgggttcttcctttttcagttgcccttagtctatcataaataagaattcaggaagttgcatccactttttttttaggtcactaatatactttatagtaagttcagctacagcagaataaattggggcttcttggtcccaataggcaccatctggtttatgaaacaacagtgtatgccctctggatcattttcccttaggaaattcctccttatctgctgcctggctgctaacttaaggacaattttcatactttctattctaataattttgtgctgtggattttcagtttattttgtttctattaagaagggggaaaataacctcttgtaaaacacacacgggtttagtctggcaacaaaaaaacattctcagggcaagagaaagtgagtatttcacagctaagggaagaattgagcaactcagattacaattgaaagctaatgggagactcatgttggaagcaaagaggtttgaaacagaaggaacaatcaaagagaaaatagatgcttttgttacctatgcttgtttttagttgtcacctctcctaaaagaagtgatgagcaggctgtaatctgtaggcataacattaaagctgagaaagctttagggaagggtaggaatggtgggttatgagatctataagactttagattgaagggttgaaatgacaaagatacttaccagtgttattcgatgctgtggtttcataagtgtctctggtaattctgaaaataccctccctaccccaacacccaggtaaaaggtcagtctatggccttacgaaaatgttatcattcactgcctctggtggacacagtttgttctctttctcactcatatgtgaaaaatcccgacgccctcccatcctccacctcttgttgccacccaccagcccttatgtcagtccagaggcacaaacaacatcattaaaggtgaggaaaagaaaaatccagtacagattggctggctccctggcctgggctggtttaggcagctcttggcttagacaccctgccttccaaacacaatctgttttcaagattcctggggaatttcaggtccaagagaaggtttggtgttaacttccccaaactcagtctccttcctctctttccactccactaaggcataggggagacccacttgcccagactcagttttcagcttgtgggacaaagctgtgttcttggctctagaagaagcttctgttctctccaagctctgtgttgtttcctttccttcataactttgctccgccaatgggccaagcatggctccattctgctctacccccagaggcttttggaaatggaaaaatacaaaagatgctgagaggtcacatttaaagaagacagccactcttaataggatatacaatcagaagttccagaatgcaggcagaagctattcctttttaggccccacgatagcaccaagttctttctagtgtggatcctgcaattggcaaagtgccagaaagtgcaaaaaaataaaaaataaaatgatagatgcaatgtagtttttgaagcactctgaaaagtatttatctaaatgagaagcattgctcccttttttgtgcatggcaccatcctatatgaagaagcatcttacagctttctgtctagttgggtggaaaacttgtttaaaagtaatacattagtttcctctgagataggagaattacttggactcggggtggggaggttgcagttagccgagatcgtgccattgcactccagcctgggcaacaagagtgaaactctgtctcaaaaaaaaaaaaaaaagtttcttgttctgtggtttccattacccatagtcaactgcagttcaagaatattatcaatataagtaagtaaatcaataagatatttgtaagagatcacattcatataactttatattgcagtataatgttattttattagtagtagtggttttcaatatcttattgtgcctaattcataaattagactttatcataggtatgtatatacaggaaaaacatagtatatttagagttcagtactgttcatagtttcaggcatccactgaagatgtataccccacagaaatatatcccccacagagaagggatgactactgtgtatacctctttttttgacagagtctcactctgttgctcaagctggagagcagtggcacaatcttggctcactgcaaactccgcctcccaggttcaagcaattcttctgcctcagcctcccaagcagttgggactacaggcgtgcaccatcatacctggctaatttttgtatttttagtagaaatggggtttcaccatgctggccagtctggtctcaaactcctgacctcatgatctgcctgcctcagcctcccaaagtgctgggattacagacaagagccaccacgcccagcctatacctctttttttaggtcagtgtttttgaatatgattctaatatctcactgggcagccctagaaacatcattttctgggttcttctgtaatagagggatgccctcaaaggatacaacagacccattggtccccaccctaaattacccgaggatgctggtctttttcaatagtcttgtggcttctctcattgccagattcctttaatacattgttctgcttcttaaacacagttctcaaggtaagagtagtaccatttttttttaccttaataaacttggtttctttacaagtcaagatcttgtaaaacagttctcttcaattttaagaatgatggctgtattcagaatggttgagatttccagaagttggatcttgagacaagcagtgattttcagtattaccattctggcttccaaaaatgatgctacagccacattctaaagtaatatagtaataatattaatattactatataaatataaacatatatttatataaaatataaatatacattatatttatattttaataatttatatttacaaatataaatataatttatattttatattttatataaaatataaatacatatttatataaaatataaatataatttgcgaatactaactccttgttggttattgtgccagttattttttattattattaattgcttctaatgattatccaatacttaaattagttcatttggtcttcaccacagtcctctgagatatgcatcctttcatctccatttaacagatgaggtagctagagcttacaagggtcaagatcattattaagtcatgcagctggtaagtgaaggagatttcattcaaactcaaactcaggtcagctggaactcaatggtcctggtcctaactacttgcatagaatagaaggctggaccaaaaatatggctagttctaaaaacaaacaaacaaacaaacaaacaaaacagctaaagattaattatcagagaaaaaatcatcagctttttatcagatcctcaataatgacttagaaatccattaggaacaattgacctaagtggatttatcaggaactctagtctgggaaaagcaaattggtttcaatttccctatggggcaaccctgaccatagagtaggggtcatctggagtgcggtgttgagaaagtttctgaagtaattgctagatcagtaggaaaaagtcatgcattagaaatatctgctgtgacctcatttggttgatggtttgaacaatctattttataaaatcatgagacatcagggatttgaatattgaatattagatgatattaaagaattgttaattttttaaatgtgatcgtgatattgttattacattttgtgaaagataaaaaatcaacaccctaacatcacaattaaaagaactagagaagcaagagcaaacaaattcaaaagctagcagaagaaaagaaataactaacagagcaaaactgaaggagaaagagacacgaaacacccttaaaaaaatccatgaatccaggagctggtgttctgaaaagattaacaaaatataccactagccagactaataagaaaagagagaagaatcaaataggtacaataaaaaatgataaacgggagatcatcactgatcccacagaaatgcaaactaccatcagagaatactataaacacctctactcaaataaactggaaaatcttgaagaaatggataaattcctggacacatacaccctcccaagactaaaccacgaagagatcgaatccctaaatagaccaataccaagttctgaaattgaggcagtaattaatagcctaccaaccaaaaaaagcccaagaccagatggattcacagccaaattctaccagaggtccaaagaggagctggtaccattccttctgaaactgttccaaacaatagaaaaagagggactcctccctaactcattttatgaggccattatcctgataccaaaatctagcagagacacaataaaaaagagaaaatttcaggccaatgtccctgatgaacatcgatgtgaaaatcctcaataaaatgctggcgaactgaatccagcagctcattaaaaagcttatccaccatgatcaagtcgccttcatctctgggatgcgaggctggttcaacatacacaaatccataaatgtaatccatcacataaacagaactaatgacaaaaaccacatgattatctcaatagatgcagaaaaaaccttcaataaaatttaacacccattcatgctaaaaacactcaataaactaggtattgatggaacatatctcaaaataataagagctatttatgacagacccacagccaatatcatactgaatgggcaaaagctggaagcattccctttgaaaactggcacaaggcaagaatgtcctctctcaccactcctattcaacataggtattggaagttctggccagggcaatcaggcaagagaaagaaataaaagtattcaaataggaagagaggaagtccaattgtctctgtttgcagatgacatgattgtatatttagaaaaccccatcgtctccgcccaaaaattccttaagctgataagcaacttcagcaaagtctcaggatataaaatcaatgtgcaaaaatcacaaggattcctatacaccaataatagaccaataatagacaaacagagaaccaaatcacagtgaactcccattcacaattactacaaagagaataaaatacctaggaatacaacttacaagggatgtgaaggatctcttcaaggagaactacaaaccgctgcttaaggaaataagagaggacacaaacaaatggaaaaatattccatgctcatggataggaagaatcaatatcatgaaaatggccacactgcccaaagtaattgatagattcaatgctattcccatcaagctaccattgactttcttcacagaattagaaaaaaactactttaaatttcatatggaatcaaaaaagagcttgtatagccaagacaatcttaagcaaaaagaacaaagctggaggctttgtgttacctgatttcacactatactacaaggctacagtaaatagcatggtactggtaccaaaaccgatatgtacaccaatggaacagaacagaggcctcagaaataacatcacacatccacaaccatctgatctttgacaaacctgacaaaaacaagtaattgggaaaggattcactatttaataaatggtgttgggaaaattggctagccatatgcagaaaactgaaactggactccttccttacaccttatacaaaaattaactcaagatggattaaagacttaaatgtaagacctgaaaccataaaaaccctagaagaaaatctaggcaataccattcaggacataggcatgggcaaagacttcatgactaaaacaccaaaagcaattgcaacaaaagccaaaattgacaaatgagatctaattatactaaagagcttctgtacagcaaaagaaactaccatcagagtgaacaggcaacctacagaatgggagaaaatttttgcaatctatccatctgaccaagggctaatacccaggatctacaaagaacttaaacaaatgtacaagaaaaaaaaaaacaaccccatcaaaaagtgggcagaggatatgaacagatacttttcaaaagacacatttatgtggcccacaaacatatgaaaaaaagctcatcatcactgatcattagagaaatgcaaatcagaaccacaatgagatgccatctcatgccagttagaatggtgatcattaaaaagtcaggaaacaacagatgctggagaggatgtggaaaaataggaatacttttacactgttggtggaagtgtaaattacttcaaccattgtggaagacagtgtggcgattcctcaaggatctataagcagaaataccatttgacacagcaatcccattattgggtatatacccaaaagattataaatcattctactataaagacacatgcacacatatatttattgcagcactattcagaatagcaaatacttggaatcaacccaaatgtccagcaatgatggactggataaagaaaatatggcatatatacaccatggaataccatgcagccataaaaaagaatgagcttatgtcctttgcggggacatggacgaagctggaaaccatcattctcagcaaactaacacaggaacagaaaaccaaacattgcatgttctcactcataagtgggagttgaacaatgagaacgtatgggcacagggacgggaacatcacacaccagggcctgtcagggggtcggggctaaggggtgggatagcattaggagaaatacctaatgtggatgacaggttgatgggtgcagcaaactgccatggcacatgtatacctatgtaacaaacctgtgcattcggcacatgtatcccagaacttaaagtataatttaaaaaatggggaaatcaaaaatgtgtttaaaggaaaattaaaaactgtatatatctactatggttgtagggtaagaggtaaatttggaagggcagtgaagatggagaggtgatgtcttactgcatgctaagagctagctctattataacctcatcatagagcttacaaatcaagtcaagactcaaagtagaaagtggcttgctcaaaatcacatggctagaaaatagaagtgtttagttagtgtctgggtctttaagcctaacagatcttccacaatacccactgacacactcacagttgtaatggctcacagtgagagcataaagcatattgaaacaccctttatgctcctctgggtccaaggtgtcctcaagaattatgtaaacaatttaatactaactaatcacaagggtctttttaaaaacagtttaattgtattttaactacagttttgtgtattgtagtttaattttgagattaagtgtagatgcacatatagttctaagaaacattgcagagagaacctgtgtaccttttactccctttcccatgatggtatcaccttgcataactatagtagaatatcacaaccaggaaattagctttgatacagtccactgatcttatatggatttcatgagttttacatggcactaatatgcacgtgtgtgtatgtctttagttctatgccattttatcatgcatgtatattcctacaatcacctccatagtcaagatacaaaatagttcaccacaagagtcctcactaaggggtgccttaacatattatttcactgaacatgaactacatcaccagagaaattattgctgacctctgaatactttatttcctacctggatgtggatttgagtaatgaagagaatcaggctaaccaaaaccagaatctgaatcaaagaagatgaaagtaaattggtctaggtgtatcaatggcaaaggaacctattttaaaaagtcaagaatacttttaagatggtattttataaagatgcatataataataaacttaaactttcacatcttcaaataatcaggtttgactttattttttccttgaacaggtaatttaacttctctgagatggagtttttcatctgtaaaatatggataatcatacctacttatggggcaacttttgaagatgaaataaagtaatatgtttaaaaggcactttaaaaatggtaaagtactactactactaaaagggttataatgatttccatgaagaggaaaacaagtaataaataattaagctgacatcaataaatgatttttgaagagaaccttccaggatatactgtatggtcaatattagcttatccaatctactatacattctactcctcaggcctacaaaatggccatggatgctgttcatgataattcagcaaagctgaaaaattcctaaacatcttgtatctcatccaaggaagagtcccctgaaagtttttaaaacttggagattggtcaatttatgaatgaatatgctgacacccagagctataaagtgacttttgagcctagtattggtatttttctctatttaaaatctctgacataaggtcccaaatacatagtaattgtgagttttagctttaatatttaattgaccaagatagaagaaaattggtgccccacagaattaggaacgtggtaaagtgtggaagcactggaatcatgaaccaaagttatgagtctcagaactggcctagctctttcataaagccaattcacttagcactagtctcatgaggggcaaatagggttagctcttccaattccttggctgcatacatttctatattactactacttttaatggcaaaaaccacaattacttttgcgccaacctaatactaagtatttaaactctccttagttgatcttacacatcatcaactcccaggaaagtggaacactgaatcaaatacacttcttgttcataaaggtatatttgatttctaccatgtaatggagtttcatcttttaaaacaactattatgaatcactctcttctcaaaaaccttccctcgcctccaaacagaaaccactctgaaagaagcagatcttagtgaatttttggaagctgtggccttgtctgatagactctgtttaaacaccacttttacattaaatgccaaatcctcagctctatgcactgcctcattagttattaatgaggcaacatatttgttcaaaatttatggttgttgatttgctcccatcactgtatgaaatattaacatagcatttgtacttgcaaccatttgcagacattagattgtgcatttgcatattcatgaacactcataaatgtttaaggagacagcatagaaagcatgggcgctgtcagacagacagtaaaaaggcatatttacagcgttaataagtatttgagtttataggccaaaatgatgagcaacaaattaagtgaaattctggtttgcctattgcagagacctagggattttgctattttttaaagcttgtaaacttgaaattcatttcatagatgctgaataaacgcttattgtttagtcacaaaatatatgcactctgtgcaaagaacttcctaagagtatcaggctcttggagatttcatctcactctttctgagatgcagtttttgtctgccttggggttcccttctatcaaagtaatgtgggaaggcaaatgtgtcatatacttaaccagaattattttctgttttggttccacagaggaacttggacaaatgatatgtttggtgtaacaacaacagccaatgtacttgactcagtctgtcaatttatacaaactaagtcctggcaatgaaaaggttcaagcatggagcactaatggacaatatgagggagaggcataaaccatccaactaacaaacaaacgcttgatttacaaataatccatgcatacgaatgtctgccaacatcccaccaaacccattccactataagaaatctcaccccttgccacattcctaagagtcatggtgaaaaatctagacccttttggaagttttatgggtaaatgatggagaaagtattacattaaatctctacctcacactatatacaaaaattaattccaaatattttaagagaattgatgatgaaaggaaaagctataaaacttatattatgtaaaacaaatataggaaaataatcttcctgacctcagggcaatgggaaaaaaggaattaagccatcctgtgggcagtatcactacctgtgccatgccattgttaaatgtctcaaatatcatctctgggtgaatgaatgtgtgagatagctcaccatatccttgtaccagcaggagagggaggtcatagattggaacatgggttgtagttggcttctgttgccatggcctaattgttctgctggtcacttcttgcccccttggcattactgctgaaatctgcaactagtagatccatggtcttttctttcttggcacagcaaggatattcttttcctctctggtgacacgctgtgctgcaacttttgctcattctattcatctatgaggtctgaaagttcttttcatttattctttagcctaggcaacctcctcaacaggccatggcaacaaggccacttcaccatccctgcagtgattcctcagtaattcaccaccagaagcaccatcaccttccttctgtgtccctccacaaagccagttgggacttctagatatttttgaaggcatattgaactagatggtgttctagggtactaatttcaagctgttgttctcctaaccatgccaccatagcagcaattttattctgatgcatagatttgtatagagagggtaagaaattattccatgaagtgatcccttctcagaattttaaataagaaatggaaaaactttctgtactctcagagttttcataatttcccctggggtaggagggcaggtgcagaaggtgagtccaacatgtttgtatctgatctcgtctctttctgacccccttcccttccatacaatcatcttgtaccaagagggatgtgcttttccttcctcttttctgtgcagcaatatcctctcttacatcctattctctttccagaaatacattgactctgctcctttcactagggctatggtggcagaaaggatacagggaaaaacacactgactttttgagaagagaataaaatctaacctcctatgcacacagcctttgatgagtcagaaacaacacacattacacacagacatacacacacagattcacacacacacagatacacacacacatgttaacttctactaatgggaagaaatttatttattaattcaacacacatttgttgtgactccatgtaagcacagtgactctcatgcaaacacagtggtgcacaaacaggaagctatttttaaaaataaagctgtattctacacttcaaggaaagaaataagtaataaacaaaataaataatactgaatatatcaagttattataaaatgctaaaaagaaataaggccaggtaagaccatagagaatgatagatgaatggaaaaatgctttattggatgtggtgactagggaaggcctttatcataagataacatttaagcagggaacggaacaaagataaagaaacagccacgtggacgtgtggtggaagatcgtttgaaggaggagaagagcaagtcaaaggccctgaggcaagagcacactgggcatgttcaaggttggtcatgaaagccactacagtgggagtgcagggatgagtgggaagggagtgggaggtaagatcagagggacggtgagaggatggatcataagcttagatcacaaatttggatctgcatgatttgggaagccactgaagaatttctagcagaaagattatacgatttcatttacattttcaaggaagccatctggctactatgttgggaacaaatttaggtggcacaagtgtggaagctgagagaccagctaggaggtgactacaatattccaggtgggacaggctcagactgaggaattagctgggaaggagagagaaatagtaacattccgggggaatgtgagatttgcatatggggtgtaagaaaaagaatcacagttactctatggtctgggacctgagcaaccagaattatactgatatgaagccaacagtaggaggagcaatttgggggtggggatcagagctcagttttgggcaggttcaggaggcagatctcaactgaagggaggccaaacaagcagctgcattctagagttcaaggagtaggtccaggccagatcagcaactaagacagtaactagcatacagatgacatttaaggccatatactaggtgggatctcccagggtgggattttagacagaagagaaaacagggtggatcttgatctctggagcactctgatgtttggaggtcatgggtctgaggagaaactagcaaaagagacagagcagttactggggcagaaggaaaagagaagaatgttgaaataaagaagtgtccaaggaggagagactgtgttgagtacagcctgtcagtggggtgggaggaggaagaagaactggctgttggccctggaatgtgggagcattggtgcctggggaggtcagtgtccactgggccttaccatggtggctcataggagaaagaagaggagaaaaaagttttgagagtaagtgaattttgatagagataactttgagctttactctttggctcagtaagatgggttccttgggaggacagaacaaaatggagaaaccatcttctcttcctccctgaaaagggcctgccctgaacaatcgtgtacagggagtacaagtccctcattcctctgcagcagcaggaaatgggctctgtccaggccactggactccactgatgtgctgaataagtggaactcgtctttttgaaatgaatgcctcgggtacgtcctgttcccagctccttctccagcacccgcagcccctcggctgacatttcagaaacacagcccaagctgaaatgggcagcctgcccatggaagagatggggcagagggagactgtggcctgttcacacagtttggtggaaagtgaagactgaaggggcttgtaagtagcacaactaataaagctcctatttatctaaacccacattccacagagcttcacagatcttagagacatgagctcattccttcttctcgctctgaggtagtgagtcaggttccttgagctttattttacttatgaataaaataatgtgacgaaccgagaatcctagcaacctcaggaccatggatttttcagcattttcagagcgctctctgtagctgagaagctcaccagggcaaaggaaccccattagtgtatgtttgaataagggagacaagacaagaatgtttaaccaagcaatctaagtccaaatatggaaatgggagaccggactgagctttgcataatgggtcagtcccgggttctgtgaggatttagccccttggcctctcattctgactccacgtggggcaatttaatttctctctgcttcagcttctttccctggacaacggagatcaaaatagaaccacctgaggatacagtgacatagtacacatgggagacttagagtagagcttggcacagggatgggcatggtggctcatgcctataatcccagcactttgggaggctgaggtgggtggattgcctgagactagcctggccaacatggtgaaatcctttatctactaaaaatacaaaaattagccaggtgtggtggtgcacacctgtagtcccagctacttgggaggctgaggcaggagaatcacttgaacccaggaggtggaggttgcagtgagcagagatcatgccactgcactccagcctgggtgacagagtgagaccctcattaaagatatttgttaaaatatttttattattatcattataactattgttattattatttaaagaggataagagaatatcaataaaagaatgaaaaccttcctggctcattcaagctagggaagaaaagaattttatctagaaatttggtaacaccaaacagaaaactgttgctttagttatggtaactccagctattttaagaagtaaagcccaaaatttcagtggcttaacacactagaagatgattttttgatcacatagtagcactgggcaggcgagctgattgacagccctcttccacacagtggttcagggacccagcctggtgccattttcaatatgaagctttcaaggcaactctggatgtcatttctgttccagaagggggaaaatgcatggaggaggataagtcgaggcatgtgtgaggaagaaagctaatatacatcaagcctagaaatgaaacattattttctctttcattccattgagtagacttctctcaatgtgtatctctcagaattctgagaattctctcagaatgcgtatctcaacaaagggggatagatatcaaataagctgttggatataagagtctagaatccagagaataggtacagactagagctgcaaatgagagaacaaaaccctgccaacggaaggtggaatgctagaaaatataaaccctgggtcagaagccacttcccagccacatgtctatgctgtggaagcagaagtgcaagtgttaagatcccacacattctgggtgtacctaagcatgtagatcagaggaagatagctttcttggtaagaaaattctatattgtcaccacttctcagccttttggctaagatcaagtggagaaaattccttttcggggttccaggatacaaaaattagggcttcaacctaatatggattgggacttaaatcaaagttaatttgcaaaacaaagtaataaggaagtagcttcttgcactggccaactgaagcaaaaaggagttgggggcctgggagtggggagagatggagagatagctggtgagactgaagcggggcagctatggtggcctcctgaaaataatggcctttggagcttgcgaatggaagggacagtctagggactgcacactgctgacttgtagtggctgtgctctgctcacacagcagtctttctctctcctccccaagggtagatctaggccctgggtgacctgacacttgtacaatttgggaggccctctgtaagagtacaaaattacaaatactaaatttagtcacaaaagtgaatatttatttagaacaagaaaaagaatcacaacaaattacacattttaaaggtgacaaattccacagacatcatgaaatccagacaaatgacacaatatttgtattaagtaatggactgaatcacttctataatacattttttttctacatcgtttggctcatccacctcaatttccatttctacggttttataatacaatttttctagagagaaaggataatttaatcattcctctaggatacttgattaaaatgcatttttattgttggtaattttaaaatgtgtttgtcagattcacaactagttattgaaaatatgatgtatatttttaggatcattttcaaatttagaaaaatttttatcaagtttcttgtatgagctgttatagacgtaattcctatctatagaactactacatgcttattccctacaagcacaaggattgtaatatagtctattctgcacaattcccattgagaaaagaagaaaaaattacagtgcatttataattttaggtgctgaaaaattgagtacagttctgaaagatcacttctgttttgatcagtcatcaatgagaactgaatcctccacttccaattacgcatatctggtcatttgaagatatcacacaaactagcttctggcttcatactctttattgtttttcttttgtcgaccatatctttgcagcatcgggtgctatgggatacctgcatttcactgtacaaccttggactctccctccctccatgagcaataggagaactcctaggaacaagtctaacactaggacttccagcaatcttgagactaaagccagaggtcacgtgaactacataaactaaattcctccaaatacaaaccaagcttcccaccccaactctccttagctgaaagggtgctcacaggtactccaacacctcctgaagtgtgttggaagtgtgcccaagtggaaagcatcaatatacttcatcaattgctaagaagatatcatattgtaatgttattagtaattcaattattaaaatgtattagtgttacttcatttaaaaatatgactatgggtggggcgcagtggctcatgcctgtaatcccagcactttgggaggccgaggcaggtggatcacgaggtcaggagatcaagaccatcctggctaatatggtgaaaccccgtctctactaaaaatacaaaaaattagctgggcatggtggcgggcacctgtagtcccagctactagggaggctgaggcaggagaatggcatgaacccgggaggcagaggttgcagtgagccgagatcgtaccactgcactccagcctgggcaacacagcaagactccgtctcaaaaaaaaaaaaaaatatgactatgggtgtaccttgccttgacagagctaagtaggtgaggggttcccagagcacaagtgtcattggcttcctggtaaaacacttctggttaactccacactctcaaatgaaggggcattcagcacacagccttagttagcactttcttgttttgttggttccccagggctgctgtaataagttgtcataaactggggggcttaaaatgacagaaatcaattatcctattgttttggaagctagaagtccaaaaccaagatatcctcggggtcctgctccttttgatgactctagggaagaatcctggcttgactcttccagcttctggtggctcctggcaatcactggcattcctgggtttgcagctgcctcactgcaatctctccctctgccttcatatggcctccttctctgtgtttctgtgtgtcctttgctgtcttatttaaggaaatccagagtgaatttaggctcaccctaatccagtatgatctcaactcaatccttaccttaattacatttgtagagatgctatttccaaatagcatcaaattctgaggttttgggtgtaacacaattttttttggggggggcattattcaacctcttctagttgggaagtgagatgggagaattgacctcggtggcaggctggggagagttaaagctgtacacacagaagggaacactcccagatatcaaaactgaagattgaggctcagaagtgaccctagagcattaagtgtaccttgcaagtcttgggcatggtgctgaacttcccagtcactggcaggggtattgacattgaagcctggaggacttgatagcctgtgcgtggctggcaccctgggctaccattcagttgcatgggtgtgtatattatgagtcctatctgaaatctggctctgtccacacttatcatatcttttctgttgaaccagttcaacctgccatctccggaatttacagacatgatacaagacattttgtacatctgaacaagctgcacaaaagaccattgtctttgcttaggcctgtctgcccttggatccattcttctcctgtcttctagggaggcatgggaaggctgatctttgaagacttggtgatatgtttaggctttgtgtccccacccaaatctcatcttgaattgtaatccccataatccctacatgtcaagggagagaccaagtggaggtaattgaacaatgggggcagtttctcccatgctgtatttgtgatagtgagtgagttctcccaagatctgatggtcttataaggggctctcctccttcgcccagcacttctccttcctgccaccttgggaacaaggtgccttgcttcctcttcaccttcttccatgattgtaagtttcctgaggcctccccagccatgctgaactgtgagtcaattaaacctctttcctttataaattacttagtcttgggcagttctttataccagtatgaaaatggactctttatccaggctccatgtgagagagctcccagcttccagggggaagcactggtggggaattataaggtgggagggcgaaagggagaagtcagaagtcagagtatgtccctaccattccccaacttcatgcagtgactctgatcacagatgtgtctccatcttgaccccagatccacagacaggcctatctggtcaagctccactgataggtccagcccctgggatcttcttttctcctctagccatggggtggtaggggcttcctgctgttgttaatccctcattccccaccagcactcctcggctcttctgtcactccagtaaccaattctcgcattaaaatccctcaattttttttttttcaagatggagtctcgctctgtcacccaggctggagtgcagtggcgtgatctcggctcactgcaagctctgcctcccaagttcacgccattctcctgcctcagcctgccgagtagctgggactacaggcacccaccaccacgcctggctattttttttgtatttttagtagagacagggtttcaccgtgttagccaggatagtctcgatctcctgacctcgtgatctgcccgcttcggcctcccaaagtgctgggtaaaatccctcagttttatgcactgagattggatcctgtttccctggctgaagcctaactaatcgaactacaaatgttaaaagagggaatgaaattttaattaatataaatcattttatcggttacattaataaacagtttaagtcagtatattagttcatgttgacagatatatgctaacacatatatacatacatgtatgtatgtacgtatatatgcatgcatgcctgcatgtatctatgtatgcatgcatgtatgtatgtttttgaagaaaaaaaggaggaagcgggttaacttccgatgagaaataattgccgatttcacttttgagaactcaataacttgtcatattgatttcataaaggttaacaattatgatttatgaagaaaacacttgattgttaatcaattatccaccataaaggatggtggctgattgggaccgtgcagatcaatccagcaccaagagcatcctttctgtgacaagtgaccatggggctggccgctaaaggtgtagtttgtcagagttactccaaggtaaaaactcagggcttttaagtaccaagttcttcttttcatgtatcatcaaaatatacaattgatgaaattttcctctcattgactcttgtgtgtcacatcttggtctggttgtcactcctcagcaaactgctatccccagtacgtatggtttgcagggtttaccctgacaaaactatgtggaagtctcagctcctcatcaatgtcctggcctgtctcctgctatctccctggggcttttccagagccttcctttctttcctccttttctaggcttcagtctgctgccttggccttgatcttccatctgtaggggaagatctcatcaataatgttaatatgacttaatgcctcctttcccagaactattgacatgctttttgtgtttccagacaaacaacaacaaagcaaacaagcaagcaaaaaaactctaaagcaaaggagatccaaaaggaaaattccaaatgccttggcatctgggtagggcaatattttgcagcaagaagtctctatcatctctgagtcaccattcataggaaacagctcagccccttcggtaaaagaacctagcccttcccaaactgaaatgctaataacttcagcatttaaaaaacacagtgtggtatagacactgatatctcacaccagttaaggattcatcattcctgacaccagatggtatttgagacatgggattcccccatcttgctcctttagtactattctttcttgcaaacaaaaagctttttaaatggtgagtaatttgtaaagcataaattggatcataaatggatatttatttttacgtaaatcttggcaaactgaggcagctactttacagaggtgattaaaatttaaaaggcagcattgcaagaagaagataataaagggtcattatttacaatgaccatatttacaataaaatgctaaatttattttaataaatactaattttatatttatgaacagtcattcatagacaagacaataaaaactttcattcctgcttactggatttttctgtacagcatataaatcaaatccttcattcaacactgcattcatactttgagcttgctatgttttatcagagtagtcaagtctgttgtttcttaaatctgttttctttataataaatgactattgatttggttagcactcagctccaaatagagcagaataatgctaatagtccaagaaagagaggaaaatgagagagtattttatcagcatgtttcagaatcacaggtaaaaaccatggtggttagcaatttctttgtacagta

SEQ ID NO: 397 - DNA, 87603 bp, Homo sapiens
gactgctttcttattaagcgatgcaggtctcattgaaataagtacctttatgaaaatgatgcttttctgatttttgtgaaagattgaagcattttagggtaacttggaacattatgagatctagtttccggagatgtgagtaaaattaactccatgttgtgaagattttcaaatgaaaaaaatattacagaaaacgtttagggaaggctacccgtgtctgaggaggtgtgtgggaaatctctataattttctctttattttgctgtgaacccaaaactactcttaaaaaaaggaaaattttataaaaacagtttaggggagtgcctagaacttagcaaatgctctgtaacttaatgctcaataaatgctagaatatgcttctactagatctggacccaaaacatgaggctttacctattaaaagttaagaatatttatcagaattatatgcaagcatttcgtgaagcatcagatatgcagtatttcatttaatccttacggggatccggtagcacaggtagtccagccacttggcagaagaacatcctgaggttccaaggggtctgtaaatgccccaatatcaaactcagggaaaaatcagaaaccgagctttgtttactgcaggttttcagttcttaccactatatgttactgtccgtcatgacaagaccggagatgcaaatatttttatctcaaaacttcctacatgtcctgtggcttcatccacaatgtttatttcttacctgaaatcatgctatgaagaaagtattgcccaaaacacatttggatgaggtggcatattagatacataacttttgatggttacctgaggtggcccctgaacatttcgcaaacctttcatgatctcactccagttttatgactttcctttctcccacacggagatgctgagtgctgtattcatctttctgcctcgctatttttccttcatttccttcattgtctgcttttctggagcattgtaccaaatggcttggttgttctttgctgaacatgaaggactgactatcaggaattttcttttgtcttctggaattcactggctttttaaaaagtcagatatccccttcgactagatggattttatgttttgtttaatttttttcttcttgtgggtaggaatgtgtcatactgagaggcacgtagtatatctatcttggtattgacagcgttgaaccatatgtacacttttgaggtatctttgctcttaagcttgttgattttcctcttctgaggatgcatacgaaccaggtcatctgttgcaattaaaaagaaagaacatttttaaaacaagaaggtctaatctctttcttgtgcaaacaggagactgaggcccagagagagttaaataacctaatcaagaccaaatggctggtaattagcagacatgagactaaacttatgccccttttagtgattcatttagaaaaatatatttttaagacatttttcagaatactaagggagggtttttaggtataaagaatgtagtgaatgcatctttgaaaagtagcataaatgacttgaaaaaatgatattatcagtgaaggcacttcacatattttatgtgggggtgtctctcatacttggggcagaccccactgccattgattctgttgggatatgatgcttgaggttcttattcttaaagataactgcaccaagtttgccttgatcgttttactatttccttgagattactttcttgagatgatgagaccagcttgaattttcattgtagttgtgagacctttctcaggttgaaatgaattctgataagctgattatctctctgaagaaaatatgatgtccacatttcatagcttagttccgatcacttcagtgccattttcgttctgagacatcttcccgggtctgaattaaataagataataaggtgctctggagtccagtacgtattaaatagatttttttttttttaaaaaatcgaggcctacagagtggaggatggctttctttatggtgtattttctttctccatgttgaagtaggtagcagctagctagtttctttttctttatagagcaatgagttatgaagctcaaaaataaagtgttctcagtggtgtaaataaagcagtagtctgagtaaatatatcacactatgtactgagggtttgctttttgcgttattttgtctctttcttttccttctccgctctggtccagtttatgccattgtgtattgttgacacattaatcttggtaatagaaatggaaagctacttttcattgagaaatagattcaaaggaaaagatgattaatgggctgggcacagtggctcatgcctgtaatcccagcactttgggaggccgaggagggtggatcatgaggtcacgagtttgagaccggtctggctaacatggtgaaaccctgtcttttttttttttttttttttttttgagatggagtctcactgtgtcaccaatgctggagtgcaatggcgctatctcagctcactgcaacctccccctcctgggttcaagtgattctcttgcctcagcctcctgagtggctgggattacaggcacgcactaccatgcctggctaatttttgtatttttagtagaatcggggtttcaccatgttgatcaggctcgtcttgaactcctgacctcatgatctgcctgcctgggcctcccaaagtgctgggattacaggtgtgagccactgcgcccagcccaaaccccatcttcactaaaatacaaaaattacccaggcgtggtggcaggtgcctgtagtcccggctattcaggaggctgaggaaggaggatcacttgaacccaagaggcggagattgcagtgagccgagatcatgccattgcacttcagcctgggaaatacagtgagagtccatctcaaaaaaaagaaagataattaatgaacagaagttccatgcattcccaatgatgtgtttttttatcctggctctataaatctgtctgcattgcagcctcttgtgagctcccagattactgtatccctcctccgtctcacctccatggaactggtggatttagctccaaagctacctggtattgctaacggaggaggaggacacttagaatcttgaggactatcttccctacagagccgtatgcctgaggaggggagacgaatggctgggaatgatctactcagaggggagacgttacttagaattgctgtgttggtgaccagcatggtggtgcttgcctgtaatcccagcactttgggaggtggcagcaagcggatcacttgatgccaggagttcaagaccagcctggccaacatggtgaaaccctgtctctctaccaaaaatacaaaaactagccaggtgcggtggtgcacgcctgtggtgccagctactcaggaggctgaggccggagaagggaggtggaaattgcagtgagcccacatcatgccactgactatactccagactgggtgacacagtgagaccctgtctcaaaaaaaaaaaaaaaaaaaaggaattcctatatctgagagacgttgctttgtaaacctgttgcacaatttctctctccaatgacaacaatcaacagaactagtgagatgatggataataaccaaagtgaatctgttgggaaggggtgatgcatggtagaggagcttcctgtgtgtgtgtgagagctaatcacagccccatggcacgtctgagctcctttcttgtaaaagcacatcaatcagtgtctttctcgggttatcccaaatccttccacgggtagtcataagcatgtgatgtctacttgggatggaagcattctcattgagagcaaatatagcacaactgccattcagaccacagttcaagttgtggcttctcagtgagaacacgtaccaatactaaccctctctgaacatcatgcttaatctgtgaattggagataatgatgcccagggcatagggatgtcagtgcaatgctgcatgcaaattgtttatcagagtgcatgacacagagttaacatgagatgctcctcctcctccttctttttcctgttaatttttattattttcttgctattggcattgtctttatttacacatactcacatgcatatgtctttatcagtcccagatagatatttactgagttcatttaaatcgcaataatttccatcacttttacctgtgtctcaaggccctcttcagcttgggaggacttcaatatgactcaagtaggtacagctttttaaacacatactgtagtcatactcttagctttttttttttcctgtattacctcatttgatcatggggagaatactgtaaaagagtactttttatttccacctcgtgcattggataattgtggccagagatggacagtaactcacccaaggtcaagcaactagcaaatgctggagctgccagttgcaccaagtgggtatgacttccaagttcaaagctctttcttcacgtatgcacttgcctctgaatatcatggtctgtcctctaactgaccccttaggagctggacatgaggtaggtaggaagttgagcttcaagaaggagctgtcagtgcagggtggtccatgaaagcccctgggtctcagatggcagagaaacatgtggtttctttctagaattattcactccttcactgagcccatatttaaagcgcgttggttttgctctaggcactctgttgagtgcagagtatttggtggggtgcaaaaccctccatgtctgagtcctcaggcagcattcagcctggtgggagagacaggtactaatcaaatgcttatgttttcctgtatagttatagctgagataaatgcaatgacaagggaacctgtcctagatttgctgcagaaaccaatcaaaggaggctttgctagggaggcagtatttgagctgagagttgaatcatggatggaaaccacacaggggatctcctttcccttcaagccctgctgctggagccgggcaagttgcaggggaccctgagggctctcagttatcgctcatgcatcgaaaggaatggaactttctgcattagatttctgcagagattagcacttcttttacgtcagaggcatttttatgtaagaagtctactgatttcttcatggatgaaatcctttggccttcttaatagcacgtgtgtgccaggccagctccagaagctgatagattcaggtgaactcagttcatgtgaactcaggagcatttgctgagaagcctgattcctcttggtcagaagaactcactggccgtttctacttagatgggaaggagcattttcatctcccaaacaattttgtgcaatgcctgtaatcagccagcagttgccgtccatttctgcctgtcttttatcattgaacctaaaagaatctgtctgcaggaattaaaagttgtcgttttctctgatatactatgccttgcactcagtacctctaaggaaatgtcacagaccccccaaaactcccccatttaagtggtggaaacatggaattctctagtttcatgatgggattggtaaaggaagatatagctactttgtgaacttggtgcttataccttctctccttttgctagacatgaacctgaaggcaccacccaaaaagtcaaactagacaacatctctatttttaaaaaaggagaggcagactaaacattacatcagcgtaaggacttcagagtcacacagaactggatttgcattctggctttgctgttgactagtggtaaaacctgcagcaagttctttcagattcgtaaacgcccccctaggtcatcctcaaaagagaaataatggtggttgtgcttagagagacttctgcaagtaaagtgcctagtacatggtaaatacttggtgttggatagtaatcattattgccgggcaggaggctgaggcaggagaatggtgtgaacccgggaggcggagcttgcagtgagccaagatcgcgcactgcactctagcctgggtgacagagagagactcatcttaaaaataaaaaaaacatcatcattatagctattaatattgtccaatactaaatggataagaaataaattatttcttatttatactaaattatttctttctaagtctaattgatctaaatacatatgtaaataatagtcattatataatatcatttaatatattaagtcattatataatatcatttaataatatataatagagaaaatgatataacaatctgatacataatgagttttaattatatatttttataaatgatatttatgatttatatctttagattattaatatttatgtatttttataaatgataatcatttatgttatttatatatttctctattttgataattatttccatattttatacatgatgattgtttatattatttatatgtttatttagattgttatttacatatttgtatcagtgataattatgttatttatatgtttatttggattattacttttatatttctataaatgataatttatattatttatatatttatttggattatttacatatttttataaattataatcatatattcatttaggttgttatttacatattataaactgtaatcatttatatattcgcttaggttgttatttacatatttttataaatgatatttatgttatttatataagtttctttggattgttatttacatattttataatcatttattcatttatttatttaggttattatttacatacttttataaatgataatttctattatttactgagttatttggaatgtcatttacatacttttataaattataataatttacattgtgtatttatctatttggatggttattatttgcacatcctataaatgatcatcatctgttatttccatatttatttatttggattgtgattattatttgcttattccttatgtagatccttgtggccctgtgtgtgaatccatgttcttgagcttgcaagccatgtgttggatcatctgttttgcttcgcctttgtggcatgaaagcaatcttagataacacttacataaatgaatgcacatgactgcatctgagagaaacttttttacataaaaatactggctgtgtgttgacttgactggtggaccctagtttgctgagtgacagggttgcctgcacttgaacatcctgctcgtgtggctctgagtagttcttacctggatgacttagtcaccaaaatgtatgttgtaagtaaaagaagccccttggagctaggctgagccagagaggcagttttttggggaaatgcattggtgtcacgtttggtatgcattggatgcagaaattgcatccctgatttatgcgaaaagcaggctattcgaccaggtatcaggagttgtggaataagagatgcaaatgctgtctggaacagcaggtgccattcttagaaaaatagatatgggggatgtagaggaacaccaaaagtatttcccaactatcactcctaaaacaactttgctcagtagctgtctccccctgccactttttaaactctacagcacattttaagtgccttgtccgagcctggccagagggacgtctctctgcttctacaagaataccttgatgatatttcccagctgaaaagacttacctctctcctctcaccctatacccaggaagttttaattttatggagattgaaataatcaggtctcatgtgtatatttcctttcaaaccactgcgttcgcctgttttgaattcaatggcctgtcttatgtactcggtggagaaataatataaacaaaccttgaaatttccctggagttcagcttcccttttcatactgggtctagctaaagtttggagccaactaaaaagagcctcattgccttacacacaccctgttatctctggcgggttcaaatgcaatttctctgagaaggctgtggtacctctgctctctctggccttgaatctgagcgtctaaggatttctttggagtacacacagttgcatccttctgacagacagtgcaaattaaaagatccggcgcggcccaggaaccagggacccaaacttgccccttgggttttcatttacagttaggcactgcagacacaattattgctgacagggaagcggagctggtggcagagtgcgcctgacaggaggctcatgccagcccataattgggaggattatttttaatcagaacataccctacagcccaaacattagaaatctcctgtaaggccaagacaggaaattaaacacaccaacaataaggctcaaagggaggcggtgtgtggggtgtaatattgttagtctctcggaggtccctagagcttcggggagaagtttgcttccctacagagggaggctgggaggaacagaagcagacacagagactatacctgagcccttgttgaatgggcaaatgcagccaaattaaatgcagcagaaacactaattgcatttaagtgcaatgtgtaatgcgtttgtttcttgcaaatgcaatgacgcttattgactttagtagtagtagtagcattttgagacagagtctcgctgtgtcgcccaggctggagtgcagtggcacgatctcagctcactgcaacctctgttcaagtgattctcctgcctcagcctcccgaggagctgggaatataggtgcctgccaccacgcccagctaatttttgtatttttagtagggatggggtttcaccatattggtcaggctggtctcgaacttctgacctcgtgatccgcccacctcggcctacgaaagtgctgggattacaggcgtgagccaccacacccagccgcttattgcctttaagcagcataagccacatgtaaaccttggaatagcggatacaattgtatttcatcagtaagagaagagcctcactggttccttatttttaggaatcttcagtgagcacttactacgtggcaggtgctgtgatggcttatgatactaggctatgctgaaagtcatctggatgatcttattgccttggcaaaattttgcacagcacagtaaaactttgtttattaaaaggattgttgttgaagaagtaggcgtagcgcttggctgtttggctccagtaatatttatttagtagtagtgccaggtaatttagctgtagtgtcctcacatcaaccctctgaggtgggcattattatacccattctatggacaaaaaaactgaagctccaagcggtcaagcagcttgcccagaactaataagataactgactttgaaaccaaatctgtgtccaaaacctgtaggatgtcaaactatttgtcaaactgtactgtcactcatgaatatgactgggcacagcctggtgcttcgaggtgctgccactccaatagaaaagacagatgtagagacagatgtctacaaatgaagagtctatagagatgctaactggattctaagagtggggaacatggcatgattcactgtgcttggggagtcagccaggactccctgaagctatgaagaacaggtgcaaatttaccagtggtttaaaaaaaaaaaaaaaaaaagaacagaatcccagacataggaaacaagtagtgcacaggcacagtgttatcagagatgctaggacatttcaatttagtttagaactattggcttgcctggatgtggtggctcacacttttaatcccagcactttgggaggccaaggcgggcaaatcacaaggtcaggagttcaagaccagcctggccgacatggtgaaaccctgtctctactaaaaatacaaaaaattagctggacgttgtggtgggcacctgtaatcccagctactcaggtggctgaggcagaagaatctcttgaacacaggaggcagaggttgcagtgagctgagatcgtgccaccgtactccagcctgggtgacagtacgagactctgtctcaaaaaaaaaaaaaaaaaaaaagaataaaagaactattggcttttgggttttgttcttgttaggctcactcaacaaatataaagggagaaaatgaatctctctttggggaacgctcatcacagagaccaagcatctgatgtggggatgggatgggaagcaaaaggagatgatgttggagaatccgctcctgaagtcaaaggatattccatgctgtcctcactgtgtgaaatgcctacgcctgatggcagggaaaggtggtgctttaacccatgactgtccttagaaaagcaaccacaggtttacagtaacattacgtattgcttctgaggctggagttcagggtgcagagatcttcagtgagtccaggaaggcatgaatctttcgcatggcagactgaggcccatcagatactctgactgcagtagtggttactgctaagcagcttcctgttatgtggctgggagtcactggattcccatggggagggcttctatctccaatctaaggtggcttcagtgcacttcctgtctagttcacttctcccatcccaggtgtgatgggcactaacctctctaccaccaggaatcgcacatcataatccctgagtggtatcaagcaaccctgggcagcttgctgatttggcttcagggtcctttcaaggacagttaaacgccagacacctgaatgaggtcaggggctgctgtgaggcttggagagcatgtatgcaatcataatccctgatgtgatcaagatacagtttgcttccctgcctgcagggtgggtacaaaatcccaacttaggtgaggcaccaccctctgagatggtcttatacataattgcattgtttgctagcaacagaaatccattcaaactcactcaataaatgggcatgtttcttacacagcacaggagcacagaagtgagtttcagcactaaaagtcaggaggtgttctaggtcccaggaagaaccagcatttctgaaccgctgtgtaatcaggaaacaaggcagcccttaccctcccgccccaaaaccctcctccatggctcttccactctcttcttcttctctctctcattgctacttctgctgttttctgcacacgtggcagagaagagtgaccccacagttactgacgacacttaagtgtgccttgcaaattcctaggagaaaattgaacctagatagggtgaggtttcgtctgttctgaacatagcacttactaatggagccaggatcaggcgctgcagacccaatttctggcactatgctagacagagatggggaagggaaatgacttttggggaggctgagtgtgtctaaaattagccataggatgactaagccgatagttccttctttccttccttccttccttccttccttccttccttccttccttccttccttccttccttcctccattccttccttccttccttacttctttccttccccctccctccgtccctccctgtttccctaccttccatcttttcttccttgggtaaatatttactgaatgtctgccatatccatagcattgtgatcagagttaaaatagtgagcaaaacccacacagctcctgccctcatggagctaactaacatgctggtgagacaggcaaactttcatcaaataatttttctaataatttttaattggatgcaaaatgcaaactgggatatgggctatgaagaaagggtgatgggctcttaaagccatgtggtcagggggttccaacaggaagcagcaatgcactggagttaattaggtgctaaaagcatccccagtcaaagccatagcatgccaggcatccctgtggcaggtgaggagtaaagtgtggtccagaatgggaaagtccatggtgctggtacccgggactggggggaagtgtgatctccttactaacaaataaataaggctggagctgtgtctaggagcaaatcattagggatgtcaggagtaaggtaggtttggaatgaaatgggaagccagcaatgtaggatttaaacaatcaagtaacacagtcacatttacattttgtaagggtcacactccttgacctgcatgggggcaaggggtgcaagcctggaggcaggaggagatggcattgcattcattgcctggggaagtctatgaagcagttcatggcagaatctatggaaacagaaacgttgcagtagccagccctgtttagagagtcagagttagaaaaaaactacattctggctgtccaagggtcatcaacaccagtgttttggaagtaatcggtttgctattttgtgcatccatttggatggagtgcataggtgaaggtagctaatgcatgaactgagcattcaccttcattctgcctgactttgttccaatgtcctccgagtttccttcacttgcagctctttagcttctgtgtaatcttggtacaatgaaaattgtgcccaattccactgggacctgagattctccctggtcacaaattgctcttcacgtagtttgcaagagtaattgcaaactcagaacattttagttaaaaaaaaaataacactaaatcactcttctggaactctagagagcatattagggttttcttgctgtctggtaccattgttaatgatcatttctgttctcgctttataacaatggttctcagcctctgtttttataaaataatccccctaaatgactttacaggttcttattagtggaaaggaggggctataaaattcatttcaactgtaggttggattaagaccagatgtaaaggtgtgggtttggactcagatggacatgaaattcaatgttattacctgggtaccaagtacggtagcaccaaagaaggcccagttgctcagagaaacctctttctggaatgaaggtcaatgtcctttcttggtgctgtaaccctctggggcaaggaagaatcacttgttaggctacccaatgtagtgagcagtacataaggggccgtttcccagactacatagttacagtgttgaattaaacattgcccttgccttccagaaattcacagcctgggtaggccaagtccacaaaaagttagaaaggatgtatattctgcttctgatagaagaatatgccaatggccatagggacctcccctaaaattcaggcccactggaagggtcaatgaaagttacagagagcacgcttgggtagatgttcaagtctcaagactccagaccttccatgagttcaaatggggccaggtgaagggcagtttaggatgagagaaggttgtaatcgaagggctaaaggaatactagtgcactgtgtcttaagtatttgatttagctggatcttagaatgtaaggatatgttcggagatggaggaagtgacaggaaagagggggtaggagctgaaaaggttgaacctgaccatggtagctattatttttaataaatgagaggatgcatgcaaattttgatatgaagtttgggctgtactagggattcagtgaaactacaactactataattattaggactcagataatcctgcattggaggcatactgtgaatctctagaagagaaccatgtattttgactatttctattctaattattctaactattcttcccaaatcatgttcttccacttctcacctttacgatgtcagctccgttgccacttccttgatggagccttccccactgtccccggtgaagatctgtctatcttccccactggactgtaggcaccaaggggacagttcctgacatttagaaggcttaataaacaataaacttttaaaaagcaccgactttgtgctaagcacaatgctacttgttttacaaatattaacttttaatattcacctgaattccttgaggcaggtactgtttattcccattttaatgatgaagaaactcagacaaagaaaggttgagtgacttggccatggtcacaaagttagaaggtagtgaagccaaggatgactggaaagatggatggatgggtaggtgggtggatggatgggtagttaaatgggggacagatggatagatagatgggtggatgggtggacggatggatgaatgggtgggtggatggatggatggatggatgggtggatggatcgatgggtctatgggtggataggtgagggatgggtgggtagatggatggatgggtgaatcggtggatgggtggatgggtgggtggatgggtaggtagataggtggatggatggatgggtggatgggtgggtgagtacatggatggatggatggatggatggatggatggatggatggatggatagatggatggatggatagatggatggatgaatgagtgcatcattgctgtttgttgacactagcccatgagattggtcatttttattagttgaaagaaattgaaaacatcaaaatgcaaagcaaaaggctattgaagggtgaatactatcaccaccatttcaaccactgaatagctctatctattcttgggtctctctgcaggtcacccctctttccaatattttgaagtcacttgatgtttttaggtgttgtaatttatcaacaagaggggactcaccagatgtgaagactacacacacatatatatatccacatacatacacatatgtcatcttcatttatatgtatatctgtatatctatatatctagatatacctatcacattaggaaagggggtatattgtctaaacatatctgcaaataatgtttaaaatttacctctaaatcttgtgaactttgttgagtcttggcgtaaattgtactgctgctttataagagtaattcaattatcgatggatcaggattccagaaccctgcaaagtagtcccgtctctgctacttaagtttctccccagagaggaaacaagtcagtatcccaacccccttgggtataggatgccgtaaacatctttcagatctaccagaactcttgatttttctggtaggagatgacctctctttcaactcactgaactataggagattataatagccatttgcagtttaggtgatatttggtttatttaaatatcaatgaacatgaatctcactccctgtgattgggtgatgatagccatatttatgaaatttattactgctaggataccttgtatcataattctactcattgcaaaattaaatcatttccatatttgaactttaagtaagtatcacctgaatgcacattgtagaatcctgcagttctagcgttgaaaggaaatttagaatttatttcatccaagctaattcctagggggaaaatccataatgatatatctgaaatgtcaacctccagtcttaccttgaacacctcctgtgacaagaactcatggtgtaagagaagaatacagaagagtacttccaagcttggtgttgacttgcccgagttcaaattcaggcttcacgatgtacatgcatgtcttgtcaactgtgggagctgtctgggcctcagtttcctcttctgaaatagagaagataataacaccttctttgccaggatctgagaggatgtaataaaaatacatcgaagaactgaatcattttcatcatcatcatcaccatcattgctgttaaattcacaatatagtcagaacctattttgaaggttggtccatattactatgacaaaaaaagtgcggacaaaattcaagaatacatttcttgatactaaagtcattcccctttttcttctttaggaaactggtcaaagaactcatgcaagtggaacttacagcttccttgatcggactcagcattcagtaagtgcaacccattttgaacattcattccataaatacatccatgtctttgatcctgttctctctgaaaagctcttttctgcaggtttgaagttgttacaaaaactttgctgcctgcctatgtctttctcttctgccctattgtatcagagatgagaagagggcctgcaaggtagaaccaccctcctttagccctccctccccaatgaacctgggaaatttgtgaggttatcaatgagttaactgcgcctttattagctggggattaaaataaaatgtgtttttggtttctttttttctccccctaaggttttcttatcaggagacattctgtcccccttctgagtcacatgaccctgcaaagtagaaagaaatgccagcaaacacagatcagttaccgagagcatgtatttcttgaggcatttaagaacagttcatttgctctttttgagctggaatacatgactatgatctgaaaattactgcaaaaaaaaaagaaattttttactttaagatgctggggtacattatagaaatttcatttgttttcagcaagtaagcatttttccactttctgcctttctcattgcatgcaaggactttatttttggtgaaggtagcagtattttgtccaattttctcagctctctttttttatatgcagatatactctagcatttggggtagcaccttcacaaagtctctgatgtcagccctcctctgcaatagttttatgggtgaacagcttgttttaagaagaaatctgtaataatttaattataaatatcaaaattttaaaaggctagctgaaagaaatatttatttttcaagatgtagcttccttcataggaatgcagaatttcttagcaggttctacttctgaaagtgctggagtataatttgatacatcaaatatcagcccatgtcataaaggagcaggtagaattggaggacatgggactccaggcctgcaagaggctgatcaaagggaattcttttgccctcagtgggattgcaggactctttctattgtcttggaatttgcatattcaaatgcagaggggaaggaggcagagatagaaagaactaaaaagatggtgtattagctgttagctacatcagaatgacttagcgtaaccctgatcagctaacgcttgtatctcacaggagattagactggcagcttttgttcctaataataaaggaaattccatgtctaattccctacgtgccacatctatcttttcatgcctttgaagttcaggcttcggcatttcttgaaaactgggaggttttgtaagtaaaaaggtgggggctgtttggcatgaagtctgttcaaatctatttagtgtaaagttaaatttgcttgttacttgatctttttctgtttaaagcagcatctttctcatagatgcctttgttggtgcttgggcagggaggggagggatggaggacataaggtttcaaggatgggttttcagatcatacatgaccttctcattcctctgtcttctgaatatgattgaaattgctgcttctctgaaagaaattcctgttccaaccctgcactgggattgaaacttttaacctaagggaggctgtggtccctaagataattagtacatggatgtaagggagctcatgttaatttgtctatggatatggtatttctgtatctacaactgccatctaaagagagacattaaaaaaagtattaatttactgctctaaaccagtgagcagatataattttttttaaagaaatcattttagaaaggaagcaatggcaagatgccttattggggatgtttatgggtattgatccctcttagtgtatctagtaggtttccatcctgtccttgggattgcagcttctctgatacagcaaacctcaatccccttcagagaccaagcagtcacttcctctggaacaaacattgaattctgggacgtcgcctggttatcaggaaggcagatgatttgacatctaagctggccacatgcctgggttttgtgtgttcttcacccataacatgttggatgcatgctggttgagaaattgctccagtctcttacaggattttagcaggagcgatgacctagtagttggaatttgtacatggctgacactgggcctgggctgatgttgtgaagaatgccatattttagtctgaatccaggttttgatatgtccattggcttcagaaaattaattttcatttcctgcttccaaaatttggttattcttgtttaattttttccagaatgtttcctttgcatcggtaccctttggattgctgtttgttcaatagtatattacccctcatgatatccacagcatttactgtcgtgttggtagaccatgagtacttgttggatataatgatggtcgaacaggtacaacaatggaaagctgaataggtagatgaatgcttcttaactcctgatggagtattgtgtaaattggagaaagatggcattgacattagacaagagaccagtatgggtgtttctgatggttggtttctattccccaatactcttcttcaaagctttcacttctactttgacaggtctagagtaacagattggccaatgcacatggtgtaagagaatgagctcccaggaaccagcatctgttttctagctctccacatccctttgttgttatctgtgtgctaagaggaaagccacagaaagctcacagtagcagggtcggtgttggaacttaagcctcagcatgattttctacaacttgaaaatttaacttccaagaggtttccttgatctctattttcctatcaggctaaaaatcccatggcatgctgcatcatgtttataattaattaattgtgcaaactttatttttatgtttgtctttttctttggtctagtgctatccaatacaccatgtctgtgattataggaatatttttttttcaccaagtcttaatgaggtattattgaccaataagaattgcgtcaatttcaaaagcatactcttaatataattggctttggtgactgagagggggaaggttgggaggaggttgagggtacagataagaagaaggtggagacagaaagaactaaaaagatggtgtattagctgttagttatatcggaatgacttagcgtaaccctaatcagctgatgcttgtatcacacaggagattagactcgcagcttttgtccctaataataaaggaaattccatctctaattccctacatgccacatctatcttttcctgtccttgaagctcaggcttcagcatttcctgaaaagtgggaggttttgtaagtattgggtagagagggcactgcttgggtgatgggttgtttgggtgatgagtgtgccaaaacctcaaaaatcgccactaaagaactcatccatgtaaccaaaaaccacctgtacccctaaaagtattgaaataaaaataaaatttaatttttttttaaattgcgaagatttaaggtatatatgagacatgttaatgtacatataccttgtgaaatgattaccacaatcaagctacttaacatacttatcaccttacatagttaaccctgctaagagaatagataaggaatattctttatctgtgctgttcaatatggttaccagcagccagacggagcaagtgaacgcttgaaatgtgactattacacctgaaaactaactgaaaactaagtgttctttcaaaaactgttattaaaaaaaaatttgttactttattattattattatttatgagacagaatctcactctgttgcccaggctggagtgcagtggcacgatctcagctcactacagccttcacctcctgggttcaagcgattatcctgcctcagcctcccaagtagctgagattacaggcacccaccaccatgcccagctaatttttgtatttttagtagaaatggggttttgccatgttggccaggctagtctcgaactcctgacctcaggtgatcctcctacgtcggcctcccaaagcgttgggattacaggcatgagccatcacgttaaagtaacataaatgtgttactttagttttaattgacaaacaataattgcacatattcatggggtacatagtgatgtttctatacatatactgtatagtaatcaggtcagggtagttaacatatctatcatctcatttctttgtgtccggagagttcattaatttaaatttaagaacatgtggcttgtaacctgatactgtattgttgtatgggatggctttagactagcagccttataaatacaggggctaggtcagaagtgtccgtccttgtacctaggctgatacttagctgttatagatcaattaggactctgactgataaattgctactgtctcaagccccaaagtgtcctctattccctgctgttccatatgttctgcttccttgaatttacccttgatccagaactaaaggtttaatggtcccctgggactctgcacaatgccacagcattcatctattctaactggttggtgcctaatgcatgctgattattcaaatagtatatcacctctgattatttccatggcatctactgtagtgctggcccatagttcaccatcagtacttgttggatataataatggtcgggcagatagagggatggaagaatgaagagatagataaatgcatccaccttttgatggggtattgtgtaagtgagagaaatataacatcaacattagatgaaatactggtatgggtctttctgatggctggtttttatttcctcagtattcgtcttcaaagctttcacttctacgttggtaggtttagaataatagactccagatctatcactgaattctaatgccatatgcagcacagattgctatacatcttcactcatttctttctgtcacttaaggctcccaatgcataacacttgaaatcagtccacgtctcactcattgacccatgggcaccactctcttctcaggaacctcagtcccaagccttagttactaacattgtctttgtttttcatccgccaccaaatgataagtgagtgttttatctgtatcttctaagagacttcttttcattccctctgttggcatattgctccagggacttcttacttacgtatctgggaattctttctaggtagtcttcatacctaaagccaccttcccttggatcccagccaacagattgcaggactaatattcttgaaacaagaatatcgtctagttggttgttgaataagctcatccttacctaacattttatcttttctccatgaatccctcaatacatttcattccaactgggcaagttcatctcttgatatctaaacatgtttatttcccagctccaagcacttgctacacttggtctcaccagttgggatagcctttcctattcttttagtctacacttctatgtagatctctgttaagccctcctgataatgaatttttctctgtttatttcagctacttgattgccccttgtaggataaagaaaatcctaagccaattttcaacgtaggaagttgaccctatgattatattttagaacctgggtttcagtggaacaggcaggagtggaacagagtaaggaggtattgaaagagaaacaacaataattgccttccagggagacacagttctctcacatgcaaaattcagcagatgggttggaagtggaagaggttaaaaggcgccagttggaatacaagagggagagagaatgagaacaggcatggcctagggcattaccttaattcaaggccaggcacagggtgggtttcatgccagctgcatttagagtctgtggtctggaaggacaaactcatctagataatgctcattgaccatcccatttgctttgacacttccctggccaccaaccacccccacacactgttgtttacatttcccctatgaatatctcttacctctcctaagctgctgcatagcagagctcttttcccagcttccctctgcatataaggggcaggaactctgcagacctttttcgatcgaatgagtacatgagcatgggaggaaagagagagagaaagagaaggcagagagagaaaagacagagagctaaaagaagaaataacaattccttctgcttctttattgttaggacagagcaggataataaagaatggaagttacaaggaaggtgtgtaaagtagtagcatgggtaaggaagagggaagcccaggcagcaccccactgtcagcctcgttcttcttcatcatcttacccagttaaaatctgccatggtgcttatgatgctccctgatgaccagttttactgggtgtgcacaatctgtcttccccactggactggaggagttctgagggcatggggtgtgtcagtcttgcttgcttctgtatccttagcacctgtaaaagtgacaagcaggtacatattttgaatgagttgttcattgagttgaatgaatttgtgctgtgaatgttgatcacactctttgtactttcaaattattcttctgtcatccatgactgccggtggcaacccccatacccccaatctagatcagtctttgaaagattaagggagcaatgcttgtgaattgaccacacagctgtcttttgaaaacattatttatatgtttattaatttttcaatttgcataaatttagaggttgcaagtacagtttccatacatcatgggtatgttgcatagtagtgaagtctgtgcttttttttttttgagatagagtctcactctttcacccaggtgggagtacagtggtgtgatatctgctcactgcaacctacatctccaagattcaagctattcttgtgcctcagcctctcaagtagctggtattataggtgtgtgccatcatgctcagctagtgtttgtatttttagtagagaaagggttttgccatgttggccagcctggtctcaaactcctgacctcaagtggtctgcccgcctcagcctcccaaagtgctgagattatagggatgagccaccatactcagccaactctgagcttttagcgtaaccatcaccttaatagtattcattaagtaatttctcatccctcaccttcctcccgccctcccacccttctgagtctccatagttcatgctctgtgttcacaggtacacttcatttagctcccatttacaagaactacataactcttaacaacacatttgaccaatctggcttcagtttcctgattacaatactgataatgaggaattgaactagaatggagtgtcaatttgttctcacattgctataaagagatacctgagactaggtaatttataaagaaaagatatttaattggctcacagagccacaggctgtacaggaagtatgatgctggcatctgctcagtttttggggaggcctcaggaaacttacagttatggcagaaggcagaaggcaaagggggagcaggcacatcttacatggccagagcaggaacaagagagggagaggaggcaccatgcactttaaacaaccagatgttgttacaactcattcattgctgcaaggacagtgccaatgggatgttactaaactgttcatgagaaactgcccccatgatttaatcacctaccacctggctcacttctgacgttgaggattaccgttcaacatgagatttgggtgaggacacatgctctatatcaaatggtctttaactagggccccatctaacttcgaatttagaaagcaaatgagatatagaaactaggccacagaagagaaggttgaagggaagtatcattatctcagcaagacagagatggataagttacgaccagaagcagtcagtccctccctggcccacctgtgtacagaaattagcccattttctcttgacaggagagtgtactatgtagctaaattaggtttgcaactaaatcagtacagacattttgctttctctttgctataatgagaaactaatattaatataatttgatctacattcatgggttgtagtaacgaattacaggaaaggtacccaggcatggtggctcatgcttataagcccagaactttgggaggctgaggtgggaggatcacttgagactaggagtttaagaccagcctgggcaacatagtgataacccatctctacataaaatgtttaaaaaattatccaggcatggtggtgtgcacctatggtcctagctacttcagaagctgaggcaggaggatcacatgagcccaggaatccaaggctgcagtgagttgattgtggcactgcacaccaacctggaggcagcaaagccctgtctgaaaaaggaaaaataaactaagaattatggataatgaaagcaaatttcacctgcattcaccttctattagctttaacacctatgaggtgaaatctttgtatttatcattatcgttcaccggttaccaactgaagaaaaacagtaatgatatttctgctgaatcccttcatttaaactaaagagtagctctgcttgctgtctcagctcaacctgaggatgtagtgttgttttctgaagacattagtgaatctggaatcacctgattcctactggtggttcctgtagaagactatggaagtcacaaaggatgaaccaaaattttggtaaaataggctggttaatacgatatggaaacaggaatttggtttttccaaattcaggaggctagaatttcttcctacttttgagaagctccaaagcaaaaaaacacaaactttgtccatgtatagatggccagaatggttttattttcctaaaatatatgcctagtttcttttgaattcaggtggttatttgcagatccttgcttcagaaaataccagcccaactccatgcctggcttacagttggtacacagtaaacagtaacaatgattgctgttattgctatttaaaataattatgtgctgagaagggatgtcctctcccactgactgacttgtgtgcgtgagtgtgtgtgtgtgtacatgcatatgcattggcagaaaatcggttaactcttattgaacctcagtccctctgtttaaggagaataaattgtcttgcaaaactgcatggtggtacattctagctcaagttgctatgacattgatatggaagtcaacatgcttatcttggtaatgccatcattccttccttccttcattcattgattcattcataaatagctatggaaaaattttgattttggattctcgctaggtactgaggatatcatagtaaacaaacagatatggtgctgtacactcatgataacattggaagataaaactttaaagtaaataaaataatccatgtgagattaactatcacagactagccaataccagggagggctcaggaatgtaaggatgtgattagtttgaccagatgtgagagaggaccaaggagtatcctagatacaagtactttcttctctttctttgtcccagcccaggttttctcctttctaatctagctggctttcttcatccttctcagagggcattctcctctcagggttgtttcgtctcccagcaatgaccatttacgcttcacagggacagactctcccaccaagtccataaacctgcactctgtgcagaatcattgcccatttacagctgctaatgcattaataacagaaacgtccgtggccatgacctacctgagtcattacacactaatcataggaggcaatttcaagcagattgactagtgatcggtgtcctccctgacgtccaggcaggaggacacacgactgccttcacaaccccagagcagatggcccgagagcataatcacacactacagccggtgcaggtgtggctccaggaagggaaatctccatgtcttgcatgcaaagctgggctctctcacctggaggctgtgctccaaatgctcgtctttcattttggagcagaatccacatctcagggaccttctttgtgctcgttttaaacttatcacacagacagctctctgaagacatggaggaaatgagattcacctgcacctgaatggctctaacatgcaccactgtccacaagccactgtcgttccttctccactttcctctgcaatcccagtccagatgtatggtccaaagctgtggtcatcatgggcttgtgatttgtgttattatttcttccctgaagctgcttaagcattgttttttattcatgttgctctctcattccctgcgatcatcattataatggccacacaatataacatcaggatgatgtttttccgctttatcttagaatatctagtaggtttctgcttttctcactaataccagaatcactagagttaattacttagcacctatagagttttcatctttgggataagtgcctgagaagtataagtcaaaggatagaagcatctttatgactttggatatatttttctaacccattttttaatggatttgctcatttacagtcagttcgttgtattttgggctttctgctcttagctgcctattgtttatttgcccataatgaggactcagattatatttaagaggaactaggcaatgactttgcaattaggagtcaaatagaatctataccttcaagaaacagaatagagagggaatcttggttagaaaataactcattgctctatgacatgataatgtccaagaaaagaaaaaggagtttcagaatacatagattctggtgcaagacatgatttctatacagattcaagccaggagcctctcttcttgaccgatctgagatgaatgccatgttatttcttgacaaaggttaggaaatgaggggtctaatggctcttcaatcccgtgggttactgttctatccataaattcatgtataagaactttgttgcatgcaccgtggtcccagtctgcttttatggggcgtacactcagaagacagcttctgaaaatgatctgggtggaaacgtataaaggttgtgcattgccaatttgcagttgcaaaaatctggaaccagccctaatgcccatcaatcaatgagtggacaaacaaactgtgacacaaacacacataatggaatactactcagccataaaaagaaatgaattagtggctttttcagcaacctggacgggattggagactattatcctaaggaagggaaaacaaaatatcgtatgttctgactcataagtgggagctaagctatgagaatgcaaaggcataagaatgatgcaaggaactttgggcactggaggggaaagggtgggagggggatgaaggataaaagactacaaactgggttcagtgtatactcctcgggtgatgggtgcaccaaaatctcacagatcgccactaaagaacttattcatataacaaaatgccacctgttccccccaaaaaccgatggtaataattttttttaatgttgtgcattgtgaggccaaataagctaggattatttttgggtgtatatgctcaatagaccctatgggtcacatctagcagttcattaagattcaaataaacaaagcagcagtcccagtagaaaatgcacagccttggagacaaccaaatgaggattcaaatcttggccctctattcactatgtatgcaaagtaggaaagttacttaatccttctcagctccagtttcatcttctctcatgaggatggcaataggaaaccataggtctcttgtgaagattaaataaaaattcctttttgggaggaggggatgcctgttagggataaaccttttactatagagaatgggacccaaggagtatagcttgggcagtgatcatttcagcaaaagggagtcgtgattactgctctgctgagttaaagaaaaccttgtgctctgataaggaagaagagagaagagagaaaatgaaagacaaggatccaaccaacaagtgggtgggaatcagatgtctatgtgaaagaaagagtccctaggaaatcagcagctggttctgaagttcaatttgaagtggtttgctgtgtggtaaaccaatccccccgactctgtgtgcccttttctacccttccccctgaagttaatctttcctttcaaaactcatactcataatggtttgagagtgatcatggatggaagttatttcaagtgctgaattcctacctgactccatgaagtggaaagcagttgttgttcctagtcattcttaagataacagctaacatggtggaagttttgcttatgggccaggctgtgtactaagaagtttacaagcatcacctcatttcatccttataatgactgagtgagataggttctgctaattattactcttctacagatgagaaaactggaactggaagaggatacatagatttcttaaagttagacagcatgcaaaagctggagctgagtttgaattccacccatctcaactgtggagtctacgctcttgaccactatactaaactctttctatatgcagaactctgagacaaaagttccagtgggactgtaagtctcatcaaagaaatagtgacaaaggcgattgtcttcatcaggaggtggccttgaggattctggtgcctggagacctcagctaatgtctgggttatatttacaactccacttcttcaaaagatggatgaaggccaggcatggtggcccatgcctgtaatcccagcactttgggaggccaaaacgggtggatcatttgaggtcaggagttcaaaaccagccaagccaacatggtcaaaccatgtcgcttctaaaaatacaaaaagaaaaattaagtgggaatagtgtcacacacctgtaattccagctacttgggaggctgaggtaggagaatcacttgaacccaggagacagaggttgcagtgagcccagatcacatgactgcactccagcctgggtgacagaagtgagactctgtctcaaacaaataacaacaacaaaaacaaaatcaaaaaccacaaggtggatgaagttgatgactggtatgattttaaaaatattgacttctactgtgtagctttccttcatctttcccttcttccccatgcaaagaaagatgaagaacatgagcacactgtacaataatgtatgtctgtagtttaatactacatatctgtagtttaatacttagtatgcaaatattctaataaaaaagtcataaggatagggaagtaaaggaaggagaactattctaaagttcaaaaataccttattattcaaagcacatggtcttactcctgcgtagtggtggctgaaacagattgcaagctcctttcctaaggctgactctgcaaacatgaggttttgaagaacttgaaggtttcacacctgcacaaaggctcccaagaagccttgcacagcagctctcgtagtactgagctcaaagtcactgatgattctgttcaaaccctctagtccccactatgaaggctttgaaaagggatatggtgaaaggtgaggaatcagaatagggcccctaacattcctgtgatgctcttcctcatctcttccttactggaattgctgtctcactatatcaagcagggaactacagcaattcattcattcaacaagtacatagtgagtgctcttctatgctaggcatgtgctagccgcgagagacacagtgggaaaaccagacacccatgctgcctagactcaggggtcttactttctctagaggaaacaaatattagataagtaactgtacaataaaatagtataattacaaatcacagtgagtgctgcaatgtaaacacaccagcgtgtgataagaatgtatgcagtgtgtggccatttaatgtaggtgatcaaggaagtgatatttaagtggagacattctagggcaaattctctgggagaggagcaagacttcggtggttttggggaattaaaggatggtatggttagaacagaatcctagaaggggacataggatggaattgaaagagcagatatgagagagattaccatcaaggtacagacttcagattttatcctaagtgccttgggcagctcttaagggatctgaaaaagtaaggaagttagtaatacttgtgtttttaagaaagtattgatctggctactgtgttgaagaaggcttgaagaggaggcaaaaagaacagttaagtgggttattgaaatagtctggggccgggcccagtggttcacacgtgtaatcccagcacttcgggaggccaaggcaggtggacgtggtcaggagtttgagaccagcctgatcaacatggtgaaatcctatctctaataaaagtacaaaaaattagctaggcatgctggtgcatgcctgtagtcccagctactggggaggctgaggcaggagaatcatttgagcccgggaggtggaggttgcagtgagccaagttcgcaccactgcacttcatcctgggtgacagaatgaagaaaaaaagtctgggagggaaggatgacattggcttagaataggggtgagttgtgggaatggatataaatggaaggatcctccattttctgtttctctctctctctctctatatatatatatgtatataatatgtgtgtgtgtatatatatatgtgtgtgtatatatatgtgtatatatatatatataatctatctgttaatctatcttctgttttctattcagtgttgcataaatctcaaccatttgctcaattctctggtgcatcagagagtgccaccagtatgtcctaagtcctgcagaaatcatgcaattttttttgtttcacctttttttaaaaaaaaaaattgtatttatttgtgtattgccctggaaatgtacaaatagtttcttcttcccctattaaagtttgcttggtggggtcttgctggttcctgagtttgccttggctgccatcttccatcctacctaggatgacaccatttgtttcacataagtttctcatgcatgagaggctgacattcttaatagttctgtcactcctgttacaacaggctgctgaaaagaaacaagcgatgcctgcaggagatagggctgtctcagcggtttgtgtaacaccaatggggtgtgaggtagcaggaaaataattagtttagttagatgtaaatggaagacgaatgaagaaagtgctaatatgtggatgcctgggagaaggggtggcctgcctcatttaaggtttgaggaagaataattgaatgaatagctatgaaaatgaaagcaatattaagagacttgtatggcaacgtagaaggcgggaagagctaaattcgatcaaccagcatttactgagtgtttattatgtacctgtcactgtgtgaggcattttagctacactggtgggaaaaaataatggtaagacataaataagactttagaatctccgtggaagtcaaaatttcagaacatatgaatgcacaaacagatattagaaaggttggatagcaattgtaagctacattaataggcaaaactattagggatggcaggaataatgttgaatataggagacatgactgactgtgacgatagctagttgatttaaattctcagcacattacttctttccttcataaaatgttcatgtcacagcatagcgtgctgttatatcttcatacacacacatgcacacacatacacatacacatctggtcaaggcttgtgaggccacattaggggttctgggaacaggaaggtagtggagaaaaattccctctcctaaccatttagtgtataggagtctactgttttagtgaatagttcagagaacttaaaggtgttcagagaagagaaagtcagcataaaccatgccgtggactagaagggtagatgaaaggtgttggaaaaatgtagagatgaatccttcattgatgatgcccatctcttatgaaagttatagaacatagatgatcaatatattagctacaccttacagaacatgggccattctaacagatcataatcattatttaatatcttactgagagttttgattgtattttattattgatccaatgtcatgttttgatgtccttgacatgtgacattctttttttttcttttttgagacagcatcttgctctgccacctaggctggagtgcggtggcatgatgtcccctcaatgcagcctctgtctcccgggctcaagcaattctcctgactcagcctcccgagtagctgggactacagtcatgtgccaccatgtccagctgatttttgttttgtatttttcatagtgacagggttttgccatgttggccaggctggtcttgaattcctgagctcaggtgatccacatgcctcagcaccccaaagcgctgggatgacaggtgtgagccactgcgcccagccagacattctttcctttgctatactctttcatattgtttaaagctgttttgttctttggatctgatagttctgttgttttagtcctgagatttctccatttcttttctgctttttattcagtgttttttcaaatctccctttgtcatcatagcttctctttgcctcacattcttttctatcacttgtcaaatttctcatcagcttttcatccttgatttttcagagtttggtttacgaaatggtccagtcatttctacacctctgaaaaactcttaaaattaaaaaatatatatatcagaaatggatacaggcttattttcgtggatggacttaagtttagaataggtggcatatgtttaagtttttagatcacagacattaggaattggcttttaaaagatgttacatcaacgaatggttagaaagcagtaacatcttttctacaaagatacttgtcatctgtcagatttatttatcagttaataataaagtgatttttcatatcactagatgattttctactgtctcattagttgaagaaatcaaaagaaagccaccctatgctaactcatagaagggcataactatttagtaccccgagggccaaagaacaattaaagtgaattaaaattatttcttttttggtgggggtaggggggagcaggaaacagaatgactagactccgaaggatttttctagagaaatattttaaccattgagtaaattttccttgattaaagaaggaaataacaacttggagaggaaatctaagtattactttagggttattgagagatgccggctagtggtacttggaaagataaggacaacttgtcagccactccacagagaagtagttttattaaaagtcaacgaaagtggccaggtgtggtggctcacgcctgtaatcctagcgctttgggaggccaaggtgggcagatttcctgagctccggagtttgagactagcctgggcaacatggtgaaaccccatctctactaaaatacaaagaattagccaggcatgttggtgtgcgcctgtagtcccagctactcaggaagctgaagcaggagaattgcttgaacccaggaggtctaggttgcagtgagccgagatcatgccactgcactccagcctggacaacagagcaagatagcatctcaaaaaaaaaaaaaaaaatcaaagaaatatgctagaatcgtcattatatattgagaaataagattcaatatcccatagatttaggcactcttcacatctgtgtatctggattgggtcatagggagttttattccaggctgagtgaaataagacagaggacaggcaagtagatttcttcttgcttgccagttctcattcgcagaggatccctgtagttctgttgagaattcattggaactcagccggaaagtgctgagattgattagcaatgtcttccatgggtacaggaaggggaggtggcaggtaacatatataccagcttttgccattctgctctagacagaagaaacttttcccctgtggtcaaagagggagagatatttgcttctggagactggatctacttgggttggtgaatgcattttaagatgacctggtttcatattactgtcaagcaagagagaacagtgtcatcctataatgtcaggagtaatgttacagttcagttgggaatacctattatgcctgttagtatttctaactaaatcccctttcgatgtgatagtttaattgtaggaacatttttctgcagttttgtttagggaatactgcttgcttagcgcttaatccatttatactattggattctgttgcaaatgacactcacactggaatgtgtgttagacacgtaaggcagacgggaagatggttccattcatttcagagaaatgggaggcaaaagtgagtaggatggctttgaaggtggtggtcttatgtttgaatgcgcgtcaggccccaggtggtaggtcttggtactgcatgctgctttattcatgcatctctctaaacaaatacgtcctcagagaagagagccaggagagggaggaagttctagaaatgtgctattggtaaatatacctaaagacagtggcatttctttaaccatgttcatcataatgagaaatgcagtaaatatgaaaataaaaaatcaggccgggcgcggtggttcacgcctgtaatcccagcactttgggaggccgaggctggtggatcacgaggtcaagagattgagaccctcctggccaacatggtgaaacctcgtctctactaaaaatacaaaaattagctgggtgtgttgacgcgcgcctgtaaccccagctacttgggaggctgaagcaggagaatcggttgaacccgggagccggagattgcagtaagctgagatcgcaccactacagtccagcctgggggatacagcaagactgtctccaaaaaaaaaaaaaagaaaaaaaaaagaaaagaaaagaaaagaaaaaataaaacaaaaaaatggaaaatctgtagtaaagtcagagaacctgcattgtgatatttcctatgtccatatgtccatcattgttctccaggtattgcctggttttccagcctcacagtaggcagtgggtgagagacgcagcatgatgggagaatgaagcccattcatagtggaatcaagcctccatctttgacctcagtctgtgaccttggcagcttcttgactctgtgagccttggtttcctcttttggtaaatggaacaacaaatggatacttgcaaataagaaggcttaaataactgtgatatatatatattcatatatatacatatacatatatatatatatatatatatatatatttttttttttttttttttttttttttttttttttgagatggagtctcgctctgtcgcccaggctggagtgcagtggcgagatctcggctcactgcaagctccgcctcccaggttcacgccattctgcctcagcctcccgtgtagctgggactataggcgcccgccaccacgcctggctaattttttgtatttttagtagagacggggaactgtgatttatttttagtctcagttgaaatggggaccctatggctctgagaagtcaagacccactggtaagtaaatgtcagagctagctttgaacttcagcattcttcctacagagctgatatctcatgatgtgctgtagagagggctggatttataatctagagagggctggatgttgattctaaaactagtgcttcagttccagcctcatcacacaccacccgggagaactttgccagttgtcaacttccttggcctctgtctcctcatctctgaaagccataagattctgtaaagaggtgggggggaaattggatgagatgatagatgtggagacagtttgcacagcaggacaggctatgcagtgggaaagtaccactgtaaggaagactggatgtatagctgcagaaggtcagagaagacatagaaaatcctttaacacctgagtgaaaacgatccatgacaaatgaagttacttcatttaaaaagagcctagtcagagttttatcatattcaagaaatatcatttattggcaatctactatctgcaaaatcactgttcgagtttttctttgtgatccagagcagtttacattgcaacccttattctaaaggaactcaaaatggcattgaggaaagcatttttcaatctgacccattttttggaacccaagagttcagagcactttatattactcgacagtttatttccatggagggagtctataaatgctttatatttatccatgttatgaattaatgcatttctgaagaaatccacccaccatgtggcatgttgattccccttttctctcatttcccccaaaacaccaaagaaggagggccctatgaggttcaatggtctcctttaatggtgcatttaaagtcgacatgctgatgccaagtctttctgtattgtgccgtcccaacagggatggcttcttagcagcgaatatggggtgagtaatttgaatcaccgccatcaacctgaaaagccaaagttgttccaggataacccaaaccagaacaaacctcagatatttgcaggtgaaagaacgagaatacgaatatatgttgtgggctgggagagccaaaatggcaaaggagtggaaataaattaatggggggaaatgattgatgtggaagtaagtctctcaattgtacacctggatgccacattcttacaagcagcccagtagaggcagatatataggctacaaagacacgtgctgtcaagcagcaagcactacttattgtctctgttttctctctaattgatacgtgtcttaggaaagcttaggtaatcacttggcaaaacacatctttataagaccatctctgtaaaaaaaataaaagtattaaagtgacagtggcacagaaaatcataagaaaatttttccacgttgagacgaatcctcctgcctcttcttgagaatccctccaaagatatcctgtatgtctgccttgtgagaaaacacccccttgggtacaaactggtcaatatcaggaaggcagcatgctcatatctcagtcccaatgcatgccaaatcactaagtggatggcattttcacaaagtcagaaaagcgacagttttattctcaaggttttgttactatgtttcatgatgtgcaagcaatactttggacaattttatccagatggttttgtccaggtaatttttgtctgcaatatgtgaaatacgtgatattctactatcagatactttggattactgttttttagtggtgagaataaaaagataccttcattttccattaagtattacattttatgaatattttccccacctcttcacttgaataccttcccactgcaacacacacacctacacctgtattccttttgatccataattataagcttttgaagggattatatcaagattacctatttttaataccatgttaataattagacaacttgccaatgttgaagtttgttaaggtcctctccatcacaattcctgagctaattactagaatatcagtcagtaggttctaaatcaaaaactctgggcgtgtgcctagatggaaatctgaatttttaataggcagatgagttgatctttattaatagtagtttgaaaactaacacagttcaagcaaaaacaaattctcatacagttgagcactgggactaaaatatttttttaaaaacttggtcactggatgaaatctaagttcttggctttctcttaaagagtactttaaaggttagaaatccacaacagtggctacctggttatgtaattccaaattcattcctcttctaagacatacaatggcactcaagagacctgaaaaagttagttcttcttcaaagagtgcatgtttaaccaacttctcaaaccaggtgaccattattatgttcactttcaaaagtacggaacaatttgaacctgtagaaatgtatccaaaggaacttaatcttttattttgtggtaggtacacaataaaagttttcttcattgaatgaattagtcaagaactcattctcataatgcaggagaatgaaatgggaaggggtgaggggtggcatagctctaggagactggcatgattacagatttgggtaattcccaggatccagtagcctggggcagacttagacaattagatagaaggatcaggagtggaatggaatatggcaagaaatgtatgtgcatgcagtgaaagcgggcagaaaacaaaactcattgattcattaaatgaatattttatggaatacttactgtatgccaggcactgtgctgctgaggaaggccaagttgacagagtaactggccatcccaggatttccacaattgaggagtgtccttagaggtgggactttcatactaaagccagggaaatgccaagcaacccaacctgagtcaatcatcttgaacttgaagaagtgctgtgattttaataggtttgttgcctgatgtgtgcagcaagtcaataggagacactgggttacagcagagaaagtggtttaattatggggctgctgaacgaggagcagcaaacatcaaatccatctcccggaggagctgagggctagggttcttggagagggctaaaatgtggagatcattcattgatcaaagaggtcatcgtaaagtcatggacagggaggtaaacagtattctcatactgattctgttcctctctgggaggtctttaaactggttggcatcagctgtttcactggaatgttggatttgataaacatcttaagcgattcctttattttttattttattttattttattttattttattttattttttgagagagtctcgctctgtcacccaggctggagtgcagtggtgtgatcttgactcactgaatcctctgcctcccaggttcaagcgattctcctgcctcagcctcctgagtagctgggattacaggtgcctgccaccatgcccagctgatttttttttatttctatttttagtagagagagggttttaccatcttggccaggctggtcttgaactccagacctcatgatccacccacctcgtcctcctaaagtgctgggattacaggcatgagccaccgtgcccagcccatcttaagcaattcttaaacaaaagctttatgattctagtatcagaaatcctatgtacaggaacaatggggatgcaaaaggttggtatctagtgactttcagttagaaggaagtggaacaaagtgcagcctgattaatacttaattatgaccatatttctgcccaaaattcttgttaaccatgtgaggatggcttcagtgctaacaagagtgatgaatagtatgggtgctaaggggtcacgaaacaggccgtccgactatctgcagcaaggggacaggaagtataggggttgggggagagttaggcctagctcactcatgacctaaattagttactggtgttaccgaaaatgggtttggatccagactctaagacagggttcttggatctcaagcaagaagtaatttagggcaaatccacagagtaaagtgaaagaaagtttcttaggaaagtgaaggaataaaggaatggctacctcataggcagagcagcaacaagggctgctggttgcctgtttttatgattatttcttgatgatatgctaaacaaggggaggattatttatgccttccctttttagaccatgtagggtaacttcctgacgttgccttgtatttgtaaactgtcatggcactggtgggagtgtagcagtgaggacaaccagaggtcattcccattgccatcttggtattggtggatcttggcttctttactgcaacctgttttatgagcaaggtctttatgacctgtatcttgtgctgacctcctgtctcatcctgtggcttagaattccttactatctgggaatgcagcccagtaggtcttagcctccttttacgcagcccctattcaatatggagttgcccttgttcacatgcctttgacacaagagtgagccagggaaagagagacattcaaaggagaggtaacagcacttctggggacctgggggatcacaagcattaggaaaaccagaagaaaaaaggggaaggggtggacagagagtggcacagaatgaagccacagagatgggcagtgtccactgtctctagggtcttgtagggcatgtgtaagctttccactgatgctgcatcaaatgatcacaaatcattgatttaaaaccatgcaaattttctgtcttacagttctggaagttaaaagtctaacatgggtcttactgagctaaaatcaaggtgtcaatggggcagcattccttctgaactctctatgggaaagaacctgtttccttgcttttttttggccactagaggctgcctacattccttggcttgtggcgtccttccattttcaaagccgacaatggcaggttgagtctctttcacatcaaatccctctgatactgactcttcttttacctcgttcttctccatcttgtataggagatgagtaaaaggaggttgagacttcctgggcggcattcataggaagttagggattcctagcctctagatatttacagttaagggaacagattaataatgtttactaaacagacccaggctcagaatgtcctgatatccccatatcttgaaaacaaaaggattcctaattttgctttaaagataataatgctgattcttgcaaaatatagtaattaagaaaattaatcctttatcacaaaccctgatagtaaagcacatcttcccattttttttttgttatgctgtatataaacaagcattgtacatagggtggctggtttcctcctcttacattatgaatgtcctactctgtctatggagtagctgttatttcaccactttactttctaaataaacttgcttttggtttgcattgtgggctctccctgaattctttcttacacaaaatccaagaaccgtttattggagtccaaatcaggactgctttctggtgacacttttaacgattctcgtgattccactgaacccacctggatcattcagaataatttcttgcgtaaggtcaactgattagcaaccttaattccatctacaaccttaattctcctttgcaataaaacataaaatacttacaggttccaggaagtagcatgtggacactgttggggggcctattattctgcctagcacagggcacagtaaggattttgtgcaaattcaaacaggaattggcaaactatcaaagccctgctttgaaggggagtgatggtggtcaatttgcatttcaaaggatcactctgctgcaatgtgggaatggaggcaagcttgtgtaagggattatcagttgggaagctgttgcagagctcctggggagagatggcggtggtctggactaggatggcaccacgaagatggacatgtggaaatgcattctggctatattaaacagggagaattgacatgaattagagatagattaaaaacaagtagaaacgaaggatcccatgttttgccatggcaatcttttcacattgaatgaatacaaaacgtcaaggtgcttagcatagactagcccatgaatggcacataacagaaacaaccttgataaggttcctgtctctaaatttaaagatgtgcacagcaacctcacgagattcaaggttgaggcattgagggtagaagaagtaatgaagttaggtaggttttgctgagtggcatccacgtggatgtctattagagagttaggtatacatatctgaggttcagaatgcacattcctgtccatttcttccaaatataacctttattcctctaaatgctttttgtgaaatgtgtttggtatttgataaatctcttcggtgcgtatctccaaatttggagataggaaccttatcaaggttatttctgttatatgccactcacaagctcgtctatgctaatcaccttgacattttgtattcatttggtgtgagaggaatgctttatcctacattgatggggacacttgtttctaatgagaaatctgatgaaatcaggtgctttgaatacagatcatctccaaacttctgtcgctttatattttttctgaagtttgtctcctccctttaggagaccatggtttttgatacgaaactccatctgatagtcatttctgataaggattttacttttaaatccatcaaaagggaggagaagtgacaatttaaagtgggcagatggaaaaatgagtctcttggtctttctttatttcttatacccctcttcctctctgttcttttcacaaaagatagtctcatcagaaattcggggaaaaatggcttttcattcttattctcattttctgacattcttactctacagtcattattaatgtagaaaactctgtctattaggtaatctgtgtcttcccctaccctggtggtatttcattatcatttaaatatgccacccactgctccttctcaaaccttttgaatagagggtcattagtagatttttccccctaaattatgctcagcagttgttaaaggaagatagtcttcagggaagttctttctacattgaagaactgaagtgaggatttgcgataattatctggataactcagcctcttcttatccctcctgaggtggaacatatttcctgttctctttcattccttccttctttcatttcttatggattatctttgccacaaacaacaacaataataaccaaaacaaaaccaaataaggtattcatgtttccatgcttcctatagatgtagaaagtttttaaaaagtgttttttgaattgctagctactgtttaaaaattaatacaaatgcatgtcaaacttcctatgagacattttaaagcaggactcgtcttgagatttgaatcagtcgtctttctcagtcattttgggggattaattctgtgttttccatgcataatattccctttggattaaggattactatgaacctgggctttgtcttcatccttaagaatcaccatcccctgagaattaaagatgatgcttctcatgtaaattgcttgaggttttcacgagtctctggctgttacaaatgtcagctgagcacagtctaattctaatcttagcagagtaacctctcctgggcatcggagactgtgatgaaaggaggtaatcagtccttcttcatctctatttctcgtacccagtgccacctgatatgcatcatggaaactgttgttggaggatcaatgtctaggagaggcactgcttgatcttatgcaacctccacctcccgggttcaaatgattctcatgcctcagtagctaggattacaggtgcctgctgccacacccggctaatttttatatttttagtagacacggggtttcaccatgttggccaggatggtctctaactctgagcctcaagtgatccacccaccttggcctcccaaaatgctgcaattacaagcatgagccaccatgcccggcctggtattatacaattacacaatctttccttctctcttcttcttttttcttttttttcttttttttttttgagacagagtctctatcgcccaggctggagtgcagtggcacaatctcagcgcactgcatgctctgcctcccgggttcacgccattctcctgcctcagcctcctgagtagctgggactataggtacccaccactgcgcccggctaattttttgtatttttagtagagacggcgtttcagcgtgttagccaggatggtttccatctcctgacctcgtgatttgcctgcctcggcctcccaaagtgctgggattacaggcgtgagccaccgagcccggtttttttttttttttttttttgagactgctctgtcgccaaggctggagtgcagtgatatgatctcggcttactgcaacctccaccacctgggttcaagcgattctcctgcctcagcctcccgagtggctaggattataggcatgtgccaccatgctccactaatttttctatttttagtagacacgaggtttcaccaggttggccaggctggtcttgaatttctggcctcccaaagggaggattacaggtgtgagccaccgagcccggcctggtcttacagaatctttgtgagcatcaagtctgtcatttgtaaaacaagaacaatatatggcggcttttagggtgttatgatgatacagtaggatgagatgtttggaagagcaagacactagattcttgtgaagcaaagcattctcctgtttgccacttccttgttctctcctaggtagacttaaacagctcctgctgcagagtagatgaatccccacattggcgctgcgtccaggagggttcttggctttacccagaagagaattcaagggtgagccaggtgtgttaaacagtaacttttattgaagcaactgcgtactgctccttacagagcagggctccccctataggcagtgtgcccagaggcagttctgcagcaatatttatgcccacttttaattacatggaaattaaggggcagatgatacagacatttctaggaaatgggtggtcatttccaggtgttgccatggcagtggtaaaccgacatggcaggctggtgtgcatgtctaatggaaagctgcttctcccccagccctgttttagcgagtcctctatccgacctggtatgggaatccccacatccagagtcagttgccacctcctacctcacttccatcatcctttatacttactcggtcccagctacatggcagacataatcctaggtgtgaggatgtgttgggagcaaactcgagtttctcccttcatggagcttacattctaaaagagggatcagatgttgacacatgtgaacccatacaatctaagactggtctcagttaatttagaaagtttattttgccaaggttgaggatgtgtgcctgtgacacggcctcaggaggtcctgacgacatgtgcgcaaggtggttggggcacagcttggttttctacattttagggaaacataagacatcaatcaatacatgtaagaaatacgttggtttggtctggaaaggcaggacaactcgaaacaaaggcaggaagactcaaagcggggagggggattccaggtcacagataggtgggatacaaagtggttgtgttgttgagtttctgattagcctttccaaaggaggcaatcaggtatgcatttatctcagtgagcagagggatgactttgaatagaatgggaggcaggttggccctaagcatttcccagcttgacttttccctttagcttagtaatttggggggcccaaggtattttcctttccaacacatatgcaagtgaatacttattatatatagtgccaataatgagcccaaaacaagcaatccatctgagagaatagaagcggccagaaggtactgctgtagatagtgttgttaaatttaactatatttggcctgaggatgcctctgtgactgagtccttagttaacaaactacagcctaatttagtatgtgaactaagtgaaagcctaacttgggaatgtgagtctgtaacaggttgctgagtctcagccaatcacggcagctcagcttcagataatcccaggcggccaagggatcaggtactgttccaacgaggcaaggctgatctgtaactaatcaaggtgcttccctacctcacttctgttttctgtccataaaggctgactgcctgtgttgaggagtggagctctctgaaactcttctggttccgatggcagcctgattctcgaattgttccttgctcaattaaactctgttagatttaatttgtctatagtttttttattttaacagtgtcttgataatgcctcaagaaatgcctttttgaggttatgatgttggagcagagagttgaaataacttcgtaattgaggcttgtcttgggatggttgatgttagtcatgtcaaacgctggatctctcatatattaccagaataacctcttgacaagacagagttttctgtttaactgaattatgggagagcactacctcaacagagtcttggtggtgttccaggaggatgggcaaattcaggatatttattgagatttcaatgtgtgttgtaaggtgggtctttccatgtacagccttgtttacattgaataaagatcatgatattatagtttagaatagatggacagagcaaggcaaggatattgggctgaggagttcaaagaatcttagggtgaaagtggccatttgatgctttctcttcaagagtaagtgggtctctgaagaagttcctggaatgggcaataaagccatttggacttttaactttctggccaagagtttcctggaatagtaaagtgatgtgaagaagagagtcaactagggaagtcatggtaatgtagacagtgaacgggagatggttctcatcctcaaccaccatcatcatcattgtctctcctctttactgggggcttcatgtgtgctgcatactatgcttggttctaaagatacagctgtgaacaaacaggcatgttcctttcttctcatttggcttataatctacccgtgaaggtagatgctaaacaaatggttgcatgagttaattacaaatgcaatagttgctgtgaaaagaatgttcttcactatgacagtgtagtgtcaatcatggggcgctgtggaggcctgggagtaactgagagaggctttgcatcttgcatatgcatagatgctagctgggtgaaggacgcaagagacggttgggtgaaggagactgaagtttatcttagagcaaggagaaacaaaatgtccctgtatatcaacaattattatatcctatgttcacagagaacttgacacaaataatatcataagacacattcacagtacacagtgacagtgcttggaaacatcaaaattgacagtctacctgcgactgcctggcccattcctctaactaaacagcagttgtttgttgaaagaatgagtgaatgttgaattaatcaacaccatttagttcctcagtgacctccaacagctcatttgctcatgcagatcatacagaaactggtgagaagacatgtttgcatctcagcctagcttactcctgaatacaagaaagcaggaaaacaggccttcaggcgtgaaagtgggtggtggaaacccagcccgttcatacctcttggtcaagtttagctatcctaagtgtgggaggcagagaaggggaaagaggcaggagtgctctgagggaggttatagctttatgggtttgtgtggtttgaggtctttgctcttggttttgagcactgtaggagaggagataggcttgtgataaaatgtggggcacatgtggggtcaggccatccaggttcacactccagctccactgtttaggagctgtgtaaactcaggcaaatcatttagttccttcttgtctatttgtctcctctgtaaaagagagatggtatagatgacaccatatgcttcttggagaattgaatgagatacttcagtagaaagcacttatacagagacttatatggcatttctatggcaaatgctgcccttacgtcaggggaaatctctttgccctgttgtagtcctactcatgcttggtgagatggtatatcagcctgttcttgcactgctataaggaaatacctgagacggggtaatttataaagaaatgagcattaattggatcatggttctgcacgctgtacaggaaagatggcagaatctgcatctggggaggcctcagggagcttttactcatgacggaaggcaaagcaggaggaggcatctcagagcaggagcaggactgagggtggggagcgtgccacgttcttttaaacaaccggatgtcccgagaactctctcaggagacagcaccaaggggatggtgctaaccattcatgaaggatccacacccttgatcccatcacctcccatcaggccccacctccaacactggggattacaactgaacgtgagatttggacggagacacagatccaaaccatatcagatggcaacccaggaaaagcagatttcaggtgtactatgcttttctggggatagagatggacagaggcagatttgctcatttttggaagtcaagcgcttcaaaagaaattcttatcttgagatttgattcctgattttatcaggatcttacagcagacttcttcatggaaaagaataactgttggctaggcgagctgatgctgtgccgtgggttgctatctctttcaaattcctatctgcagtaacctctgtctctctgaggttgaaccaaacacatacttattttgagctgaattttagacaggtttagagcagccagaaaaaaagcagaaaagtgcccttcagaactcaaagcagataaaactttctgttatcccttacctagccgacgacttgagtgtagaattcactcagctgataaggaggctgacattttacctcttagaagttttgtcagataaaagatgtgcaagccatgtttaccatccactctgtgtttcaaacttttgataatagatttaaagaaaaaatcatcgagatacgaatattgtggtaaaataaagctaccccatagaattaaaataatgaggatcaaagaaaggctcaaattgttcaacatcctttaaaaggatccctttgagaaaagctgacttcttgacctatgtcattagtggttggtaaacaatttgcatggcttactaggattacactaatgttcctgactccagctccagcttgcagagagtgcaggtacagtcctattgagaacacatcttcatctctagagagcaaacctggcattaacaatgggagctaaatagaaaatcatggcatttcccatgaaaaaaagagtaacattaagtgctgggctaattgtcaagtggagggttggatatcttctccatttttccccatggttttccaatactttataggaaaaatgattaataagatatccaactccaagaattcagaggtccaaggagataagaaaggaaggcaagttggtttagaactcgtgtcttctacaggggatgccatggggggcagtggtgagcttaactgctggagatttccatggtgaatgtgcgtgtctctccttggcaaaacatgtagaaaagagacttttactattaattactttggtacgctcaagtatccttctcaaagcccttaaaatttcaaaaagtcctaggtttgtgaaaaatcatgcaattgatattggattcaatttatttgtggcgtatagacaaaaattcagatgaagaaatcgtaaaaaatacatggtgtttcacgcctgtaatcccagctctttaggaggctaaggcgggcagattgcctgaggtcgggagttcgagaccagcctgaccagcatggagaaaccctgtctctactaaaaatacaaaattagccgggtgtggttgcgttgcgcatgcctgtaatactatctactcgggaggctgaggcaggagaagcacttgaacccaggaggcagaggttgctgtgagccgagatcgcaccattgcgctccagcctgggcaacaagagtgaaactctgtctcaagaaaaaaaaaaaaaaaaaaaaaaaaaaaaaaaaaaaaaaaaaaaaaaaaaaaaaaacagtgttctctagaatatacttcccaacttctaagtacttcatttaactagttttagggaatgtttatttaactaaggtgatgcctgaatgccaacaatggcatccatacatctatgaaagaccttttactagtaaccttttaaatcacttctctgttgataatcaccaccctcttgtgagtaattactaggtcctaaagcattgtccatggattttcatatttaagcctcattaacaacactaggaggtaggtggcattaattctgttttattaataagttcaacaaaaacttaaagagtgcaagtcatactcatcagcaaggatgcctagctcacaagtggatgcatggggatttgaaccagggtctgaaaacttggaggcctaggtttctatgagggcactcttctgcctcccttagtggtggatggcctggcacctggtcctcaccacgaaatgcctgaaatgaagaccacaggcagtgggcacttggctgacaagtagcaacttgtgcaaagttgtgatatgtcatcttatcctttcagttttctcctgttgcctttcaaccacagcaatgtggccaaaacttacgaagcaggagttttatgacataaaagacataatggagtccctgtcttgacctggggaggcaggttagcttacagggaaagatacataatctttataagagaatattttcatgtgtgcggatagtaaatatacaactgtgtaattatatatatgcatatgcgtttgaattgtattctaatatatacaagaatatatataaaataatattgtatacataaaatatatatatataacgtgtgtgtgtgtgtgtgtgtgtgtgtgtgtatatatatatatatatatatttttttttttttttcttgaggcagagttttgctcttgttgcccaggctggagtgcagtggcatgatgtcggctcactgcaacctctatctcccaggttcaagcgattctcttgcctcagcctcccaagcagctgggactacaggcacctgccaccctgcccagctaacttttgtgattttggtagagacagggtttcactattttggccagggtggtctcgaactcctgacctcaggtgatccgcccgtcttggcctcccaaaatgttgggattacaggcataagccaccgctcccggcctaagggaatgttttcatgtgtgtgtatactaaatatacaagtgtgtaattatatgtatgcatacatatatgtttgaattgtattctcatatattaaatacatgttatttcagaaatggaaggcaaaataaggatattagcatttcctgaggtacgtaaaatgttgggtgctttgcacgtctgacctcatttattttacaacctacctacaagatatgcattattttcatcattccaccaatggggagtatacgggagatgctgtaactggtataaatgcacagaatttatacactgcagaaccagcatttgagttcatggctgtatttacccaaacctaccctttttcagtgcttttttctgtctgttgggcagggagagacattagaatgagctggaggtatcacagatggataaggtacaattgagagtttgtagaggtttctccagtcactttatataataaaaagcaaccagctatctcaagtcccagacctcccagccctatattctctgctttattttcctccttagctcttatccttatctggaatgttgtgtattaacttgtttcctccatctagtttataaatgctatttaggcaggggggttgtttcttttgttgctaggaccattgtacctaaagtagtacttgacccatcatagataaactatccgtatttgttgaaataatgatgccacctataatcaaacaaattcaggacaaatgaccaaaatttagtgtttatgttgaacaattatgaccatcaatgatcaatcatgaatgtggattacaatggaattttactttgaaaattttctaaacactagtttttgttttgtttttgtagcccagggaacaaaggagggcactgagagctgtgagtggagatagcaaaacaaaaaaacaaacaaacaaaatcgtctatttatcctgtccttgctttgggttaccatgcgaagtcattcattacttttagaaataattcatacattgctcaaaaaggatatcctgcgtgtttgatacaaagggcatttatcatattgaagcagctaaaacttttcaatcccatccattaactcacgaagctgcaagttactgcgacgctgccttgcccatctatttagtatttccaggcaatcatggtacagtacaaagcaatttgtttttatataatttccttcatgctcgcaaacacaacatgcatcacagggaaagccaatcatgaactaaagagaaaaagggatgatttaaagcgggagagtggttcatttgctttggggcatgagaaacaattatttcaagaggccagggtttctgtgggaagtcaggtgaataagaatgctagtgctggccggctgctttctcggagaaactgctttgcctaagtaacttcttcttttgagaggatttcttactgagccataaatgcttctaatgtgaggaaggctaaatccgcctcctataaacctgggagccatagttccatttctccccatctttcccaaagatcatctcctctaccattgaaggacaatgggaaatgctgccgcttttatcatacgtcctccatctgaaatgcacttggatttcagccacgtttgagaacctaatcttccaataaactcctttagctctatgagagatttccattaatttatttatttctgtgcttgtttgttttttgggatgggtattagctcatttgccatcctagatacctattttttaacttccttggtgttttactgacaaatataacttgtcatttatttgatttctgtaataagctgcaaagtacttatggtcccttttaagtgtagggcatggtgctgggtttaggcatggggatggtctcaggagactttgctggacctagagagccaggtaggatgggtccttaagcccaaatgcattgcttgtgggggattcaaagacttatctaagattcctttgaattcaaagggggcttgtatctaaggaccctcgatgtccctagccctttgttccctgtagtgtcacttggttatttcggccacaaagtctttgctacactggtttccataaaattcatgcaagcgaacggtgagtttaatccacgttgaggaagatctgaaggacattggagtgcccctgtctcttaaggcacagtccacatgacacgttcctgggctctggtgttcttcctgcttttcctgccttcagtgaagaacttgttcatgtcttcttttcttcccacctttagtctccttttctagaagcataaacacataaacagttcacgcctgtagtcccagtactttgggacgccaaggccggtggatcacctgaggtcaggagttgaagaccagcctcaccaatatggtgagaccccgtctctaccaaaaatacaaaaattagccaggcctggtggcatgcgtctgtagtcccagctactggggaggctgaggtgggaggatcgcttgaactcaggaggtggatgttggagtgagccgagatcatgctagtgcaccccagcctgggtgacagagcgagacactgggtcaacacacagacacacacacacacacacatagatatatataaaaaaaatagcaacagttttccgaaacatgtttcagagagcttttggcttctgttgctctctgtccatcaccagtctccagcaggacccgcctgctctccaccctatcttcgtttctttgtctgaccactcatcacctctccgcttccactctgagtctgcaccagtctcttctccacacagcagcgaaaccagtgttccaaaacgctgtcttgatcaggttgatgtccctgactgatagcttcagaggctcaaggtcaaacatctttcccaagatcaggaccaaactccttcctatgatctcgcaggcccctgccctcttcctctggctcattccccttctgtttcctcttcctgactgtatactagctgcaagagtctttcattcccttgaaagtattttgcttccttccatcacagagtttttgcacaggccgttcctgtacctggaacatttctcctccctcggtctcactaatctctgaaaccacttgtgtctgtagtctggtgatgcatcttcagtgtttaacaaaaattcatggcacttactaatagaagatgctcattaactactgaaggaatcagtgaatgaatgatcaataaatgaataaataaactgggagtcctgaggttaccgtcatcttgatataccagtgttcacataaggagacccaagtgctctgcagatatttgtcctaaaaagccataggtagttgcaggttattacaggttttcttcctctgacagcccagaggacataggagcctgacttcccagtagcaaagaacacacttagcatcctcatcttggtttctaagaccattctccaataaccccttcaaggtattgctgattacagatatatattctgtattctttttttattattagtatactttaagttctggggtacatgtgcagaacgtgcagtcttgttacataggtatacgtgtgccatggtggtttgctgcactcatcaacccatcacctacattagatatttctcctaatgttatcactcccccagccccccagcccctaacaggccccaatgtgtgatgttcccctccctatatccatgtgttctcgttgttcaactcccacttatgagtgagaacatgcggtgtttggctttctgttgttgtgatagtttgctgagaatggtggtttccagcttcacgcatgtccctgcaaaggacatgaactcatccttttttatggctgcatagtattccatggtgtatgtgtgccacattttcttcatccagtctattattgagggacatttgggttggttccaagtctttgctattgtgaatagtgacacaataaacatacatgtgcatatgcctttatagtagaatgatttataatcctttgagtatatacccaataatgggattgctgggtcaaatggtatttctagttctagatacttgaggaatcaccacactgtcttccacaatggctgaactaatttacactcccaccaacagtgtaaaagagttcctatttctccacatcctctccagcttcttttgtttcctgactttttaatgttcgcccttcgtattctatattctttcaactagaagttggtatatacaaaatgatcaggagcaacttctatttccaaaaactaatggagttttcacaaaacaaaatgggtgtaggtcaagaaaacacatgggccaaacttaaagaactcctaatgggcaaagctgaagcaatttaaacagcagaagaaagtagcattagattatgacccaaagtattaaaataaatattcatgagtcaatagtgatagaaataaatgcatggataaattaatacatggaagtagagaaacaaatctcctgtgcagaaaaatcccagataatgtatgcacagccttcatccttgaagaggtagagcatgattctccatctttaagcactgcttttacatggtggctttcttccagagagtacagcatggagaagggaaggaaagggagcaatgttgcaggggcaaaaacctgccaaaaacatcctcagccaacagatcagggtcacgtcagccagcatgtcacattaattgttggtacccttgatcacttaaccccaggagattgaggctgccgtgagctatgattgtaccacagccctccagcctgggcaacagagcgagaacttgtcttaaaaaactattaatatattgggagaaaaatgctattttccctctgtggttttcctccccatacctataattccagtctgattatgaggaaataaacatcagatcaattcaaaattgggggacattctgtaaagtacctgagcagtacatcttacaaccgtcaaggtcttcaaaaataaagaaaaactgtgaaatagctgcagccaagagaagcgtagggagacatagcaagtaaagataccattaccgtggtatcctggatggaatcctggaacaggaaaaggacattaggcgaaaaacaagggaatcattccaagtgcagactttagttaataataaggtgtcaatatcggtttattaatctgacaaatgtccccttccaatcaaagatgttaatactagggaaagtgagtgtggatatgtgggaactctctgtactctctctgcaattttttctgtaaatccaaaagcgttctaaaaatgaaataagtctatgaaaggaaactaaaagccacaggcaatcactcctccagcagcccggtaatggattcccccttccccgtgccctgggccaagactgaactgtgattctgctgtcctgcacccggggacctctatttggagcagtatttggccaagggaagcagcgctcactctccccagtccctcccctcctgccctgcttgcggattttattttagtttgcttccaatggcactcagctgctgctacaggcaaatatctggctgctttgcacgctattgtacaacacactgggggaaaatgagccttcgtgctagagtctgggtccctgagcaaataaacagagaagaaaaatggtgcatgtgggggtggtgaggttgagggagagactggggagccaggtgattgagaagttagtggctaattcagctcagagtttgggcagaaatcctatgcttctccccattcaattttccttattccccggactcctcagaaacacccagcttattggtgggggtaaagagggtattgttttcctgggggtttctgttccaaggataagggagttggaaagagctgttgagggtgtctagccttttttactaggtggaggtcgtctgcacaagcgctctctctcttgcttgctctctctctctctcgctgtctcgctccctcttgctcccgcttgtgctctctctctctctgtcttgcttcctgctttctgagttctctactgagagctggacacagatgcagtggctcatgcctgtaatcccagcactttgggagtcctaggcgggtggatcacttgaggtcaggagttcaagaccagcctggcgaacatcgtgaaacaccctgtctctactaaaattacaaaaattagccgggcgtggtggtgggtgcctgcagtcccaactacttgggaggctgaggtaggagaattgcttgaaccctggaggtggaggtttcagtgagcttgagctgagatcgtgccacttcactccagcctgggcaacagagcaagactccatctcaaaaaagaaaaaaaaaaaaaaagaaattaatggggccagagacctttggaaatttcaatggttgtgtcaaagcaacctgaagtttcggcttcatcaacttccagaaccctttgagagtgtaaaggtgaagaggaggctctgaggctgcctggatgtaccctccaactgtgtggctttgtggaagtcgtttaacctccatgaacctcagcttcctaatgtgcagatccatgaaacactgacacctccttcatgagactgtgtaaaaattaaatgtatcaacccatacaagggacttttaacagtttctggcatcatgtaattttccagtacatgttacccctcctccaaaatcaattatgtatactttaatatgttaagtggtaacatttcacattttaccttctcttcatgtaaggaggtggagagccattgtcaggccttgtctcatcttagaaaaagattagaagttgccagcttcaacataattgtcattgagagggcttaaattttgtttggattaataattcactaattaatcccatagataaagatccagctgaagagtctcattttttcattattaacaatttgaatagatttcatttattgagcaattactatgagccagattctttacagagtgcttaaggtgattatgtctaatcctcccaacagcaggaggtagatactattattcatttcacttaccctaatgtcagagaggttaagtgactttccaagcttgcaaggctagtaagaggtgaagctggagtttggaacagggtttacagagtccagagcttgtctcctgatggatatgctacattgcttctgtttgtgaatttagagaagagtggtttaaaatatcttttatctctctgtttttatggagagaggggagaaagtgctgtttgacgaagatttattgccggagggacatattgagttcgaaacatgaagggtagcaaagctgagattctggcatctgttttcttgcttgtttatcccattgctctgtcggcgcctatagaaggtagctggtttggtttgagttccttccaaaacctggctctaaggaattaatccctaataacaaatgctcagcttgttgttgaaagggtttttgtttgtttgtttgtttgtttgtttgttttgagacggagtctagctctgtcacccaggctggagtgcagtggcacgatctcagctcactgcaacctctgccttccaggctcaagtgattctcctgcctctgcctcctgagtagctgggatgacgggtgtgtaccaccaggcctggctaattgtttgtatttttagtagagacggggtttcaccatattggccaggctggtcttgaactcctgacctcaagtgatcctcctgcctcagcccccaaagtgctgagattacagatgtgagccactgcacctggcctaaaaagggtctttttgactgttggtgatcttcattactcggtgaaggtggagactttcagccacctgataggaggatttgcagtgacttgtcttaggatgggagcacattctcataatgaaagacactcttcccaaaatgttaattcttttggtagccacatgcttgtgttaactattgctttgccactggtgtatggatacaggaaaaagcacttgaaccagaaaacatcagaccaacatgtcctgcaatgctttattcctattgctggatgtttctgcaagtaagtcactctaccaacctttcgagcatctactgtcttccacgaagggatcaggcgtgtatataagccagccttatacttatacttatacacagccgacttactgtgtttgcgacctggcatcatctaagtcaaaaaaactttggtgatattaaaaaaaatgccctcaaaacaacttaatagtatttatagaaattataaagcttcatccagtgcctaaaatgaacattgggatgttagatcattaaattaatgggatgtgatctatgtcctccgtgatttcaaaaacaccattcttttaattgttaattagagaatgtagtgattacagaacgtgaggaacaattttgcttattttcaatatgctggttgtgattatgtgaattattaactctgagcagcattcaatttcgttcatttccatggctttatgaactatttccagtatgcatctgttcttgttttcaattaaaaaaaatatagatttcagcctgtaccttgtaatgaaaataggaagaagcaggaaatgaatttcttatacatcattgtgtaatatttctttatagatttttttttttccaatgtggacctgcctggagacctgtccatgaaagatcatgaggtgccaaaattctcgcaagaaaaacttggactgttattggctatatatttaatactattatacttgcactgcagggaccaaaagtttcttatcaaatttattgagatgattttaacattctgaaacagattgtccacactatatttggaaaaaaaaatgtccaagtgatagatggatttacagcttacacctcaggtttttattatagttgacatttacacagtcttgaaagtctctactcctctgttttatagaaatggcaatgccactcagtctcatccaatattattatggagctgtaacactctggtgaaggatggaccatctattacttgacaaaccctttgtcaagtatatcatgccgtttcagaattatctgaaataatcatcacagaaattcattgacccatcttatgttttgcgaatgtatgctcgaatgttaagaagctattcatttgtttttctcagatgactaaggatggggccatgtgccacagagctccatgtctgcttttacatagttatcattgtgaatggcgccccctacagttgttcagtgtgtagtctgaaattttggagaccctgagtttcttgacattgtttgagccgaagaccgttatctttacttcaggggtggtcctttcacatcttttttattttattttattttattttatttatttttaggcaggtaatttttgcatttgaagagactctgaaatgaccaagctgagccgttgccattaatcctgtttgtctaaaagtttaatcttgagccacccctctcagcaatgcattgccactttctcatacattacaaatatgtaatatgggcaaagtaacgaatgtcatgttatcaggttatgtgtctcaatcactgaaacaggctcaaaaggaatgggacccagtgtcgaggagaagaaaggcacagaggaaagattctgacacttgaagcactgctcagcagggcaaatttggggaaaagatgtagacaagaactttagacaccaggaacaagattgagaaggtgctgagaaaagatcatggctgggccaggcgcggtggctcacacctgtaatcctagcagtttgggaggccgaggcgggtggatcacaaggtcaggagttcgagaccagcctggccaatatggtgacaccccgtgtctactaaaactacaaaaattagcctggtgtggtggctaatgcctgtagttgcagcttctcgggaggctgaggcagaagaatcgcttgaacccaggaggcggaggttgcagtgagccaagatcgcgccactgcattccagcctgggtgacacattgagactctgtctctaaaaaaaaaaaaaaaaatcatggtcaatcattcttaaagctggctaattagtgttacctggagagctttacaaaccccctaccttatctttataccaattgaatcagaatgtctggaatgagggcacaggcgtcagtgtattttaaagatttccccagatatttcttatccacagccaaaattgagaaccactgggctggaggagtgctagggaaggaaaaggaatacaggatcaaaagaacctttcatttgtttattgatccagccgtttttgttttttttcactcattcattcaacaaacacttctcatgaagtccctgtgtgatatacactgttctatgatttgaagatacagctgagaagaaaacaagcaaagccttcatgctcaaggagcttatgttctagtgtcctgaagcaaatcctttctgactcaatagaaatcaggttcacgtggcaattataacacatgacctttcattaaaagcatgacagaatcattttcatgagattgttaatttggaccacaaaacaagtcctgcccaccccacgcccccccaaaaaacaaaattaaattactaaaatttgatgtaatcgatgcatatcacatctatttgtgaaacactgctgtttctaatgcccgtccttcctctaagtactcttcaccttcatttgcctaattcttcaggagtaaacttgtaaccaaaggcaaacatcttacaaatttgatgatacttagacctgcttcccaaatgcttgggaagttttcataaaattgaatgtacataaataatacatggtcaggggttcggagacttaggcaaggtgctaaatttgtccaatatgaggccacctgctcgtatgtcatctgttggcactggctcacgcatttgtgtgccaggacatatgaaattaagtttacctgatgctctctgacagcagctttctgttacaacgtgcaaattagattaggttaaggtagagggcagagtaaatggatggcttcatagactgatactagaatcctgacggctttaaccagaaggtgactggttctggtctagcttgggtcattggtaatcacaagttcctgttattgatgcctgtgcagtggcctgtggggagatggatggcttattttttattgaattttgccgttatagccaaacatcacactggcagtgcaacttcattgaccttcaccctcgaattcgaggaaggaaggtcgaggtgtaaacagaggatggagactaaataaggtagttgtctcttgaatgttgcttggtcccccttctaagtgtgtgatacatgagcaaggctaaaaggttgtacagcctgccacctgggaaccacctcccttgggctgaagctggcatgattacttgggtcttcaaagcaggcgtgcacagtttttctctcaatatgaaatgatctaatgcaaacttgaaattctaccagaagaatcattttttaactttaaaggaatctagagttgtctctgcctcattaagtaactcaattggcttcaaaagcattttttatttatattgaaaatatagaaactgtcaacttcatcctaattttgaagactttttttctataatgtggccttccgttgtgtagtaaacttagtaaagcacctgttgtacaactcaatggcattccatcccaagggatggtttaatggcataaacgaagggccgagggaaaaataaattcagatatttaaacagactaggcaccataccctaaatctttgcttgcaaagttgaccagtgatgcacagaatgaggcagaaatactgtcaaagggactggagactgatctcgagatgttctagcgtggaatggatgggtttacttatttgtttaaataattgcgttctttggaattgcctaaattttgcacttctgccggtttaaatagagtcgaattgaggttgtttctggcaagaatgagtgtcacatttttgaagggaacagcagtgacagcacaacaacagacagttcggagactaaataccattttttaaagtttccgaagattaaatagaaaaacactccggggcttagctaaaaggctaacaggagaaacgaatttcacgtagaaatcaatcgctctgttcactgacacccagtgacagaactaataattgtgtccatgtaaaatcagaccctcttgttactttttaatgaagtctgtctgattctgtgatatttttggcctaggaaatgaaagagatgttttattaaatgaaactaggtctacataggtgaagtatctgaatataactatgtaatcatatcgtacaataaaaagaaaatataaaaaaattggaaagacatgaatgtagttcaaataagcttatccctccaagaaggcttctccgtgttttcaatggaatagtggcctgtattttgcatttgaacaatggcacaaagccattggaaggggaagaaaggtttagcctacccctcttggatccttatgccacaacgtctgttccctgctgtactgagaagtccaactctcctttgcaagccaggaaaaataggacctttttcaaattgcatgcttcgaagatgctggcagaattcaaaagtgctttctccacacagtataaagccctttacctgattaaagctggttatttggcttgccaaggtgaaaagttttcttatgttttatcttgcattttccctctcttcttccctcatttcctctcctcttcctctttctttctttctcatcttccctccaacattaaagacatttggtgcaacctcagcattattatttttaacacccaccttgccaagaagagtataactccaaggaagcttcttttttaagcagacctcatctgttctctgttggtccctgagtggtacctttcagctggccatttttccccagcggtgcatgtgaacacatgtgcgtgtgtgcaggcatgtgtgtacacacactttcatgttgatggagacatatggtcatatagaggatctttgtggtccatctagttctttagtttcaaatgtgatgtgttttatctaatatctgaaagggaaacatctttctgtgtaatttctcaccctgaattacacatttaaaccccacaaatatcagaggacattctaagaaataccttgtgggtggaaaagttgaccttttgtttccctctgcctggttggctgacttgggagagagtaactgaaggcaaagggaatgtcagagtggaggaaattcccatcctagactgggcgaggggcagggggtgtggtccttttacgatattcacccaattcagagcgccctacttctgttcaaaactgtgataagaaatatcaatatgggcatatgacagtatgtgtgggagggtacctccttcacttgtagcatctcacagggagaggtcttggcaaaggcacagtcatcaaaactgatgagcccaaaatgggattcacccttaaaaaaaaggttttgataaaattagctttcctcttaacaatctgggagtgctatcagaatagcagctataaatctgtctggtagggccctctcttcttaaaatagatggatgggtagatgaatggatagatgggtagatggatggatagagggacagatggatggggggataggtggatggatgagtaggtggatgaatggatgggtggatggatgtttggatgggtggatgggtgggtggatggatggatggatggatggatagacggatgagtggatgggtggataggtggatggatgagtagatggatggatggatgggtaggtggatgggtagatgagtgaatggatgggtggatgggtgaatggatgggtgggtggatgggtaggtgtatggataccttggatacatacatgtaatacatttaaattcttaataggtacatcttatgctcttcatgtctctttctctggggaggggcactggggtgctgacatatgctatctttttttgtggttaagaccataaggatgagaccacttcaccaattcttctaggcatgttttgaagcaatgtggtatagtggaaagaacacaggatttgaatcactggaagccagatttaggtctgagcaccatgtgctttttagcttgagtacctttgctcaagatggttaacctcagtatccatgtctgtaaaatggaaaaatgttttctaacttgctggattgttgagagaattaaaagatatctagatctaggcagatagtgtttaactcaatacctagaatagagagagcattttgattaatgggagctacagctactacttcaactgctgctaaggatctttcttgtttttactttcccctccttctctgggtgttttttttttccacgatacattttagaaatagaagccacattctaacttctttggctccttgcctgactttcatatggtctctggtcgagaatggtggccattctatgtgtgtgtgtgtgtgtgtgtgtgtgtgtgtgtgtgtgtctgcctgcctgtatctatgtctgtatctagaaaatatatatttatacctggaacatatgtacgtataaataaaattctggaagatgcatcttgctggaagatatatgtcttgatatgtatatctggaaggtatatatcttgtttttcccttgcttttgacagatgttctaaactcaccataccttttggatattgaactataaagacttctacattcctattttatacatttagaattgtgaatattgtaataaaaattcctctgacatttctcacatactacagacatcatgtcccctactttttcttcatggagagatatgagacaatgttgaacaacccagaataagccaaaatataaggaggtaagaatggattcgttgtctgaggctcaatatgacaccacctgaattttctctatatcacccttcaagggggtgaggatggctaagaccactgatacttatgtcatagcatgaacaaataataactacttaccatgtgccaggttcttctgcaggcactttacatagataattttatttaatcttcatagcaaacttagggagtagatgctagtattatcccaagtttacagaggaggcaactgagtcacagtaagctgaaatgacatgctccaggttgcagaatgatcataaagcagagccaaaattaggcaccagtgtcttttggtgtcaggaatctctgcttttgtgcttttctgtctcatgaaaatatcagagtggctctctctattgggtctcattattgcatgccattgtgggttcttctgactgtgtgtcacctttcacaaggagcatttcctacactgtgaaagtgcacatgacaattttatgtacttcttgttgaaatccttgtcttccttatgctgcccattggtgcttcacactattttcttcctcatcccacttccgcagcttgtagctcctgcctgagctttggaagtgaaagccaaagttccacctcgatgcaggtgataaaactagggcaaaatgaataaagtgagagctttgacgtcagcacgtggaacacatacacaggttatgctgaattgtaagctggacattatgtcactgtaggtttagcccttcttggattttctttgtttgtttgttttgttttgttttgttttgttttgtttttaaggtgtagtctcacaccgttgcctgggctggagtgcaatggtgtgatcttggctcactgcaacctctgcctcccgggttcaggtgattcccctgcctcagcctcctgagtagctgggattacaggcatgcaccaccatgcccggctaattttttgcatttttactagagacagggtttcactatattggtcaggctggccccgaactcctgacctcatgatccacccatctcggcctcccaaagtgctgggattacaggcgtgagccaatgcgcctggccccttcttggattttcttatgcatttgaaatcaggtaaagctaaaattgtgaatatgtaaataaaaataccatgagaacatgggagagggagctggggtgttttgctttcataggatgggagccaatgcctacatgttttctattgtatcttttggacaggtagaatgattgcaattgttaaaaaaaaaaaaaaatagggaaaatgatgccaggagcagaaagcaaagatgttttcaaagagtcagaaagactctgttccaaccacaaaccatcctatcttcccccagttaatggggttgcctaaatcgtcaactcctactgtgaaactcaaacccttgttgttccaacttaactttttgcccacagagtagtttaggacaatccaatgtcagtatggcaggtagaagtagcacaaagtaagatccatttgtgtcttgatttgagggacataaatgtcctattttctttacgtgtcttggtcaccccctcacacaggctctctgaagttgtttccgtcattttgtacccttcctcttcttctctttgtaagcttaagtttcacattcattggctgtttttctctctgaggtttcagcttcaagggattatgcatatgagacttgtattatataccctgaatgaaaaatattgaaaatatctcacagctagctggatctctcttaatccaggctttccagaaaaatggtgctgggaccacccctggaagctcagcctgccccaaaccccaggaatcttcagtctgcaagggcagaaccagataatgaaatggcatgctagcaggtagtagttctctgatctaaccactgccacacataaaaaatgctgcagctttgatttgggttttatgtcctgtgattacacggatcgtgctggttcctaatgtagacctttccagttctctgggtgtgcacctctgcatccacatctccttccaattcatggaacctcctttatttcttccctgcctgtaattcttctgctctatgatctgagcttccactcatgcccttattatttagctcttacattcctagaagagtatatgtttatctattttaccactttgggcattgtcatatgtcataggttcattcaccattcattgaacaaatggttatcaattagtcatatgtaccagtccatgtttacacatgacaggcacatcaataggtaagagaggaagagcccatgccctctgtttcaatgttggtagtaacatggcttgtgaaggttaaaagaaaaacccagaagcaacctagtcttgtcatcaaaatgagaaagtaaagatggattgtggtaaagtaacgcagtggaatactacagagcagtgaaaaataaaccaggacgaatctcacaattttagtgttggaaaaaaggaacaataggatgtgttatcctcacttgtgtaaaattgaaaacatgcttgtgtaaaattgaaactatggaaaataatgtgaaacaaattagtatatttcttagggatatatgtatatatacatgtatgtatgtgtgtatatgtatatatgtttgtcagggataactaagggattcctaatctattggtagtatttactaacttgggcataggaagcagatacatcttgtattaagtaatatactgcttatgtgccttaaatatctcattttaattttttataaacaaaattgatatgctcacttcaaattcacctaattttaagggattgaattattccttagatgtattctgctgaacttgctgggtcggatagtgtaaagattgaaaggattgatttaaaaaatggaaaaacattgtgaaggaaaaagaaaggaggcattgtttgagaacgtttgtcttagacatagcatctctacccaacagtgcaaccactcattattcctagcattgagggaagaatggttaattttggtgaaagttctagttcatatgaattcctctctttagtcctaaagttgttgggagtgaagagatctttccatgtcctcgagggctggtaggaaaaatctgtgtcttgttactaccatgttcccccaccatctttcctttataagttttaattaccctccaacctatacctcatgtaaagtttttcactatcacgcattttctacaccttctatgtacgtaaatacacatatatttttaatactcttacctatcttagtgtcagttccagacatgttgcctggttaactttgaatacttcagtgtgttcctaaaaacaaggacctaaccacaatacaattccaaaattaagaaatttaacacactggtatagtcctctggtctcatccacagtttgttttccaatttcatcaattgtcccaataatgaccttgatggcagttttgttcatggtccagaatctaatccatcatgcatttcatttagttgtcaagtctctttagtgtcttttaatccacaacagtgacagtcttgcttggtcttttatgatcttgacatttttttaagaacacatacgctgggccgggtgcggtggcttatgcctgtaatcccagcactttgggaggccgaggcaggcggatcatgagatcaggagatcgagaccgtcctggctaatgcggtgaaaacctgtctctactaaaaatacaaaaaattagctgggcggggtggcgggcggctgtagtcccagctactggggaggctgaggcaggagaatagtgtgaactcaggaggcggagcttgcagtgagccgagatcatgccactgcactctagcctgggcgacagatagagactccgtctcaaaagaaaaaaaaaaaaaaaaaaaaaaaaaaaaagaacacaccctggactgcccattgccgaatcacctgaagagagcccttcaattttaactaatcatttttgcaagcttagttgtttcagctgctacaaaaaagcacgagtcttttaaaaaggagtaaaattctgacacgtgctacaacatggacaaaccttgaaacattacgctaagtgaaagaaaccagtcgcaaaaggacaaatattgtatgattctacttatttcaggtacctaggatagtcaaattcatagagacaaagtaatatagtggttcctagggaccagggggaggatagaatggggagttgatgtttaacgggtatagaatttcagttttggaagttgagaaggttttagaatactgataatagttgcacaagaatgcaaatgttcttaatgccacttaattgaatactttaaaataattaaattggtaagttttatgtaatgtatattttgctacaattttttacaagagagtgggtcctcaatatgtaaatataatgtcaattaaaataacaagaaaacacaaggcagttatttactttgtggatgaccctcaatttgggtctttcagctgtttctttatgatcccagttggggtgtgcatttttgccagggatacccccaagtaataatgtcctgtttttcccagggtgccatattaagagacacatgatattagtttgtctattattggtgatattaacatcagtcctttggatcatatgatgtctctcagatatctccagtaaaaactttctcactgtaattaatacatagtttgggggtgggaggaatggttttagacttttaaaataccgatttgtcatcaatccttcattcactagttttaccattcattgatgattcttgtctgagtcaattatgattattacggctatcaaatgatggttttctaaccccattgcacttatatgtgtgggttggcattctatttcctttcctatatatatacatttaattacttatttcagtataaagtcatggattcgtgtttttattctatgaactacaatcggttactttcgttatttgttttgatgctcaagttgtatcatatgtattcactgggagccccttcaagctggctcctgtatcattttgacataaacccgtaagttttttttaataacatccttattccttggcaccagaagatattccaggtatatcttgacttttcttgccccagtcctagagccaggaggccatttttccacagagtaatccttcctttgattggagagtggtgtttagaaacaaagttctgggcgattatggcttctggaccctctaaatagacaatatagatagaactaggaaaaaatacacacatgcacatacacatgtatatataattatcttttcaaagccaagaatttgttaatccttcctaaggattatgttcttcccaacaggatacattatctaggttaaaatttccctgcctatctgatatcacttgttattacgagttatcttttatctgtctgttaggctgtgagacccttcagaagagagacttcatattttttgtcatctttgtatccccattgcctaggaagatgtctggtacagattaggtactaatattaattcataggattgttgggtgaaacgatggttgaatgaaaggatggttggttaggatcattgggtaggagggtggatgggtggagtggagattcgatggaaaagtatagttgggtgggaggatagttctttgggatcctgggtaggagggttgttgggtagaatggagattgggtggaagtatactcggatgagagggtggttggtaaggatctttgggtaggagtattgttgggtggaatagagattgggtggaagtatactcggatggaaggatagttggttaggatctttgggtaggaggatggttgggtggagtggagacttggtggaagtatagtcggatggaaggatggttggttaggatctttgggtaggaggatggttgggtggaatggagaattggtggaagagtatagttggatggaaggatagttggttaggatctttgggtaggagtattgttggatggaatggagattgggtggaagtatagttggatggaaggatagctggttaggatctttgggtaggaggatggttgggtggaatggagattgggtggaagagtagagttggatggaaggatagttcattgggatcactgggcaggagttttgttgggtggaaaggagaatgggtggaagtatagttggatggaaggatagttggtgaggatctttggataggaggatagttgggtggaatggagattgggtggaagtatagttggatggaaggacagttggttaggattgttgggtaggagtattgttgggtggaatggagattgggtggaagtataactggatgggaggatggttggttaggatctttgggtaggagtacggtcgggtggaatggagatttgatggaagagtatagttggatggaagcgtagttggttaggattgttgggtaggaggattgttgtgtagaatggagattgggtggaagtatagtcggatgggagggtggttggtaaggatctttgggtaggaggatggttgggtggaatggagattcagtggcagagtatagttggatggaaggatagttcattgtgatcactgggtaggagtattgttgggtggaatggagattgggtggaagtataactgtatgggaggattgttgtttaggatctttgggtaggaggatgtttgggtggagtggagattcagcggaagtgtatagttggatagaaggatagttcgttgggatcactgggtaggaggatagtgtagaatgaagattgggtggaagtattgtcggatgggaggatggttggtaaggatctttgtgtaggaggatggttgggtggaatggagattcggcggaagagtatagttggatggaaggatagttttttaggatcactgggtaggagcattgttgggtgcaatggagattgggtggaagtataactggatgggaggatggttggttaggatctttgggtaggaggatggttggtggaatggagattcagtggaaatgtatagttggatacaaggatagttcattgggatcacagggtacgaggattgttgtgtagaatggagattgggtggaagtatagtcggatgagaggatggttggcaaaatctttgagtaggaggatgattgggtggaatggagattgggtagatatacagttggatggaagaatggttttcatgcaagagcatttgggttaggggatggttggatgagaggagttgttaagtggaagaattgtgacgataaaggatcattatgtgggaagacggttgtgtgggatgtggtctgcatgtcttatttagcaatgtatgtcttttttgttatacttctgtactcattgcattcaggtgctgtttaagaagttattttggttcctttttgtctttcagatagtaggtgttcattcagtatctattgactgtgtgactatgactttcaggaacaggaatggatgatttatctttcgattctttgcattctccatagtgctcagcttggcgtaaatacagatttaatattcagtttgacagtaagtcagttagaaaaccacagcaacataatatctgccctatttaccttttaaagaaaactaaggatgctgtattagtttcttcaacactgagtgtggacttgattcattgtctctggatattcagttgccccaaaattattcaagtagtctacttggcaagtatttcaagaatggagggcattgtttagccttgtaattattcattggctcatgtaattaggagacaaacttttgctttggaataagggttacaccacacaatttgggatcattttgtgatcaggcaattgaataggctagaaagaattcctttactgatggatagacattctgaatacctgttttatccttttctattttctcatactaagaaagtaagtagcaaattcttctcacactgatattgtgaacagaaaggaactctactatttttggccatatatatgtttttttaattttggatctattatgtgttctagtgtctttagagaaaattttcgtaattgaaccttagaagagaagacaaatgctgtgtaatgtacataagaacaagaagacgttactctagctgaaaatgtcttttttccacagtactttatatcctggccaactgctcttgtgcaaggcgaccaagtaacattttcccattcagctataagaacgaagagactgttattgccactggctggtattgagtaatcgtacataggtggggtgagttgaaggcaatctgaattataaaacaccttcctttgaagtcaaatcaatttttattcttaatctgtgaacatgagatgggaacaaataacttctgagtgaaataaagatttcttagcctgtcaagatttatcttatcaggctgaagaggtgggattcctgttagcaactggcagttttaaaaatccattcgcctgaggaagtgtgaaaacagtctgcagaacaaagacactgagctattgctgcattgagtgcttatttgctccttttttacatttcctgcttgagacctcgccaggtccaactttaaaacgtttgcaggctaatgggagtgtgtgcacagggagtatcagaaatcatttccttaggggaggaggtgttttgtggtgcaaaatgttgaggttctgttgccaaaacaccaactgcaagagggtattttctgtgaacttcatgggtggctttcatagggaattctccatgtcattctctgatgtcttttattggcccttgttttgccagagtggggaaaaaaaacaaaaacaaaaacaaaaaccaccttccctgtgtcatttctcttttaacaaagaaagccaaaataattctataaatgaaagtcatgcacatgtagaactttgggtgcagctctagagtattttttttttttaaccctcctaggatgaagccaaaagaagaaaactggttgtatttctctaacatttttaggcagatgatcgtttctgggcagggggaaaatgccaaagcctgtgcagtttctctttcggctcatttgaaaatactctaggaaaagacccctgtggattctctgccccttctgtaatgtgtggaatcatgtgattgctggacagcccccttggaagcctgccagcccagcctcttcagcatccagatgggaacccggaggcgcatctcacagcggaccgttgattaacccaaggtcacctggctctggtttctgacggagcgagaatgagtacccagaggtttccagaacctcagcacaaagggtatccatgatgaacaggcatttccctatcccttctctctcctgtcccctgcataaacaatgcaaaaaacacactcccttcttggccaggacccaaagacctattatcctacacatgtctttctgtgctttgagggatcagcaggggtgccagtgaacttggattactctttggatcaccctgctgcctccagctccccctctgttttgtttcatgactcagtcatcctgtttgagctcatttaccacttgtataggggtacattccttgacttctcagagcaaaccaagcccccatccatgatttcttcttcttttacaatgagctctcatatcacatttatcccagtggaaatttcatatcaatatctgtgattctttgactgttctctctttcccctagactccaggatccttgggatcactggccttgtcatttatgttcctgcttatgtcctatagcctggcacttagtgaggcggtgtgttgtgttgggttttgtttgtttgttggttggttgttgttgttgttgtttgcaagggcccctgcaaagtatcacaaactaggtggcttaaaaaagcagacatccattctcttgctgttctggagcccaggaggctgaaatcaaggtgttagcagggacatgatccctctgaaggcattaagggtgaatccttcgttgccttttccagtttctggtagttgctggcattccctggcattctgcggcttgcagctgcgtttttgaaagctgcctcactcctaacctctgtttacattggtgtctgttcacgtcacctgtcctctatgtgtgtatctctgtgtccagattttcttccgtttgtgaaaccagcagtccttggtttagggcccaactaatggtttcatgactcctgtgttagcttcctagattgcagtaagaagtatcagaagctcagtggcctaaaactacagaaatgtgttttcttacagtgctggaggctggaaatctgaaatcggggtattagcagcgccatgcattcttcaaaggacccagggaagaattcttgctttcctctttcagcttctagtagtcgttagggatctggcggccctcagcttcgagatgtgtcactccaatctctggcttgggtatcacatagccttccctgtgtttttctctgtctccaaacttccttcttcttataaaggtattggtccccagactgggctcggtggctcatgcatataatcccagtactttgggaggctgaggcaggtggatcactttgaactcaggagttcgataccagcctgggcaacatggaaaaattccatccctacaaaaaaaaattaaaaattagctgagcacggtggcctgtgcctgtaggcccagctacttggaggctgaggttagaggatcacttaagcccaggaagtggaggttgcagtgagccaaggtcatgcaactgcactccatcctgagtgacagagtgagaccctgtctcaaaaaaaaaaaaaaaaagaaaaagaaaaaaaaaggtatcagtccctgtatttaggcctcatcttaattccatatgaactcatcttaattacatctataaagaccctatttccaaataagcccacgttctgacattctggggggccatggatttctgggggttgttatccaacccagtgtacaaggcagtacacatttattgaatgcatgaatgaatgataatgctctgggccctggcaagtctcagcctggagaactgagtctgcctgcctgcgtagaatcaagaacaacatgcacttcagtggaatttgggaagggtcagggtctgtgccgacagaaatggaaaaatcctccaagcgcctcaccctctcttaaaagactcctcaagattgctttgctgttctaccctctacagtgtttttaatatgtctatttaaatgcaaattttgactttctgtctgtaatcatataaaatgtttggcactaaaattttaatcaggaatgtaattttagatagaggcggtaatggagtggtaggccacacataacagaatgaagcttccccaacgtggattcccagactatggaagtgctggcctccctgctcccagctgagccgggaaaactctgccccactccaagaggtgcttctcaaagatgattcctgatcccaggcatgtcctgtgtcctgtcaccaatcctggtgcttcatcgtcctttaaaatccaaacgaggtgatctagtgttcttcctctgcgtcctctggtcttctagcatcctggataggccgtgtatgtttagaaagaggggctccaccctgtgcccgcctaagatgatggctcatttatcaagaccaggctggaggctcagctaccagagcttctgttgtttgggaggaaggctgccagcagcagatgtttgtcctcgcctcagctccctgcagcctttgagctccatctgccgcacactcgggcacagctgccagtgcttcccctccgtgctcacctttcacctctcacggaggctggggtttcatgcatctgggcccaacagagagatggtgacccagaccctgcgatcctggtgccacaatccttcccaacagctcgctgggcatctttctgcactagcctgtcagcatgctggaagcagcaccgatggaggttgttgagcagggttgcaattgtagcccgtcactttggtcttggtgttccatcttgttagggcaagagagtcagagcacacacagccatctcctggctggatcatctggtggagtgggagtgtgcacatgcccacccccatttctaaataagatatgcattgtctcagggcctttgcaatgtccactccctagtcctcaatgctcttccccattggtcatcccagagctcatctcaaatgtcaccctttagaggggcagctgtcagtcttcccagttaaagcatatgccaaccccctcatcactcctggtctcaacaacctctttatttccctcattgctattatcttcatctgtaattctcatctttataatatctcttgaatgaatctttaggaggattactcttcctagagtgtgcaaaacggattgcagggatggtgagaggtgggcggaaatgttggaaaggggacaagggtggaattggtagcactgatcttgttgagagaggattggccctggaaaaagaaagtagcaatggagcaggaagtaattagacatagaagagagctcttcacgtgggaggtgaggagaatcggtgttgggattgtgtgttaggactgaggaaggaggaggaggaggatgcccagctttctaaactgggtatttgagtggatgggggtgacttgccgaaaataaagaatggtttgagaagaaagatgctgtgctcatcttggaaatgttgagttttgggcccctgtagaagacccagctgagatttgcaggtctgcatcaaatggagaattcatcagagaggcaatggtactcaaaaccatgacagtgaaaggtgcttccctaggagagaggcaggataaaaaaataaggtggcccaaaattaggatggccacacatcccagttagccaggatattcctgccttatacctgttgttccaccataatttctaatggcccccgcccccctactttcactttcacttgtctcagtgaactatatcgtcaccctacccgcatgagaaggttggggaaattcagagttcataggagggcataagaacccactgaaaaaaactgagtatgagcagaagggtagaaagaaaaaccggggtagtgttgggtaatgtatgccaagggtagaaaattgacaagagaagaatcattcatgtcaaatgggtcacagaggtgaagtcatgcaagtgtcaagagctgtgcattggatttagctaccaaaaaaaaaaaaaaaaagtcttgatgaccctgtaatcatgatggtgggaatatgccagagacaggtggctttgaggagaaaatcattgatgagaaactagagacagtcagttccactaagttttgttgtgcaagaagggggatatgttagaggagtttgcagacgggcatgagagaacaagagaaggttcatgggatgggaggcatttgagcatgcgtcagtcctggaaaggggcctgatggagaaagcttcaggagagggggtgtccacatgatacagcagtgttcccaagggagagagagcagatgcaggaagggacaccttccctgttaacaggcaagaaagagcaagttggggtgtaaggaagtccgtaggctttatggcggggatttgaagagagtagcatttattttctcctctgaggtaggaggcatctgagaggtgggggaggttgaagatgggaggaaagtagacagttgctttaaatagccacatggaaaatgggagaaggaattggctcattcagatgacttttattgggtgccttctgtgctccaagccctgggaatcaactagtgaagaaaacaatccaatgggactgatgttctccttggaaagagaacagtgacggtggtggaggcagcaaagggaacactggaggctgaagacccctccccaacttataatgatgcgtctgtgagtggtgaatggtggggattttttttttttttttttttttttttttttttttttttttttttttttagtagaactcagcagcttgggtctagacacagagaaaatggacaacttatggtctagagatggcagcacagaaaggaaggtgagttgaagttctggggggaaaataaatggcaggtaaagttatggaccatttgatcaaatcctggtgtgaaataaagagcatacttaggatatgtcttttgttttttcttcttttcctctgacatgcattgctatcatgagtgtccttgaacaaatctctttgggggcatacaaaaccatttctgtaaaacaggtgttaagtataggaactctgggtccaaaggagaacacataatcaatttggataaatattgccaaattgtctgttgcacattcctcaccagtttgtgctgccttcagcagtgcccaaagcgcctccttcccttcacataccgttgccaacataggccattatctttctgagttttaccaagtggaggaacaaaccaaaggtcctcatatttttctgtgcattctggtgattgcttgtcttggcgagcatcttctttttaaaataatcttgctgggggacttgtggtatgcaatgatgactgtggaagtattttagggggcaggtcagagaggagatgcctgtcagtttggggcaaggggatttgggaagtttttggaggaaatcaaatgggagacaaaagaatttgtctgagagctggagaagaaggaatagatcctagagacattttcatttttgttgcattttatttttatagatttaagatgtgtaagtacaaatttctcatgtgcatatattgcgtagtgatgaggtctaagcatttagtgtacccatcactggaatagtaaacattgtacccaaaaggtaatttttcaaccctcacctccctcccacccttccatcttttgcgatctccagtgtctattattccaccctgtatgtcatgtgtacccattgtttagctcccagttataactagagatatgttggaagtaaaatgcaacgggcttgatgaccttgcaggaagtcagcgaggagtgatcagcgctgatagaggcttatatctttggagtttgtgtgaccatgctaacttttaaacaggaggaatgatacaaaataagatgcaggtttggggttcttttccaaggtcttgcctttacctattggatgtcaactatcttcttgggtcattgaacaggagctcttcctcttggcttgtggcacagatgagtttgcttctgtcatgacgctggggacatggggtcctgtgtgctaggccaggcattgggccgatgtatgcctggggctaccgcatctgctgctgctggaactgggtctgccctgtgtccctcgggattccagcaagtggacttcatcgcattatcatgcattcacctggtcagtttctgcacgggctgtttatagggcacgggtttaatagctgtctcccctgctgcactgcagattccacgagggcagagaccatgtccggctggtcgatcatcctctcctaggaaaaggctctgcaaagttttcctgtaaagggccacacaggaaatatttcaggccttttgggctgtgccatctctgttgctattcaactgcctttgtagcgtgaaagctgccttgatgatatgtaaacagatgggtgtggctgtgttccaataatactttatttatggatgcagaaatttgaatttcccatcattttcatgtgttgaagaatagtattcttgtgatcctttttccccaaccatttaaaattgcaagagccattttagcctgtgagccatacaaagacaggcagtgggcctgcggtctgaaagcatagtttgttggtcccgtcctaaagtttagcacagggcctgtaatggcagtaaacactcatttcatattgtggaagaaaagaaagaaggtgtgtaagttgtgtttttgtgcttgctttctcctgcagagtgggtaaaggaatggtactgaggactagtaaaatgcaaagatttggtatcggtaggtcttcatcctgctcctaatgcatagtgtgacctggagccagtttgtgcagctctttgggcctcagctgtcctatctgtgtgatgaggagaagcctagcttcattaagggatgtgaaaatgcttttaagactgggtgcagtggctcatgcctgtaatcccagaactttgggaggctgaggcgggcagatcatctgaggttaggagttctagagcagcctggtcaacctggtgaaaccccatctttactaaaaatacaaaaatcagccagatgtggtggcaggtgcctgtaatcccagctacttgggaggctgaggcaggagaattccttgaactcaggaggtggaggttgcagtgagccgagatcatgtcgctgcactccagcctgggcaacagagtgagactctgtctcaaaaaagaaaatgcttttactctcaagcccactgaaaagtgttaagttattacccaaagcaggagaagcagcacaatagaccaggaagctctaaatcctgacaagccagtatttacgctgcagccagcccagggctcagctgcagaggcagcgaaatcctaacagtgagcaggaggatttgacatctggtgcccaagaagtttgttaaggttgcccagtcacttgctgacatgtgctagcaaattctcatgctttctccaaaaaaagggtatactatgggcttcgctcccacaacattttggtaaatcttccaagaagatctggctttcttcttgttaaaggaagcatttgatggcagcctggatgaaatagatatcaaatctgagtgacattattgctgttgttaaactaaagctgaacctcttaaacttggcatcagttgactctcctctttgtcagaaaacctatgcaggatgccatgtgatctggaggacacaaaagcatgattgtgtcatttctttctgtatggagtctgtgcagtcagacagttcttttctatcttgctttcttccttgggtcaggacaagtccaattcactgaatgcaccaagccccttctagaaaaacagcacagggctggacacagtggctcatgcctgtaatgccagtattttgggaggctgaggtgggcggatcacaaggtcaggagttcgagactggcctggccaacatggtgaaaccccgtgtctactgaaaatacaaaaattagccgcgtatggtgtgtgcctataatcctacctactcgggaggctgaggcaggagaattgcatgaacccgggagacagaggttgcagtgagccaacatcgcaccactgcactccagcctgggcgacagtgcgagaatttatcttggaaaaaaaaaaagaaaagaaaaacagcacaacaaacaagaagagttcagtggttacaatcaaattttaaaccaattgtcaaagtacaagccaccactaagcagatggtgggatctggtttttgttttgttttttgaagcataatggatcctctgtggtatgggaattttaaggggaaaaaaaagagaacaatttctccttctctgcagtacatttactgctgctatcactctctttctaccctgaaatgtttctgtttcaccaccattcatctctcttgattggttttgcttttttttttttttttttcttctaagatgttgctaaatttgcttgtaaagttttgtttattcattggcgcttggttgaaaggtgctggatcattaatctaagtattcaaggttaaccatgctttatgctgaaattgcctttttatggaacagatttcaaggttttgcaagagttgagtgctacctcatttttgacatttcagcaatgaatcctgtttgaaatgtgatttgaatccaatcatcatcttatttgtggaggaagataaaaataatatacaaatattgcagtaaaattgcatttttccctgccccctgttttgcatttcaattcagctagattctgctagggtggcacccagcaatggcatccctgctttaattctatctttcattttttttccctcccagaaggcttaaacatatttcctttctatctaacataagttgtacagggcttctgaagagtgtgcattgaagaaatggagcttacacaattacttctataccttattatggaatctgagggtaaacagggctttggaggtcatctaattcgtctccttttgcaattacagaattatttctttgaaggaacaaatgaagaatctcttcttccaggcctctttgtaaatgtgtgaacaagtttataagtgcctccatctcagagtgtgtgtggatgtggctttttaattaaagaccaaggcttcaagctttgctgttttctccgatctgatatagccactgttcctagtcacatcatggagctcttggtcagcctgtgatctgggaggtttcttttctaactaacgtgtatccttcccttagaactagtctgcaggggctggtaccaggcagcctctcttaagaaacttacacccagaaactgctccatttctgtgtaaatggtagccatgtccgagtgggtgtcactcaccctatttcagcagcaccccctccctgtttgctatctacaaattatctctcccctcattaaagtttggtcttccaaagcttttcaaactctcagactctcattcactctaaaatatttacagattaaccatgttcagcctcagcatggtgtcatcatgggaagatgctctcagtgtggacaagataaagctgttaaagctggttgagccaagctttttcgtatttaaataatggaaacaggaacaggcagtatgcatagttaaggacgtaggtctgggttcgaactctgcctttgctacgtcccagctgtgcccatgacattatttaacctctcttgcctcagttttccccatctttatttttgttttattttattttattttttgagacagagtctccctcttttgcccaggctggagtgcagtgccgccatcttggctcactgcaatctcctcctcccaggatcaagtgattctcctgcctctgcctccccagtagctgggattacaggcatgcaccaccacacccggataatttttgtatttttagcagagacagggttttaccatgttggccaggctggtctcaaactcctgaccttaagtgatccacctgcctcggcctcccgatgtgctgggattacagcaagtttttcccatctttaaaatggacacaataacaaacctactttctaacactattgggagaacagaacaaggtaatgaacagaaagtgataagcacagtgactcatgcgtcacgtctacacatcgtatttagcaaaaagctaagcaagttattcccttgctgtgaattatcagattctagtaccagggagctgaaatactagtctgggggaagagtgtgccaatgagatctttgtatgggacagcttccccaacattagtgtgggaattccattaagaactcatttcttttttttctttcttttttttttttttgagatggagtcttgctctgtcgcccaggctggagtgcagtggcgcgatctcggctcactgcaagctccgcctcccgggttcacaccattctcctgcctcagcctccccagtaggtgggactacaggcgcccgccaccgcgcccggctaactttttgtatttttagtagagacggggtttcaccgtgtcactcaggatggtctcgatgtcctggcctcgtgatccgcccgtctcggcctcccaaagtgctcggattacaggcgtaagaacacatttctaagcttcacactgctgtcctgttgtcatgatgataggtcaaacttactgcagcttagtttgggcgggacattttggctgggaacaccaatacccgtaaaggtcatgtttacattcttgtgtgagcctttctttaaccactgagtgtattttctatcatgattatcatccacttcttgctgtgtattggcatgagggagtctttgtcctcctccatttgttcatccaaaaattactgaatagctaattaaccccgatgctggggatacaccaaacatgattcctgcaccttttcgagcttatatttggtggaaaggatagaaaaagcagcaacaaccaataaatggaaaaataaataaagccatcacaggtggtaagatgtctgtaaaagaaaccattgcgtcccaaagagagaaaagaagttcttttagtatctccagttgttaaaatagtgtctgacacatagtaggaactcaagtgattattcactgagtaaatgtttacggtaaatggaatagtttaggtaggggaatccacaaagattctctggggatctactatttcagcagaaatataaagaattattcatgagatgatcaaggggccagatagggctgggaggaagggaagtatgggtggtgagaaaggcggagagctggaaagatattggattgtttgaggaattgtggaataaagaatctctatggttgaaaaataaagagagaggtgttggggtagttattgattccgcaaagatgaagctcagagagtacccaggaacatgactggggtcataggttctggagaggaacttggactttaattgaaatgcaaggggaaatgactaaagtcttggtaaagtcaaagtccattggcaaccattcaatgaacttcaaatccatgccttttagggttggtgaccctgaaggatgaagcgttggccttgagaataaggcagttcttgtaagttcaaccactggctttcacttacagccttcatcacatcactcacctcctgtaagcatccgtagccttcattttcaatggagaaaaaagaagttgagatgcatttctccccattgctattttggaatccactcagagcactcagcgcctgctgttgttctcattggaatcttgctgtcccatgcaacttgacttctatttacactcctcggattcgtatgtgcaagtcttgcttgtgagggaagagccaccctagatatgaaaggacttgattaggaaaaaaaaaaaaaaaccttttgaagagagaggtgtaaaaaaaatgaagccattagcgtcaacttaaattcaagatatttgggatgatacatctgcttataggctcataaaacaggcaccagctcaaggttatgtgaaacaaagaaaatgtctagcattgctcagctgttttaggctacctaattatatttttagctttatgcacttgggattctcttttcttttttatttgttttgagggtgtatagtgggcacctgtcaattctgcagcccagaatccatgcccctacttctctaagagtgtccatttttccctctggtgatcattcctccccattctcagaccttttgacttccaggagagcttcgtctgtctcagtctacagggaacaagtgtgtggcttccacctggctctgagaagcactgtgtaccccagtcactatgactgttgaaaggtgagcatgcgcacctatcagaaccagtgacatgaagtttgtggaacattttttttttttttttttttttttggagacagagtcttgcttttggccaggctggagtgcactggaacgatttgagctcactgcaacctctgcctctcgggttcaagcgattcttctgcctcagcctcccgagtagctgggactacaggtgcatgctaattttttgtatttttagtagagatggagtttcaccttgttaaccaggatggtcttgaactcctgaccttgtgatccaccaacctcggcctcccaaagttctgggattacaggtgtgagccaccgtgcttggtcctgtctgtggaatttttaaaatgtgtttgaacttgggggacgtaggtctgaagctgtttgcagccattttggcaccatgtggagcgtaggaatgaaactcacactcacagaaagtgtgaagaagagcagaaagaaagaaatgaagaccaaggttcaatggcaccatttaatggtgatttaaaacatgtgtttgtttttatttttacttattatttattatttttaattaatttgtcttttagttgacaaataaaaattgtgtatatttgtcgtgtgatatatatatatataatggaatactactcagccttaaaaagaaggaaacctggctgggcacagtggttcccaccagtaacctcagcactttggtaggctgaggtgggagaattgcttgaacctaggagtttgaggctgcagggagctatgattgtgtcactgccttctagcttggatgacagagcgagatgctgtttcaaaaacaaaaacaaacaaaaaggaaattccatcacttgtggcaatatggaagaacctggaggacattcggctaaataaactaagccaggcacaaacatacaaatacaccatctcagtaatatgtggaatctaaaaaaagttgaactcacagaagcagagagtagaatggcggtttccaggggctgacaggtggagatggagagttcaggagatgttggacaatgacatcacttgaaaggtccctggatc

SEQ ID NO: 398 - DNA, 150945 bp, Homo sapiens
ttgccccaggtctcacattccaagtcctgcactctctcctctgctcttaccgccccatcctggaggagtcaggaaagccacactgcccttggctgcctggacttcccccaccagctgagctgctgagaggctggtggactgaggggcggagcagacttctgactctctgaggaagaatccagctgagagcccctcttcttaagtgcttccaacccagccagtccgagtaaagcaggtctgcaaacagggtgagcaggggtcagaagggaagagacagcctctataaacatcaacaccatgccctagaactaggccccagctggagcctcgccagcagcctcccagtcaatcaagaaaaagatccggaattggggaaaaggaagatgcatcagggccaagcctcgcgccagatctggcctgacgcttcttggtgccattgactgtcctggctgcattctgttcgcccaaggtcagtcctgccaccaggccagggctggcgtaactgccctccctgccaggccttaatcccattccctggaattaggcctcatcttcctatttcttcttgcggggcttgtagggaagggcttttcctgatgatggacagggctttttctggtgccagtgacaactccagggttgcaacctccatccagacattctctcacctcatccatggatttcaacagttgctcagactagacttgagttttcatttgatatcaggggcatagaacaggggaagaaacaggcgctttagttttagatctctgtcaaagtcctggctctgcacttactacctgtgtggctttgagcaagtcgcttaccctctcagagcccccacttcccccatagagaaatgggagaatggaagctatcagagtggcttccatttagaaggagctcctcccagcccttctctaacaggtcagaggaatggatgtgcttccaccactccctggcatttggaatcccagccaagtgccggttctggcttggccatctgctccatcgctgtcagcacactgctctgcatggtgggacagttccccatctatggtgctctcctgagccatcactgaccaggcttgggtctccttgggcaacctttattatgtggtctgcccatagtgggtggccctggctgctcccagggcagggaccatggcactcagcctgcatctcaggagtacctgtctgcattttactagtttctccatgaagacttgctgggttgaaaagagttgagaacatggcataagctgtgggatggggaccaagagaacctcagcttcatgctctaactttactcaaattacccaaacacttcagtgcaaacgcatcctcaaaactattcctcccatgtgtcttctgccttagagaatgacaccagcttccactcagtgccaaagcctgggcttcacttctcactgtgcccctcacccaccctccccactccaccacccttctctatcaccctctccaccaccctctccattgccctctccaccaccctctccatcatcctctccaacaccctctccatcaccctctccaccatccctccgcaaccatctctatcatcctctctactaccctctccatcatcaccctctccatcgccctatgcttcaccctctccctcctaccaatctccaaaacctgtggcttctgcttcctctgtcttatatctcatgtttagtctctagaatgcacgttagtttagtgaccagagaagaggtcccatgccactgggctttcactaatgtcattgccaccacctgcatgatttcacgccagcaaaatctttctcccagcctgaataactcttactcatcccaaagacctcaactccaatattgcctcttctaagtatccattcctgcctctttccaaattggattaggtgtttgccctcccagcctatatggattagatgtccccctgctcaacctatatgctcccttctcacccccatagagtaattgtcattctttgtgaatactgctagtttgcttgtctgtgttcaacactagatggagtgccctccaatggcagggatggtgtcagtacttttcaatgtgatgttcattcctagcaggctacagacagggtttagtaaacactcggcatttcttgaatggataagttctccttctgtagaaatgaacttgccaaaggtgtaggtaagactctcccagattaaaggctaaggagcatgaccactaaattcatcttgtaaacctgggttggatcctggatcaggaaagggccattcatgggacaattggtaaaatctgcataaagtctatggattagatgaatgttctatcaatgttaatttcctgatgttgttccctgtactcagatggcctgagaaattgacatctaggaaatctgaaccgaaaagtatatgggaattctttatgctttttttcacctttttcgtaaagtataaaattatataaaatcgaaagttaaaaatgcagacaaaataaaggtgtatattaattgaaaagaatgaaaactaacttcaggattccctcggaacttgattttttcattagtaaatttatcaccagttttcttttccttctgcttccccttttcctataaaaagcagtacctgtatgacagggcgtgggagggactcactgctgaaagcttacatgacaggcacgtgtgtgatgagtaggcccctgaaccctgctgggtgccaccaaccagcctagcaggtgattgcagagcccccagtggtcaaggtggacccggccagcccaacacaccggcccaatgcaccggcccaagcgcttcctgctggactggctgggcaaatgactcatctggactctaaacactagagctgcttcctaccatgctgaggacagcacccgttcatgggaatgggcttcacaaacagaaaagacccccaggaaggagagcgcctagcccaatccctagctccaccctgtctttcatcctcaagccaagacggctcgtcctccgcctcgtcctcagggtgtggacagactgtctgagtctcagggttggggccttcccttcagatgtcaggagtgcaggagaggttgcaggtgaaaccccaggcctacttcatcagcttgagccccaaagctggacaaacatcccctgtggcagctggcaggcctgtgccctccaggagtacagctggtccaggccgcccttcccatccaagacttgcagacgtgggagccatgccactgcctcctcctacagctgcagagcccctgcactcagaggcaggacaccccacatttatccacccaagctccagaagaagggcagtcagccttggcttgggcatctggggcaacatggtaagcactttcccacagggctgcccccagggctgttcaaaagctactctttggaatgaaataaaatctgcccccagcaacatccacctacagatcaaagtcctaccctatggtgattacacagaatcggtttgttttctctgccttgttgcagtcctttaaacatctggagacagtaaccgttttcctccagtctttttttagacagcgctgtgggattagacagttcttccactcgtcttcaaacagcatggtttctagatccctcaagatgttaccactgtctcatatactcacttttaaggttctttctataatgcaatggacaatgagactacaaagttccagacaaactagccagcacagaggacaataggaccatcgcctcctgtgatcgacaccccatttttgcattaatgcatcccatcatggccttgttagcaatgtgtgacgtcattgctcccactgaagctgcaagacagccacaaactccaaaacattcactctctcatatttgcacaattaacttttgaataccaaataaatgttctatgttaatcactgctaatattatatctgttagttttgtctctatagttaacacaatttcataactattcctgggcctcccaagagcatgggaagtccctcctaatgacgtgcatggtggctccaagcatgtcacctgggatgggagagtgtgcaaaaagacaaagctctgcagggccctgcccatctgataatgctcccttactcctggggaagccaagcagagaagactccaatgctttaaaccatggatgtgaggcattgtgaagggactgtgtgctctagagagggtgtgaggggatgcaagggatgctggaggcaaggtgcacctctgaacatgtgcgcatttggaatccagtcaggaaccagcaggcctatgggcctggagggagggtcctggcagcccagacacccctccccacaccgacaggagttaagacaaaggcatcactctgcttcatcacttctagaagaaagagaggcaagcagactgaatgtacgcctcacaaagggtgtgatttactgctcctgaaaaaaagtgctgaacctttttcattctgatgatatccagactccagaggggcagcagttcacttcagcggtagacagtaatgtgcatctctgctctggaacttcaagccacagtctgcaagaagaaaccccacctaggaaagtggcaccaagaaaatgcttcctgccaagacaatgcattaaatttattccttacaaacacatctcaactggggctatttctgcctcagtgaactctcagaaagggaggcaatgtggtggtttttctttcatcacataaaggaagtcagtaaagtggagcactaggattgtactagcaaatgcatcaacaacggacacaaagtagccttgacctcatgcaggattccacagatgttaaagtgtctgtacagatgagtggggtcacctgcggccaagtggttccatcattaaaccatccaaggattagaccatgtctagtctagggttcattgaaagcaacttctgggtggtcacagcaacaattgggaggtttggggtacttactgtgttcccaggaggtgtatgtggtctctgggcatggatgatactcattcatttcatgttggtcgaaagacatggtatttagtgaacgttttacatcatttctgctttgaagttgtggcaaactgttgtttcatttaagatgttcattttctccctctccattctctactagttttggtttatgttttcagtagtattcaaagcaactttaaccataaatctcagtgccttgaaattatttttaattaaacaaaaaactcatttaatataaaacaaatatatattaattaaaactctgaggacagccttagtagaggtataaatttcaaatcaaaccaatcagaaaaaagaaccaacagaaatttaataaatggaaaaatttgggaagaaagtaaacagtaatagctgatggtgcatttacttggtgccatgcactattctgaacactttataaatatcaaagaattctttcactatcctatgagttgtgcatcttaaagacaaaaagccttagatgcagaaagattaagcggttttcttatgatggcctttctagtaactttaagaactagaatttgaatgcaaaacccccacccttaactattatactgcttctttcttgatataaagtctattaaatagaagtcaaaaaattagagcgattgtataaataattccaaatatatcactgattataataactattactgggctaagttttcccttcaaaaggcaaattatgtcaacttaaatgtattgttaatacaaaaatcttacacacaaacacatacaggattgaaattaagaaagacaacagtatcagagttgtcacagaggcctgctaatcgcctgcttctcacatttctagagaggtaagcacaccactccagccattggctggagactccctcacgtgcaggtctctatccagaagggaattctctgacccggaaaacacagggaaggtgacttctattggattctcgtgaccacgttactgagttccccacattaaaaggtgagcagggagggcatgttctactttctcctgcagcttccaggacctgcctgtgctttgtcattgcagggctgggcacattgctgcctctgggaggccaagctggtgctcttctcatgctcctcactcccaggctttggctggttgagcaccttagtcatccagtctgcaggaccaagaatctccaatttggggaagaaggaaaaggaaaaggaaattccatttttcccttaagcacaagactacttttccataataaaaccacctctgttcttaggactcatccagctgtgctcccagtggactaagaacccaaaagagatgtgcaagtatttatctccctccaaaaactggatgggattttaacaaacatgtcagaaattgaaagaagcaagagcacaaaagaccgagggtgtaaataataaaactaacaaacttgattgtatagctagaaatagaaaacagacaaagatatggagacattgtttctaccaaaaacaataaataataaataaaaattttataaaattctacagtgtacagtaccccctccttatccccaggagatttgttccaagacccccagcagatgcctgaaaccttggatagcaccaaaccctatatactgctttttcctgtacatacacacctatgataaaatttaatgtacaaatttggcacagtaagagattaacaataatagtaaagcagaataattataacaatatactcatgaaagttatgtgaatgtggtctctcaaaatatcttactgtactgtactcacccttcttgtgatctgtcgatcttatcatcagaacaatgagtgagtgaccaacgggcaggtagcagaggcagtgtggatacctgcacaaagagatgattcacctccccagtgagacacagcaagatggcaccagatttcatcgtattactcagaacgcatgcaatttaaacgcataattttgaaagaggaaaaattataacaactccatatgtagaataacccagaaacaaagaagaaaggaatagcctctctccccaaaataaggttaacatttaaaaatataaaaaacttcaaaataatatttagatttaaaaagaaatcaaaggtaaaaaggctctttaaaaggaaatgtaattcagaacattatttatcgaaacctataagatatggccaaaaaatactctaaggagcatttatagcctcaaaagcattggctttaaaatatactgaaaataaattaaaatattgtactgaagtaacattcaatttaagaagaactccaaagtaaacaaaaaacaattttaacagaggaaaaaatacatttagttaaaatacaagttaatgaaataagaatgattattaaataagaatgaaataaaagaaggtaaaaaatgcagagagttctctctgaatggagggctcacacctacctgaccctttgctggagtaatctctgagctgcagtctcggattacctggtgccccacaggcactctctctgaagccagagggttcagacccacctaacacatcacagtgcctcagtgatggtgaacacatgacctcagaagcctcttagcccatctttccccacctctactcagaaagttgtttctcagttgagccacactctgacagttcctaaccctagacaagggaggagagaagatatatgtgtcaggcagaagtggcctctctctccttggtgcaaatgcaccaccagggccctcagactgcacccactgcagggagacaaaagaggagagcagggccagaggagggagctgcccttagagacttccaggtgcttgatcagctcccctggcatggatcagtgagagccaaccccaggagacatcttgggctgagctactaacactcaactcctcctgcctgcaccttgtggagggagtagctggtcaagcactgagtccaaggagaaggtctggcctcctcccctgagaggaggaaggatggggacaaccaggaacagggaagactggggcttctctaggagaccaggccctcgcaggaaagagaagccccacagacatggaggctggccaagctttgcccattgggcagtgctatggactgagctgtgtctcccccaaaatctaagtgttgaagccataatccccagtatgacaggatttagaggcagggcctttaaggaagtaaataaggttaaatgcagtcacaagggtgaggccctgatccaacaggactgctatcctataggaaaaggaaagcacatgagaagtacacacacacaaggaaaaatccacatgaggacacagtgagaaggcagccattgcaagttcggaagagtcctcaccagaaaccaaccctgctgacactttgttcttggacttcaggaccgtgagaaaatgagtttctgttgtttaagccacccagtccgtggtactttgctatggcagcccaagcagactaatacagtgaggagaaaaaataaattaataaataaataaatagcaaaacaaaacacagccacttcctctattggaatagccaagatttttctttttacatactatatgttagaaagagagagagtaaaaatgtaaagaaaagtgttggcttttttattttaactagtgcttagcaagtttaaaacaatataaatggtgaaggccatcacacacgcatcccttcatttgacacttcaggtcacggcatctgtctgaacctccatggctcatcccattcaacaaatgtttgactgagcaaatatttgacggcaggtcttgcggaacatatgtgtgacagggaaggactgacagggtgatgccacagagatgagcagcagggacccagctcagcactctcccttccgggcagagctgtgtcctcccgcgagtgcgtcggggcagaagccacagagtccacgtggggtccctctagagtctgcacctgtgaaaacaactgcacctccctcatcctccatgtgcgtgcctgacagggcctggctctctggccaggggccagggggagctgcccagagacggcccttcaacacaagagcagcaggagtcaagcaggaaacccggagagccactccctgaggaggagcagccccaagggattgtggggggccagtgtcagcttggcctcagacatcccagcacgggtgcagaggagcacagcactgtagtccccccagctcagtcgctgtccctgctgcctgacccagctgcccagcctctttgtcactggtcacatgattctttcacaaaacaagtagaacaaggcatggttgtatgaatttctagctccctaccctccagcctgggtaggtcagggcacctgtctgaacctccattgctcatcccattcaacaaatgtttgagcaatcatttgatggcaggtcttgcggaagatatggcttatagaacacgaagcacatgtttcttttgcaattgcagcacatcttacatgtatgtaaaaagtagctcaattaaacagatgagtgttaatattcaaagatgaggaaacacattctctacattgctgatggtgtttatgtctgcaaagggaattcggattgggaggatggatggaaattagagcttggaatccacaatcagaccaacacaggcctttggcggctgggaagagggtcgggtgccctgatcttcagggcctccagcgctgggttcggggttcctgaccaggatcctgaagctccaccagctcgacagccttgcagaaaacaacaaggggggctcgggcctctgtaaatatctgttctttttctgctcacagtctccacaggaggggatggggctgcatttagctgctaaagcctcttcctctgtaagtaggatattaagggatggagtccagctagataaataaaccaagtccctgaggcgagacccttgctgcccccgtagaccggagaaagttcccatagtcggactccgagccagcagctgaagggcctcctcatgtttcaggattcgggagaggaggggccacgagggatcagctgtggatcacatcccaaacgccgctcctctctgggctaacaccgctgggcctggggatcctcgtgtgcggaggaggacgaaagtgtgccggcagctggctggatcctggaaaatgcagaggggaggggagggcctgtggggaccctaaaggccccaaggagaggctgcgggaaggccaaaggctggcgctcttattcccaggcatgccaagcccctggctcacacaggcctgtggggctcagtaaaggacacaacacaacccttctctgggctcctggctgtctggcgggggaaaagagttggaaaaagaaggcccatatatcttaaaatgataaaaagtgatggccacatacattgtcagatgcctatgtcattgtcacttaaggcattatggggacagatggcaagacaagcaccatgcaataatgagttccaacctgagttctcctgctctgctaaggggtcctgcgcgctgggtagaggccagggagacagtgttgatccacagacctgggaggaagaagtcaccaggctctgtgaggatcagcagaaaccaagcagacatcccactgcactgcccaggaacctggtgggcatcacacatttggaaatacttttagggaaagggggcagaagacaaaggggagcagtaaagcaagtaagagtgtctgtccaaaagtcaccaagagcagcttacaaatcctgttcacaggcgctcttgcctagacgccccttcccgggtcccagcgcttcagcgcagccagtgtctttcctgtctttccactctgagtcctcaggccaggccagctccatgtccgggtgccttagcacagcctttgcccccagccgtggggttgggaggcttcacaccactcgctccagcctgctccgggtgtgaaggcagcacctacatgcagtcctaaccctcaccctgcctggagcacagagccccaggtgaatgctggctggaaggattagtacactcatcatgtaggacaagaatactatccccatttttggacaaataaactgaggttttgatttttttgtgtatgtaattataagagtaaactgggagtagttccagagctgcttattctaaatctctcacacactaccttctcaaagttaagtggaggcactgccttgattgtttcagcaggcccactcgaaagttgccggtgaagggatgttctggtactgaattgaaagggagacaacaaaaggagccagtggccagtgagaacacctcagagggtgtccacacaccagcccccctgctctctccaccacaggagcgtttagcatttgcaaatgtgagtggagagcctcaagatttcgccgaacttggaaagcatcagagaagaactactaatatctccattcactatgtgctaagcaccctttgatacacattgcagggttaaaaaggtaaaccaaagcacagtaaaatttttaaagagtttgagcaaacagggattcatgaattaggcagctccaaagaggaagtggtttgtgagttccatcaaaggaatgcaagaaggagatttctataatacaaacagggaagtcaaacaaaagaaaatatttaattgattatggatatgcaattggcttattgagtctatcccactgaaaaaacctctagttacatacaagcataccttggagacattgcgggttcagtgacaaactactgtctgcaaatactgcaaatatcacaatcaagtgtgtcacatgttttttgtttcccactgaataccagttatgtttatagtatactatagtctatgaagtgtacaatagcattatgtctaaaaaagcagtgcacataccctaattcaaaaatacttcattgctgagaaatactaatgattatccgagccttcggagacttgtaatctttttctggtggagggtctaggcttgatgttgacatgttgacggctgttgattaatcagggcagtggttgctgaaggttggggtggccatggcaatttcataaaataagacaacaatgaggtttactacatccattgactctttcatgaaagatttccctgtagcatgtgatgctgtttgatagtattttacccacattagaacatctttcaaaattggagtcaatcccctcaagcactcccactactttattgtaatctacatttatataaaattattcatcctttgttgtcatttcacaatgttcacagcactttcacctgaaatagatcccatctcaagaaagcactttctttactcacctgtaagaagcaactcctcatctgttcaagttttatcatgagattgcagcaattcagtttaatcttcaggctccacttctgattctatttcttttgctgtttccaccatatctgtaggtgcattctccactgaagccttgaatctctcatagtcatccacaagggttgaaatcaacttctttcaaactcctgtttatgttgatattttgatctcctctcatgaatcatgaatgttcttaatggcatctagaatggtaaattatttccagaagatttttaatttactttacccagatccatcagaggaatcactatctataggaacaatagtcttacaaaatttgttccttaaataataagacttgaaagtcaaaattactccttgattcatgggctgcagaatggatgttgtgttagcaggcatgaaacattaatctctttgtatatgtccatcttgggtgaccaggtgcattggcaatgagcagtaatgttttgaaaataatcttttttctgagcactaggtttcacttatgtgtttaaaatattcagtaaaccatgctgtaaacagatgtgccatcatcaaggctttgttttttcagaaagaggaaatttagcataattcttaagggctctaagtttttttggaataataaacgagcattggtttcaacttcaagtcgccagctgcattagcccctaacaagcctgtcatttgaagctttgaagctttgaagctttaaagctagacattgacttctctctacgtacaaaagtcctagatggtatcttctttcgacagaggactgttttatctacactgaaaatctgttgtttagtgtaaccaccttcatcaatgatcttagctagatcttctggagaacttactgcagctcctccatcagctcttgctgctttaccttgtacttttatgttatggagacagcatctctcctttaacctcatgaaccaacctctgctagcttccaacttttcttctgcaactttctcacctctctcatcctctatagaactgaagagttagggccttgctgtggattaggctttggcttaaggaagactgtggctgttttgatcttctacttggaccacttaaactttctctgtatcagcaataaggctatttcactttcttatcgttcatgtgttcattgaatacatgaatgatgattttctctaagaaattaactttctcaagaatgtttcctttgcattcacaacttggctaactctttggtgcacaagacttagctctcagcctgtctccacttttgacacgccttcctcactaagcttaattgtttctagctgttgattgaaagtgggagatgtggacccttcctttcacttgaacacttagaagtcattgaagaactattaattgtcctagtctcaacattggtatgtctcagggaaagggaggcctgcggagagggaaagagagggaaacagtctctcttttcagtagagcggtcagaacacacacaacctttatctactaagttcgccatcttatatgggtatagtttgtaccccctgcaaaaaattacaacagcaacatcaaagatcactgatgacagatcactatatataataataatgaaaaggtttgaaatattgtgggaattaccaaaatgtgacaacaaagtgagcatatgctgttggaaaaatggtgccgatggacttgcacaacacagagttgccacaaaccttcaatttttaaaaaagcacaatatctgtcaagttcaataaagtgacgtgcaataaaacacggtatgctttcaattatgagtgagttggctgcttctgattggttgagattacgttctgcttttctttaagatagatatttacaagaaatagctcaagttaagtctctgtaatgtttgcaaagcaagtgaggttaaagtcacttaggaggcttaacaagctttatctgctcagggcttcttcaggcctggcctcagtgttaactatggcagctgcctctgagatggcccccaaggatgctcattcagtgtgagagtgagtggcttctgaggctacagaatcacagccattgcagctttccccactctcacggtggctcgctcttggggaagccaactgctgtgctgggaggacactcatgcagcccatgtaggggccactggaccacctgccagccatgtgactgagccactgtggaagagaaggccacatggctgcaaccacagagacaccaagcaagaactgcacagcccagccttgcccaaatctctgacccacagaaaccatgaaatgtcatcaattgctcctggtgttttaaagccacaacatttgaagtgatttgtcatgtagcaatagataaccaaagcagattaataatttaatcaccacaaaaaacaagagtacatatactattacctttaataaatgaggaaatgggacatgaggcaaacagccagtatacatttgctagagacaggttttgaatccatatggtttgcttctcactgcactatccaagacagtggccaaaatccattaaaaatttttaaaaataagacattcagtttctcagtttgtactattcacaattcaagtgcccagtgtggccagaggaagctatgttggagagtgaatatcggatgtttccattattgaaggaagtttggttggactgtgctggtgtggggcatattcaattaaccactacatctaacatctaaaaataaattggagatccttgcttgaattcaccaagggaattaccagttgtgggttgctcctggagtgtaactggatggtacagacagcaggctctaggcatttgaagattcattccccactccggatacgccaggttggaagaaactcacacctcatagagaccctccacctccttcccatcttctctcaagttccctggcattttttttgtcactcagcttgttaaaactcagtatatcaagacacccccagcacgccagggtgctcatctctcaggcccatcactgcttggttttcttgtccattgatcactcagcacacacatagaagacttacctggcctgggcccactgctgggccagacaccaaggagaataagatgcagccccttgcttcatggtcctcacagtcctctgggaggtttcctgcaaggtggtgctgtgctctgcaatagaggaatcttggaggagctgtggaaaggcagaggctgaaacaggaacatgcagctgctagaggtgctcaggaaggacacatgaaaagatgcatttgaagtggtaggacaggaagggatgcctggcaacagcgaagaaatgctggggtacttcccacacaggcagtggcttcagagagcacagctcgctccaggaagaagaaagagtctgaggatgccacgatgatgaagacagatgccaggctctgcagggcctcacatggaaggagaatgaaaagaggatatgtggcctttccatttgcctctatgctgtggggctgcatttgggtctaatggctgcctggtcgtcaatgcacactggagggtgactgaggtggacacactgttttgatgtggctcctccacttccccactgactctagctgggctcaggtgggtggcagagaacagcatgtagaagcatggcaggcaccatcagcctggatgcagagggacgctaacaaacctgtagaagggctccagccaattcacaatagacatcagatgagtatcttcaacagcaagagggaggttgctgcaactgctttgcagacagaggccagggcaggggcagggggcctgggaaaaggcagcaccacatacagggtcaggatagagatgcacaaaaagggcatgacagcaaactgcccacccattcacatatgaaatggcagccacaaatgcagagggaagtagaccttggaataaaatcttcaataaatcaatgagcaggtcattcggtgacttagagttttggtcacttgcttctcaatgaactagtcatttgcaaattgtttttcagtgaattgatctggtttccagaaagaggccccaagcagaggactccactgtggcttccagagtgttcactccggtcacctgctcagatgtaagaaatgcaaaggaaactgaactgcttaactctctgaagtccctctctttccttatctccaagtgcaaatcctccacacagaaggctgaggtcattctccatggtatgttttaagcctttccatcttcactaaaacttcttttcttcaggtttctttcttgttctcttgctgtcgtcttgccctcctgcctgctcttgctctttctttctataaacaatgatataaattaccacttagcctgagctgcttagcttattccctgttctttatggagacagcatgttccataatggatcgcctttgtgcaaagaagcaatcccagtaattaggcacactttcatggagaacccaagcaccataactcaggagatcataagcatttctaccctggtgaagttcagtttaatgcaaaataaacatgtgtttcctgtcccttattctaaatcgattgggccatttgtctaatttaaacactctataaattatacacatcctccaaagatagggatgaggtagaggcccttgatgtatgctttttcctatggcttgaatccatcactgtctcctgcaaggccccttagctttctcctgagtggatggaggccccataactctctgatctgcttcattttctctgacaccccttaggatcctttttcagacaatttggctagagaattatggctgactttcagaagaaagggaatgaagtttaaacttgaactgagtcttgcaatatcttatgttttgctagcacaacattcaaattctctccaatttctcttctctgtccattataagattttacaagggaaaagtcaaagaaagtaaggcaggttgggtatggatacttgtggtgtacaattatgcaccatttttagccaatttagcacaactgaatactgggggggaaaaaactctcttgatcaaatcattagtttctctggcatatgagctttcaagaagggtgaagacctctcttgggatttacatctccaactggtgggttttcttaacttttcaaatcttgtaggtaaattgtaacctggttatcaaatagattccattttattataaataaattaggccctattttgttcccattttcacatttaaaagctaatctttgttgtcatgcctatctgttaaatcacataatacatgaactggaaggaaaataagagctcagagaattcaatttccttattttataaatacactgaaactaacaaagagcggcaactgagatggaactagaactaagattcttgaatattggttcagtttgtaggggttagaaaatatgacaaagtcaggcataagataattctgtaatcactgctactgtgtggcattgcacagaggtttcatataatagagtaagttaagaaaaataaagcaaagctatgattttgaaaacaaaagagaaaattctatgttttcaactgaaaggattatatacctagaataccaagacaaataacttactaaataaaactgtaatagaattcagggagatgggtgattaataagaatgccatacagaaattaatattttgtagtaaaaaataaatagaaaaaaagtcctcctttacaaatttcataagcccataagactcctaaaaactaataagaaatgtttatggcatatataaataaaacaatcatacattcttgaaaaactataaaatacctgaatcaatgagaaacaaatcgtttctggctgagaatcccccatactgtaaaattatcagttctaccaaatcagttaggagatttattacactcaaaccaagattctcaaaggatgatttataaaatgtgacaaggtgattctaaagttcttctaggaaacacataagtataaccaataaaattctgagaaagaataattatgaaaacaggcttgctgtttcagatatcagaatatattttgaaacaatactgatggaggaattgttaagtaaccgatgaagcagaaaagcagtagaaatgagtccatatatactgtgtttttaaaatggtatatcaaaacggtatatcaaaactgtggggaaagggtgagttatgattaataaataaataaactgctgtaagccagcaatacaattacaagagaaaataaagtcagttccctctttgaccaatatgcaaatatgaattctagctagaataaaaggataaatataaaacttccagtggaataaaagtacatataggaattttttaaatacaaacttataaaggtggaagaatccttgctgaacaaggcacgttgttgatgaattataaataaaaagaaggaaatggccgggtgtggtggctcatgcctatagtcccagcactttgggaggccaaggcaggtagattacttgaggtcaggagttaaagaccagcctggccaacatggcaaaaccccatttctactaaaaacacaaaaattagccaggcatggtggcgcatgcctgtaatcccagctacccgggaggctgaggcatgagaatcacttgaacccagataaaacttaagagttctgtatgacagaagacaccatgaacaaagtataaagataagtggcagagttacaggcagggaaaatgtttacaacaagaatgaacagtaataattcccagaatatatatggaaatcctaccaaaaaaataagacaaacaatataaacatataagcaaaatgtatgaacattagattcatagtaaaaggtactgatggctaataaatatataaagatacagtacttgagtaagttttcatataaataatgacctataagaagaaaccaggagaagcagcactggattagcactgagacaaaataacatccactgatttgggagaaccaatgtcttcactattgagtcttcccattcaggaacatgcttggtctattcatttattcagatctgtatccttcaattagtgtaattgcttcatttataaggacatagatttttcattgactttgggaggtttttttgacattacctttcaaacttttctcatttctgtgtcactcctttgttccctagtccttcattgccctcctataagacattctgttaatatatcacattaaataagaaatgaataaaaactctagcaacattcaagcagcattctctgaagacacagaaaatcttgtagaaagaattgtttaaagaacgcatggcatataagaaaatgtggaggtgggaagcaaaggagatgatggctgttcgtgtgctcccggaccagctggggtcctagtgcagagacgctgggatctgattcagagcaaggagttatcctcatgccagataagggtacattccaggatggccagggctaagaaggctttcagcacacactccctctccccttttcatttccctccaccataagctgagggccctcaagtttttcccttgtctttttttttttttgagacggagttcccctcttgttgcccaggctggagtccagtggtgcaatctcggctcactgcaactactgcctcccagattccaatgattctcctgcctcagactccctagtagctgggattacaggcatgcgccaccatgcctggctaaatttgtattattggtagagacggggtttcaccatgttggtcaggccggtttcgaactcctgacctcaggtgatccacccgcctcggcctcccaaagtgctgggattacagcactgtgcccggccttcccttgtcttttccacactttccttctttccccaggttgacacttcagacctccaggctgcttgactggcataagtcttgaacccagcttccctgtgcaggaaaacatgctgctgcctcttgtttttctatggatcccatcaggtttacctggatggatggatggatggatggatggatggatggatggacgggcttcacctctggcattggttcttctggatttagacatctcttatccaagagattacacactagtaactaagttctaaccatttgatgtggctttcaactccactagccgattctctagccctcctgtggctttcctggttatcctattgagtgctgctttagatatctcattcatgtcttcccgggtgtgaggacagatcatgcctctaaagacgcatgttaattttccagaaacagagaaaattcgactttcagatccatgtgcatcagttccatttaaatctgtcattagcaccatgaagtcaaactgcgtcagaacttttcagcattaaatatgacctgatggatgtttcctgtgtttcttttcctttgcctcagaaaaaaataagctgcccttagccatatgagaatttaaacacagctaaaatatcagtcccctaaaacccatgtctatggacacttacacagaatagctccgacggtttaaccaatagcaagtccaaataaagagaccactgcagtgaaagccacctcaaaataaggaagctcatcctggattcaccacactccacaaactcccaggaggacggagttgtgactagcacataagaatgagaacaacagtgccaggaattgaggtgagcgaggagtccctcagcaggaagtagatcatttctaagagatgagtaaacacctcatgcagctgctgttttaatttctcatgtgcttgactgaaaagcagtttggaaagttgagatgagctttttttttttttttttgagacagagtctcactctgtagcccaagctggagtgcgatggcatggtctcggctcactgcaacctctgcctctggggctcaagcgattctcgtgcctcagcctcctgagtagctggtactacaggcatgcaccaccatgcccagctaattttttgcattttagtagagacagggtttcacaatgttgcccagggtggtcttgaactcctgagctcaggagacccacctgcctcagccacccaaagtgctgggattataggcatgagccaccacaccccacctgaaatgagcttgctttcttttctttttttttttccttttttgagatggagtctagctccttcacccaggctggagtgcagtggcatgattgtggcttactgcaacctctgcctctggggctcaagcaattcttgtgtctcagcctcctgagtagctggtactacaggcatgcaccaccatacctagctaatttttgtatttttagtagagacagggtttcactgtgttggccaggctggtctcaaactcctgacctcgtgatccgcccaccttggccttccaaagtgctgggattacatcaaatgagctttcttaacctctcatgaactcaggatactggatgatttattttctgtctatcagatagcattcacaagactttaatttggaatagaattaagtactccatgaatgcactaaagaggccaaataaaaggtagaggttggcagagaacactctttaaatggcccaaatatatgttgtttataagaaactcacttcaagtataacaatataggcaagtagaaagtaaatggatagaagaaaaatatatatatatatataatgcaaacactaatcaaaaaaatgagtaacaatgttcatatcagataaagtagacttcagagcaaaagcaattaccagagacgttatttaatgataaaagagtcaatccatttagaaggcatagaaatgctaaacgtgtatgcaccaaccaacagagcgacaaaatatgtgacgtgaaaacagatagaactaaaaggaaaaatagacaagtcaacggttatcattggaaactttaacaccccctctcaaccattggtaaaaaaaaactagacaaaaaataatcaaggataccatcaaacagcaagagctcattgacatttatagaacactccactcaacagcagaatgaacattcttttcaagtgcccaccaaacctatgccaagatagacagtgctatgatttgagtgtttgtccccttcaaaactcattgtaaaatttaatccccaatgtggcagtattgagaggtgggacctttaagaggtgattgggtcataaaggctctgtcatcatgaatggactagttcattcatggattaattggttaataagttgtcatagaggtgggactggtggctttacaagaaaaggaagggagacctaaactaggacatgagcatgttaagccccctttctatgtgatgccctgcaccatctcaggactctgcagcaagtccgccccagcaagaaggtccttacacgatgcagccctcaaccttgggcttcccagcctctataaccataaaaaaaaaaaaatccttttctttatcaatcgcccagttttgagtattctgttataagcaacagaaaacaaagacagacactatcttaggctataaatctagcctcagcaaatgtaaaagaattgaaatcagagagagtatgttctctaatcacaataaaatcaactagaaatcagtaagagaaagataacaggaaaaatttcaagcacttgtaaactcacaagcacatttctaaatagtctgagtcaaagaggctatctcaaggaaaatttgtaaatgcatcgagctaaataaaaattaaaacataacattaaaatttgtgggacacagttaaaagcagtgctaagagggaaatttatagcactgaatgtacacaatagaaaacaaaagtttcaaatcatttatttatgtacctctgtcaagaacctagaaagagaagacaaaaataaatccaaagcaagcttccagaaataacaaagataaatcagtgaaattcaaaagagaaaaacaataggttatcaatgaaactgacaaacctctaataagattggcaaagggaaaagagagaagatacaaattactaatatcagaaataaaacaaggaaaaccaatacagacccttcagacagcaaaagggtgacgagggaaagccataaacaacttagcacacataactacaaaaacttagatttaatggaccaagtccttgaaaaggacaaattaccacagctcatccaatataaataaatagtttgaatagccaataactattagggaaatttaatttgtaattttaaaaccccctaaaagaaatatttatgcccagatggaaatatttatctccaggattccactggagattcctaccaaatctaaagaagaattaacaccaattctgtacatcttttccaggaaatagaaggggagggaatgctttatcaaagtttaaaacttttgtgttattactttaaagagacaggggcttgccatgttgcccaggctgttctcaaactcctgagctcaagcaatccaccacctcagcctgctgaagtgctgggattacaggtgtaagccactgtgcctggcctaaaaactttcgttgaaagaatgataagatgagttacagagtgtaagaaaatatttgcagatcatatatccaacaaagcactaatatctagaatatataaagaagcttcaaaactaacaattaaaaaaatcgaattagaaaatgcacaaaagacacaaagacaaagtggatatacagatggaaaataagcccatgaaatattttacatcattagcctttagggaaatgcaaattaaaaacacaatgagataccaccaatatacctacattaatagctaaaataaaaaatagtaaggccgggcgcggtggctcacgcctgtaatcccagcactttgggaggccgaggcgggtggatcacgaggtcaggagatcgagaccacggtgaaaccccgtctctactaaaaatacaaaaaattagccgggcgcagtggcgggcgcctgtagtcccagctactcgggaggctgaggcaggagaatggtgtgaacccggaaggcggagcttgcagtgagcggagatcgcgccacagcactccagcctgggcgataaaacgagactccgtctcaaaaaaaaaaaaaaaaaatagtaacaacacccaatgttgggtgcaacaaccaatgttgggtgcaacacccaatgcatggatgcagagaaattggatgactcgtacattgcaagtaggaatgtagaatcattcagccacattggaaaacagtttggcaattttttaaaaaaataaacatgcaaataacatatgacccagtgattatactcttggacatttgtcctagagcaatgaaggcttacattcacacaaaaacttgttcacaaatatttatagcaatttatttacaacagttaaaaactggaaacaactagatgtccttcagcaggtagatggttaaacaattgggtactattaatatatatccatactatggaatactactcagcagtaagaagaaactatagataaatacatcaaacagatgaatatccagagaatgatgctagtgagaaaaagccagttccaaaagactggcttacacactatcagatacacactatctgattcaatttacataatattctcaaaaatgacagaattatagatgtggagcacagagtcgtggtatccagggtctaaggaggggtggagataggaaagaaagtgggtatgactataaatagaccacatgaggaatccttgcggcagtggaatgccctgtagcttggctgttctgatgtcaatatcctggtggtgatattgtactgtaattcatggtaccatggatataccaggatttgtttaaccactgaaagcaactgggtaaagagcacatggggtctctgtgtaatatttctagcaactgcatgagaatctacagtgatctcaaaataaaactttgatttcaaaaagaaaaaaatgtttttaatccaaatatttttaatcctaaaggcatatggaaacagaaaataaataaatactacgttaattcttttcactacaaacggtctttcataaactcttcagagtttttctgaatggagaattgtaattctaactaaaagatctactacttatcctgaatgtggagtcaaggtagagttatcaccatcccaataaactgcacatttcacctctgcctacgccaaggatcaatcagtgtgtcatctccaaaactctacatcagcttatggcctgaagcagcctggcttacgacataatcatttcactattggtcactaaaataatctaattacattccatgaaaatgtaactggaaacaagacattgtttgacagtgtttgttgaaaacctttatcacaatattacccagagggaagtgggaagaaacagtttccaaacaactcagtttccaaacctgaactcagtaataaccccttctctttcacttacatctaaatatctgatccaggtcttagacaaactgtatgtgtgtgctcatgagccgcagcacacaggaagaggagccccaccatactctctgctgatgatgaggtttactattgagaaccaggagggaccttcagaggcagccagccttgtgggctcaccatactcagaaagaagagtgaacactaatttagctggtgtggccctactgctctagtcagacttcccacaacattctattcagtgaatccatggactccatgacatcactcagggaacatttggagtccccatagcctgtcagtctcagccagagacaaaaatccaaaattctactcagctagccagtggatgcaaccaaagcttcaagctccagatatcagagcttctacattctgtggatctaaagccttgatcaccaccctaggacttgagcagcccctggagttaacgtcagtgttctttcctcaggagccatctttcatctgcctggagacctgcttccatgcagagtaggacagctctccatttggagatgactccatcgagctttgtaatttccataacaggaaattagaccaaagacaatgaaggccttaatgggtaggctgcccccactgtgtccggagtcactgagaactaggcatggcaggtgttagcatgcccctaccagatggaagggtgctgtcctgtggtgataatgttaggcccccatgccccagtgcccaaccaagccagcgccttgctcctggtcatcaccaccaaatagatccagtcgctaagactgggtttctgctctgtctctaattttctattctagttaactagaatagaaatagaataggctgtaaccctattcttctggcctgtccccgcctccttttctccaagggctgaaacctaattcctttatctcccagctactgacaagatgttatcactcacctgactttgggttttgccaattctcaaagattcaaagaggccataagatagaaactcttgtgatttttcttcaaacaaccagacccacaaaaaaaaggcagaaagagaaaaaagaatcttgaattagactcatcttggataaccctggacaacagggatatttaattcaattcaactcaacaaaaacatctcaagtttccatgtgtgtctggcattttttcagcttttggaatagtagagattaatacaacacagctcttgcctgccccaagtgtgttgctaattgggaaaacatacatataaacataactccttaatttaatatagcacataatgtggctggagggtttcataaaatatgaatttttgtttcatcaagagtagtgtatgggtcccacagaggaggacaaagggaaagcaggggagaaaggactgggcaagagccaaaagagggagaaagagagtccccagcactaaaaaggacacattagatggggttgtgtgagcagcaggcacctgcactgctccggggggtggcaggacctccgagggagctccctgggggttggctgcagggagactgcccgcaggtcccagcaaagagccccacacgcaagcctcggatgggatcctggcactgtctgcttaccaggagccaggccagacaaaggggaaccaaggtgtggagcactggacaaggagtgaaccaaaggtggccagttcggccatgaatagagtcctcccagatgccctcctcaaactaagttccccttcatagacttttgggatgagtggaacaaaccccagttgtagagatgagggagatttctgccagccctggcagaagtggggcagagaactgattataatcgattgcataaaaataaagctctatgactattgtgcgtgtgtgtgtgtgtgtgtgtgtgtgtgaagttttttttttttttttttgagacagtcttgctctgttgcccaggctggagtgcgttggcacgatcttggctcacctcccaaattttcccacctctgcctcctgggttcaagcaattatcctgcctcagcctcccgagtagctgggactacaggcatgcaccaccacacccagctaatttttgtatttttagtagagatggggtttcaccatgttggccaggctggtctcgaactcctgacctcaggtgatccacttgcctcagcctcccaaagtgctgggattacaggtgtgagccaccacgcctggctgtgaagatttaaaaccactctacagtgataagcacagggtatagaagaaatatggtggagggcaccagacccagatgtggactcctatgaaatctgcatggagaagctgatgggaagactgagtcttgaagcatgagttagagagaatctggtaaggaaggggcatagagggagatccaagtgagatgacgtgtgtgggggtgggggagactgaagggaaatctcaacagagggcccccccccaacggatctgcctctggatccacctccacaatgctcttaggtttggcacactgctgcttcctaccttctatttgcaagcagcccgtgatacctggcaacatgtttgcatggcccactctgaccctctgtctcttgctcaggaaataccctagaaccacaaccataagagcatctcatttactttgcagctaatttaggattcataatctttcatcaatattaggatgatagaacatttgaactgaagatttaacaactttgttcaaaattgttcttttgcagatggcgaaatttatttaagaccagaaatgagaaataacctgtcacttgtcatgcatccagaaaggggtggagttgaaatctgcatccatgtctcctgatggctaatcctttgctggagggtcagcagctgctttgtagaactgcaaggggcaatattcagcttgtgttctatgaggttggctccccaggtgcccctcagagttgtgtgatgccaagccctgaggccatgctgcactgcctccaacaaagggcagccgacactggccagatgctcacagcttcaccagcttcacagcttcacctgggcatcagcttctctgcagtgtccatgcccaacacattgggagttagcaatggtgtgaagaaatggcaggaaattgtaccaggcgttcccaccttcgggcatgaaagggcccagtgtcagggaaaagcatagtgccttcttctgccacagaaatgagctaggcagggagaggaatcagagatgactctgtttcccttcttgttctatcaaccacctcccaaattatcccacctccaattctctgccactgccatcaagaagccaaaagacaagcatttgaaggagatgtcccaggacgtaagtggagggcagaaaatgtgctcttgtcactggagcagcagaggccaaggagatcctttaactcccctcaccctggacaccagcctccagccccaggtggcatgcatcctgagggtgcagtggtgggctgaagaactgtctttaaaaacgcacttttcctaggaagggggaacttgagaagctcagagcattggaaagtaatgaaagccttcttgatggagaagctaataaaaaggagagacccacggacagcatggagggggccaggcccagagcccaggcaggcaagagctttccagccaagggtgactcccaactggctggagaagggaactttgtgacaactggcttgtgtttgggctagagccactcggaggagtcttcaaagaaaagtaaaaagtgggagagccagccgactggagatttctggaaatgggactttcagatactccccaattcagatttttatgtactggactagttttacgctaaagttactcaaaacaacaacaaaaaagacagagagggagagagagggagaagttagactatcctgccccttcttagatggttacaatttcctgttctaacctagtgtgcaggttcaactgggaggtgagtgaactttagggagcaggactggcagagcagggctccacgaagccagggcctcacagcactgccacacgccatggcccgggcctgtggcctccttagaggtggaaggggcttggaaggcggtagtatcaaagcttgtacacaaggattatttgacacttcttctgtccaaaagtggagtctactccccctctcaactatgggccagtcttagtgacttgctcctaactaatagaatgcatcacaagtagtttgcaagactagatcataaaaggtgatagatgatgcactttccatatgatgttctcccgcctcccctccctctccctctcactctctccatcaagatctctccctctctatggggatgctggcactgggaacccagccaccatcttgtgaggaagccagatcaccccttgaaaaagccacacagccacacataggcatgagggagacttcagatgactgcagccccagcccgtgactgggagctgccccagatggtgccaagtgggacagagatgagccgcctctacctgcattgcagattcccaagcaaattaaatgttgttattgatctcagctaccatgttttgggggaatgttttattacatattagtcaatgaccttactagaaagcttcttgctcaagctttttcttggtatttggaaactgagacctcagagctcaggaagaacaacacacagtgaaggctgctctgaggtgaggtcgagctgctgcttagactccagcttttggcctcccttttggccaacctagtggttgattttgagtgttaactggactggattaagggatgcccagatagctggtaaagcattatttattttcagttgctgcattaattattctcaatgcttcagtaggcagtttaacatttgatgaaagtaactgggttgccccaggtgtgtctgtgagtttatttatagaggagattggtgtgtgagtcagtggacccagtgggaaagaaccaccctcaatgtgggtgggcaccatcaaatcagctgggggcccagacggaacaaaaggtggaggaaagggaattccttgctcattcactctctgctgaagttgggacaccctttttctcctgccttggacatcttaactccagtttctccaggctttggactccgggactcaccccaactgcccctacaccctgactctatgttctcaagcctctggcctcaagctgagccatcaactcctcaggttttgaggctttgagacttggactgagccaagctgccagcttccctgggcctccagcttgtagacaacctgccatgtgacttagcctttataatcatatgagccaattccgctaatgaactcttcatatctctctctctctctctattgcatatagattatatatgtatatataaatacatatatataaatacatcatatatatatatacatatatatatatatatcagtcctatctctgaagaaccctgactaaaacaccagcctgtgcccctccctctgtcccacaggtggacacatggactgtgtttgccacctgagtactcccagcagagaggggaaaaggaagcagccccatcccactgggtgctcccccaccaaaacaatctttatcttctcatgcagatgtcagtccctgggctgggttgctccccacacccaggatcctgggaatggtacgtcttgcatgtcacctgctcctgtttgtatgaaagagcctggacaccaggcaggggttggggggacaactacaatgccctttgcagggctctacacactgaggctgcagccccacacagaggtggggagagcaaagctgttcccagccctggcgtagctgcctggacacaccaagggccttgtctgaagtctgggtagcccagatcctggagttaacaggagaaacatgagagcagcctctttcacaggctctcctccagtcataaatgtgccatccagttccccacaaataaagcacaggccatcttacagagaacttgtcatcagaagaaagaagtgccggactccttgctgggctctggggagctcactgctgggatggatggagtagagtctgcaggcagcagcctcacaaagcccagaggcagggtcactaagagccaggagaaaggccccaggccctgtgatgactcccattctttaacgcatgtgcttcattgtgcatcttggatggcagccctggcatccaacaagatccaatcagtcagtaaaaacgtgctcagcaatttccgggagcccaggtgactctggaatgcctcgaggaaatgagacccttcccctgcagttcctaccaaaggaaaaaaaatctgaacacattgtgcaatgggagctgagggcatgctgcccaggtggggcaggaaaatgacaggaaggcacagaggtgggaggagaggcaggcccgaaggtggagcctcaggagctcagtgagaagttgttgagcttcctcagttagccctggtctggacccactgttctcccacaggcccgatgctcttcccctgaaaagacgatccccagatctgatcccaccacctttccagcacccaccctctctgtcctgctgcaccatccatgcacctccaggtcagaacaacttagagcgaggcacaggcaccctcttctggacacccctgcgagcacccaccacccaccccagctccttctcaccctaagtgcacctccccatcacccttacttcatgaaacttctgaatctgtctcccactctgtggtgggatttcaggtctagcacagaataagttcttcataatctctgggtgacaggaggctcagagacccatgggaagctcccgtttgataaagtaagacagacccacagtccttttccgtgcagggctctatcaacataatcaggctgtaagtgaaggccacacacaaatgctgttgagcccaacagagggaaagaacacgtcttaggaggcttcaggaagactttctggaggaaggggcatggggcacattccctgcagaatctagaagattggaagggttgaaaaacaagaagtggagaggagaggaggttgctaatctaggcaaatcagttctaagcaagataaggtagtgagagaccgaatgacataattcaatcagggaagagcgcactgcccccggatgggaagagaggattcttgtctgccgcagtgggctggggctgccataacaaagtaccacggactgggcggcctaagcaacagaattgcatctgctcccagtctgtaggctggaagtctgagatcagggtgtcggcagggctggcttcgaccgaggcctcgctacttggcttgcagatgccatcttctccctgtgtcttcaatggttttcctgtgtgcatgtctgtgtccttatctcctcttcttacaaggccatgagtcctgttgaattaaggcccaccctaatggcctcattttagcttaattaacctcttaaagatctcatctccaaatacagccacattctgaggtgttagggattaaggcttcaacataggaatttggggggcacacaatgccccccataccaatgctgtcatgatgcccccgcacagtgggccaaggtggatggtaggggcctggagaaggggccacccagggcagggagaatgcagccgggcccaggatgggcccaggatggcacacatgaaaagcaggcacaggagggtgaggcagtgcctctgagcagccctgagccccaggcacaccagcagggccggagtacagggaaggctaggaagcatgtcctgggcccagcctcgcatcccactcctgccgtgaccgccagcgtgggggaggctgactccgcccaggagagctgcaccttgtctctagttgggctccccagaagcagactctgagatgaggacccacacacaactgaatcactaaagatgtgcttcccaaagacaagtaggggcctgggtgaggagaggaggaagacagctgggttgtggccttggaccaagggccctgtctcccacaggcacagacagggaagggggtgcaaaatcccccaggcacttctgctccttgcaggtaaagcagctcctataacccaggaatcctgcaaggaccagcccaggccccagtgccagcactgccctcaagtgagagtgggagggaaacaataaggagagatctgaggggatctcagccaagcaccgagatgatctgagacacacttaaagagaggctatacctgcatgggtgctttcagcagcataaagcgaaaacgcaaccacaatggcttacaccacatggacattgattagtttacagaataagaaatccgagctatggtggctatgaggttggctcaaagatgtcttgaacaattcaagttcgttccacttctttgcattaatcctcccagcctattgacttcatccttaaacttgttgcttcatgattataaaacagttgccacagtcccaggcatcacaggcagacatgaagagattcagccaaagcagaaatgggagttctcacccacacccttttgagaacattccaggtaaacatcccatcaagcctcaataaccaagttaatgtacctgccccttagtaaagcaatcactagccacaaaaactgaatgaccatgattattaggctggggttagcccttgagccttcagccttggaggggcccagcatatatatatatatatatcagctaacaagatgggggagggaatggccttgggcaggatctaccatagaggtagtaccttaagccaaagaaaagcaactgctctgctgaaattctcaacatctgtggacctggaggtgaattttttatggtcttcaggccttccttgtgatcctgaaccagcactatgcatttctttggcagcctctgcttccttgccaggcccattcagcctaggctcacagaccttctctgtccccaccttcactccctgtgcacacggtgccctctcctgcacagcagttgccaaagcctggcacatcagctcatggtgcctctagtgtccacacacactgtagcaagcacacatccagccccattttcccagctttgtacctcatgtcagcacctcacccagagccagggggtggggttaggtggggaccagaggggcccagggagctggacagcctgccccagccattcccacactccatgcatggcctctgccacctgatcttttcaaagcagcttgtaaagagtgaagaggagttgggggttccctggagatgcctcctctggcagcacaaagggtttctgaagactccagctggaggacagcatgggctggcaagaggctgtctaatgctttccccagccccttcctcagctggggtttctgattcatagcattggacctgctctctgactcctctcctcatggctccaggagggcccctggcatcagtgtgcccctgagcactagactctcccctccaaaggcagtgagggcaccgcccagttctccccaggagctggcatcaagttaaggtggcagcttcccacggcaccctaagaaagtccacagtcaccaagtgttgagggctggcctcatgggggtggtgggacagggtgtcctggggctggacttggccaatttaaggcttgctgcccactctgggtctttggacgagctcttccccagggccagcggaagccccgtgaaggaacacagttttgctctgctgtgcactgctgcctgctgctcaggtccctaacatcaggactcccacctcctctgcatgcccactgcctctctgtggtttgctgtcagctcagaccaggggacagagagcaaccgtctttccattatgtcaagctttgcactggctcagtacatctgggcagccagctggctgtgcttccagggctgcagcacttcaggtaagctctctgcgcagctcaaatgcccaactctccgtgaaatttttgcctttttaatttaaatccttgctttgtcacttaaacttaatggcactgtgatagcaggcaggggtggggaggggcagcctggacagagcaccgaggtggctcaagtcattcattcctgagtttacttctaggtgtcctgggactcacagcaacccacagagctgggagaggcatgagaccctgctaacagataaggaagtcaaagtcagaaaagagagaccacttgtttaagtctcataccaaagtgaaagacttctccagttaaatcatatgactccaaagttggattttatcaggcttggtgtacccacctggagagtaagagaataaaggtggtttcttttaaaatgcttttgtgcaatctctctctctctctttctctctccatttctctccttgaatctaaatgctacagctgaaagcacagaactcttccccagtctaccccttccctccctccagtgtggatcctgcaggaaagccaagatctacagacaggaatctcctgtggagggagagagcaggtcccggtggccccaggagtccacctgctttgggaaactttcctgtgtcactcagggcatccacccagaaaaggcgggagagggagctggagccgggtcaccagcagccacctgcccagaatgaggagggtgaccagaaaccaggagttctgggcctgagggtacagaaaataggaaggagctgctcagctccccacccatgggggcctgcaggaggggagaagagggagagagggccagagcccccagcgctgcagctgccgccacaatagaggcattgaagctggtgcggcagaagcgtgcaggggctggaagaggagtgcagaggggaggggctgccaggagagccccagatgagagggtctgacgtcctcctgacctttaagtctggcctcagtgccaagaaggagggcagactggaccgcaaacagccccctgggctcatgcctgcatctcattatctgccctgcccccagaggcatcaaatgcctggttgttctcagattccccaccctgctgcctgtcgcatcctttgctgaaagatgtgctgtaggcgccatgaaagaagggacagggcctgagcagaggccccactccatgcttgctcctatactcttcctcactccccgggtcccctggtaagcagatgtctctggaggctggagacctggatcctatcctttcctctccctgatggggtaatggggcttgctccagggagaggaaaggagaggacccaggtatccctagggagaggcctagagaggacctcatccagcactgggctttgttgtgagtccccagtgtggttcccatgcgtttacaccagtctcggccctggctctgcatctcacttgctgtgggcccccagaagttcctttgccctcagacctacaaactatctcttgtacaacaaggaggttgaaacacaggatcccaggaccagtatgtaatccattgagttgattttgccattggttgaacagatactctggcgggagcaggttacacttttagcttcttaaacatctctcaaatctgttcactctttccatctccaccctcactgccttattcctgtgtgccaccatccttgcctggaccaatattctccaggcctccagatctggaagcctccatccaactcatctacttaatagtgaaatgcaaacctgattgtattactcgcctcctaaaatcccttcaaacacttcacattgcttttgagctaaagatgcaaatccttcacatagcccagaaggccttacatggcccagcctcacctctcagcctcctattcccttctttgcttccctgctctccatcagacaacaaagggcaaggttgggagccatgtcttgttctgttcatcaagctgtctccagcgtgtggtgtcattccaggttcagccagcagaattaagtggacaaatgaatgatgaacaccaaagatggcaattatctctcacagagatgaagagaacaagcccccttgcccaaagtgccttgtcacgttgatgcccgatgttccaccatcagaagtcaaaactagatccctcccacgtcccttcaaactctacagagcctttgttgcgagagatccaatgtatatttataagacatgcaacccatgctgacaccatgaggcagcttcctttcactgattgcctgtaatgtgacaagcactttgcatttgcggcagacctcctggatgggcctgtgctctcattcagatgcacagaattaggcaatcctcctgttcaaccttccatgcaatgaccagtatggaaccaggagctgcctgaggaaaacaggaaccatgtgtttttctgtctggagataaaccagattccaaggggacacaggtgccctgggaaagatgttaatgaatgaagtttctcaggccaagagctagtcagcagcatatgtatgtgcaaggggtcagtggtgctacagcatctatagggttggttctgcaagaggcctccttccccaagcctgcaccagccgtgggcattatcaggaggccacacgttcttttgtggccccgtgaaagaacagttctgcggccaaacatttacagtcattgtcatattttccaaggcaaggccatgggggctcaagtcagcaccagctctggggaggaagagataagctgaggctgaagaaccaaagtcagaaggagaggaaccagcacacgaggaaggtgaggaatggtatcttctgagaggtgtggccgacctgggaggcattacgggaccaggtgcacccttgagccaccagaggcatgacagtgggcctgactagagcccccagctgcaggggtcagctgggatgtccccaggcctgggcactgaaacacaccagggtgaacatttgcaggaaaaataaatccatgaatgaactgagctactctcatcttgaagctacttgtgttctcttgtgcagccattttttccatttgaaacccacctccctcacctaccccatcctacggctgttctagaagagtgagcaggtataccgacacctcacacagggcttgcacgctgcaggtgatcaggaaatgctcattccctccctgcctcttttgggttctcaggcacagtttacccctgtcaaattcccattagactagatgctctgcccagccctttcaatgctgacgtttcacacatcttgtaagaaagcccttgggtctggccaggcccgggtgtggacagggatgctcacattgagcctgtggacacagaagagtctttattcgggcagactcttgagcccttgttctgactgagcctattggtgcatttgaggggggttggggggagtgaggatttaaaaaaaaaaaaaaaggtcttgagggatgctggggaaggaagagaagccaagtgtctggatggtgtgaccccagactgcaacgctagaatgactctcaaaacattctcctttatcaaggaaacaagaatgtgagtcactctcttcccgcaccccaggggtttctttgctgagcagggctgcaaactgttcagctaattaggctgcatcctgaccttagcctccatccgcagcaggcctcccttgaggggagccgaggtgctgctgccacctagggtcaggagagtgcactgcagggggaccgcagggccaggaaggaaaagtcaggaccctgaataaaagggcaagtggtcccagcatggttccgtttacaaagaacttcccatctaccactgctgggctcttaaaagaatcccatgaattcagcagggcaaggttttactatcttctctttacatataaagacgctagtgattgcatggctgaggacgggggtctgggacattacgaactctgcggcagaggttatgggtagactgtgggaattcttcatgagggtttttaaaagctattgctggtgtaagttggtctgtaaacatccttaggaagaattggagagcaaatgagtcatggggtcctgataactgcactgagcttcactaaaggccacagggtcaagggcttaagagacagagtgagggccactgggtctcttagcccatcatcagggcccccattgtctgccggaagatgccagcaaacccaccatcctcgaggtgctggccagcccagctaacagtcaaaaaggaggaggatggtgatagatagaaatgttattttgtgtatttatttcatcacaacctcaggtacatgactgctatgggctgaatgtttgcatcctcctggagtaggcatgttgaagcctaaccacgatgtgatggtatttggaggtgaggactccaggaggtgatgaggtcatgtgcctggagctctcatgatgggattagtgctcctataagagacctgagggccaggtgtggtggctcacgcctgtaatcccagcactttgtggggccaaggcaggtggatcaggaggtcaggagatcaagaccatcctggctaacatggtgaaaccacatctctactaaatatacaaaaattagccgggcgtggtggcacaagcctgtagtcccagctagtcgggaggctgaagcagaagaatcacttgaacccaggaggcagaggttgcagtgaaccaagatcacaccactgcattccagcctgggtgacagagcaagattcttgtctcaaaaaaaaaaaaaaaaaaaaaaaagagagagagagacctgagctagcttgctccctacctccctgctctcccttatgtgagaccacagcaaggtgccatcccaaacctgaaaagggccccctacataccacatctcccagtgccttgatcctggacttcccagctccagaactctgagaagtaaatgtctgctgtttaagcttcccagcctagggtgtatttgttacagcaactcaagctgactgagacagtgactcaccctctagcctgttctgcaagaaggagaatcaggagttatgtagcaggaacacaagggaataaaatcctcaatattcagttcttcaacttccaagctgggtcttgaaattcaaatattaaacaacagagagaaaagtcaaaacttggaatttaccagagccaagttgtggtaaaacaatttggaattctaaaggtaaagccccagggaagtggggactactttttctttcacagattagaaagagaaaagagggttggggagaagagatgagtgtcagttgctagaactgggagaagtggggaggctggggcctgaggccacgcagagagaagggtcgtcactgaaggactccccaggcccttccatcccagcgccctgagccactaaatcaatcgccttttgtgagtggccttgcaggtctcctgtgtgggaagccaagtgagctgaggctgtcacagccatcaagtgaggtccacgcagacatcgttctctgtgtgctgcacagggaccaacccgcagatgtgactccccccagtacccatccacacaatgccatctaccaagcaccacttccaactctcacagatgccttgggacagaggctgctgtctctaacacctagagggactgttcttgcagtgtctgtgtcgcaggtactggacaacttaacatgagtgtgacttagtcccatcactgtcatcaccatacttcgttttatgggtgagcaacaagaccctaaccttcgtgacttccacttggtatggagcttagaggaaagtgacagggatgaaggtctctcctgtccagccccaccatcttcaggaattgggggctttccctctagcccgcctttgcccctctaagtgattgacacactgcacttgccttcccatccaggggaccccgctgggccaggtgccattgtctgctgtgaccctccccgtgtgtgtgtgtgtatgtgtgtgtgtgtgtgtgcagggtgtgtgtgtgtgtgtgagcatgtagctgtaaatagtactttcctgatttaaaaatgccaggaaaatcccaaaacacagagatttaatgtccgtttattcccttggggcaatgttgcctccactaaaatggtaaagaaaaaaatgaatgatagaaagaactcattgtgtcagaggggtactcgcatgtttgcatttttaccctctattctttgccacagtaggaacttgcttttttctgagtgtacacacaaacacacacacacacacacacacacacacatactcagtgctgtactaggctcctgctgactgtcctatcatagtgtttcctacagaaccatctcacgtctctctgggctgattgtcttctacaatcaataaatggttcaaagactcacaaattctgtagatgggcctttgaagagggctgcacagtctcccagctgacctcaggatgagcttcaggccatgtgaatgagaaagtgcacagaggcccctgcagggaccctggtgcctgacgcttcccccagagccaggctgcccaggtcccagccttgtagctcacaagctgtgcgaccttgggcaggtgcctttctctttctgaatctcagtttcttccttggtaactggagatgatattaaatagcacctgcctcctagagttggcgtgggattaaacagttagaaccagaacagtgtttacagcagcacctttggtatagcagggcaggagctccagatcttggtcctgaaggctcaggccctggggcctggagactaaagcagcattcagagctttatgaccacaagtagctacgctcccgcctgagcctgttgtctgggcctttggtgtctctgtggttatgtccctcggtcctgattccttttttaggtttccaagaggaagcttcttgttgagcctgtgaaccctgaccttggacccctgctcatctggcccacccggacgccacgcctgctctgtttgggggttctctcccatccccacccttgcttggcagctgctcccatcagacaggtcctcctgttcatccccagactgggagtgcaaaccctgctcagggctcctgtggccacaggcacccccaaggcagagaaggaagccaggaaggagaaggctctgcaaactcctggaaacagttaagagatgaagaaaattacaccacttgaactctactggccagagtcctgggaaaggcaaactctccttgggccaaagtggagggaaccaccccacccctccacaggcatcatgaacatggcccattggaatgcgctgagattcacaatgacttgataaggatctgggggctgaaagctcagcaggatgactctgagctggacccagccccaccctggcggtccctgccacacagcagtcagtttggagccacgtggctgccattcctggtgacttcccaaagctactgcaactttttaaaaagataagcacatttccatggtgtttttaacatcctttaatggttttcagctttcttttcaatatataattactgaaaaaatcactatgaataataaccagaaaccaccaaaacctacatgcaaagtagtatgctaaaaactttactcattatcttgtctaatgtttcataatctgcatgaagcaggtagtactgtcatccccactttacagaggaggaaactgaggcctagaaacaggcacacagccagtaagtggcagaggcaagacaggagcccagctccttctccaccaactattttgctggatcatcgtcatcatcagcattttctggtgcctgctacaccatcctctgcttctcagggacatgtctgaagccacagaatcactgtccctgccggaggccagattagattcagcccgtgcgtagctcacattctagggtgtcagagggagtgtctttctccgtcctgcagccacagccatcagcagcactctctctctggcctcccagggcttcctctaagaagcccccacgggcactgcaggtggctggcctccaggagcacacagctctcggagttccaggtgttcccctgagagcaacctgcttgggcactgcaggctgctggggttgccggtgatgacttcctttccatttctgttctcgatgtcgtgaggcagtcttcctgatctctgctccccaactccctcccatggttgagaaggccctggctctccatattaaatctctctctacttgaaatagctggagcacttctgctttcccacgaaccctgaccaaagcctcccagccccagctacagctgacaggctcaagagcaccacaggctctcaaggctggcctggctcctccacacacaacccctgcagatctctactcactccagactccccctgcctctggccaaggccctgccttcctgccttcaagctgggcgcccatttctccaggaaggcttttgtgaccgggcttcatgtcccttgcaccctgtgtattgatcttcctgcttgatgccaagccctatgaacacagcaattctatctggctttgtacactattgtacccagcacagggtctaaaaatactttttgcataaatgaatgagtaaatgaaaaattattgagtagtctttgagatcctgatgccatgagtatagagaaagagaatatatgcatcttaaatccattaaagtttgatttaaaatgcacattggcactggctgaaagctgggtgggctccatggggtacaaagacaagcccaccaggagccgagagttgaggagtatgaacaggcacaggtctccgtgcagctgcagtatgttacagcttctggtgacttctgccaccctttgtccctctagggtctgtgttcctgccaagagaaaaggcagtggcaggaaggaggctgctccagatgtcagaaaggcttagcgaatggtttactgtagttcacgaaatttctacaagagtaaccaattggcatcagctccctgagctgcctgcttagagaaggagcttatggcactaaaccatttttgtatattccatcaagatctaggaaagcagatttcctttttcaaaaagcagagaaactgtcccaccctgcagtcattgtgagtgcagagggacggggagccagcgatccatgaattgccaagccagattgcagctataaccagattttagtttgtgaaggtcttttacagacctttttataccctatccagtgagtatgagttaggctggagagcaaaggaattggagcttttccacaccacacacggtttgcggttggcccccaccaggtggctcccctggcggaggactctgcgctgcctgcacctgagcgtagctggggcttgcggtgtgcgtcaaagtggctgcggagttcttgtctatagaaactgttcaaagtaaccacctgaattactcctaccatactctttctttgaccttttatttcttttaagcataacgtcagcactgatttgaaatcatcaagtaacttcaaccaacgtaaaaatcctgagttgcttaaaaaggaaagaaaggctgcccccaaagtgacaggctttctaacttgcctgtgtctttgcacctatttccctaggacgcgggaacgcccctttcccacacccacttcattctcctccctgtgcctcacgttctgggaacatcctcctcttgactgcatttcttagcctccccgggctagggaaagtgtggtctccctttcagcaacctcagttccatatacatttctttctctcagaatgtctgatgctatactgcatttattggttttcttgtttctctccctagtaaacaggacattttttgaagtcctgctggcacatatgcagtcctcacacaacgcctggtggatgattgattcattttaagagagcagatgagctaggctgtctacaaatgtgtcggatccagctcccgccatccttccttcgcaaagcagagcttgccaagcctgcgcacccacgggctgcctctcttcaaagggcggagcctgtgcagtgagcgtttggccacctggtcgcacaccgagtgctcgtcagcgcgcatggcctgagcgttctgccctgacactcgctggcctctgggcgcttctgtctttgacaacgtcctgaacactgtgggaaggctcactagcattccactccttccctaatgtggagtgggtgtgatttgaggggtttggcccccaccccagctgcaggggtaagtcacactagtttgggctaattagcagaatctcatctccttagcgcaaacaacattgattcaagaatgatcagggatcccagcccaaaccaagccttgctgcagcaatcagccgctcttgggtttggggggaggatacggcgtgtgtcccaaggtgggtccacccagcgaagccagtattcctccttgatgactttggaaagagtctctctctcgttccggagggtgtgatgtgtgaggttggaaccacgagggacaccagcttgagaacaaagccaaactaaggggcgggcggagccaagacggaggaggcgagtccggagcaaacataccggatctcaggagccccgtgactgctgctcttggctgactcgtcacaaagcatccagacgcgtctcggccctgcgtccaagacgcaaagttgtgcggcaaccaagcctagagctaagcagtcaccaggagtggagacaaaagcagtgaaaggatgggagcgaaaacacggatcccgagaacgaagccacgagtgcaaagccgggcgttgtgcaaactatcccgggcctctgctgccccctggcggacgccgcgcgggagcccagaaccggagcgctctgagcgaagccgactccatccgacaccgccgcctcccagagggctgccctgggaagtcactgaaaacagcctgcggaagatttctcctgtgtcacgtggggggaagaacagccgctacctgttagattgccatgaggttgaatggccaaaatggataaccgggaccagagttatcctcccacctgaaagaagcaggaggaaaccaacaaaactatagaaacaaccgttttcaaaacccagcacaccagatgcagaggacagtgatcctactacccagacagtttccgggccacagcacaggaggtgcgggaacccggacagggcttgaccccatgagctcaccctcacgagttgagggactaagccgagtcctcagggcaggcacggcgtccctggaggaagagggggctgcacagacacaactccagtgatccacaaaggctgcggccagggtgcagcagggcggctcagcacgtgcaggcgaggaagctgccagaggcccagaaagatccccgtggggctggagggaagatccgcctgtgtttgcacagggcgggaacagcgcctcccccatcagccagactgcaggctcaccactcaggaggcacgggacagccctgcttcaggggtgggagcagttattactaaacgcagctctatccccatctgagaaacgtcaaaggcaggaccggaaagcatcagactgttacaaagtaacttaaccgtaccccagaacaaagcctgaaaatacacacaggaaaacaaagacatccagcacacaacaagaaaaaagtggcaatgtctaccacccagtaagaaatgaccatgcatgaagtgagggagaaaaaaattacccataatgaagagaaaatgcaatcagtggacgaagtgccaggacacaacctgtcaaaatgggtgggatttggctaaagcaatacttagagggaaaatgatagcactacactaggttagaaaggaagagggatctcaaatctcagcttccgccttaagagcgaattaaacccaaagtaagaagaaaggaaacaagaaaattcagagcataggccaggtgcagtggctcaagcctgtaatcccagcactttgggaggccgagatgggcagactatttgaggtcagaagtttgagaccaccctggccaacatggtgaaaccccgtctctactaaaaatacgaaatttagctgggcgtgggggcgtgcacctataatcccagctactcgggaggctgaggcaggagagtagctaaagcccgagacgtggaagttgcagtgagcagagatcgcaccactgcactccagcctgggtgacagagactctgtctcaagaaagaaagaagaaaggaaagggaaagggaaaaggagagagaaagagagaaagaaagatcagagcacgaaaggaaaagaaagagagagaaagaaagaagaaaggaaagggaaagggaaaaggagagagaaagagagaaagaaagatcagagcacgaaaggaaaagaaagagagagaaagaaagattacagcaggaaaggaagagaaagagagagagaaaggaagatcatatcataaatcagtggaatagaaaggagaaaaacaaaagggacaaatcaatgaaattaaaagctggagttttttgtttgtttttagaagatcaataaaattgataaactcctggtcaggttgatccccccaaaaaagagaaaagactcaaattactaaaatcagaaatgggaattgtgatatctatcactatagattctacagatgttaaaaagaaaattaagagcatattatgataaacttaagaccaatatatatgacaaattaaatataatagacaaattccttgaaagacactatcggcacttaagagtaaacagataatctgaattagtcttatgtctattttttacattaaacttgtactttaaaaccttcccacacagaaacctccaggcccagataactttattatccaacttaggaagaatgaacatcaattccatacacactcctggaaaattgtaaaagacagaacacttctcaaattgttttactctggtaccatgaccaaagacattacaaagaacgaaaactatagactattatctctatgaatatgaatgcaaattttgtgtgtgtgtgtatatacacacatatatatatattattttattttgttttatttgagacggagttttgctcttgtcccccaggctggaatgcagtggcatgatctcggctcactgcaacctctgcctcccaggttcaagcgattcacttgcctcagcctcctgagtagctgggattacaggcacgccaccacacccagctaatttttgtatttttagtagagacaggatttcaccacgttgccaggctggtctcaaactcctgacctcaagtgatctgcccaccttggcctcccaaagtgctaggactacaggtgtgagccaccgcacctgggtctatatatacactttataccaaaatacactttaaacaaaatttcggcaaatgaaatcaaatccaacagtatgaaagatcataaccaaatgagttacatgccagaaatgcaaggttgatttataatttgaaaatcaattaatgtgattcagcatattttgaaattaaaaaagagaaaccacagaagtgtcacaatagacatagtaaaagcattttcaaaaatctaacatgcattctggacataaactctctcaacaaactaggagtagaaggagcttcctcaacctggtacacggcctctacaaaaccttctgtccacattaccattaatactaaaagacttaatgcttttcccctaagatgaagaacaagacaaaactatgtactcttacaacttcttttcaacatttttcaacattttctagcaaatacaatacagcaagagaaagaaataaaaggcattgagattagaagggagaagtaaaactgtctttattcatagataacaggattttctatattgaaaattcaacgtggcctacacaaaaagatattagaattaacaagtgagtttaataaggttgcaggatagaggatcaatatacaaaaaccaattgttttatattttcactagcaatgacaatcagaaattaaaatttaaatctagtatcatttaaaatagcatcaaaaatatgaaatacttagagatacatttaacaaatgatatgaatgaactgtacactaaaaaccataaaacattgctcagaaaaaaattttaaagagctcaaaaaatggaagatacgttgcattcatggatcagaaaatataataccactaagatgtcaatttgccctcaaattgatataaagatcaaaagaccccctccctgtaccctagattcctctctacctcctggcatctccacttgaatatctaataccactaatatgtcactttgcccccaaaatgcaaaaaaaaaaaaaaaatgaaacttctagaagaaaatatagagagaactatttgtgagaagcttactgaggcgattcattcaatgaaatgccactcagcagtaaaaagaaatgatcagtccccatataagcccccaaagcagggagtaggggggtttgtagaaactgacaaagttattctgaaagacaaatgtccctaaataagaaaagctacacatggcccagacacataagagcaactgagatttgacaaaggtgcaaaggtaatccaacgtgggaaagatagtctattccagtctatcaaatggaaacaatttgatatccatatgaatcaaaatgaattaaattcatattttgcagcacctaccaaaattcactcaaaacaaaacaatgaatcttctataagcatatataggaggaactatttgtgataagctaatgtggtgattcattcagtggaatgctactcagcagtaaagaggaatgaaccatcgatacaagcaacatggaaaaaagtcataatcattatgctgactgaaagcagccagacaaaaaaaagggtttttgttagatgctatttatataaaattcgagcagactaagctatactgatggaaagcagatattttgtggagaggctccccatgtgcagagacgcaatggggagggcagaatggaggactagaagggacaggaggcaatgtgtggggtgacggatagggccactatagtgattgtggtggtgatttcatagatgtagacatatgtcggaacttagatcgtgcactttaaacatgtgcaatttattctgtgttgtttatacctaaacaaagctgtaaacattcataaagaaggaagacaggaaggaaggagggaaagaaggaaggaaggaagggagggagggagggagggaggaagggagggagggaggggagacggagaggcagggaggaaggaaagggagggacagaggaatttacacccttgtggaaggaaggaaggaggtagaaagggaggaagggaaggagaaaaggattcactcccttttgtcacgtgttcagactctcagaaaatatcactgagcgttttctctacagaagctttctccacctgtcctttgggacaccgtgtgcctgtagttttcctcatactttcctggatggtctttctccttcccccaacattgccccaacctctcaactggcagcgccctaaaactcagtcttcttttctctaactcgcctcctttggtgagctcactggatttcatagctctgaatctcatctctacactgaccaccctcaaatgtctccctgtagctcagacctcctccctgaaccctagagtcctctctacctcttggcatcgttgcttaaatatctagtagagatctcaaacttggcattttcaaaattcccacaaactatgcttcccactgtctccccatcttagtaattcccactgctcgagttaaaaatagcacacacacaacaaaaccaaaaaaacacagaattacccttggcccctctctttttctcgttccccactttcaaatcctttgacaaatttgtcaagcacatcttcaaaatttacccaaaatccaaccacttctcaccacctatatagctacagacccagctcaagccggagtgatttagtgtctggtccgatccccgccgccttcacccctgcccgtcactggccctcaatagagcagctagaatctctctcacacaccaactcttccagctttttttttttcctctttttacaacattggccagaacctcaaacactgtgccaaacggaaacagttagaatggatgtcttagtccatttgggctgctataaaaaataccctaaattgggtggcttataaacaacagaaatttattgttcacagttctggaggctgggaattccaacatcaagacactaaaatatttggtgtctagtgagggcatgctttctgcacacagtctcactgtgtcctcatacagtagaagggatgagggggtctcaggccctaaccccattcctgaggattctgcccccatgacctaatcatcttccaaaggccgcaccttttaataccattatcttgaaattttcaatatatgaatttggggaggcctcagacattcagaccatagcattggacatccttattttgtttgtaatttcaaaggaaatgggtcttatgtttctccattaaatattaggtttgtggtaggtttttttgaatataacttttgccaagttagggaaatttcctcctgttcctagttttctatgcttttttaatcataaaagttgttgaatttcataaagtactatttctgtattaattttaattgccatgtaatttttcttcagtagtcttttaatatggcaatatttttaacaaaagattttatgacaatttttccaatgatgagtcactcttgtattcctaggtggcatcctacttaattataatatattcttaacaaaagatttgattcacttagccaagatttagtttttccttcaatgttgatatactaatcaattgaagtcttcttctctttgtatttattgttcttatctgatacttgagttatgaattacattagactcataaaatgagctacacaactttctcttcccatcttacggaaccacttataaagattagcaattaactgttcctgaaaatttagtaagattcatctataacccatccgggcttggggatttgaggaggggaaatctttgaataccaccttacttttcttagtagttattagtttgtataacttttctaatatcttcatcattaagctttgcctcttagtcttccaaaactgtttctattgaattcagtttttcaagttcattaaaatataattgaatgcactgtgagtgttcaagtaacaggaaaatgctgatccttttagctatgttcacacattaatctgggcttacttgaataggccactcttcctctcagttgaaacagaaaatcgtgttgtttgataacattgtttccctacatcattcatgtccctagaattatgtaggacaaataacatttccaatagattgtgtaccccacatccccccttaaaagtctatattgttttaatagaaattcccagagcccatggcttgcctggcttctttctatgatgaaatgtgggtgcatccttgacagccttcatcatagccttagtactgctcatcaccaagggctgctgctatggctcccacattcttgggatgcatccctccccagtcagtgcctactgcattgctcaaataataatgttgctatattgattacaattaaacatgttatctctactgtgttacagtaaatcacagattcaccagagagaacagttacctaggactcccagttaacagtaatatctttctggcatacctccagtttggggaatggcaagctgaaaccataataactattattcaccgagcgcctacaataagcctgacataaattggcacctgagatgtgctacctagaagctttattaaaaccacagaaggaaagccttagtacctttggttcatttctttttcttttaaagacagggtctcattctgttgcccaggctggagtgcagtggtgcaatcatagctccctgcagcctcaacctcctgggctaaagcgatcctcccacctcagcctcctgggtagctgggaccacaggtgtatgccaccatgcccaacatttttttgtattttttgtagagataggggtttcaccatcttgcccaggctggtcttgaactcctggcctcaagccatctttccacctcaacctcccaaagcattggggttgcaggcatgagctaccactcccggcttgcttcattgatgaagaaaatattgatcacatgggttaagtgacttgcctgaggccacttagagagtaagttagagcagggattcaaattcggatccatccattttttaacttcccactgaaatctagatatttttcaataaagaattttctaaagaatagcctaaaatcaaatggtttctgccaaatcaggtatacctacaaatttttcggcccccagttaccatcttaagtcctggacagctattaagtggcatgcctatgctggctcctgcctattgaaagcagttgtctggagtcttgcactgagaaggattgtgcagctgagcttgggctaaatgagaaattgctgagattggattctaatgctgtttgtatttatcagagttctccagaaaaacagagccatacggtatatgtatacatacatatatatatatatatatatatatatatatatatatatatatatatatgagaagagattaggaattggctcacacaatcatgggggctggcaattttcaaagtaagctggcaggctggaaaagctggcaggagttgatgttgcagtcttgagttccaggacagtctggaggcagaattccttcctccccatgggacctcggtcatttctcttaatgccttcagctgattagatgaggcctacccaaatgatgaagggtaatctgcttctctcaaagtctactgatttaaatgtttaaaaaataccttcacagcaacttctagactagtgtttgaccaatcaactgggcagcatatcctagccacattgacacataaaatttaccatcacactatcaagatcaggaagacaatattccgtaacagtgggtctcagacttcagcatgaataggaagcccctgacgggcttgttaaagcatggattgctgggtcccagccccagagcttctgatccagtagagcagggctgtccctgtgagagtttcctgagatgccgatggtgctggcccaaggccacactttgaaaacgcccctgaatggcgtcattgctacattgctgaagtgattacgctgaagcatcatgaacaatcatcatacaatatgtttctaatctacagtttctatataataaaaacaatttgaaaattttctgaatgtctaagttttcaacaagaaaaactttacttttaacccaggaaaatatccacccagtccttagcttctcataagattataataaaaaattgtctcagaatattataataaaaagttgtaatcacataccttcaatcaatattccaaagtaacagagacatgtcactcacagaattaggagttgggccacttgggttggacaaggtcaggtcacaattctcaatttgtacagctgatcagagccagatctcctgattcctggtgcgtctctccctcaggcctcggtttccacgtccataaaatgggatagtttgcttgtgctccctccagacctgataattcttctacccagggttcacatatcttgactcagtttgaagcagaacattcagacaggtagtactgtcagagaggaaatggtctgccctgtaaggcaggactgtgggtgcgagaatctgcgctggagggcaccaggtggaaatttcatagggaagattcagattgcagattggacacttcattcctctcacactgtgaacttctacaggtccctgaattacagaccccattcctgggacaaagcttaaaagaaagaaacaaactttaaagaaatataggaaggtgcctttgttactataatgattatggatatctgttgtaaaaataatacttattgagcccatacatctcacttgcagaaatccaaagctatgttattaaagctgtttcagggtttcagaagataaataaattgaaggtctctaaaccttcagcaaaactgttccaacttggattaatctggaactgaatgtcacattgaatcctgccaaggcttggcagggccccaggtaggaatgatttacattccatccagaaaagcggctttgggtcctggaggaaccagtggtttcaatgcagccctgaccaggatagctggatgggagtgttcccctgggtgggctcaggtggcacaagggagatgagggtcacccagttagagtgccaaagcactgctcatctctcagtcactatgactggtagaaatgccaccagtttgtgcaatgaaacaagtctacatttattccctgtgaagctgtgattcctggtgtagcacgcacaatccaaaggtcagagttgagactcagttcttgctctgggagtttgtggacatgaccttcaactcgaagccagaagaactgagtttaagaccagactgtgcccccttaagagctctgtgatctgggcaagtcaaatcgcccctctgactcttcagttcctcatcagtaagtgaggctaaattcccatgcctggtggactccacaggggacccctcaccaagagttattaaggtgcagcttcccccactgttaatacctacagttcatgcaaatcaaagaagactttagacccaacttgagtggcttttatagagtatgtcacaaaggcaacaatatggcataaagtactcagcacctttccccacctgtcagtggaagcctggtcctgaattgtttgtggtgttgaaggatgccaaggaggctcaccctgtgctaaggtgtcacttcagggcaccaggagagctataagaagaggtagatgggaagtggtcatgaaagagggcctgccagagcttttaggggaggccagaagagggactgtggcccatgaaagggtgaggagaaggccatgctgacaaggacagtggcgcacatgtgtgaggatttttggaaatcttctgctgtgtgtcgcacccctgatatgccagccctccaaagacttaattaaagtcttatgttatcttttttttttctttttttttttgagacagagtctcactctgtcacccaggctggaatgcagtggtgcgatctcggctcactgcaagttccgcctcccaagttcacgccattctcctgcctcagcctcctgagtagctgggactacaggttcctgccaccatgcccggctaatttttttttttttttttttgtatttttagtagagacagagtttcatcatgttagccaggatggtctcgatctcctgacctcgttatcctcctgcctctgcctcccaaagtgctgggattacaggcgtgagccactgcgctcggccaatcttatgttatcttaaaacacttttggagtagaaattacatttctcttcatgcatcacagtgctaagactagagcttaaggctgaggctgacaggcctagataactttgggttgcatatacttaaattaagagtcagcacattttaggatgaagcttcaggtaatgatcatgaaaacaattcctagcatctctacagactccatcattttcgaaatgctttctcacattaatgcaattccattctatgtgttaagcaaagcataggctttgctcccctacagagcttggcatttaatgcagaggctacttttcctaagcagaataaccaaaagaattccatgtccaactacagcaggataaggaaagctgtgaggtattttattaattagaaaatgctggatcctcctgtctagctgaggtaaggatgaactttgacctcagagcctgcatatggtagtgtttatgcagagatgtagtcccatatagacaaataaatatggttgtctttatacatatatgtgtatacacacacacacacacacacacacacacacacacatctcacttagctagacacagccccatcttgagggcagagagtggtcttgtctttccagttcacctcttccttccagtatccagaggtgaccagtaagtgttggtggtggagagaatggtgctaaggagaatgggctcatctgtgttactagactgttagcgggaaacagaagccatctgatgacaggtcacctatctttgtgactgggtgaatgagttggggtgggggcagctttcgagctttcatacagctctaaagacaaggctggtccacctctagtctgagctccataccaggctcttgccagcaccttcctccccactcgccagtgaatgaggttcttctcattactctcccttctcatacgcatgtatttctgacgcgtctatacaacagctctgggccttgatccacccatatcagcccagttcgtctacaggtcacccttgtgtttctcactgtgcctggcaagggcaccacagcagggctcatgggtgtaaaggcaacatggttaccaggggaggggtgcgtgagtgtacaggaaggaggacatggaaggcacaggtggtgggccaaggcctgacctgacaggggaaccagtgcaaaaggcggccttgtcctcctggccaggacagtgcctagaagatgcccactgtgtggccagttctggtcactccccttacagtaagggtaccatgaaacaagaggaagagaatcaacgggcagaactaaccccacacattgggcagaccatgcatgaattgtggtaagtataaaaacacaatggcctcccaggtctaccaagccaagtcactgctacagtatgggccagcagagcaacaacctactgggtctgggcacccacctcgtctttccaggcctgctgagggggctggttcctttcactccccctgtatcccccaccctgctccagcagcacagtgtccaaaagctcggtacctatcagctcagtccacaacagtgcacagtccgcttctcagtggaaagacttctgccctaatcgccccctccagcagggctggcaggtatacgaccatcggggtgctgcccctgtctccggtctccaggctccagcaccctgcacctagcagggactgcaggataaatgctcctcaccagcttctttgtatccagtccagattcctttctccttcaagggcaggtgggaagtttgcatttcccagcctccttccaaaagtaaggaaaagctagcaattctcattaatcaagacagcaataaatccaagcagacaggacttcactcctctctcactgtgaggttctacaagtccctgaattacagcccaaattcctgggatggagcttaaaaggaaaaaacaaactttaaagaaatatagaaagatggctttgttactataattattatggatatctgttgtaaagataatacacactgtgctcatatatcttacttgaagaaatccaaaactatgttcacctaagccacattgagagctgaattatcatttgtaagagaccaaattcttttatcaaagtaacaggataactttcaaatgtgtatttatttgtggggctgggccaacagccagaaaatatctaaatgagaactcagattcatctaaacttgacattttcagttgatctaatggttaatttgtattcagtccactgactcttcaatggcttctaattaggagacaagcagagaattccgagtcctgtggtttgcgatctgggtgccttatctcttagatggttctaggctatccacatggaatattggaaagtgggacaaatggagtcaggcctggaaaggagatgaaaggaaagacagtggcattgagtgactatagttaatgacaatgtattgtatatttcttttttttttttttttcttgagatggagtctcgctctttttcccaggctggagtgcagtggtgcaatctctgctcactgcaacctccacctcccaggctgaagcaattctcctgcctcagcctccccagtagctgggaccacaggtgtgcaccaccatgcccggctcatttttatatatttttttagtagagatgaggcttcaccatgttagccaggctggtctcgaactcctgacctcaggcaatccgcccgcctcagcctcccaaagtgctgggattataggcatgaaccaccacgccaggcctgtatatttcaaaatagctgagagaggacttttaatgttcctaacatagagaaatgataaatgctccaggtgatggacaccccaatactctggcctgaacattacatgttacacgcatgtaacaaaatttcacgtgtacctcatagatatgtacaaatatgtatccattttcttaatttaatttttttttttaaagaagggtgtcagaaagccaaaattagatgctgcacagcaaggtttgagttaagggcagtgctggaaaacagaacaaacccttgtgatcatgcctctcagccaggtcagggacccattcctgcagtcaacagctgggaaggcgtggaacctgggagggggcagcctggggaggggaaaaggccgcttggaggtggaggggaggcctcctcgctcaccacccaatggcagagatgaggcgttggaggagcagagaggaaaagtccctgtgccgcagcagctctctgccagtgcgcatgcgcacatgtccgtgaagcaccgcgctggggttggatccgcctgcctcagcctggctgagctgcaggaagatcggtattcaggcagacagcatacgcagtttggaagaaagcaaagtgctttgcaagtgaaggggagcggaacatgccaccttaaaatctgtcactttggcataaggattaagtggagctgccggcaattgagaagaagcagatacaagagaaactctccgccctcacctatttaccaaaaagctggacataaatttgtcaaggtgtgcccccaaccctctctaccgggaaggatggagttaatcaccagacacaacccgagcccctcctcagcctggagagggcaccagaggaatctgcacagcacgtcctggtcccactgaagcccttcccttccctcagctccccgtagggtggccttcccgccctgcgcctccccagaaactcaagcccttctcctctgtcttgtcacttctctaaacaagcattctcttgtgaggtgctatgaaagctcgagctctggccgccccttggagttactcactgcggacgttcccatgggtgtgcgtgatgcacgtggtaataaactcgtgtctgtttttctctcgttaatctgcctttgtcagtctctttcagagccccagccagagaacctagaggggtagaggaaagaagattttctcctccctacagaatcagacaggcctgcactcgaatcccaggcatgccgggtgctcgctgggtgctgctggtggagccccttcttccctgtgtccgactgtcctcattggcaaggcgaaggcagcaacaccgcctggaaacgagccggctctccacagtctcagctgtttgcatcctccctcgtccctgtcactccctatgtctgagggtgtcccggggacgctgctgccctgtgggcacctgggacagttctgcctcattccccccactcctcatgtccagggttgctctagggggcgtccttagagaatcttttcccgtccacacccgagccctcaaattccccaggcgaagcttcctcagctcaagggatttccccaggactacctcccacccagaaccccttcccaccctccactttagactttctcatgcctgctgggtttcctggggtctagccacgacctcaaatctaaagtctccccttttctccattttactcccttctttctttcctccctccctctctcttttccttctttccttttttatttaccttacttcccctccaacccggccttccctctcccagttgaacactcactcatgagcaggaccttcctagctctgattgtgtcttactagcaaagaccctgtccattgcctggttctcctctcaaatcctttgccctggatcctgggaggtcataccctggggcaggctccacctccttacctccggacactgtcacagttggcaactctagtggacacctggtgtgacacagcgaagtgggggagatgggttcgtcttttccagggagcccctcacgcctgccagctccaggcctggctcgccagccctctgcaaatccaccggcaaactcacacactccggtgcactcccatcgctcacgttaccagaataggttcctaagactgggagtgagagagggcaaggcacccagggccacgtggagcggggatgccacagcgggggacccgtccgagatagtttcaatggtcatggtaagaaacgatcagtgcctgaggcgtggcaagagtgaagagaagggagggatgagagctgggaggaaggagaggccactggaaggcaggtgtgtggataagctcagcagcaggctctgatcagggtgttgggttagaggtgggggtctaataaagggaagagctgttgatgggggagatggtggggtcccttttgggcagggaaggacagacatgcctgtgggacacctgggtgaggacatcaggaggtaggggatggtgtcgttctggaaatcactccaaatgtaccccaagaacagaagatttcccaagggtgctaaggaaaccttcctgcttggtctcctggtagagagcaggtgtctaatggggaaatcggggatgaggctagacgaggagtcagggtgaggtgggcggaaagcccagagccgtgatctaaagacctggctccagctaggccccccacctcccttgtgtcctcaaaagcaagccacagatgctcaagcctcagtctgcctgtctgcagaaggtgggaagagctcctccctcacacctctatctgggggaatgaggaaccgggaggcctgacagaccatgggttctgaaggcaaggcaggccttaggatagaagggacagcttcagaccagggtggaggctcccggatgaagaggaggaagctgaagtttcaagacatggggcattgtcatatcattttattcagcgtagctgccttaagcagccagaccagtccatcccggaacatgggacaggcttctttctcttcttaatcacatgtgacagcttcactggacacttgctgtagcctctgagtccttgtggacctgctcctttcctcttaagcaattcagacttaaatcccagctgaggaaagtctcatgagaggcaggtgtgctctgggccctgggacccggaaggtcataggatgcggcaaggactcactgatgggttggggatgtttccttccaaggctggcaggctgagacatgccctgtctgggtgaccatgcagctcccaggcccaagtgtgaccaggggagtctgcagaaagcacagaacatgcaaaacagagcatcacctgctccttcagccactggaaaacagtgccatcagcgagaccaagatgagctgcccatgctccaggtgcacagaaggccagattgaacgccatcagcccagaatagtagtgtttggtgttcacaccttttcagagctccagcgaagaccagaggaagtggaagtgcgtgattcagggccacccttcacatcccccacaagggcaaaggggaagtggtctttggtgataagggaccaacaaaaaccagagctgccgacacacactggaaatctggcaccagaaaagacccccgaatccagtcatcgtctggacagtgagagtatgcccagccacctggatccaatggtggacagcacttgcagtcagagcccccagttcacactgcacatgccccctcgcttcacctccaaccttagagagagagctcacttcacggacccaggctccatgcccttgtccctcagggctgtggctgacatcaagcactgacaggtgttggcccgtggtcagtgctcagtaacttgcagttttttcttttcctaaggcatcactgctctcttcctgtcctctctttctagaggcaaggcttctccacaaccttcacccagcacagcaacaaaggcccaagggagcaggttccccctcccctgcctgtggccagccaacaactttacctctccaggctcagctttccacctgcccatgagtggtgaaacagacaatgtgtgcagctgcttctttcaaaaatcttcggactgcctgtcccacactgcacagctctctagcaatagatgctcacgttcccgtgtggtctcaatgcccaggaattccctggctgctttcctgggcaggtgaccctgagcagctcagtattctggctgagacacctcgtgacaaatttggcttcagactctaacctgcagcagactccaagctcaacaactcagtatgagagaggaagtcctagacattctgggaaaacatcatttctggaaaaattcagactagcaagtggtctaaataacgataatggatatgcttattatgtacaaataatgagagaccagaattgtgatagggtccctctcttcctgttaccagtattttcaaatgcacaaaacatcataaaatgcataaaacgcctctaagcaacactccactgccatttagtctccctcactgatgccatttacatatccattaaagggttcttacacgacttctccacgccactttcctctgctcacacgggtggtttatgctttctgcctgccctcctgggctctgtgacatagtcaggaatgcagtctttgtaagagtctgtgctgagaagattggtaaattgcgtctggcaaatccacggagatgcctgctcacaccctgattctgttgttttcactggagcatcacacatgccccaggcctccgaggaggtctttctcaccactcttctgtcccaacacaagcaggtcctgtcattcaaagggcagctcagaaaacaacgggcacagaaaaaaatggacagtggaagggtgctaagaatgagcccatgtggttttcataacgccattacatctttccaataccaattctctgacaccaactgcatgtcaaacaattcaattccattctgacactgaacacctagagttactcagcccccacagggtgaggctccatcccacaagactgcccccattcagacccaactgcaaatgcaatccccaggacacccacacttctgcctggccaactacaaatttgggggtgcccatgactcccccttaggtttaacaatgcacttgaatgactcacaggactcaggaggacactcttcataattacagtcatattctaaagacacaaatgaatggaagggggcaccgggcaggctggatggggagtcagtgcacggagctctcacaccctctctgggtgcacctacgtgtcccccagccctgaagctccattagcctcctgcttccgatattttactgaagttttgttatgtaggcatcatgattaaatcatcagccattggtgactgcactccatctccagatcctcctccttcccggaaggtcagcagacaggctgcaagttcccaccctctaatcctgtggccagtccctctggcaaccagctccatcctgaggctgtctcggggcctgccaggcattgcctccttggaataaacttgggtatagtcaaaggggctcattatgaaaaacaaaagaaaacattcctgtcactcaggaaattccaagagttttaggagctctctgccagatctaggttcaaagaccaaatatatatttctcattttgccacgcaggcagagctgggttcacctggctgactctcaaggcattggctctcagtgagcatcagggtcctgcaggggcgcccccacatcagagcacagctcctagtttctgtcaagctaaatgtccatcagccctgtgactcagcaatcccacttgtgcgtattcacccctgaagaaatacgagcctgtgtctacaaaagagaactgtacctgaatgtttgcagcaattttcttcataacagccaaaaaagtcctagaaacaatgggtgaatggctaaatgaattgtggtctaataaaaggaaatgaactactggtatgaaaacctgaatgtgtgaatctgatccagcaatcccactcctgggtatctaaccagaggaaaagaagtcattatttgaaaaagatacttgcacatgcatgtttatagcagcacaattcacaaaagcaaaatcatggaatcaaaccaaatgcccatcaatcaacaagtggataaggaatctctggcatatatatatgatggaatactactcagacataaaaaggaatgaattaacagcatttgcaatgacctagatgagattagatactattattctaagtgaagtaactcaggaatgaaaacccaaacatcatatgttctcactgatatgtgggagctaagctattaggtcgcaaaggcataagaaatgatacaatggaatttggggacttggggggaagagtaggagacgggcgagggataaaagaaaacagatatggtgcagcgtatgctactcaggtgatgggcgcaccaggttcttacaaatctccactaaagaacttactcatgtaaccaaataccacctgtaccccaataacttatggaaaaataaaatttaaaaaaagaactcagtacatatttgaagatttaaaaaaattaagaagccagacacaaaaaggtacatattttatggttccttttatactacatctagaatcatcaaaatgaatccacagagactgaaataaagtatggttgttggtggccaattggaaaggggtagaaaggggcttcttagaggctgacaatgtttcacattttgttttgagtgtagttaaacaggtataaatgattatcaaaattctgcaaactgaaggcttaaatcacgcgtgttactgtgtcaaaagacaaaattacaacagatataaagatctcaattggctttacttacgattctagaatcaagcaacacttcattctatacaacagaataagtgttcccatgagctgggcgaggaagttggttttgtagacagagaaagggctgaaaaaagcaaaaagaaagaacaaaaagcacattgttcatttcaacattacttttcttataagatgggacccggacagaataacagaaaaataacagattgattaacaccaggttgcttcaggttactcttttataaggattgagggcatgaacttcatcattacgccaactgaacattgaaagcgaacctgtgtgggaaatgtggatgttatctcatctgatttctcagcccagataattactcagtttcagttttctgagcatggctgactccattttgatttttagtctggcctgttggggcctaatgcagtttagttcaaaacaatggcctcctataatttttgtttaacaatcgtgtgttgtatgtacctcaattttttaaaagccctctcagtggggatcatgggtctaggaaccatatggaggtctgtgactcagtgggaaggggtggccctggcctgtgaagactgaagggggtccatgtcccaatcctacaggccctgaaatccagaactgagtcagatgtggtgacttgctgaggaagggtttcgaagcccacacggacactgctctacccttgcctctccctgaatcctctgaaggcagcgtctatgcagtgcattctcggatcactatccagtgcctgcctccctctagtcctgagctcctaaatcagaaactcctcggacacagggagtccagtcatttgtttcacctctgtgtcccccaagcctggcagggacaggctgaccaaaggcgttctgtgaatgcagaattgttctaaattgctaaataccaacatcagctatggatgactcagaaaacccaaccttacacaccaaagtatccaggtagtcaacacactttgactatattagccacataattataccatttctacaccccaacggtggtggggagggaaggatttcctacgccacacaacagagagacagcagatgcaggccactcactcaggagttttgttgtaagggcagcagaaaaatggggcggggactacagggtgatgttctccctctctctctctctctctctctctctctctctctctctctctctctctctctctctctcccctcccccttctctcctgcaggaaattccaatcatgtatgcattttatgaagcaattgattagggagaaaaaaagctacctgaagtcctctctcatccattaacttctactttctccaactttcttttgcaatgaagtacagtgagactagggtttacaactcctgcttcagacctgttggccccaagatagacctgcgttcagctggccctgacaagtcccttaggtaggtcagagctgagggtctgcacaatttccaacatcaccatgtaaacatcttgctatggtttgagtatgtcccctccaaaattcatgtgttggaaacttaatccccagtgcagcagtgtttggaaggtgggaccttttgggaggtatttaggtcatgagcactgcaccgctataaaagggcttgcgggagtttgttctctgtcctgctcttctgccatgtgaggatgaagcattcaaggtgtcaccattcaaggtgtcaccttggaagcaaagagaccaggccctcacctgccactgccttgagcttcaccttcccagcctcgaagagctgtgagaaataagtttctgttctttacagattacacagtgtaaggtattttgttataacaacaggaacaaagacatccccctgtcatggggtacatatattgaactttgattatccaagtataccaacctaggcatgtgagtgagaccccagctgggcagcagaagcacccacaccccgtggcacgccccgtggcagcaggagcaagatcagcactggggccgctccacaggaaacagcttctggccccagccatggagtcctccagtctcagcccattgggaagggagaagaaactgcactaagcttgcaggcctaagtaagcatcctgtgagtgcactacacttattacaggaacacggccctccagaggagagaagggccttcttgcaaaagacaaaggactaaagccattattcaagcagtaaatagaaatgagattgattttataaaacacatggttacaaatcaaatgatgcaagttcctttaacaaatatttttaggggcacctactgtaaaccaagcattgtggtagccaccagataaaggggactgagttgtattaaacatggttcctgcctcccaggaactcacagaagcaggggtggagggagtcaggcacacagacagctgaaactgctcagccctgtgcttagcatcttgtgagtgttcagaaatattagcagcacatgtaatcccagcactttgggaggctgaggcagacggatcacctgaggtcaggagtttgagaccatcctagccaacatgtgaaaccccatctctacaaaaataccaaaaaaaaaaaaaaaaattagccgggcgtggtggcaggtgcctgtagtcccagctactcgggaggctgaggcaggagaatggaatgaacccggggggcggagctttcagtgagccaagattgcgccactgcgctccagcccgggcgacagagcgagaatccatctcaaaaaaaaaaaaaaaaaaaaatacaaaaattagccgggcttggtggtggatgcctgtaatcccagctactcaggaggctgaggcaggaaaattgcttgaacccaggaggcagaggttgcagtgagccgagattgcgccactgcactccagcctgggtgacagagcgagactgtctcaaaaaaaaagaaaagaaaagaaaaagaaatattagtggttacaatgagacaatgatgatgattacaatgagataagggcaaccatagcaaatggatgagattttctggcagcattgaagataaatggccacgtctattggggtggtcagggaagggctcatgggtgctgggatgctcacgctggtgggcagacaaagagacaagatacagagggccaggagaatgtctgggtagattgcaaagggcctaccagttctcctgggtagtcagaagcccttcgggaggactgaggaatacaccaaggacccagaatcctggcccaaggaccaggtcagttcacattaaaccttgtgctggcaccattgctataagcagtcttcaagagaagctatgttgttgtttttgcccaagcaagggtcccttcccgttttatcatcacatatttgaagtgaatatcagagatgaagattaattaattgcaaagaaaaattattatgcaatgatctgtacaatgtccaccataagtcttaccaattccttggacttctcctaatggaaaaccatataacaatttcaaatggcattttaccagagtccagggcttttcaaatccatctgcactctggttccacaaatgaaaagcatgcaagaattagagatgaagtgttgggtgtgtgatgctttgtatctcaattccatggatagctgactccatgctggtgtccaggatggcctgtcctccaggttctcaggctctggattgtgcctctagcactcacttcactgtggatcccaatctgaggatggctttaccaagcgtgcacaagcccctccatgggagaaaaagaagtgatctcgattcagagggtggactctacttgagctccttaggcaggtgtgaaggtcgctagggcttgttctgactccataagcaaaagcagcagttctctgagagcctgacctcataaaaggatgggcgtggtgggagacagggctctccttccctcttccttctctttcactcattaatcttcctggacttttccaacttcctgcattcccaggagacaatacacctgatgtgcaagctcagagcttcttttgtttgattgggctttgattttgtttctaatacattttcctctgcaggaagaagtctaactccactaatttattctagggaaccatcaagtgacatccaacagtgtgcattcagcacagcaagagggctgcagacacagagcccaggccacaggctgtccagctcaccccaccacactgattacaggacagagcttctgccttccagctctgcgagaatgatggtgccaatgagatgggtggtcagggaaagcagagccacatggagggcatggcctgtgtaccctgcagaggccatggcagggcctggttctggctgctgcaactatatcacaaacacatatgggagtaaacagactcctgaagttgaaagaaactgagaactgcaagacaggaccactttatggaggacctgagattctgctcaagaaactagagtaggacaagacctaccatgctggacttggtcactggaaagcagagaagagtccatgtgcaagctgactcggctggactcccaaacccatggcccttcgctatacccccagtcaaaacggagacaaacttggtcacaggcagttatgcactgcagttgacttgtgctagcttgtgagagctgatggttaaattttcagctatttttagagctggatgttaaacaaagccatcattaagttattttcaattaaataaattagataaagtgtaataagtaccccaaactcatcacatcctaattatttgactacgttttcctcttatctctgctcttggtcatttagtgtctattgcactacacaggggagatgctgtctaacattgtgattctaggcatctcttcccagccctgcactcagtgacatcatgtgggtggcttgaaatcagccacagtaggagtatttataccacagaaattggcaaatgctataggtaagggctttttccctggacagtttttgttaaatacttacctgccagcacactattgtcccagagcttcatgagggctgcctacatgacctgcaggggaactagaaagctgttgaaatcttacactggggaataacatggttattctgtgtttttgagccaccccctggctgtcgtgtggcagacagtcagccagcagtcgatggcaccgcatcagaggataaataggcagaccctggggccccagcagccgatagggtggtagccagggaggtggaaagggcagggcttctgttgaactgggaagcactagaggaaaactagaagcaaatgctggccctgaggttttaagcctgagatacaggcagatgccaatggtatcagccaatttagaagcctcagaaggcttaaagcaaggaccaggactgagaagagatgagccgctttaggctgttctgaagcagaagaaactgatggtgcccatgaacttgaatacagggtgcaggctaagaagagattggaggacagatgctcacatgcttagctagcagatcatgtctgtgcccagtagtttttacagttttacaagcctgtcactccctgtcactctgagagcctgacttcataaaaggatgggtgtggtgggagacaggcctctccttccctcttccttctcttccactcatcaatcttcctggccttttccacaccacacccagaaagcaggggtgtaactgggtccaccagggcagcaattgcaggttcagcaaggagcctctggatctgtggccagcgcagaccagacaggcacactgtgccagggtggggagaagtggagatgcaatggtgaccccaggcacaggcccccctgggaggaggatgtgggaggagaaggctgcacaggtgagggttgagcctggggtcaggctctacctccctatgaagtgtgccccgccagctactggctcttggccaccctgggagggatgaggtcagcttcccactctgacccaggactggggaagcagaatatgcctcggtgcagaggtgaggagacaggagaagaggccacacctgtgtgggcacacctgccagcactgggacaaggtctaagtagggtggagtgggaggctgggaggagttcaagctaagaaaatggggtgaccccaaggcagaggcctgttgtccaagtgcagctgttcagaggccattttccctggtttgtggtaggaagggccttcatgtgtatgcggttcctgctcgccctctaggcagcctgaggcattggagaatacagagccagagcaggaggaccaggcagtgttctgggcctgctccttactagctctggggccagcctcacacaaagtgtgccattcacgtcttcattcagtgcaaatatcttatatgtgccaggccctgagaacactggggtgagcggccccaccaggtccctgccctgacagaatgcacaccccagtgtagggaggcagacaatgaacaggaatgtgaatgagaacacacaggtatgtccctgtgacttgtttagtcatctataaaatgggaccagcaacgtcaccagccctacccatgcaacaggactgtgggacatcacagatgggacctgctggaactcaggggaaacatcatgaactcacccacagctgcctttgctctcctttttttcttataataaaatgtacataacataaaatttacaattctaacaatttttaagtggcattggggacatctacaatgttgtgcaatcacaccatcatccacctccggaactgtcttatcttccccagcagaaactctgtcccaattaaatggtaactctgcatcctcccctgccacaggtccctgcagcctctatctgactttctgtccctaagaatctgcctattctaggtagcttcatatcagtgtaaacacatcatactacatttgtccttttgtgtatgacttatttgagtgaacttcacctggaagtgggattgctggatcccatggtgattccatttagtgtttaacttattatttttaatttgtatggatacatcagggttgtacatatttatgtggtacatgtactattttgatatatgcgtacaatgtgtaacgaccaaatttgggtaactgggatatccatcaccccaaacatttgtgttgggaatgttacagatcttctctgctcgctattttgaaatacataatagactgttgtggggtgggggcaggggggagggatagcattaggagatatacctaatgctaaatgatgagttaatgggtgctgcacaccaacatggcacatgtatacatatgtaacaaacctgcacattgtgcacatgtaccctaaaacttaaagtataataataaaaaaagaaatacataataaattatggttcactaaagtcaccctactgtgctatgaaacactagaacttattccttccacctctctgtatcattttaaccattgaccgatccctcttcatctctcctccctgctaccttccacagtctctggtgtctgtcattctactctttacctccgtgagatcaatgtttttagctcccaagtatgagtgagaatgtgcaatatttgtgtttctgcatcaggcttatttcacttatgtgtttgccttttgaataactgtcatgctgttttccacaatggatgtgcaattttccattcccaccagcaatgcacagggctccagtttctaaacgtcctcgcccactcttgcctttcccattcttctggtagcagccatcctaatgcatgtggactggccttttgctctattctatgcgtattgtcagattgcatcccacacgcatccatctcacgcctatgttggtctaaagcgttcatttgtggtgtgctatttctggactatgcactgtttctgtactgtacaccagcctgtgtaccctatactttaagggcaatgtaaggcattgccaaagttaatctcaacaaatttgtaactgtctctatgtttctttccttagaaacagaggtgacaggagctactagcctgtctagaaagcttggtaatatgtcactctcagactagggattctgagggtcagtcccagtgctatcatactgccaatctctcttgccccaatctgcctctcctgtgcaccccagaagaggaagcacaaaccagtgccagggaggacagcaaggctcagggcaatgcacccaagctttgctctcatatttatggaccattgttcattttcaaaataattggcatcaacatgaatgggtaaagaacaagagaaaataacccagggccctgtaatctgtccctggccagactcgcctggtccacatccaatcctccacatacattaacctcaaataataaataacctaagccctagagcaggacacactcacagtataattcatatctcaaaatccaagcaagtgccaaacagcggccaacactatgaatataaattccagcttgttcatatgctgacattctaaagtctgacaagagtgagcaagaaggtgtttttcctagctaatgagttgaactccttcagatctagaatttttatagaggtgcgctcttgggaaccttgacaagagctaagagcttgggagaggatgcccatgtccttgctaacggatcatttcccttgctcagcaagttttcacctcattttacaatctcagggtgtctgaggtggaaggatgtttgtgatgctcattgaacagatgagatcatcaaggcccagagggttgatccgaggtgagcaggccccacacctgtcactcccaggcctgcaagatatattaagggcagcacctgccattcctcaaatgggagagtttaatttgaggtcattgacaaatctgttcaaagaaactgacatttgagtccaagctgacttacttggcaaaaaaaaaatatatatatatatatatgtatatgcacatatacatttttgtgtgtgtgccagtgtgggggctgagacatgacaccccttccatagaaatatgaaatatatcattgtgccgcggaggacccagaaggaggggagtcaggagggactggaaactgggaggcatgagaaatggccctggaagatggcaccatggccagctcccaggagcacacagcctcctgcctcaagcatgggcaccccaagctcctaggacaagagagagggaatgacccccagggagggcacacagccaccctgagctgctgctccacctctgatccatgagtcaagtgttcctgtcactccaggtccctctcagtgccctgggcacctagactaaaagaggccctgagaggatgaagagctgagtcccatgggctcaggtagtgccggggctgtcacttcgtgcagactgtgcctcatgaggagcagggtcagaggggcaaaagtcccccacatctgatgggcttgggctgggatgcagcaagatcccccccaggcccccactctccctttgacaggacaagtgggagagcagctggcatgggggcaataaatattttgagcacaggtgccagctgcttaggcaaggacagaacttgggacaccttcctgaaggaggcagggttgggcacagcccctcaagctggtggtgaggagtccctggcccgagtgcattccttgccctagagagagattatcctgcctgttctgcagcagcaagagagggcaggccccaggcaacaggaaggccagagcaagcctagtgtggacagggcagcagtgaggtagaaacagccccaccccaccacttcacagtgaccacaggcccagcacctgcacattccatcttcatttagcagtgaccgcgggcccagcgctgtgcccagcacccacatattccatcttcattcagcagtgaccatgggcccagcaccatgcccagcacccacattccatcttcatttaatagtgaccatgggcccagtgccgtgcccaacacccacacattccatcttcatttaatagagaccgcgggtccagcaccgtgcccagcaccagtatattccatcttcatttagcagtgaccacgggcctagcgccatgcccagcacccacacattccatcttcatttagcagtgatcacgggcccagtgctgtgcccagcacccacatattccatcttcatttagcagtgactgcggacccagtacccgcacattccgacttcctttagcagatactggcaggtgccactcctgctttgcctgcagagatggtcctttgctttccgggctctagggactacagagagaacaagaatggtatgatgctgcctcatctagaaagggaacccactgtgtgttctgacatagcagtcccctcccaagggagctgtggctgtcattcatgtttcaggaacaatacctcaagtcaaacggtgcccaggagaaggatgcacctgctgcataggctttagtttgctgaaagaagccaaggctgagagggaattagcaacactaggaaggagagaggttggggatggtggggttcctttctgtaagtagcagcagcttggtctccctccttgcagagaactgagagaggataaagactgctctgtcagggtaataagccttctaaagctaatgacttaaatgcagctacttattatctcccagtactgcagattggcaatttgaggcagactcagctacatggttctttgtgtgcttctgctgctgggtgggcaggggctgactggtctggggggcgccttgcagttgggcccacagtctccctgctcctccagccagctagccagacttgctccagaggcaacggggtgggttcagggagagagagaatgcagggcatggaggtcttgcagccagatgcaggtccagagctggcccctcatcactccactattggccagagccagacacagtccagcccagattcagaggggagagaagctgctgcaaagccacattataaagagtgtggacatgggaaggagaggaggactgtggccacttgtgcactctgctgccataggcctatgaggtgacccagtcacctgccttcaagaaacctctggatttgcaaagaggatttcagaatttcagtgtggaatgaatgccagagagcctcttctgaatgcttaggcctttttttctttctttctttcttttttttttttttgagacaatgttttgctctgttgcccaggctggagtgcagtggtgcgatcacagctttctgcagtctcaagctcctgggctcaagtgatcctcctgcctcagcctcccaagtagctgagaccacaggcacatgccaccatgcccagctaatttttttaaactttttgtagagacagtgtctcactatgttgcccaggctggtgttgaactcctgaactcaagcaatcctcctgcctcagtctcccaaagtgctgggatcatacaggtgtgagccactatgcccagccatgcttgaaccatttagaactcttgatacttgctcagctggacagagtgcattgtcttccaccagctcagtgattggaaattagagcagttatctaatttggagaatgggacaatttttatactcaagtgtttataaactaaaatgcatacccattaaaaacagataacctgacctaggctaagagaagctgagtgacttgaccaaggtcatgcagctggtaaatagctgaaactgaccagcccacccaccctgcttttaacaaccacatgacatgatactatgggtgcctgtatctcaggaagagtggcccactgacattggaagccacaaagtgaacctcagcagctgagagctgcagagagggtatcttgtgagaagtattggctgcccatcaggaagagcggcgtccaggagcagagccttcagtttctgcactggggagctgctgctgctacctcaccaaccttcccaacccgggacctggaaggcacatgtggccactgtgttgtcatacctgtgttaaaaacaaaaattaatcgggaggccattgggctgaggcagctgcagtgcctccaactccttcgttagcaatccacaagccgactcagcataaacagtcatattctaggcctatcagaaactgctgactaacccctaactggcgactttctactagttaagcttaaccaatcagaaaccaccaactactctctaactggggactttccactggaatgatccgaatgaaattactattcactgtaaacaagcatgtattttctttgccttgctcccacctccaccttgtaaaagccttcctctcgcatgccttcctcagggccctaacttctttctatctggcactgcccaattcgtgagttgctcaagaaaatctctttaatattttaatatgtgcctcagtttatctttgaacacctgcaagtgctgaggagtggtcccttcttgattcctttgtctggtttttctctgtgggttatacagaactgcaagagcaaaaagataaactaggaaaatcattctgtaagctatcaaaatatgtgtcctagatctttatttttaaaaataatctctaaagccaacccagacctacacgggccacctctggggcaactctcaggtctcatgtgtggggctcaagccttacttctgccacaggtttccttgaggctcacaaataagagccagtttgcaaacaacaaaggatgcaaaggaaggcttactgagcactgtcatgccttggagtttaaaaacgacaataccaccctagagatggtggggctgagcccagggactgtacacagccagcaagagacagcaccacagcccgtggtgccagggtttcaaccctgctgtgcttcagtacaatcacctggggacttttaccacctgcaatgctcaggccccctccccagagactctggcttatggcacgggggcagcctgctttattatttttttaaatgtttcccagttgatattaatgtgcagccaggactaagagccacttttagacaagtagtattcaactcaacattgcctgcacattgtgtacacattgaaattacctggggagccttagaaaaggtactaagactgggtcccacctcactcattctgatggaattggtttgaggtgtgacctgggcatcaggacttttgaaagctcccaggtgattcctatgggcagtcaagtgtgaggcccaatgtcttaagtgacacttaggtgaagaatggatctgggattctcagaaaagtttttgtttgcttgttttttgtttgttttgagacagagcctcgctctgttgcccaggctggaatgcagtggcataatcgcagctcactacaacttccacctcccagggtcaagcaattctcctgcctcagcctccccagtagctgggactacaggcacacaccaccacacccagctaatttttgtatttttagtagagacagagtttcaccatgttggctaggctggtcttgaactccttacctcaagtgatctgcccaccttggccttgcaaagtgctgggactacagcaatgagccactgcacaatctggaagtccccccgccacctgggtgcttgctaaccccaaggagttccatgcacgtcatcctccaaggtcaagatctctggccatggagacagccccacatgcagagaagccctgcagctggcaccacaaagctcaggctgcccaggtcctgcatgcagctgtcttgaggctcctcccctgcagtcctgccttcctccatccctgtctgagccaggagccaggcaggcttccctggagaccctgccaaaggcttttcacttcctgctggtcgattttctgggtcatgttaccttttcagggcattagcagcctggcttctgaggaaattgagctacccgtcctctgggggtggcacaaagtgactgggaggcaccagcagtctaaaaagaactccttgggccaagcacgatgcagagggccctacctgcagtttccctgatgggcccaccagaaccaaagcaagagaagcagggtggctgttctggagcaaagaatctcatcagaatctcctagagggtttgtgaaaccaagactgctgggccccaccccagagtttgtgattcagtgggtctggatggggccataatttgtctttctaacaggttcctgattgggctgatgccgttggtcctgggagcctccttgtagaaccgccggcctgggctgctgctttctactttcccacagtgtagctttttctctgacatgagcattctctgcaagtctaaccaaagcactctgacttcttgtgctgaacttccccaccccaatcttcagcagaggcagagtgtgtggaggaaggatggagagcagatggggcagaatagcgtccaggtcctaatccccggcacctgtgagtgttgtgttgctgtataaagggaattcaggctgcagacagaattaaggctgctaaccagctgacctgaagatacagcaactgactagcctgggtcatccaggtgggcccattgtaattacaatggcactcccttcccagttggaagaaagagaggagcaaagaagtagagactcacaggtgagagggactgggtcacatttgctggtttgaagacagagaaaagctgcaaacaaaggaatgtgggcccttcgagaagctgggaacagccctaccctgacagacagcaaggaaaacagggacctctgtcctacaggcacaaggaactatctctacccacagcctgaatcagcaaggaaacaggaaaagcaaaaaggcagaggaaaagtgagagcctggcttttaaagttgggaacatacagacaggagctgactcagtagggtcagagctgggcgcatcagcccacatggaaggtcatgggggcatgccctctgccccaaactcagaatcgcttgccagcagctcagagaggtagcctggcctctcccaaaacccccagcagcagggatctcaccatgctccaggtcgttcaggtcatcagttcccggctcgcactgatggaactgctggaaacttctcagcagagaaagctttgagtctgctgctgcaaggctcataatcactaacatgggcccatgtttccagcaagactcagacaagcacttcagtggctgtgggtggcacgggctggcatgatcctgggctgatttcatcctcttgggtgctgaggcctcccatttgtgacttggggtgattcctgaaaacaccttctctgagaagcctccctgggtcagctcagcctgcttatttctcccttatggcactcaattcatgtagcctttattgctgtgaactgtacagggcctcattcttttctgcagtatctgtagtgagacatccaggtataagcactctgaatatttctgttggcacacagatgattccagtatttaggttaaataaatcattatttagcaacatgcatgttaactttttatggtaaggaaatgtttttctgtatatgcataaaaatacatctaaaaggatgtattttagtatattaaaatctggatggggaggtagtattttcttaatgtttatgcctgtttcttttttttaaatacttttttatttttttcaaagtaatacatgcactgagtttaaaaagccaagaaacagtgagtcttaaaaagacaaagaaaaacaacagtaacacaaagcagtcccatttcacccattccacccccagttctccccaaagacaaacattgtcattaacacttctaggaaattcttctcatcttcactttcatatttttggtactatattcatgttgcaatttttaattgattagctgtaggcattaacttttgaattccccatcactaaccctcttcccatcttcctaacacataatcactttgaagactccttttgttcagttttgggaaattttcttgcattacgctttgaagctttcctccccccgttctgtttctggaactcttgtaggtcaggagactggccttgagaataaaccctataatttgttttattctttcgcttctatttccctttgtctttttgttctacttgattttagcttctaaccattctgttgctttcttgttttattttatttgggttttttaattttttgcctgtctttaattttgaggttcttgtggtctggttacttttcatggtattctgtccttgttttatagatgtaacatcttctcatatatcactcagtatagtaactgtagggtatattatttttttaagttttctgtatgtgtcctacattggctgcactgccctctccaggtcccctttttccgtttgtcctggtttctgtgcttcatgttggatcctttcctcaaataccagctgactttgggctgtcctcatacctaggacaatgccctgaaaaactgattgaaattattacacgtgagtgttgaagatttcaaagacttattggcttcaccagggggtcatagaatttttggtcccgcaaatgttagtatccctgtattagtccattttcacactgctgatgaagacatacccaagactgggcaatttacaaaagaaagaggtttactggacttacagttccacatggctgaggaggcctcacaatcatggcagaaggcaaggaggggcaagtcacatcttatgtgcatggcagcaggcaaagagagagcttgtgcagggaaactcccatttttaaaaccaccagatctcatgagactcattcactatcataagaacagcgcaggaaagacccacccccataattcaatcacctcctgctgggttcctctcacaacgtatgggaattatgggagttacaattcaagatgcgatttgcgtggggacacagccaaaccatatccctgtcttttctggggttactgacactctctaggaagagtcctctaactgcctgggatagaggtacctgctgctgttctggggacggggactgaagagccactagttggcacaagtctggcttcagtccccatctccatcctctgtgtcacccagcctgccaaggcctggcccgtcaccactcagttcatctggagaataaatctctggtctgcattggatggggaagcaggagaagggcagggagggggcagggaggagaggagggatgggggtccccagattgggtggggtgggaggagattggggtccgactgctctagaggcagactttcagctatcccctcattttcagccccaaacccaatctctgctccttaattcctggtgtttctgggtgcaaagcccttcaggtgggctcaggtgaaacactcattgctcacaggaacagcccactgcaggcagaaccctcctgtgttccacaagatcagttaccccccaacccttcaccagaattcctgtctgctcttatctgtgtccccagaatgaacattttttaaattctcactttcttttttggtggggaagagccaaatgccgatcactgagcagctatatgtatctggaagtccctgtgttttcaaaaataagcctgttttttgttttgtttttcagttatgccaggaagtgtgtatttttgctatgtggattggcaattggttgatggcgggcgaatgaacagagccaaatgaataaaacacaattttaacacttagggaagttacaaatgacttttactgactaaattctcatttttcctgatagaactttagccatcttttgagaattaatttaaactgaaaaaatcaaatgttcagagacattattataaaaagcactgacacagatgggaggttgtagcttccctccaaagtctactccagccctacaccccttgaagagcacagcccagccctcacagaggatcctttgtgctttctcctgggccagccccttgcccctggaggctctgattaatgaggaaacccttttctcacagcaagagcagagggggaccctgtccacagacactcggtgccttcgcctgaaatattgcttcctctgcatgttggaatccgttcctggaggcattggggacttaacctcttgaatgctgtgtacttagtcccctgggtctctggggaggactgacgtcagacaccaatttacagaaatctgccttcatctagaaggccaggcccaggaaggttcagactctaccgtgaccagacattgtaaatctgcctcacgacagctcatcccaggagacagagctacccagcagggccgtgtgaaggacgtccaatgagcttgtgcagcaaagaggtgatccctggcctgaccccagctggcatggcaatctctcactctgtcagtgccctgtttcaaggaggcttaggtgaaatggagctcatggtgataaagatctcagcttcagtgactcacgaggatctgaagggttcaactacctctttgtgaacagaaaaaccaatgctcaaaaagtgtggctgcacaagctcccactgacccttagctccaatcaggattcacccccaggtaatctggctcaaaaaccactgcaccatccccctaccagaaatcaggtggcaaatgacagctgctaaggcccccatatgtgctgcagggggagcagagccaactgttctgcagccccattgtggagcaggtatctcactccatcccgcacagaccaatgcccagtggactaggcagttctaatgccctggaagctaaagatagacttgctgggcaatggtcaggagaatcatgcacaataacagggcctctctgctttgctgggaacacaagccctgcgcgtactctagatactgcccacagtgtgaggcaggaagcagggactgcatctaactcagagaagaagggagaagtgagggacaaaggtgaacctgaaaatgtatccactgcaccctgttccacagttgggtgtgtggctttacctgcttcatggatgttggccaattgattctacagaaaagaatctaaataaaagagcccccttggacaagcctcctgcattcattccatcatctaccacctctgattttacaaatcttcccagctggtgggaaatgtcagcattaatttagggaattcaaatacaaaggggctgggcacggtggctcgtgcctgtaatcccagcactttgtgaggtcaaggcgggaggatcatttgagcccaggagtttgagaccagtctgggcaacatggcaaaaccccgtctctactaaaaataaaaaataaaatagtcagatgtggcagcacgcacctgtagtcccagctacttgggaggctgaggtgggagaatcacctgaacccaggatgcaggcgctgcagtgagccaagatagagccactgcactccagcctgggtgacagagagagactccatcttaaaaaaaaaaaaatacaaagagatgagtgctgggggctggagggcaggtaactcactctgactgtaaggatcaacaactgtcggggggtgactgatctggactttggataatgtgtgtaatgatgatgagaagaagagaatgttgagggaaaaaaggagaaggaggaaacaaaagaataaggagaacatgacaaaggtaaaaggaaagcatttgaagcatttgtctgcatggcctgggagtcagtctggaggagaaggagaaggatggaaggtggaagatagagaggtggtgcgggggaagcttgtagaaagcctgggatctggacaaaggaactcagactttaggcaatggaaaatctctgggagtcttaagcagggctgtaattgtgaagacctgctgtttccaaagtgaattccagcagttggaggacagattggagagggatgatgctggaggctgggaggctcattaggagactggggcagcatctgtacaagaaatgagagggatgggagccacagatgagagatggcagatgtggagcaatgaggatgaggattggcagaacggaagaggaagaaatattgtcaaaacttattttgtttccagatttggtggcaagggtaataattaaaccagtggccaagatgtaaagtccaggaagcggaaaggaattgaggtggaaagatggtttgatttggaatacattgagtgtgacagagaggtgaccaataggcaggtggaaatggagctcatggcggaggagaaatgctggtgtaaatccttgctaggaacagtccttgtgcttatggtgctcaggccacagagccccttagcaataaccaggaagagagcggagagtggatgggagagagagggttgcaaatgatgcctcggtctattgctgagtgacagattaccctgacacctggtaacttgaaacaacaagcatctattatctcacagtttctcagggtacctgggagcagcttagctgggtagctctggctcaaggcctttcatgaggttgtagccatgctgtcagctggggctgccataatctgaaggttcaactggggctggggcatcagcctttaagctccctaacatggcagctgctggcaagagccctctgttcctcactgcatgggcctctctgcagggctccccatggaggcaactggcttccccctaagagagcaacccatgagtgagagagtgaccaaggtcttatcttttataactcaacacttggactattgctaccacttctgctgtgctcagtcctataggcaaacccaggtataatgtgggaggggaccacataaggatgtgaataacaggagggtggttcattgaaggctgccaaccacagatcaccaacccaggaaacagcacagaaaggtgagtctgtaaagcatgcacagaaaaaagaaagaatgcaagccccattgcgtgtaggatgtttaccagagaataatatatatgggagattgtccagaaggacagggtggtttcaaatgctaaaaagtccaggcaatgggaactgaatgagcatggaaattaggccactggacttggtgaccagcttctagactggcatggccagccacagtgctacaaaagcaggtaaaagccacctcttggcagatggagaagtgggtggaaaatgaagacataatggaaggtgctggtaaaagtaaaccactttccagagtgttggtggtgatgtgaggagagactgagagtagtttgcaggggaaagctgttctgtacacaaaagctttggctggtgggaagaggtagaggggaaaattggaagacatgggacagagacttaattgatgatctagagtcccagaggacatatgaggtcagtgattggaagcacaagctgagataattaactccccttcctctagtggcaggaaaggacaggtgagggatggttgaaagggatgcgagaggtatgcgggctgctcgtctgagggtctctattttcttctgctgacgttgagttgagggatgaggtagtggagggggttcagaagaaataaaaggcttaggttagctctggtgacttgtctccagggacagccactggcgttgagtaatgcccatgaccttcctgctgtgttgtggaaatttcctcaccccacagctgaagagtaacacacacccctgtttcatcctcccccgacttctcatgctccccagagccacccaggcatttggcatttgtgtgctactgtcaatggtgcacaatttatgtccatcccctacagctgggaatgtctacaaagcatctatttatattaatagaagctccagtcaaggctgggagacttgtggtcttgactgctgggggagcttattcgcctggaccacctggaaggaagatgatgggagccttccccaaatccatcatcagctctgcagatctaggaacagtgagatcaacacctctgcctctagtcctcccaaatcatctgccccgaggctgtgcagacggtctcttctcactaggcagctctaatgcctgaggtacctatgaaaccagagtggcagcagagggtcaagccttgggcaagtccacttaacctcacatgaccctgctccctcatctgtaaaatgggaagaatagggttgttcatatatcatttagcgcaatacctggaatgcatttaatgttaagcaaacactaactgtttttcacaagccctggaggtcagacatgactgactgccaagggacttgattataggtttattgagtctgtcttcctactgctcccgcacatagacactttgcttagtgtacagtgaaatgaaacaatatggtgaatatgggctttggatgagcccatcattccaaagaaaagctactccctttaccccaattttccatggccagggggccaggctgtgtccccagtttggagtgttggttcagtaggtggaatcctataacaaaacctatgcaggatttgtcagggtggccagttttctttgttcccttatgatattagcttccatttcctggcaccctctctagacacagtatatctgacccagtaagacaacttctagacccattttacagatgaggaaattaggaccgagagagtaacgaatttcccaggccacacagctgctaactgcaaagccgggctttgctcccctcctgtcccctcccctcccctcccctcctctcccctcccctcgcgcctcttctggcctccttcccttcatacatggctgctcttcctgaccaaacacccaaggaccatggacaagaaagaaccagcagagggggaagccccagctctggtcctttgtatgctgggttccagcagagattgtcttccagaagtccttttcaacttctcagcgctttcagggttctttcaggaattgcggatgcccagaatcacagactcctgggtccaaatggttgagtcagtgtgtgagaactgtccgggacatccttcccaacccagcacccaaatgggctccaggtcgtcactacctcctgcagcagctcagcctaacaccaagtggcgggttgctggagcatcttcccctactttgagctaaaagctcccctacccagcttcccctcactagcccagatttggactccttaagatgcaatggcaattgtgctttctttgtgtaatatctacattgcaccattttccccaggcagctgggcccctgtccactctgcttcatgaatgctgtaacttgagactcccttctcagagtacttttccgcactcggctggtttccacctccctcactgccttggggctctctgtccttccctctgtcctcccccgtctcacagcctgttagaagcagagctccccgggcgttcgctgatttctccaggaaatgccccttctcttttacctctgggtccattagcaactgctgggtcagacatggatgtctggggcttcaccaccttctcttccaacttctattttagggtgtggcctttggttcctggcaacctcttctctaactccggagaggtctaaggagcacacccgcccagccagacctccccctcctccgggggctccacagatgggcttagatggtagtagaggagttggaagttccaccagagccctctttgcgggttcttcaagagggactttctctggggttcctccatattttgttttttgccacaggccctactttctttccactgtcacccaacaccctcctcttccctccctcttatgggggcagtcccaggataaccctcggccttgttagttctcagctcccctaacctgagcccagtgtacagaaaaaaaagcctcctgcggaaaaggacgtggggagagcacagctcagacacagtccaccgtcagcacaatgctcttagctctaactggaagccgacatcacccatttgacaattaagaacaggtaagtttagcagctccaaaacgtcccccactgcccagtgctgctcctgtctcatgggccaggacctgagctggtgatggccttggctgagccctgccacaacaggagacagctggccaccctgagcaggtgcatccaaagggagggagtgcagctggtcctctccctcttgttaaaagcaagagaggctttcccagaagctcctcagcacacaccctgtctgggctatttgaccagaactgggtcacaccctctcattcctaaagtagtctctgggaaagggagacagtagactaacctgtggactgaacagtccctgccaagccaggcccggaaggaattcgtatcttctgagcaggtgaccatcagatacaaaaaaaaataagtggctgttggccagcaagaagcaagtgagcactgtgggccagccagagcttcccgacccatgcaaatcaagggttcctaaaggacagggagctgccatcgctgctgaagcccagcccccgcagctccatctgtgcaattcagcatatgccacagagaccggaacacctgcatttgggggagtgggtgtgtgtggtgtcaagatatgtcaaagtttaagaagattgaagttgatagtctgctaatagaaaacaactaacccaggaaataaatatgtaaatcatacactcataaacttgatcttgaagatcacacgagcacagaagttcctaaactcattcaaggcggaaaaatacaaaaaacggtaatctttatggaatgccatgattcttgatcaaattaatcaatcaaattaaaataattttaatagcaaaaaatatctattcattatatatgttgagggtgtatcatcctcaagcaagaaacatgcaagccaggcatggtgcacacctgtggtcccggctactcaggaggctgaggtggaaggatcgcctgagcctgggaggttgaggccacaaagattgtgccactgcactccatcctgggcaacagacaagaccttgtctcaaaaaaaaaaaaaaaaagaaaagaggaaagaaaggaaggggaaggggaaggagaaggggagggaggggaggggaagggaggggagggaagggccaaactaattgttcttgagttttccgttattattggcagaccttggctttccatggttcaacttaggatggtgtgaaaatgatgtacattcagtagaaattgtactttaaattttggattttgatgttttcctgggctagcaacatgccctacaatatattcttacatgagctactccacactttataacataaaccttgtgttagatgattttgcccaaccataaactaagtgttctgagcacatttaagtaggccaggctaagctctgatgttcagtaggttggttggattaagtgcatttttaacttaaaatattttcaatgtctgatgggttttttgggacataaccccatcataagttgaggagcatgtgtattgggtttgcttggagtttttttccttatttggttgttttgttttctatcttatatgagcaaaggggtaaaagatttcagaaaaacacctgagagataaatcttaataccattcaatctagcacatccgttagtaaattaagaatgagggaaagcccaccactgtccaagtgtaaaggctgggctccttgaaacagctacagggacactccaagtacatcaaaaacaccaattcagccaaaacttcacatttattttctgcaaaagttaccaaggctcacagatgcctttgggtttccccaaggtcacccggttaattattgacatagcaactcccctcgcaaaacaaagaatcaaaatgatttcccacgtcccatgttgggatgcatgttaatgaggaaggaaggcctctgcgtggcggggcctgagctaagtatgtctagtcagagtccaaatccgggacagatttgaaaagctttctaatccacctatacgcagaagaataaagcttggaactcatttcaaaagttgtttctactggtgatttaaagacacactcctctctcccatatgcacataagcacagacctgcaagagcactgtcccctccagagccagacactacaggcccccagcaagtgtgaaatccaggtgtgactttctaggcatggcttggtgaggaagggcctggcccactccttggctccctcctcccagccagaaacggttaattgccagctccagactgcctccagcccagccctaatcgccgatctcaggcggctgggctgcgctggggctgagcggctccagcccaggctggggttgtgtgagcagcaggagcattcttccaaggtaatgattaagctgagtgcctggcaagggcacgggctgagagcacagaaggtgagccctattcacacctcggccaggctgcggtggccaggactggtttgggaaggcagggccccggtgtgcagccacagccagcagcctcctacctacacaagggtgttcgggagcatctcagggccgaagactttgctgcctgccctgccaggactttgtcctcacccctggcaccatgcagctccaggtgttctggactgggctggaatacacctgccggctcctgggcatcaccactgctgcaggtaagaccctgcctcctggctgctgatccttgcacactggcaccacagatagggctgcctgaggggtgggaggtggccaggagacagcaggcacatctggccacttctgtgcttcaatttttttcccaagacccctagaaacactgctctgtagagcagcagcaagtgcagtggggtgagcctagggctggggaccagagggctgggtgctggatctttgcttggcaagtcaccctccctgtgaccttgggaagcctcaagatcctcatctgcaaaatgattccaggggccaccccacctacgcagagagttgtcatgagatggaggtggagacagaaggtgaagatagaaagggctgggcttcgctgtgtatctacaaaaggtcaactgagctcatcctgctttactcaaaccatagccctacctcatggagagagaactcccagtcatgagcagctctgccctggagggacaggctgagcctggctggacgtggagatcacaggcttccctcgggcccatgctggaccctgttaacagaacaccctgtaggaacccagacccctgtctgaggtctgactgcaggaatgcactgtggtcttagcagcagagatgcttcccagagatgctgggctccttccttcacccagcagaatcacagggctgctcaactggacaggagggcagactgttagagcagagcccagagccaccatcctgagccctgcctgctcgcttccccagggcaggcctgacccttagccccattccccctacagagccaggatctgttttggggaaatgaacaggcagaattctgagcccttaactctgagccacattgtcccttggggacaaagagagacacaccccctatcaaagcccttccccaccactgggcaaaagcttacccacgggtcttaccaaatgggaaagttctcctaggtcaaaatcacatagtgcttgttcctgccccagcctagtcacttgcgtgatatatgaccttggggagcccctgacccctctgaggctgcactttctgatctgtatgatggggacctgctggccaggtgtttggacagattaaggatgcaggaactgagcatggctaagtggaactgaggatgaaaacctctcagcagaagcccccatgacacactccagagctcaatgggaagctgggtcatttcaggagcactgggctgggttcagccgtgagctggccagtgggctcttccagcatctaggccatgagttagatcatgaagggctgctggatggtttaaccccacccctcctgctacaggatggggcacctgagctcaaatgcaggtggtgaccttgcccaaggtcatggtcagagggacagccagcccggagccctggtccttcaactttcacaaaggccagggctctggccaaaaccttccctgtcttccagagtaggcagcaggaagaggttcagaattgctctgctgaggctctgagtggaggcactgagggaggagccagatccagccactttcagaaccacgttgtcgtctacacataagagaatgatggccaagacccccaacaagcaaaaaagccatcctggggagaggaaggccaccctaaataggtttccatgtctgttgatctgagtccaccctgctccctctaggctttggtttccaaatctgtaaaatgccaagaatcccacagttcccccagccacactccacccagagctgaggcccacctcccgtcgagaggctgttctaagatgtatgtacctatccttctaatggattagctagagacagtttaacagtctgatttatctcagtcaccggaagagtctgcagcccctgacactcccatgtgcacgcacacacacacacacacacacacacaaacccgtgcgcgcgcacatagggctcgtcttaaccacagcctttatctccgcacagggactgctgttaatgctgagaatgggcctccctcttggttttgataggagattcagactaaaaatagccatgagctcccttctaatggccaggctttcaaatgatcttgctcgggctttctagagtgctgggagggagtgggaggctagagagaggggtttggtgttcttgggcaaatctcgagtttcttccagcatcactgaactcctggcctatttccagtacataggatttgcaaattccttattctcctaagcctctcttttgttgaaatcttctgttgagaaatccaggcttcatttacaagggcactgctgctagagaggaaataagaccggaaatagagggcctcactttgcagaaaccctagggaggtggggagtgtggatttcttaaaagctaggaagacatgtgacccaagggcactcagagtgtcacctgcagggaccaggcagctgctaagaggctacagcctctcattagcagcctcttccctggaccccctgcagacaggatcagggctgtcaaaagcactgacggcacctggtgggtgcctctgccagcatgtcaaggccctatgactgtggatgaagccacagcctttggatgaagcctccttaggattcctcgaagtcccgcagaccattcttgccccacctcagtgtccagccccatatcatgaggggttgtagagcacagacggatcattgccaccaccaaattgggataaacaggcctcaggtagttgcacctgggtggaagtgtttctaaaattagaaaattccctccctctggagcagtcatgtggtttccaggacataacagaccactcccgcattgtttacaccgggttcatttgcttcacctccctggctcaggatgtggggttggggggcaggcgcccatgggtccatgtgcatgcatgcgcccgtgtgatgtctaagtgcctcagttgctgagacgcggcatccattgccgcccatggaagcagacacagctgggaaatggcacacaggctgtgagcactccacattcccctgtgcggatgccggagctcctgcctgtccatccctcaaagcaggttctccccgtgtccactagagacagggtaaagatgtcctgagtgtgagactcaggccccagaggaggctcagccctgtgacaggttctcagcacagaccaaatggcaggaaaggggtcctgggaaatggatttaactgagcctggagcacagcggtccagggcactcctcccctgtgagatgagaaaggacctgtcccacagcattggtcccagttgcaggctaggaaagcagggttggcttccctttgaacttcagccatcctcttaccctttaacctcaggggaatcttgaataactcctttgccactccccagcccctgctgaggtggccaggaagagcatgggaagagccccctttgtgggacagaggaggcacctctcaggccgtccaggctgggcatggagggaaggggagacatgtccctgagccccgccttgtagtgaaagccctcccctcaggctgtgtcctcacacacagatgtgcatgggcttccccataagaggcttgctcagaaaatgtctctgggcacttgagcaaggcctcccaatttccctcagagcaaagaggctccagcttgaggccccactgccccatctccagggctgaatttcactcttccagcctctgcccagagcagaggttgctgagaatgaacatgattatttgagtatttactcaaataatactcaaagcccaagctttgcactgtgtattttaaatgcagtatcgcatttcatcctcctgtcattgggagcatcatcatgttcatcctcatacccactgtacaggaagggaaaccgaggcctgatggagcgaagcatcttgctcagggtctcacaccaggaagcaagaagacaaagttccacctgatgatggtctgctcctgagactccactcctaatcgttatttcctccacctgaatcaggattaaaaagcatgtcccatagtattttgatgaccccaagatgcaggatgcaaaacacacagaggagagcaggagaggcttgatcagaacttccccatcctctaccctcatgctcctgcccttggtcagttctgatcagtcaggtggggtcatggtgaggacacacgtacagtgaagcacatagtcaaggatcaccaaacactttctaaatctcaagacaccgatattcattgcagctatccattctctatctcaagattgccacacatgctttaaccagcaccaccgtgaccttctctagccaaatctgctcctggaacccatctggggacagacaaatctgcacacatttccagggggaactatcacagtagggcttgccttgatgggtccagaggtgcagggctgactgcatgcattatggtcattgtctcgctccagccccacaaatgcctgagacgctagagtgctgggctcagtcctattttacaaatgaggaaactgaagctcagaacattgaggtaacctggcagaggtcacatggccaggagacagaggtccggtgttagaactccactctgcccaaacacagggctgtgttatggcagctccaaagcaaagggcatggcagagccagcagggcatgaggggatggaggcaaagccattctgagtgaactctgcttgtcaggctgacgtgctgtttctcacaaattgagtgcttggaatcaacctggaatcactgaggggttttattttgttccaggttttgacccattaacctgtttctctatataatggacacagccacattttcaactgctcccatgcttcccacacagttagagcattggcttattaatgtacattaggagaaaagaagtatttaaaacccagctgttctcattatattttaaaggatagagcaaatgcatagtttgaccttagccctgttcaaagccttcaggaaaacaaatgcttctgaagcagccatcttgggccctccatgctaattttacccctcttacatgtatatccccatgaccacctcctgctgtttaagaaagtgtcatgcactccaacgcctcgcaagagatttatcacccaagtgagcccacattgtattttcagaccttccaagtgaatgttgactgttttccttttctgttacaattggctccacaagtaaatggaatctgcctccctctgttccccccacctaccaccaacaggcaataggatttggttcaaacatttcttttttcacaactttgtgcctgtgccttgcttctagatttataacaagaaatctgaaacttcaattaggtttcatttacttggcaaactgttgctgagtccccagtgatctgctcctgagactccactcctaatcgctatttcctccacctgaatcaggattaaaaagcatgtcccatagtattttgatgaccccaagatgcaggatgcagtccagtcctgcatccccagtcctgagtccccagtcatgcagcatagacacatggattagaatggcaagaccttgccctgtgggagtgtatgggctggacagagaagcaaactagtaagtgcacatccgagcaccaagcactgcagcgtagtgtttgggaggtgggtctgtgtcctgggacaatcactgtatctaccctctggagttgtgagggctcaatgaaacaatggctaaagtagcaagctgcctggcacatagattctcactcagcatgggctaattttagaggaacgtgcagggcatggaactgtgtagcatgagttatcagctccttttgttggaaggaagaagaaggaagatccgaggaaaggagcaaagcagtatgtgactcatgaggctggaaggaggaaggggctacactgtaaagagcattatactgggaaacatttcccatcacattctgagcttgggttgtgaagatcagcccacaggaacttggctatttctacaccacatatagtaagccaaccagaggaaagatggcagccctgttttatttttcatgggatgacagctctttcaagattgtcctgggttctattcagccttctgaagagggctgtgaacaaaaagaaatgttgtctgacataagtggctgacactgtgaagaaggggctcaggaaacccccaggagaccaggtaagggtcagatgaagaagcctgatgtgtgtggaatggacagagaacaatgggagcatggacaatgctttctggaaacctgccatgtggatgagtgagcagatgcattctccctgaacactgagaaggaataggaagtgaatacctcggttctccctgacattgagacctaaaagaaatttctcctgtgggcctgtataagtttgttttcacactgctgataaagacatgcccaagactgggcaatttacaaaagaaagaggtttaattggacttagagttccatgtggctgaggaagcctcacaatcatggtagaaggccaggaggagcaagtcacatcctacatggatggcagcaggcaaggagagacagcttgtgtgggggaattcctctttttaaaaccatcagatctcttgagatttattgactatcacgagaacaacacgtgaaaaacttgcccccctgattcaattacctcctgctggtccctcccacaacaggtgggaattcaaaatgagatctgggtgggaacacagccaaaccataccagggtacttacaagggagatgctattctacgtgggagacactatcctcagtagtgccaatgaaccatatgggtctgcagagtccttcctcatcaccaaagagtggggtatcagcacagatggcctcacaggtgaattctaccaacacttaaggaagaaatatctattccacacaaactcttccagaaatttgaaaggaggcaatacttctcaactcattctataaaattagtatttatgtggataccaaaaccaaagatattacaagaaaactatagactaatattcttctcaatatagatgcaaaaattctaagcaaagttttaacaaatacaaatatattgaaagaatgatatatcataatcaagtggagttcatctcagaaatgcaaggttgttttaatatttgaaaaatcaattaatgtaacttaccatgtgttatggactaaatgtttgtgtccccccagccaaattcatatgtggaaatcctaacacccaacatgattgtattaggaggtagggccttctctgaatggaaataatgcccttataaaagagacctgagagagctccctaggcccttctatcatacaatgtgcggtaacagtgagaagacagttttctataaggaaggggtccctcagataccaaatctgccagcatcttgatcttgcatttcccagcctccagcactgtaggaaataaatttctgttgtctataaggtacccagtatatgggatttggttatagcagccgaaatggactaagacatcatatttaaaaactaaaaaagaaaaaccatattatcatctaaatagacacaaagttttaaacgaaatccaacattcttttatgattaaaataaaactatcatcagcaaactagtaacagaaggaaactccctcaaccttaagaggtcattacagaaaacatacatctacttaaatgtaaaagaccaggtgcttcctcctaagattaggaacaaggcaagggtgtccactctaccacgtccagtcagcattgtactggaggttctagccagtgcaagaaacagaaacaaaatgcatacagattgtccaggaaaaagaaaaattttattcacagatgacgttatcatctgtagaaaatctaatagaatctaccccaaaagctacttgagctaatggagggaatggcaacattgcagaagacaagcttaatatataataatcaactgtatttccatacattagcaacaaacaattagaaaatgaaatctttaaaaatacaaattataatagcattgaaaatccgaaatatttagggataaatctgacaaaagatgtaaaacaaactacactagaaactagaaaacattgctgagagataacaaagaaaatctaaatgaatggagatgcatcttgttgatgggtcagaaggctcaatatcgttaagacatcagttctcccccaaattgctatacagtttcaataggagctcaatctgaagtctcttccaactgaatgtccagaaatatctgccatgaaatccttcccttttcccacactgtctctgaaccctggctcatgtatatcagctgaactgatctccacacgtaggtaaacctccccaccatgcttactgtttgccacaacttctgagctaagaagcctgtggctactaccttactgtcccagtgaattcacagcaactgtttccagcaactccatagtcttggaaatggtacaaatctagcttttcacctctaccctggcggtgaccacctctcctggaccatccacgcccattgtcatcagcctggagcgtctttccctgaggtgtctttggacaccctgagtccagcaggagatgagaatgaaaagaagcaataaatatacgcggtgggttcggaggctgccctcagcaacagtgagtacaaaattctcatccaatgcccagggcatccagtgccaaggttagtgtggcctctgatgactgtgaagcgtcccatgttaccaccaagggcatcacaataaatgcaagacatatgtcacaattcaacccatggagtcagaacggataagcaacagtggatcatgaggtcagccctatggcaaaagcagcagcagcctgaggccaggggaatatcccctcagtaggcagccccgcagatggccccagcctcaggaacatgctggcctgagccccgtggggaccctagcagggttatggagggctaatacaagagatgtggagatagatgggagtttgggtcacttatatcccaactgggctttgagaagggacctcaaagtaaattagtgaacaacaagcaacactggtgcacagggaacagctttttggccacaaaaaaacccacaagtgtgttaatgggagcaaaggatgagaataaaccctctccttccactggagaatactgatgggaaccgcctgcctcttataatagctttcctagccatcgtctgcatttgtgcagcactctcatttacttagactgagcagtggtcggcaccattttgcatgtttttattttccccattttccagaataagatgcagaccaaagagttaatcactttcctgaggatgcaggactcagcttttctgatgcaggccccatattctttctgctctggtgcagccccctcctagctttcgtcaacccatgctgagaccagagctccaggatgagaaggatactcacacagtggctgccctgcccagggctgtaccacaggctcttggcccaggatctctgatctctgctaagcctgaactacaacaaacagctcaggaaagcaacacagaagcaagccctggaccctgagagaagaaagttcttgtaccaaggttggatctggcccacacaggagggacagagactggagggaaggagctaacaagatgagagaggccaggcttgtccatgaatggctccatcaaggtgcgatgcaaggcacctcctgggatcatgcagggagtgagacagaggcgtggggtgagctgtgctggagtgggcataaggtacctctgttgggctggggtgagagtagctggggagcctgaggtgggataatagggagggatggaaggagtcaaaggccactaatggccgtgtcaagcagtgctgttcagtgttcccttgcccctccacctgggcaggaaagacagcacagccggactgaagcacatctcagggcgattatttcttgtagagaatttggtgtcatgaggctctgattctgcgggtagcagggcctttgtcccattgtttgtctccattgattggctcctgatcattgatcagctaatccaaaaatcagctcttcagtccctggtcccagctcagggtaatgccctgggggtatctgttccagtgagttgctgattcaggccaaccacttccacactggactagcaccctgtgaaggcagagcttccaagacaccagccccactgccctgtgagaagtatggaaggccagagcgcaggctaaattccaagaggagctagaagccctcagactctgggcctcccaaatctctagatgccagggccagagctaccactctcagggcccacgaagggcctacactgcgcctgagggagggagtaccaccttgggcttagactgaaggccacattaaattacaatgagggcccccttaattttaagaggagcacctccttcattgtagaacacctccttaatttaatggcaaatatcttcttagtcttagggagaacacctccttaatgaatgagcacctctgtaattttaggaggtgtgcctccctaattttgagccctggtgtccttctgggcccactctgctcctagttatccgggtgccataacttctttgtgtttaacagagagccccgcctaaatctgaaacctggcagaaacctaaggtccaattccacaaaacaaggagtgggctgtcctcatccacaggttgaagtgaggcctttgagagggcgggggcccacctgtgcagtctccgggaacagacgctcagcagactggagaggagctccttcttacctgtgacaatcccattcttcattcaagcccccactaaatttcaggccacacttcatgttcacctcctgccaattctggagaacagtcccctggaaaaaaaacttttgggaaactccaggccctgtgtgaaaacactttggggtcctatatctatgtcatgtggaactgtgataccttccaaaaatattttgttcccagtacagtccagttagcacaccaggctaggagcttccacagccagtcccaacatggctctctggggtgagtgttggatacggttcacaaaattcctgcagcaaggaatctcacttcttgctttctttactttttctactgggaatgtttgcaaaatgcaactgtgggagggacctgctttggatgatacaggattctcctccacagatcctctatgaagtcttaagttataaaaccaccaataggattccatgacccagtggaagtccccagacaccatctgtattcctaggagcctgaatctccaaggctatggggcaggtgctgcaggacccagaaatgcttactcctgaggagtcacaatataatgtttactctaaggcgtcaggccagacacagagacttctatgccaaaaacctcaggtggctagatgactgaattagctgcttttccagttaaccttgcatggctgcataacagcccactctaaaacgtagtgatgtaaggctacaatcatttgattatactcaaaactttgtgattcggaaattctggcagaactcagtggaggcggctcacctctactccatgataactggggccacagatggggtcacaggtagggtggctggcatggctcacgtggctgaggtggctcatctggtgctttggttctgattgttgtctgggtccatcacttccagtctatgtcacatctgctggagctggaatgtcaaagataacttcttccatcatttgtcctgtgcaatgctgaaccagctggggctgttgtgcctctctctctctctctttttctctctctctctctctctctctttctcttcctttctctctttctctctctcactctcatttctccctctcactcttatttctccctctctctttttacaagtctctctacaaggctggcttgggcttcctcacaatatgtcggtctcactcctcagggattagcaggtgtgtcttcacagcaaaaccattcttagccaattttcctgagagatggcagccagcacatcgctgagaaaactgggagaccttagagttggcagttcccacttgggagatgtgcagaggaaacaagacgtatggagagggcctactgtctacatggcgtgtggtggcacctgagtgaggggcaacagggctgacatgcccaggaagcttccaatcccagacacctcctggccagcccacacctctgcccccctactgcccagataaagtccaaacatcaacatgcaatggcagggcatgccttctgctttatgcctgggaagcctccttctctgggtccccagacagaacagaccctccactcttctgggcctctatgccaagcgccctgctgtgccactggacagtaaagccacctgcaccacaccaccaggagccacagccagaactgtgcttcaagcccaagtcaacaaagaaactagcagataccctgtgctgggagagggagtggccaggagcacctggagctggtctctgtccctcagccaccaccaaatatcactgaagtctctcaccatctgcacggggtcagggagctttctgaaataccaatctaaacacgagtcccttctgctcacgctgcagagcccaatatttaagaaccccacagtcgccttgatccacatgcactgcccattgcccccgactgtgcccctgcttctgctgttaggggcccccacaccctgcagtgcctggcccctccatctgcacaggtctattcctgctgctttcctagtccactctaccttcatcgttattcatcttccctgatagtcccacgagtggcccctcctgtctggccccagagctcctgggtgagtccctcgtccagcttgggttactgccctcgctgaatgcacttttctcagtccacatcacatctctcctgctggactaagcataccacagccatgagcccagtgcctggcccaaccggtaaccacagaagaccaggtgggcctcggagaagcggccaggagccgccccccaaggagggtgggcctgccgctcccagcagagctgcctgaacattgagaccagaggcaaacagagcaggggacagaggagggactcggtgcgagtccgtgttgtttcaacctggcatgctctgcatccaggaacacgaaccccaaaagtgggaggactgagcagaaagcggtgacccgttggcctggatatcaaagggctttacagcctcccatgagcgccccactgatcctcttccgccttgggtaaattgaggagccatactcctggctccccacactctcctcctcccgccaggtggcattcctcagtctcggcaggcagaatcctgctggctatggttggagggagcttgtgggagtgacctcacgccccttagtacaaagtggctgactggacactggcaaagctgccagggccaagttgggggaaggagtcacctctttgcattgatcacctgacatctatcaggcactaagccgtgcatttcagactccaatccaagcaattttctccaatccaagcaatgactgtgagttgtaacttattctgccccttccacagatgagaaaacacagcttggatgagttaagtacttgccacttgtatgtaataacacacagaactgggatttccatccggctctcatttctctgttgccattttttttatgcaaaccagcactctctctacagtgttcctcaaatgcccctctgaccgctgaccctctgtttgtctaaagagtgcaaaacaaaaggcatcaaaatagctctccacatgccaaacaggtgcaggtcagggaagaagctgagttcccaagaccctttcctgccatctgctggtcgtctgccacaagccccctgcaaattggccaacatgacgtgtcacgtaagtggagcccatgcctgtcctacagagtgctcaatgcaggcatcagcctggagtcgaacaccccttcccaggcccagggcaggaagcacttcttccccagccagtgattcactgagcacccatgacacgcttggtatcagttagctcactacggtcctcatgaccactgtgtgcaggagataatgaggaaactgagactcagagagattgggtgactatgctatgaactagaaaatgaaagactgaaactcaggatctgacctgggcctccatccgtggttggttggttggtttgacttacattacttacattctgtgtgcctcagtttcctctatgtaaagtggggataacaagagtaccttctcataggactgctgcaatgattaaacaagcaaatgaatgctgggtgctgataataggacatggcgaaaaccaaataaatggccatttgcctgcacatcacacatatactcacatacactcacatattcacacgtgcacattcacacacatacacacacacttacacacacactcacacacatatatgcacatatatactcacactcacatattcacacatgcacattcacacacatacactcacacacacacactcacacacatccacatatataatcacactcacattcacacatacattcacacatgaacttacatacacacccacatacacacatacatacactcacacactcacatatatactcacatatacacatacactcacacactcacacatgtacacacacacatacactcacacatacatgcactcacaagcctacacacacacacgtgtccacacatgcacgcacgcaggctggaaagcagtgggtagcaggaaaccgcgcaccacctagagctggctgcctccacctggtctctaggccctcactgtccagcatgtatccttgagtgaactacacaggccactgagcctcactgtcctcctctgtaaaatggagagagtgggactcctgtgccacaggcctgctggaagggccgggacgtgtgcaacatggtgtggaagctctgaagtgctctgtaagttttgactcttcagttaggctgacactgcagggggatgtggcccactagcatcatctgtcctcgccccaggtgagccagcagggcagctggaacctggagagagtgggagactcggtgtccgcctcctgtgaaccaagggactggtggcacgttaatgtgggcagtcgcccatgaagcacagcggagccccagagccctccatccattgctcagaaaacataaccgcctcttctcacctgcctagatccaagtgctctgtcccctttccccggccccatatctccatgatcgcccctcccaccccccacccccagaatcgagggatggagtgctggtagcttcagtgcaaggctcttccctgctctctagaagaggcatttcagcattggacgaagggcccccttcagcttgagacaccaggcgatggaagcccacacaatgtctctgccagggaagaggaagcaccagaagccaggaagcagcgccacgagcagcagggaggagaggccacccccaggcagccagggatgacagcccagcccaccatctttgactgggaggaagagaggatgaagccacccttcagcacacagcaggggcatcatcagagcccagagagaaacagggtcagcattgtaatcagttagggacagaaagacttctagtcagcaggccgatgcactgcccctgcaatgtttctattggggactccaaaggtccgtgctgtgctggttgtgggaagccatgggagccagcaaatccttgtgaggagagcacccagagacagcaagtctggaaaggcaggtccgagatgaaattcacctatgacagatgaaagttcagcactaactgccaagaaaggggaggaggagagctgaggttgagcaacattttcttgtcagagaaaaaccccaggagtttaatcagcactgggtccaaagcaatgagcaatgagtgtgacctgccgccacccctcagcaagcaagaccaaggccacacaacagcaaccagtgacccaagcaagagaacagggctggggcaggacccatccacggccaagcactgaagccagacacacagcacacactggggtgggccccagcacatgacagagaacagctgtgaatcaaggggctggtgccacattagtgtgggcagttgctgggggcactaagggtggctgctctggggaagcttaatcagaagacctctgggcttctgcctggagttccagggagcaatccaggaggcttcctgctctcttgcaccttgctagtcacagctgcctgtatcatgaagagaagaacctaccttggctgtcagtccccaggaagaagactcactccacagccaaggtaccctcaacagggcagtgctgtggtgtagagcaccaggcccactcttccttcttctcttgccccttagtgttgatcggcgtgggcactgagaccttcctccagggccagttcaaaagcctggctttctatctgctgtgagtatgtgtgcatgtgccacttttgacctgcaagttctgctcaactcaccctacatctgtctactcagaataactcagagcagtccccttcccatgtgaattccatcctatctcaggggtgaagggagttgaggggggctctagaatagctcctggtttgtgcagaccatcccataaatcaatgaattatcctttctacccacccaaccatccaccaattgatccagccagccacccatctatccatccatctgcccatccattcgtcagcccacccatccatccactcacccaccaatctattcatgcaccaatccactcatccatctatccatctatccatccatccacacatccatccagctacctatccatctacccacccacctcttcatccacctgcccatccatccatctattcatccatctacctatccacttgcctatccatctattcacccacccatctatttatccatccacccacccatccatccatctgcccatatatgcatacatacatacacacacccattcacccatccacccacccatttatccatccatcttccaattcatccagccagccactcatctatccatccacctgcttatccatccatctatgcacctacacatccatccatccatccaactacccatacacccaaccatccatccatccacccacctatccatttattcacccatccatctattcatccattcactcacccatccatccatacacccacccatctatctatctacccatctatctatctattcatttacccatccatacatctatccatccatccatccacccacctatccatccatccatccatccacctactcatccatacacccacccatccacgcatctcatcaatcatttatttattcagcaaatattaattgagctcttgtttagagaatggggaatcaggtcaaagaaatatatatttgagcttctctacatgccaaatacagttaaatgtcttaattgcattatgttatttaactttcacagcactgtaggagaagggcatattggcctagttttacagatgagaaaattcagaaggagtaagcaggttagcccacatcaccaagctcatgagcagcaggatccagattcaaacccaagaccctttttttccccagacaatgtcttttcttctccactaccagctacctctgtaagtgtgtcctggcaggaaggtgatccctgtgcagtggtgtcccaggggattagaagaacctgggtctctgccccagcatctctgcagccccatcctgaggggcttctagcagtttcttccaaatgatataggaaggctgtgtgttctagccccccaaatcctgaagagcttactgaactgagaagcaacagataacaatttgccaggctgccccacaaatgtcctgttctgcctacagggtccaccaggctgtgacctccactcccccccctcctcaggatccacctctaccttcaggtggcagctgacctgtgcttttagcagcctccaccctcccgcctcagggcaggcctcttgctgtgtttgggggctcacacctgccatctcccagatgcggttcagcctctgagcccatttccacactgccatctagacacacagatctctctgacaaccttcaagagcttccaccacctctggtccacaccctgtgccatattctggcctctgcctcacttcttgccactcatgtacagcaggaggcttctgactctttttcaaactcaccagcatggcctcgcctccaagcttcactcattctgttgggtgcccaagcaccgtccacccatttccacctgcccaatgcctgacactccttcctggcattctgccctggcaattgtgccctgagcctggagcccctgctggctggcagtgacttctcctggttctgaacaccctccgtgtctaactgaccatgtccctagccgctgtgcaccattgccctgggatccagaagcaggcgggccttcctcctctccagtgggtccctaactctcgggtcaggccatggcaggtgaatgcaggctgccttctgcccagaaccctgttttgtctctgttttgaggggaccctatgcccatgtggtctctgggtggtccagtccagcctggggtcccctgccccttgctgtgccctgttctctaacacctgcaggatcagcactcagtacctgccctgtctgtccctccctgccactcaatagcaccagacaggaagtctgaatgagtcgctttattccccaagccttgatatacccctctgtcccagggcatagaaaaaggcagtggcaattattttgcaaaacacgtcttgatgtgcctgttaggcacacaagctctggagcctgcgtgctaggttctgatcttccccctgctactgataaggggccattggtgatggggcaaacctctctgtgccttagtttcctcatcggtaaactgacagtaattatagtgtttattataatataatatagtacttattataaaattgttgcaaggactaaatgagttgatatttgtaaggcctttagaattatgcctggcccatagcaatcattacataaatgttagttattatcattttaaaaccaaggggtaagagttaggctcacactgggaggcatagagactgagaggagtggagatcactaaatgatctaactaatcacagggagagagaaatgataactagaattgatataatcactgtgtgccaagcatggtcctaagtgctttacaaatatcatttaattcttagaacagttttactgttgatgcactataataaccccagtttacagctgaggaaactaagacagagaaaggtcacacctctcacctgtgatcacacaatctagaaacacccatggctctgaggaaaccctgaccccaagccaccttctgcacaacactatccactttcattccttcatttattgcaatgctcattaatggagcccaataagcccgacccactgtgagcctgggctgtacagaagaattagacagggaacgccctctgggggttcacagactagtgactctggtcatatggtaccacatggagaagtaagaggaggtcaccagacagactggagagggaaggggaaggccttccaggaaaagctcacttgtgcaaaagccctgtggcacctgatagcttcttgtgttgtcaagggaacatggaggataggcagtgagaccctccgtaagtacatattccatttccaaggattctgatgtgagtctaggggtggcctgggagccatgaattctacacattcctcaggagatgctgattgcaggatccatggaccacactgggagcacaaggagcctttgaggcatcctgtatcaggaggaacatgatcagattcaggtgtcaggcagcccagagtgacacagtgggggagcaggagacaggcctggggtaagtgaggaagtggaactggtgcaggggtccagggggcagggcctgaacccaggcaatgcccatgaggtcagagaacaggagcgatttggaaggtattgaaggaatgtaatcaacagctcctggtgactatttggataataggaaaaggaagaaggaaagggtcaggaacaggtccaggtttaaggctggaacacaggcagtgggtgtccatcctggtgaccagcaggtagaaggatgtgcctgccagtgtcacacagggtgccaggtgaaggccatgtcacctgctggccacggtgccctccccacccatctctgaaccccagaccccacctctccccagcatggcccagtccggaacacgccatgtcctggagacagcccgtggtgaatgttgtctgggggaatccaggtgagtccattggctgtagatgtgatgtcaggaggccacgtgtgagaagacagccctcaggaaagcaaaggaagacagaggcgccagcctccctcacctgtctccacctgcaggtttacaggagccgctgtctccatatgtgaaggggcctactttgtggctcagctgctggccatctgcttccagtaagtagtttccagagagacccctccattgtccaccccagccccagacaccacagatgtctccacccaagagcccacaaccaggggatgtcctgctcctgaagccactgtggacaggagccccccaccgaggtacaatcagcctggcctggaggtgggcacaggcccaaggggctccattgccttctttgccctggtcccaaccaagagaaccaactgacacagtcattcagggcctgtccttgcccagaatccccagaaaagtccagctccccctcaccaggagcagccagtcactgggccccagtgtctgagccatctgccatggggtgaggaccctgcagaaggcccagctgggagtgagcagacctgggtttgggaactggctctgtctcttcctagggcccgggggcaagtcaggggcagtatgtctctacaccccttcgtggggcaggagtgcagaccctgcaggatctcgtgaggcccttgctgcttcccagcctacactcagtatgtggaagctgttatcggtgagaccgaggactgcggctctcagaacctagacactggtccctgggtggtcagtgagagagccagtcttcagatccagatgtcccagcaccttgcaaggccactggctgcctctcaggctcaccagccctaaggcagaaagctttcccctttctgctgaattccactgccaagctgtgcttgaaacttcagctggggagaaggctggggaggaatggaccctggatggactccaccgcaccctgccaccacacacacgcaggaatgggcaccagggggcaccagtgagccatggcagtccagcctgcgagcataagagagcagtgctttgggccacctggacagcctgagcactccctcaaagctagaggggcaggatgtggctgtgtagagccccagctctaggccaattcagaggatggaggcgctgggtctaaaggcaggcacttgccccctgtgaaacatggaggcagcgcccctgaaggaagctgctcagcatcaggcttctgccagggctatgtgtggtccctgtgtatacagttagaaaagaagcccttctgggccaacactgtactgtgcctaagcaaggctgggtgaacagggcacagctgggtgccagcctgctcactcacctggccaagcctcttatgcagtgcactacaagcacaactgtcccaggcaggtggctcccaaactgcacactttctctgcattagtgcagacttcccagtgagccctgagcctccagctgtcttcctcactaactcatgcagcatcctgagaacatttaacttgcttccccttcgaccagaaaaacaggtctgggcagcctttcaaaaacttgtggaccctctagagggactcaggcaaatccactcattgtggaacccacaccaaggaccgctagggctttctgttcagccagggcccactgcagagcatgcccacagcagggcctggcccagactccatggcatccagtcttgctggggttttcctgggacacattatgctaacctggactccctctccccaggtgtcaaccagggtccctggcagacagagtaagggagaaagcccactggctgggctgcttccagaagttcctggcctacctgctgctgtcggtggcctgcttcctccacccggtcctggtctggcacgtgaccatcccaggtaagagcacaggggtagagatatgcagccccagcacaggtggactctgagcaggaggagctgagcccctcaaagtctagctccagtggtggctccagggaccttacctgccccactgccctctctgacctagagggtggacatgaggaatcatcggaatgccagacatactccatgctgatcaaatggcaggaatgtcccaagaagtgcatccttccttcacagagccgtacagaagtggaaccgcaaaggggacctcacctttcctcccactgaccatgtgtggtctgagcttcccaagggtgtgacatggccacttccctgcccaaacccttctgaatctccccagtgcctactcattcaggtccaaactcctcagcctggtttgaaaggcacttcagggtgggaccccagaaaatcttcacagcctcatctcctacttccacttcacgggtgcataccactggccagctggtttctggtcagagaacccaggatttcttgctcccaccttttcagtttcatccacgaccttttctgctagtgtccttctcctctctgctccctatctgtgaaaactgtgccccctcctcatgaacccatctacaatacagggaagacagccctccagggagaccatgttgaaaagcagagcctccatccttcctgccatttagcatccccatcccagcctccaagtggacccccaaatctgatgtggggtgtgaggacaagccaggcaagagggccagggccacaggggcctgtgaatggccacacagcgccgggttgcaggagctctgctgcacgacatgcttgcaaggactccggattttttccgtgactcctctagagccctgacctctggctcttttccaggctccatgctcatcatcaccggcctggcctacttccttctgagcaagcggaagaagaggaaagctgcccccgaggtgctggcctccccagagcagtacacagacccctctagcagcgctgtgagcaccaccggctctggggacacagagcaaacctacactttccatggggccctcaaggaggggcccagctcccttttcatccacatgaagagtatcctgaaggggactaagaagcccagtgccctccagccccccaacaccctgatggagctgagcctggagccagccgactccctggccaagaagaagcaggtgcactttgaagacaacttggtccgcatagtcccctccctcgccgaaggtctggatgatggggacagtgagccagaggagaccacctctgacacgacacccatcattccccctccccaggccccactcttcctgtcatctcttacagccaccggcctgttctgagcgcttgctccagcctggaggacgctcagtgaggggtctacctagctcaatggccctccctggagtttcagggtcttctctggtcagcttttcaaggggtaaccagacacccccacactggctgggcccctgaggccatcaggaggtgtgactggccagcatttctggagaggcctcgagggaggcacaaacaaggctcacgccacctcaagccagcacaagctccttcctcctggccacaggtggggaaacccttatgcttccccaacaagaccatcactgccactgcgcacgaggctgcaggtgccattgactcagcccagaagggacagaggatgtctgcccagcaaaagcctctgggcttttcttactcccaacccagggcacaacactcagtgaggaacctatggtccacccatctctgcaggcccagggaagtgtcagtaacttaagcatctctaaggcagagaaggtggctgtgggtcttgaccaaccaagactgctcagggtcgggaggggaggctgcaggcctctggtgggagcagccgggccgtgggccacattctctgcatgctctagggctggggctgagctgctcaggaaaacaatgccgctctgtgctcactgtgggaaagccaggccagatgagcaaagctcattccagaaacatggctggggacttccagcctccttaccacatggcctttccaagattccaggttgatgatgcaaactgaacgcagtgaatgccagggcccagaaggcaatgtctgctgtgggcaggaccacagaggctgcccaggggtggcacagcacagagaagtgtcagtgccgtgtttaggcacttggtagcagaataggtgataaatataaatgtcttcaaaatgaaaggaagtgaggggggaagaagaggagggaaaatgggaggataggaggaagtgggcaggcaggcaagttctctgccatggggccacggaagtgacagttaacccagaaggaacaaagacatctgaatcagatattcctttgtaaatctgtaaaggatttgcaatataggctttacttctaaaaattgttgtcgggtccatgaggctgttgccaggaagagcacacacaccattcttcatggcaactgcagtgagggagcagtcaggaggaagagtcctgtggcttctcagtccctgtggaggctaacgcaaagctctgtagaacaagccttagagtgcatgctctatggtctaatgagaaacttgtgtttgtgcttgcacacgtttcaatgttccctacaggatattttacaaaggtatgaaaataatggccaaccagaagctagtatcagtttggggcctaaatgcagcaggtgttcctgataagcagataagcagagctcttcctgcagtagcccaggtctcaccaaatgacaaatggctaatcaagacactcctgcaagcccttgatggtgagagctgcagagctgtttcttcagctgccatcaaggcaggacctcaggacctgactgtctacagtcagggaatagtgaacaatatgggatatgggtataggtaggtggtagacaaggatcgtgccccatggctgatgggccgggtgtctcaggcaggccccctgtgcacagaaagagcctaagtgcagagaagccaggcatctttcccctgtcaactgtggaaggggaatgtgatggccacagacaccctcatggcacagacatggccagcctctgacgttcctctgcatcagagtagttctgtcctcgaagccccagtcagcagagctggatgaccagatcgcaagaagcaaaccagaaagtgtgatggcagagatgtcagatcccgtttaataaacacttcagtaaacccaagtgtggagtgttgttttgggtgtgttttagagatgtgtgttgggagcacccttttggaggtgtcttagtgtgtgccgggagttccagtgatgatgcgatggaattctgaggcacataggcttcctggagattgtcatcagttaagagagtgtctgctggtgtgcagcattacaggacaattatgatcttacctaggttagtaaagttctcaaacactcttatggctacaaaacaaaaacaaaaagctggagtgagatcattaaataggccagaattctcacccatcagtggaccaagcaagaaagtggcatcttcctcataagcagatgagcaccacgtgtctccattgattctcagcctgtgacctctatgaccacatccttgtccagaagaatccctgcaaagcagatgttgtaatgatctgcatccttgccaagaagcaaagactagaaggactggccctgccatgatccccctccctacctcagcagagaggggagcattttgtatatgaagaacagagtgacaggaagaagaaagagcaccaggctgagcaccattcgacctccactaatacacgtctgaccttgttcaagccccttcgcatctctggctcaggttcccctattaagtgcaaatcacagcagtaactcaacaagacatgggcaagtgcttttcagaactacaaacaagtcactgtgattgcactacatccctatccctacgggggactcgccgtgagggggcactgaggaagcaccaccctgacttgcgtctgtggcaaggccagttcaggtccaagagctcctgtctccactccaggttccagggctagagcctggggagggtacagcccccaatgcctacctcagaggaaagtcatagtggaccccacatttcctagcagctgcaccctgggggtcacaccgtgggtcctctgtctccctctcccatcagccctaaggtggttttttgttgttagttttctgaaatatctttattgagatataattcatataacataaaattcaccaatttaaagtgtacagctaggccaggcacagtggctcatgcctgtaatccaagcactttgggagtccaaggcgagtggatcacttgagcccaggaatttgagaccagcctgggcaacatagcaaaaccctgttcctaccaaaagtacaaaaaattagccaggcatggtggcacacacgtatagttccagctactcaagaggcaaagatggaagaatggtttgagcccaggaggtcaaggctgcagtgagctgagatcattccactgcactccagcctgggcaactgagtgagaccctgtctcaaaataatctttaaaaaatttttaaattaaaaaaaagtgtacagctaaacagtttctagtagattttttttttttaatacatggagtctccttttgtcaccaggctggagtgcagtggtgtgatcttggctcactgcatcctctgcccccagggttcaagcgatgctcctgcctcagcctcctgagtagctgggactacaggcgtgcaccaccatgcccagccatttttgtatttttagtagagacaggtttcactatctcggccaggatggccttgatctcttgacttcatgatccacctgcctcagcctcccaaagtgctgggattataggcgtgagccaccatgccaggcctctagtagattctcaaactatgttcatcacaatgtaaattcacaacattttcatcatcccccaaagcaaacacaacctagcacccgttcgcactcactccctacctcccatcacctgccctaagcaaccactaatctactttctgtcgtataaattgaatcatataatactggtttttttgtgactttgttcacttagcgtgatatttctgaggttcatccatgtcgtagcatgtatctttattttatttcttctcatggctgaataatactccattgtatggatatactaccttctgtttatccgttcgtctgttaacggacactggggttgttcccactttgtccctataaagaataacgctgctatgaacactcgcgtacatgtttttgcatgaacatctgctttcatttctcttgggtataaatctaggagtggaattgctgagtcatatggtaactctgtgtttaacttcttgaggaaatgccaaactgttttctagaggggctgcgccattttactttcccaccagcagtgtatgagggttctgatttctccacctccttgccaatacttgtcattgtctttttttattatagtcatacatgcactgtggctttgtagttccttaatgaccaatggtgttgagcttctttcatgtaattactggcctttgaatatcttttttaagaagtgtctactcaaatgctttgcctgttttttaattgggttattatttgtctttgtattttgagttgtaagagtttttaatgtactctgaatactataccctttcagatatatgattggcaaatattttcatccattctgtaggttgtctttttaatttcttttttttttttttttttttttgagactgggtctcactctgtcacccagactggagtgcagtggtgcgatctcagctcactgcaacctccacctcccaggctcaagtgattctcctgcctcatcctcccgattagctgggattataggcgcatgccactactgcctggttatttttgtgtttttagtagagatggggtttcaccatgttggccaggctggtcttgaactcctgacttcaaatgatccacccccttcgacctcccaaagtgctgagattacaggcgtgagccactgcgccggctttttttactttcttgatagtgtcctttgaggaagaaacaatttaatttcagtgaaattcaatttttctttttttctttgttgtttattcttttgtggtcaaatctgagaaactattgcctaaccaaaggttatgaagatttatttctatattttcttctaagacttttatagttttagttcttacatttagatctatgatcaattttgagataattattgtatgtggtatgaaatggaatctaacttaattattttacatgtgaatatacaattgttacagcactatttgttgacttgaactgtctcgacctctttgttaaacattaatagactgtaaatgaaagggtttatttctgaacttgcaactccagcctgttgatctgtatgtctatcctgatgccattgccacaccatgtattactgtagctttgtggtaagtttcgaaaccaggaagtctgagccccctccaagtttgttcttatttttcaaaacagttttggctattcagggtcccttgcacttctacatgaattttaggatcagcttgtcaacttctgcaaaatagaaagctgggattttcatagggatttctctgactctgtagataaatttggggagtattccattccatctgaacaatattaaatcttctgatccatgaatgtggggtgtccttccatgtatttagatctttaattttttcaacgttttgtagtttccaatgtgcaagtctcacacttcttttcttaaaattattcctaagtattttcttcttttccttgcttttgtgattgggattgttttcttaatttcattttcagatgctagaatgtagaaatatgattggttttgtacatggattttgcattttgcaaacttgctaaacaaatttattagttacagtctttttgttttgtattttgtttttgagacagggtctttatctgttgcccaggctgagtgcagtggcacaatcacggctcactactgcctggagctcccaggctcaaacaatcctcctaccttagcctgaaaagtagctgggactataggtgcacaccaccacacctaatttgttacttttgatagagacagggactcactatgttacccaggctgatctcaaactcctggactcaagcagtcctcctgcctcagcctcccaaagtgccaggattacaggagtgagccaccgtgcaggattatacaatctttttttaatggatacattgttattatctacatacaatatcatgtcatctgcaaatatagaaagttttacttcttccaatttggaagtcttttctttttcttgcctaatttctctagctagaacatctagtacaatgttgaatagaagcaacaagagccaacattcttgtcttgctcctgatggttggggaaagtatttcgtctttcaccactgagtaccatgttcctggtggatttttcacagatgccctgtgtgagattgaggacatttccttctacttccagtttgttgagtgtttttatcatgaaatggtactagatttttcgcatggtctttctgcatctattgaattgattatgtggtttttgtcctttattgataaggttcattacattaattaactttcagatatttaatcaaccttgtattcatgtaatgcatcccacttgctcatggtatgtaatccttttacatggtgctgggttatattttatatgttgatatattttgttgaggatttttgtgtttctctatataaggaatactggtctgtagtttctattcttgtgatgtctttgtcttattttggaatcagggcaatactgctctcataaaatcaagaagtgtccccttctattttttgagagtttgtgagagactgatatcgattttttgttgtattttggtagaattcaccggtgaggccatttgggccttggcctaattcaaactcttcacttgatatagagcttcagattttttgaaaatttcacctttgaatcggtttctatagtttgtgtcttcctagagttttgtccattttatctaagttatctaatttgttggcatagtattcctttgtaatctctcttatttccataaaatcgataattatgccccctctttttattccccattttagtaatttaagccttctcttttttcttggtcaatctagctaaaattttgtccattttctcaatattttcaaagaaaccacttgcttttattgattttctgttttgttgttacagtctgtatttcattatttcttttctaatatttattttttcctttcttctgcttactttgcacttagtttactcttatttttctagtttcttgaggtggaaagtagggttattggtatgaaatatgtttgggttttgtttggttttgttttttgttttggtttttttttgagatggagtttcactcttgttgcccagactagagtgcaatggcgcgacctcagttcattgcaatctctgcctcccaggttcaagcaattctcctgcctcagcctcctgagtagctgggattacaggtgtgtgccaccacacccagctaatttttattattagtagagacagggtttcaccatgttggccaggctggtctcaaactcctgactgtggtgatccacctgctttggcctcccaaagtgctggaattacaggcgtgagccaccgtgtctggccatgtatttgttaatatagacatttacagctataaatttcagagcactgctgtgactgcatttcatatgttttggtatatgctgtgtttttgttttcattcatctcaaagtattttctagtttaccttgtgacttcttcttttgatctgttggttatttatgagtgtgttatttaatttatacctattctaactcaattccattgtggttggcaaacccatttggtatgatttcaattcctttaaatgcattggatttgtattatggcctaccatactgtctaacttgaagggtattctacatgatcttaagtagaatgtgtgttctcctgttgttggatggtgtgctttgtggaggtctgttaagtctaagtggtttgtattgttgttcaagtcttctctatccttgttgatcatctgattcattccactcattactcaaagtggggcattgaagtctttattattactaatgtgtctgtttgtcccttcagttctgttaggttttgcttaatgtgttcaaggctctaatgttagatgcatgtaagccagtaattttatatcttcttacgcactgactttttattattatggaatgtctctctttatctttagtaacttttttgttttaaagtcaattttgtctgatattactgtagctactccagatctcttatgattgctatttgcccagggaatagttttcatcttttactttcaacctgtttgtgtctttgaaactaaagtgtgtatcaggttttcatcttttactttcaacctgtttgtgtctttgaaactaaagtgtgtatcctgtagacaacatagagttaaatcttgttttgttatccaatagagtaaccaccaccttttgatctgatcattgaattcatttacattttatgttattgatatgataggatttatatatctcattttgcttttttatattgatacacaatattttacatatttatgggatacatgagagtatttgttacatgcatagaacgtataatcatcaagtcagtgtacttgggttatccatcgccttaggtatttatcatttctatatgttgggaacatttcaattcctctttgctagcaacattgaaatatacatcgctgctaattacagtcaccctactctgctgtcaaacattagaacgtatatatatatttatatatatatatattctgtctagctatatatgtgacctattcaccaacttctcttgattttctcctctactttacttctacttttctatatatcttgtatattttttgtttctgtgttccccttttactgctatcttttgtataaataaatattttctagtgcaaaaatttagttccttttataatttttaaaattatatttttagttattttcttggagattgctctagtgattataacacgtcttaacatatcaaaatctactttagatttatattaacttaattccattgaaatataaaaaccttactcctgtatagctccattctgtccccaattttctatagtactactaatatatattagatccataaatattacaaacccagtaacacattgttgtcattattactttttacaatcaagtcttataaagaagctgaaagaagaaaggagtatatatttttcacttcttatattaacctttttatttgccatttctagttctcttcatatccttctttgagttcaagttaccatctggtttcatttcatttctgcaatgtagttttgcttccacctgtctcctttgtgctgctattgtcattgcctgaagagctttctttagtatttcttattaggtggatatgtctgatagcaacaaactctttcaggttttgtttgcctgggaatatctttatttcacctttgtttctgaaagagttttgctagatatactattcttggtcaacagtttctgtttttgtttttactttcagcactctgattgtcttcacactgccttctggtctccattgtttttgatgaaaagtcagctgttattctcactggggtccccttatgtgtgctgagtcatttttctcttactgctttcaagattttctctttgtctttgtctttcaacatttttacgaaaatgtgtctgaatgtaggtctctgcatttattcttgaaattaattgagtttctttgatgttcatattaatgtttttcatctgacttgggaatttttcaaccattatttcttagaatatttattcttctccttttttctctcctctccttctaatacttccattatggatatgttggtgtgcttaatagtgtcccacattagtttgatgctgtgttcctttttcttcattctttttactgtcattgaggttgcataatctctgtcaacttatcttcaagtttgctaattctttcatctgctatctcaaatctactgttgagaagttttaatttcattattgtaattttcaaatctagaatttccatttggtctgttttaaaaataatttatatctcttttatttcataagatataatcatacttttatttcattctttaaatgtagtttcctttagttctttgaacatatttataacagctgctttgatgtctttatcagctaagttcaacatctgggccccctcaaaagttgtgtctattgcttgcaattttccctgtggatcacactctctcatttaaacattttagaacataattggtatcagttctggatactgattctccctcctttttcacctggtctcttgttattgtttgtttattcatttgtttgtttattgactggtatgggctaattctatgaagtcagtcactttttccccaatgtttggcttctgatgtccctgctccctgtccttatcttttagactggttacctcagaatttcttctgggtcagcataagccatttactggtcaaaagttgtggttaagaccccttaaccagtaagacacttacctcttaagtaagtatctaactaggggcataaggcttggaggcctctaccaaaattcaaagaggttacatttattcctacattcatctagggaccagtagcttggatgtttcttctctgatcacttctaagagggcacaatcttgagcctacaaaactgtgatctagactgcctgagatgtatgtgattttatttttttggcctagctttctaggagttgccccagtctagggtttggtcagagcatgtgcttaagcccctcgtgccagtgaggcatctatactttttttgtgtgtggatttgtgtgtaaattggggagtgttttcaagttgccccacattctgctctgattgctcctgagtgggtacagcctagtatttgcccaggcttcccaattcccagaattgactgtgatgccaagagggctcttgggatcttggctgtctcttttcccagttatttgttaaatttctgggtgtcctgcccttttgttttttgctaccagtttcacggagttacgagcacttttaattgctctccccaagctattcattgttttcaataacagtatgttgcacagaattatccacatcctgtcctgaacaaaatccttcctctcaggcagagctataagctcttcattcttactgtctgctttctccccgggtagaatgtctgcagcactgcacaggagctgggagtgggaactacctgcttccctgaagaggcacctctgctctacaagtaggtactaggggaacctctgctctacaagtaggttctaggggaagtggcccctggtattctcagcttgcccctttcagtgtgaaacctctgccctaggagtgagttagggtgagtaatcaaggctccagtattctcagtctgttgctcctgtaatagagcttctgctaaatgactcggtgctcagaagagaaagtaaacctaagttatcttggccgtgcctccctagaatagagcttctgcaacacagggccaagtgggatgagacacaccagcatcttgcccctcctggagtgaaattatagcctagactgagggctacagggagaggaagcccctgtgttcttgaccacacctgcccagagtaaagaccctagagcagagtttccataaggcagagctgagagagggtaggggagtgggtcatggttcaaatgccatggaccctccctcactgtttttaccaaaatttagtagattttattaaatgaatgtttctccatttgctgtgtgcccttaggacaatttccagagatttaaatgaattaatatttgtcattttctccagtaaaatagttgttttgctataaaacggggcatctgagctactgagtcctaaagtactgctcctaatttttacttttttaccatgaccatgaggaaatagagtgcactgatgagaactttgaccatcaagtacacaagacctaggcttgagccctatatctgcccttcaccagctgtgtgaccagctagtggaactcctctgagcctgtttctccatttgtaaagaagcaataatggattctggatattagccctttgtcagatgaatagattgcaaaaattttctcccattctgtagaattgaacaatgagaacacttggacacaggaaggggaacatcacataccagggcctattgtggggtggggggaggggggagggaaagcattaggagatatacctaatgtaaatgatgaggtaatgggtgcagcgtaccaacatggcacatgtatacatatgtaacaaacctgcacgttgtgcacatgtaccctagaacttaaagtataataatacaagaagaaaaaaaaaacagaaaaaaagcaataataatgtactgacatccacaaatggctaagaattaaatattatgatataagtgaagtattggcaggatcttcctggccccggaatgcttctttcctgggacattggtgcctacagctgctctggggccatttgctcccttcttgcaggaatgcagctctctctgcaggctggaagtcacgctcatcaagccctgtctgctgctgtcagctcagcctagagcccataccttgctgatggcatgtttgcctgagaaacaaacttcattcccttttcctggaattctaccccatctcactcctcaccaatctctcaaagagaacttatcctttggtatgtccaaatgggaaaatctcttgctccattccctgtgtgcccaagatttcaagctttctctgcaagctggtcagccatccagctgtcatctgtccctcaaagccccgggctcagctgctagcctgctgatgaacagtcagctgtttgactacctggaaaggggagcaaaagggtagtgttcttgggagataaagaggaactgtctctgttggccaaaatggggatttcccatgggacttgcttgactggctgaatggcttgttacggtccacagaagaaggaagaaccgagtcatgatctttgcacagaagagaagaggtatttcgagaagccaagttgcagttaagtggaatgttatgccctgagtttcccattatgacaagggtgagacagctgcatagaaagaatagcagcatccaggaagtcaggagtccaggagtatggtcccacttgactctgctgggatttggagtcttgggtcattccccacatgaaacccaagggataaggccatcccaaaaggtcctgccagctccaagcctcagggatgcccagctgtgcacattaccagggggcatttgcccaaacttaagagcaagcccaaggaaaatccagcactgagtctaaacatatgctgtgcaattctttttacagtatgagcttctggaaagcttgcatagtctcaggacagggatctggaggaaatggggagcatcagaaccacagaaggttgtactgggaataactggggcaggagcaaaagcccatccaagcagatgtttaccacctcattgatatggaagactctgtgagtttcaaatcaaatttccctttaaagagcagataaagagtaaagcaaatgggccatgcctttgattattcatttgtccctaaataggtgcttctacctgaggctgcacacgctccgccaggggtgaggatgccaccagcccactatagcttcagtttccagcttccaggaaactggatgaggtatttgcaggccccaagtcttgagttcctctttccacattgaaacatgttcctttcttttaaaccaacagcaccagcataaacttagagaataggttgctaagggcaaaagtcggtttaactcagcaaacatttactaagcacctactgtgtggaccaggcatcacacaaggtgctgggctgaaggagtgagtctggcatgctgtgtgctctctagacaagccaaatgtgtgactgacatgaggcagacatggcactacagtaaaatcacaaacagtatgctatgagagaggaagtcaggcagagggaagtctgggaaggtagatttgagttgagcttcggaagcagagctggaatcttatcatgcacatcattgtctatcttgggacaaaggaagcatggccaagtccatcagagtctgaagcaggtggatttattttccatatgtaacaaggcgtttgtgcagtaaaaagaatataaggcaagcaggcgtatcaacaacaatgatgataatcactgagagcactgagacctcagtggattcagtgctttgcctgctccatctcctctaatccccagagcctgtgaggccaggtcccttacagccccattctatagatgggaaaccacagtgcgtggtaatttgcacacagctaaaaacaggtagagcctgtattcattccaggctcagagcagagattcttaatgccatcaggaaactaaagtctgaggctggccacagacctcacctgcctgatggcctgggcctctctcctctcatcatctgaacaaggggggttttgaccaggtaacccctaaggttctgtttcactcagtttgggctgccataacaaataccatacactgggtggctcaaacaacaaacatttattcctcgaagttctggaggggaggctagaagtccaagatcagggtgccagcatggtcaggttctagggagggctggcttcctgggtcacagagagctgcctgtttgctatagtctcacgtggaggaaagaagtcatctctcttatgtctctgcttacagaagcactaatcctatgcaagagggttccatgcaaatgatccaatcaccctgcaaaggccctacctcctaacgccatcacactggggattagagcttctacatataaatttaggggaatacaattcagtccatagcaggttccctccagctaagtcacctgggatgctaagtgttcggggtggggtgtggcagtgcagatgaagaggaggaaaaagtggctcatcaatgtgggggataaaggaagcatgagaaaggggagcactagctcaggtggagaaggcaaatggagccactccccactttggttgtgactgctgctgactgctggaggcctagtgccctttgagttttctctgagtgactgataattcctgagcggagctgggccccagcagagcctgggagctgtgccaagctctccctccaggccccagccgtgccacctccaagaccagaacaagaaccctagcctcagcagggtctccccaacaccatgcagataaaaagtggccaagaaaatgtcaccttaaaactcaggaacacagcatggacatccaggcttctcctcagtttccttctaagggcccagggctcctgttattcctgcttgctgtgctctaatgcctgggacttacagagaaggctggcaaacagagtccagccagcacccagcctccaaaagcctcttgtgccctgagcccagagctcactgccacctccccgagcctccagcagcccatgggggcttttctggtctcaggcccagctgctgctctccccttcaccagagcattttcagttcccacttctctggcctgagtggccccctgtgctcctggccacactccttctctctctccccatctctaggtcctctcccagctgccccaagcctcactcctcatgcatggtgctctcccgaggagctgctctcccagacttccatctctccagcctgttccctctctccctcttgagacccagctcacacattgcaggccgtgatctcgcccctggaatagaccccctcagctgctgggactctgcagggttgtggcaggcattgcacggcttctcccaggggatactattgaccccgttttctgatggagcttgaattgtcctggctcatgtaccttcctccccttggccagccatgtcctgcattgggttagtcacagtggtccacccttcccaaggtgcctgcaccctagtcgtggccaatgggaagaaagggaaggtgactgggaagcttctgggaaaggtttccttccctcagtactaaaaggatccccaggtgaggcgccatggctcacacctgtaaatccagcactttgggaggccaagacgggaggattgcctgagcccaggagtttgagaccagcctggacaacaaagtgagaccccgtttctacaaaaaattagtcaggtgtggtggcatgtacctgtgatcctaactacttaggaggctgaggtgggaggatcacctgatcctgggaggtcaaggctgcagtgagttgtgatcgtgccactcactccagcctgggaaacagagtgagaccctgtctcaaaaaataaaaaaataaacggagcctcattggaacactcttcctcttcttcccctgaatgtcggcatgtctgagggaaagcacagaaatcatttgcaaatatcaaggagaattaaaccaatatgctgaagatggcaatgagcaaagaacgaacgaacttgggtccttcaagattactttgagacactgaataaaccaagtctggagctacccattgctggggatttttattacgtgaggtcataaaatccccattgtttgggttttttactcctcacaactaaaagcatcccagcccagagtgtcacttatccacgcccttcaccatgtttggcggggagaaaatatccctgccaaagggagataccatataaactcttcttcacctatggcccaaatcaggccctctgcttatttttgtaaatagtgttttattggaacacagccacactcattcacttacatattgcctatggttgcttttgcttgagcagttgcaagagagatagtgcagcctgcaaataggaaaatattcattatctggccctttacagaaaatgtttgccaatccctaaggtcgactcattagaccaatggagcagcaaaaatttctcaaaaattgccacaggttgcacaggtagatgaaatcccaggaaaaagaggcaccgttacatgctaaggaaccttggaatgccctggcatcaggccacactctgctacagagtctgtcctgataaaacatgagtacgagctgtgggtcaaactctccatgcttactggttgtgatggttaattctaggtgtccacttggttagcctattgtgtgtctgatcgaacatcagtctcgatgttgctgtgaaggtattttttcagatgacacatacatataaatcagcagactttgagtaatgaagacttccctttgtaatgtgggtgggcttcatccaatcaactaaaggctttaagagcaaagattgaagtgccctgaaaaagaagcgattgtgcctcaagactgcaacatggaaaccctgattcagtttccaccttgctggcctgcagatttcagactcaacactgtaacatcaacttacctgaatttctagcctgctggggtcagcccggcagattttgaacttggcagcccacaattacatgagccaaatattccttataatctatctatctagctgtatagtgaactacctagctagctacacccatgtctttcttgacctcaatgggagatatatgtaaatatatatactgtttctctggaataaccctgattaatacactaatcattctaattctgtctcagttgtaaggtcgacagcttattcattattttgagagcattcattttcaaggtaaaaagacagagatgatccccaaatgagacaaaacttaagacaatttgcaattacatggctctatcctttcttaaacactagtccttagttcacagttaggaggactgggaaggcagcttgggcatgggcagcccccatcaaacgggaggctgaacagaggtggctttgatggcaggctgggaggtgaggtcaactcaactgaagcatctttaaacacagggttaacaggtcaagtctagctagctgtggggcagtttggcccttcccccttggggaatgttttacattccttggaagctgcatacttaaaagagatagacaggacagagcttccctccaggacatgggagtagccacattgtctggctggtgggttttcccagaataccctgaggatggtgtgttttaaaatgtgcagtccaggagctggacagatcgcccttgtttgtgcatatgtgctgtgccctctcaaggttcctttccttttccatctgggaggtctccacttcctttggctgtttcacatcctggcttgagggaaggtcctgatcacttactagttcacagctttgcatctcagttatatctcaccattcataagaattctggagcccaagctgcaacaccaggctctttgtggaggaaaatccatttttaagacattctcctttgagaagcgccgtccttctgtaaaccctcctacactgaactgttttgtgcctactttccttttacagtgctgctgtttgttaaatgatcaaaatattgaccaacataaagctgctttctgatgttaaaattagagttatattgaaaatgcagtttgttcaggagtcttgcatcaccgtaattatttttgtcttatttttaagatgttatcaactcacagcagttacaacgcccattaataataatcagcttaccaggagccccacactctctgtgccccacaggagaacagcccaaggcaaaggtagaagggtggtgaagtgtggatgggtggggaggtgacacagtcctggggaggcaggggcagcctaggaaagtggagagatgtccttttccagcctttgttctgttggataaatctatatctatatctagatagatagatggatggatagatagatagatagatagatagatagatagataaataatttccagtagcaggaagatagggaggtgaggacaaagggaaaaagctatcaacaaaccaggcctagttatgttctctgcatgtgggctttcagaccatccttgtcctcacagatgtgtttggagtagacatgtgttagatagcttacccttttctcagagaccaagtagagaccaagtgcttgagccaagtacttattttttcctcaaaagcaagtttcagcagcaatttttaactataccatcttttaaagcaagctccccccatcctaggaaactctgtgctcaggcacttattagttctgcagggtggcatgcaaaggcttttctaaagcataatcataatggaaaaataatacataaaatctgtgcacttgtgtgtgtgtgtttaacaagaaggcacttatgcagcatacatcattaaactttatgtgcatttggagaataaattatcatttctagcctgcctctggtatgggttgaagagtaaaatacattaacctaaagttattatttatatgctaacaaatggagttaatgaaaactatttcacatagaaaggaaagataagtggtatgcagattttttgagaattcacctgaaaattgatggtaaatacaaagtcttctgtacgttaagatcatgcaatgggataacctcattgctcgaggatttcaccaaagcaaacagagcaagaaacgttctgtacgtggtctcttcctgccaagcacgcacaatcatcaactgttttctaaagaatacacatttggaatcacacagactttttgaaaaattgcttgaaaaggtcatttgtggcagggcatcagggctcacgcctgaattcccagcactttgggaggccgaggcaggaggatcatttgagtccaggagttagagaccagctgggcaacatagagagaccctgtctctacaaaaaatttagaaattagctaggtgtggtgacccatggctatagttccagctactcaagaggctgaggtgggaggatcgctggagcataggaggtcgaggttgcaatgagctgtgattgtcactgcactccagcctaggggacagagcacgcaagacttgccaaaaaagaagaagagagagagagacagagagaaagaaagaaagaaagagagacagagagagagagaaagaaagaaagaaagagagagagagagagaaaggaaggaaggaaggaaggaaggggatggaaggaaggcaagcaagcagggagggagggagggaaagaggaaggaaggaaggagagagagagagaaagaaaggaaggaaggaaagaagggggaggaagggagagagagaggagaaagaaagaaaaagaaagaaagagaaaaagaaagaaaaagaaagaaagaaagaaagaaagagaaagaaaaagaagaaagagaaataaaagtcatttgtttttaatttaatgttggatacaatgaagggggaaaaaatcacatgaagccatccataaaaggccttaaggaatcaatcagatctatcagaaattaattcaaaatcccacttactgtcttaagagaatggcttgaaaatggttctcattattaatatcatttacatcaagatatataaacctatttttcaggactcaaaaatctaaatgacatctcaacaacatgtgattgtacccaggcatttccccctgggagcaccaaagggaagaaggtaatttttcggtcttttggaagctgtgccctggtgccaagatgcctcaagccaaaaccacacagagcagcctgcctgacagatgggcccagtagcctttatcaagctcttaggctcttatgagcttccctacttgcgaattaaacataaatttatcctttgcggctctttcataaaaacactggctcatgagtgtttccatttgtctttttacggatcttacaagtcagtccaaactgtttgcagaataacagcatttcctaagtctttctgaggtaggaaggccaaaaagaatgcaattgcccaagacgaacaggacaccctgctcacttaatggactcccaaaggcctcctttactggggcggcgccctggagcaaggagtcttgcaggaacttctgtgtggccttggctcccctgagacccagtgtgttccattagaggtagatgttgtttttccctcactcccgggtggtacagacaccaccacattgggccatcaggcacaaacctggactctgccactatctgcacatgtcatttggagggggaactcagcctccctgagtttgttttcttacctgaatctggcaaaaagaaaaaaaaaaaatcaatcatacatcagatattgattaaacactgtgacaatccagacagaatcagtttttaaggaaacatagtgtctcttcctctaggagctcatgataaagactggaatatacagcatgccagagtggtatgcgtgggtcagggacgggcattttacagagggcccagggacgacctgaaaaaggaggtgatttgtgattaaagacctgaagcaggggaaggagggagcgctgtggacatctggggaaagagccctccaagggaaggaatgaccctgacaggaacaggctgggtgtgtgggagaaacagtgtgatcagagcagggagaaggagaggcagtaggaggagatgaggtcagagagacaattaggggacaagatcatctagggaaggggttggcacactatagccctgccatccattttttaaaatagttttatgagaaccacaaccatgtcctttggtttacatattgtctatggctactttcaaactaccccagtagtggtgagtagttgtgacacggaccatttagcccacaaagcctaaaatatttactatccagccctgtacagaaaaggtttaccaacctctgccttgaagaaataggggctaatttttctccatggtagggagtctggagtaggcagtgcagggttggtgcagaagctccatgatgttaagaaggatccagacacctttgatctttatgctctgccagcctcagcatgcggacatgttgctttatgatctcaacatggctgccagtgctccagacattacacatcatgtcctcatttgagacaggcaggcaggagagacatctgttctttctaccagaaaagcaaaagttatcttcaccatccctcagatctctcctcccccaggacaccttcccccatctctgcgtccagaagtaggtcgtatggccacttctagcttcactgaaaaaaagctatgaaaaggattgtcaagacttagacagctgttttgttttttttaactgtaacccacagtaagaagcacacataactgaaacataaacaatgcaaacaaaaagttccacaaaacacaacttatatttactatttgtgctgtacactggtattttcccttgcatttttgaagtactagtcacatcatcaactaaattaatttcatgacccactattgggttgtaagtagagtatgaaaaatacaagtgggcatgagccataactaggggctggcatgttgctgctacagacaagtgggtatttctctctcctttccttccctccctccctctctctttcctctcttccccattccctctttcctccctccctccttccttccctcctttccttccttccttccctcctttccttctttccttccttccttccgtccttccttccttcctccctccctctttccctttcttccttccttccttcctttttgtccttttccttctttcctatctttcttttttccaaagaaggaaatggacattggctggcaaccaacagtatctgtagcctccaccataagtgagctggagaccacacccagttctactgaaccctgaaagaaaaggtgacccctccttctgaggggtctgacaatggaccctccccttctgaggggaggacgctgacaatggacacctgtgtctgatgtaaaatgcaagcactcacagccataaaagagaataaaatcgtgtcctttgcagcaggatggatgtggctggatgccattatcctaagcgaactaatgcagaaatagaaaagcaaacaccacatgttctcgcttacaagcaaaagagctaaatatcgggttcacctagacataaagataaaaacaatagacactggggacttcaaaagtgggagggagacagcggggcgaggggtgaaaaacttcctattgggtactatgctcaccatctgggtgacaggatcaatcccaaacctcagtaccacacaatgtacaattgtaacaaacccgcacgtgtatcccctaaatttaaaataaaaatggaaattttaaaaaatgcaagcagtaacaccaactgcccaggagtgctgggggaattgcatgggatccccaatgtaaagcactagcatagtgtctgagcccacaatgggtgcacaggacacatggggttgctgtcccaaacccagtcctcactcagagccagtcatggccctgtgaacagcattaattaggtcagagagaatgattcacactcgagttctggagagcccagggaaactgttatgtcaccctggtgctatgtttacttctcctatcaggagtgattaaattcttaggatctcatgctcagaggttgacagttatattgaattttacccacttttaaaaaacctttggaagcacccgattatttgtctcagctttgatgagggctgtggaagagcaaatgtgtcatgacaagtcaccaaccacagggagcctcagagctgtcaaaggatgggccattctccaaaaattcaagcaaacgcagaaacgggagggcccctggactgggtatcttcagtcctgtcactttttgcaggtgggggttccaacataagtcatacagcagccatacaagcattagcacagcccctctaagtcgaagttcagggacccatgagactcaaatcccaggctgattttggtgcatatggccacctgcactttctagaagatccatatcagattctaaaatggccatgagaccctaaaaatattaggaaacgcacactgaatgaaactaaaatgatttatgttaggggtgggagagaacaggtccagaggtcagagctgggaatcgtgaggtaaagcagaaattgcaaatgttttccatcaaccccatcccccaccttgacacccccacaccccagaaacactgaactgttcccagttccccaaatggcttgtggttttctgtcctctctgcctccgtgctggcaaatattcgtccaggaggcagtgactgggagagaaagactaacttcttattcaccagatcggatttcttaaacaataaggagttctaagaggccatgccaagcaaacggccagactgtacaaaggtgccccttgagcaataaatagcaaatgctctgggctttactgataagcctccccagactccaagccccaccaggcatgcagacaagtgcctgcagtgattgcagcgcctgcgcagcggcccttgttggaagtccaggagtccgcgctaccccgcaaagtccctggccgctgcccgcacaccgaacctctcggggctgagtcgggctgctttctcctcgcgtcccggggcgccctcgggaactcgggagcgcgcggcgagctgaacaatggcctggggacacctggcaggtcgcaggccccaaatcttccccgccgcccctaggccaccgccctgcacccggaacctaccggcgttcccagagcggggcggacggggcggtgccattggccggtgcggagtgaggggcgtgctcggggcgggacggagagaccggggcggcacctttggccgtgccgggcgagaggcggggagcggggcggggcgaggggcgaggggcggggcgaggggcgggcctggccccgagcagctgaagcctggggtcagcaggcgctgcgggcgcagctccggtgcaagcgaggacacgacacatgcagtggcttctggactgcgcgatgactggacggtgagtgatgaacgagcaggagagtgcttgggcgtccatggagcatcccctccgacccaggactgccaccaggcagggacgctgaagcctgggcacttgtgcccttcggccgcagcgcgcagggtccctcccccgccagcctggcgcattgcgggcctcgggctcattgctgagagggggcactgcgcctggcacctctgttaagcaatttaggggctacaacctgagcaagacagatgagcccggccactggctacaccttttttgttcaccttgtccttaaccagtttcctagaagcactgatcctagagttggggagagagcctagaggcctctggcacaactctgatttcactgatggaaatcgaacgccaagataatagcagcagggggggtctgtctcacaatcgctgtctgtagagggctcgccttgctctgggccaagtgctttaacacgatatgcctcttactcctcacagcaagtgagagtcctactttcgttatccccttttcagatgtgaaaactgaggcttaaagagttataaaattgtccacctttaccggatgagttggtgatggagccaggatttgaacccagggcttgttgtgcccctgagtctcttgctcttcacccttagtctccgaaggtcagcctgcctgctgccctgctcttctgggctcctgactccggtcccatcctgcacttcccacttccaaaacatgcctcagtgttttcattaacctggcacggcggagggagggaggcctcctctcacaccagaatcagtgcccaggccagggccagcactttcttaaaacacagtaaggacagcttcaggagccccatttcacataggaattaaataaggtcgcacagcaaataagggctgggcttctggaatttgaacccaagcaggttagactccaaagctatgctttgcactcacagaggagcccctcgctggctttgctgtagtttaactgcccacagtactaaggtgtcaatcaggatttgttgccagaaaccatttttttttaagttagaagtgaattggtgaagtaacaggtaaatgtagaccatcctgccttctgttcctctgtgtggttccttagctacttctgccaggacagcaggttaggggagaagacaggaagggagagggtcagaggagaaagaggaagggagggaagaggagagatgaaactcattaaacttaggttaaaaaaatgctggccggaaattgtcatgggctgtttcagcactttgtcagtgtatgtgaaggctgttgtcattagttctagccataattctctcagtgtgtagtgctggtgatttgacaacaaaaaggttgatgctacagattaaagtgtctgtctgaaactcaggagattgggttgtatttccaccatgaagctccagtgggtagcctggaggtcgagaacagaatcaaggtccagggtcgccctgggtcaggaccaagtggaccatgacagataacaaagaacatgaacgaaacttgggtgtgtgtcagagttcagattctggacgtgcaaagcctcaaaggggagacctaactaggggatctgccagaaagccctctgccctgggcccctggggtctggggcctggtttcaggtgtcagctcagactctctcctcattcatggccactcctgcaggcaggcctcacattcccatctctggggctccacagtctctccagagcccccaactcccagtgtcaataagaatagtaatgggagcctcttttcattatgggtgagcccaacacaaggcccatcttacaggtctcctcattcgtcttcacagaagtcatcgaggattatagttatttaattgatgaggagcccaaggttcagagagggaactggacttgcttaaggtaacagagccaggcagtcacagagcagagctttaaacccagagccttgcaaaggctaggtggttattctctcacagagtatgtttggggaaattgttttaaaataaagaaaatcaaataagaagtggctgcacttcctaaagcttcaacagttttcttatttttgtaaaagagaaacttgtagttcccggggtctccttttctggctgtcccaccttctgccctaggatatactgttgaggaagaggcccggaaccccctccctttgccctgcctgaccttgggaagcaggggtggggtgtcattgagccccatagctgcagtgctgggaagagccctgaagactctctatcagctgccacaacagctctggctaaactgatgcccaagagacggcgcaacacgctaggatcacaggccaagttaatgccacagcaaaactcacatgcaaggctctacaacgttcctctgcctcctctttcttgctgtgacaggtttcagcagagattctaaacctaagatctggggatctgggagtacatggacaagagctgtctcatctccctgcagtgatatgcaaattgtgtgtgtgtttgcacgtggatgcagattgcaacaacatgcacatacatgcattttctggggagagtgcactaagctttcaagagactccaaaggactctatgacccaaaagattctgggacccttttgtctcacagggcccttatgtccccagcagtgacatgtggcacacaggcctggggcagtggacagcacaggtgagggcagccgtagagagcctccagagcagccctgcagcagcaggcacccagaggggtctgcccctctgcattgcactcccagccccaggcaatcgggatattggacagtgcccattttgagcacgtttggcccgaaaaccatagctaagaagatctttgtttctgtggatcttctcttccataggctagaggtgagcctggttggtggggaagttgaggagtggttcagggggttccaggagcagagaatgtatgtttaaggtgtaaggggggagcaggaggactggaaatggttttcttgtcccaaattgctttgccttgaaacaagggcagaagccagaagtcttgcccactgggaaggctggtctgcgatctacatggctgctcagggccaggctctcagaggaaggggagctgtatcagggaggcctggatgctggactggactcagagagacctgtcagtgagaggccagaaccgcagcggggagtaaaggtgagctgggcctgtgtggtcagtccagggcaaggcgggagtggaggtggaggggagctctgtgcccgcctctcctggactcccctggtctccatcacctccacctggacagtgcagagtcttctggggcagggaggagtgagttgagccagagggatgatggcgggagtggagaggaggggtctggtgattggaactgggcagcaggaggggacagcagtgtggaaggaggtgggagcagcagctgctgagtcgccgcctgccatctacaaccagacagccggctctcaccacaaaaatgcttggctgagggtaccccctcagaggcacctggtttcggcagacgctgcaacttcttcactggccaggctcctgccatttgctggcgaacaggtgctgggaggggccttttaaagcttcattgtcctctgtgccctgctgccgttgtggctggcaattcgaatgtggtagccacagactgcagtcaggaacttagtccccccaggaatgccgtcagcgtggcctgcacctgctctgtggcctgcacttgctgtcctccaccagcgggagcagctcaggctcccagctgtgccccacacacttgtcctcctttcttttgcttcccaggtcactttcgttatgacctatttgatttaaatcacgctgaaataagaaaataaaaatcacaatttcaggaaatgtgaaaacagaggtaaccaagctctcagacttcacagatatgcttagaacattttaatttggatgcctgtacgttttcccttttgccaagtgaggacaccacatctgtgttggccatgttttatgtaagaagggacactgtcagaaggaaaagcaggcagcacagtcttaaaataaaaggctttcaagtggactcaatttcgtgtcacgaaagcctcacttcactcggcatcttctgttccttttgccactggcctgtaggaattgggccccgggggtgactgaaagaatcacagtcaccttcttctgtaataactttccccacaaacacaaaaaaggaaagacggcccatgcctagcagctctaaagccctcggcggcctttgtccctcagtagtgacagcagactgtctctctctgcacggctggcagagcagctgctgaagtggaaagggagaacaactcactgcttgttcactgggacaggtagccatggctggcatgccgcctagggggcctcctctggggtacagacagccctggctgcagctgatcactctggttggggacagagtgtcctccagcctgggaaacaggcgtggaggcctgagctatgtcctgggacctgggggaggggaacgggcccagacaaagaaagctgtactttcccagcagaatggcacggcttggaggaggggagagcctgctggccgacttggcctgtccagctgcatctgtcactctgtggttttttgagcctgagcctgggtggcaggccagccccagcccatcctctcctgactcctgctgccacccatgcagcctcgctttaatccatttgtgtattgggcttctacctaggatctaatttcaagataaggttgtgctgtttataaaagactgaaaaatactccagcagagattctcaaaggccccacccagtgcacttggagattcaatgcaaaaggctgttccaggaaaatgctccaaatagagagatggctccctttcctctcctgttgggtgtgcgtgttcccccttgcagtttgctgctgccacagctgtctttcagacaccccttaggtactcatgcagtttcctgtagatgtgatgtcaaaacgattaaattcatcaaaatgaatgaaagtctggtaaaggggatagggcgcaagcacagtgttgagatctgcagtggaattctgtgagtgatcctggagctcaggaaaaacaggtcttcttgcggtgttggctctgagaaccagagagaccaagtgacttttgtgggagccataggctcttggccccttaaagtttcactaaaaatcacagacatgaggcagattgattaataggagaaaagtcatacacatgtacttaaggtgcatgcatgggagccttcagaatgatggtccagcttcccagtgagtaacagagacttatataccattttgaggttacagaaagaatggggcttagattctggtgaaacaggctatggaaggaggagaggcttggctagtgaaagtgaccttgttatgtagatgaagcctccctcaaagagacttttaaaggtgtggattctcagtctctcctggatgtggggaaagatctggaaaggggagggggcctggctgcattaatggagattctctacagatgcaaattttcccactgaagacactctgctagccacttctttcaggatgggcaagtggcagccatttaagaatacgtcaaagaaatatatgttggggataaaatattttcatctccttcccttgcttagggccatgaagctaatgagtgctggaggacacagaaatgtgtgcctctctcaaaggagagactctctttgtgtggagccaaggttcccaccctgtaaggctcaggacccagcccagcaagctggaaaaacctccttttgctgcagtgggccctgagccacctcccttagctttgctcgctgacccccctgccctcccctgggatggtgtgccccgttctctgccccagctgtttaccctacaagcccaccttgccctttatcccttcactttgccatctgcagcctaggactctcctttactttcctcctggtctgtctcctctgagcaggtgcccccagctggtgccattcagtcatggccggagacactcaacacgttggttgtgtcctataaataagcaggcgtgcaggggaaaagcactcctgaaggccagtgagggagaaccatgcttttcaagtagtattacccagagctctagaagatgaggctctctgccaccaccacctcactgtcaaccacggcaatcccctttaatctgttttgcatacattttctatttgaacaaagagttccacagttaagaaaatttcaaacccattggaggtcaatattcttgttgtacagatgggaaaattaaggcccagagaggagaaggcatgcaacgaagcaccccagagctctttaggaagcattttctatgaataagtaaccactgcctgacttatgggaaattccacttctaagtgttcctactacatatggcaaaatgaacttcttccccacacactataggagaccggaagtaaatgtaaatcatgccgtgtcgtgaatcagaagtcacaaactggagcctcactgtccagtggactaggagaggtccccaaacactggtgggacttcgaccccagctgatgtccaggctcttgactccttgaattccttcccatatgagtcagaaaatagtgaaagtacacactcaagaagggagagtgtgcaagggggttgggagctgcttcctttatgggtttctttaaccaaggggtgcaatatccaagaagattcctggaaaaaggtggaactttcttgaaactgtggtgccacccatttttacatgaaatatgggtgttctggaactgtcatggtgcctgtgggtgtgtaatttagcatctcagagagttgcctggttaatgagcgtatagtgaggtcctagaagaaacctaggtcgaatccagcaccacgttggtttcagttggtcttagccagcttggcccacactctgatttttttagagtcttatgacccctagcttcttatgacccttattttaacagtttccttttgctggtcatgtgaaatggctgcctagaattttctattctcctgtgaccatctgtattattcctgtctcaccactaggtgtatctgtcttgcaaagatgtttagtttatttataaacatatttaaatacaaaatattacattaaatatttgttgttttgattggattatgtattgcatgagacttggtctgggttatgctgcagtaacaaatccctgatacaccagtggcttgtcacggcagaggtttatttctccctctcagtccatatccagtgtgggttggcagacagttctggtccacagtcactcagggacccaggctgaccatcgagtagctgcacatggcttgaaacacatggctttctgggtcaccacggtggagacaggagaactggagggttgtgcactggctcttaaagctgctggcctggaagggacccacaacacttttgttcgcagctcagtggtcagaatgaggcccacagccccagctagctgcagagggccggggtggtgagcgaccacacgggcattccagggacagtgcatgcctctgccagccagccacctttcagtagtgaaatatagcccagaaaaatccagattcctggcttcttatgaaacgccaaaagagttgccccgtcgaagaaggaatgtgccccccattccccatggaccccgtgacgaatgtccctcagcggagtcacctccgtggccattggagacttttatattatttattcctgctgtatgtgcacagctttggaagagtagacttggagggagtctagaagcttcttgtatttattcagcaatttaacaaccatgtatggacttcctgcgatgtgccaggcttatgcttggggctggaaactagtggtaaagcaccccccgccctcacccccaccatgttcccgttctcttgggagggaagtctaaacaagagctgggttctgcagggcccagtggggaaatgggaagagacgatggggcagagaggggctgccccaacatggactggggcttttctggcaagggtttccaggaggagctaacatcagaagacaggagtagttctgggttctgaacagagaacagcactacaaaagccctaagggaaaaaaagcatagggctccttaggggagccgtgaacttgctcagtgagcccagggcttagagcaggaagttggggtggaagctggatacagaggaaggcaagagaaaaaaacactgcctgtaattttggggtaaatccagcccttcctgtaatgagtttgctgaaagcaagacttcgttatgctgaagacccacagaagcagtgtgggctaagaaacccagttccatggctcaccctgggctgcactaggcttctgccttgcaagtatatgaggaactacccagagaggggggcagatcactttttccatgggcaagcggaggtgccgaggaactgaaactttatgttgaaatccctgttgcctggccaagaaaaatgcagcaataagtccccagctccaggccttgctgctgggggcctgacatctctccaggccctgaggtgcctaactctggagcaaggcagaggggaggtatggataggatgatcctgaggtcatcaggaagcccactccctcaaatccttccccttctccaggccaactgtatttccctgcctcttgcatcacaggctcatgcagggctgatgctagcacagagggcaggtttgtcacatttgtgggtgtcaagcaaggggggagagagcaaactggactggtccaagtgagtgcctgaggagctgggcattctgcagggatgggctctgaggacattaataaatacgacagcaggtggagctgagcttgagccccccgccccccgtggcatttgcacacactcaggtcgggaagacatgatgggtttgtgtgaacagatgtgggggagttgtgaatgagcagagctctgtcgtgggcaggatgtggtgtggccccaggctgtgccccctcccaatgtgtcctaacacccctagccctgagctgcaacttgggagatggaaggtggaggcaaggtcagcactggagtatgtgtgtgtgtgagtgtgtgtctgtgagattgtgagtgtttgtgtatgtgtgtgtgtgtgtgcatgtgagcatgtgtgtatgtgttaagtgtgagtgtgtgtgttgagtgtgaatgtatgtgtgtgtgcatgtgattgtgtatgcgtgtgtttttgtgtgtgtgtgtgtgtgtgtatgtatgtgtgtgtgaagctttacctccctgcctagcatgtaggaggccttgataagagtccttggccacattgacatgggggagagagaggaacaggaagctgtgcagatgccaacaggttcgagaaagctctggtggatttactgtccgtgaaagaaacctggggagggcaggagcggctcctcaaaccaatcaaggctgtgtgtggaaagagggaatagtatgtgtgtggaacagtgtgtgtgaaccgcgtgtgtgtggatccactaatgatcctgtgggcttgagattaccttgttgcacagacgaggaaaggaaggtttgggagtttaagtcactgcccgtgatcaatatagagaaggtactaagagaccagaatcaggggtccaaatgcttgtgctggaacagtggcttttctgcttacttgctggtaatcttgggcaaagtgcttaagctcttgtccctgtcttctcatctgtaaaatgggaatatggtgatactcacctcacaatatcgttgtagggactggaggagataactcagagaagatgc

SEQ ID NO: 399 - DNA, 53537 bp, Homo sapiens
agaactgtgttgaattatctctttccatacagtatcagcattagcctaattaaaagctataatgtctgatataatgattaaatcgttagctctgctgtagggaagcaatattttgttttcccttcaattagaagctgattgaggttttcagagcaggtcagctgtgaaatttgaattatatgtgtgagtactgctcacagggtgagcccctactccaaagctcccagagcttctccaaatgctttcacccagagagctcggaggcacacagcacgcgcgcgtgcgcgcgcgcgcacacacacatacacacacacagttgtttgttcttcgattgtgaatgtgcggctctccacacgaaccgcccgaaagaaagcctgggtcgcttttgaggagaaggagtttcttgacccttccccgcaaacgctactggaacggcctccaaactaggacgcctagtcaggcaaaggagagagcggtgcgccggcacgcagacagctctgctgctatccctgatggccagggctctctttccgttctccttccacacaccccctttccctgggctgttattatttttttttcctccttcaaaaccaaaccaaaccaccaccaacaaaaacttctgtgctactctggcttctctggttttgtttgggaacagtggaaccaagttagcccgggccagggcgcagatgatggactcagagcgcccagggaccctagagagaggagcactcctcaagagccccctggccatcacccgagcgccctggagcgccatcacccgaacgcgcgctccaggccctcgaacaaggcctctggctgccagagcgagtgaggggcgcagaggcggcagagagcggagagccccggtgtctccgcgagggcggcggcggccagcagacggcgatcgaggcgcgcgccacggcacggccagcgcagacacgccgcggggtctcgggccggagccgtgcagccgggcccgctgcctctttgcccctcatggctccgcgcgggaggaaaccgggccttctccgcccgccctcctctcgctgcggtgtccccagcacccccgccccgcccccgcgcggtccccaccgtcgcgctcccctccctcctcgccctcgctccgcgcctcctgttggcagagatggcctcgaaggcctcttccaatttgaatggctctttcttcttctctctcccgcgctttcttttccgccttctcctcctctccttctgactactcttgtctctttcaaaagctccgcctggaaactagcggcttcctcttcatctgcctcctttaactgtggcctcggccctctggggcgacaccagagcgcggaagcctgagcccctcggagatccggggaggcacctacacatggcctcaatcctccaaccggccccagaagccgtaggagctgaacccaggagggcaaccggttgtggtgcggccacatgtccctggagagtgtcagcaagacgggtcgacttcaccaggaccacgaaagacagggcagagtttctgtcttctttcactgtcccgtagaactcctagcttgtccatcgtgctccttgcttgggactcgggactgacactgggccagaaaatccacctctagatgcctcaaagctcgctttcatgctggggggcgggcgggagcggggaagggggacaaaagctaaaagtgctaattattccatacagacagtttaagctaatggtgttacagtccagcactcaatttacttgaaagttgaggtttcttgcataatggcttaacctatcacatacatacaggcatatatgtgtgcgtgtaacttctagggatggcttggttctggattggctttgaagattatgaccacaggttacatacaacaatagaaagtgtctttatccacatttctaagttgatcttcgctttggcattttgagcaaagaggcacaatgaagtttctgagctgccaaaaaagcaagtttggtcaatcaacagtgacagtaaccctgtgcctgggggtctagacttcctattacattacttgggaatagggaagtcagtgttcaaatctccaggagtccagcctttgggaaagtactgggtttgaaggaggtaactgccaacttggctggaggtagaagggagaaggaggtgcttttcaaactggttttggactgtcttctctcttcttaaagagtcactgaggaaagagtttagaaggagcaagaaattgaggcttccagaagccatcgatcaccagcaggagttaatattatgctcgtcaatcctcatgccaggaatgaaggcacagaggtctagcatgcagtgccctgtgctgcctaattggcactgcctgctgctgccaatcatttatcgcttggcaacaagttacacctgcagctttggtttaatacttatgcaggtggccacacatagtgcgtgcagccgcttgggcctagggaacatctcgtcactgaagagggcttatggagagcaccctgaacgttgagcactagtgtgagctcacaggatgctaaaccattttcctcttatttagatgctctgaaaaacaagggtaacgtcgtatttggaaacaattttcgggactatggtagaaaaaaagtagaccatttcaaagtcagctatccaagttccccaaagcataaagcattcctgcaaagcacactggagtgcagggtgtttataaaataaattgctccattgatatggaaaataatgtgccaagcctgattcatacaaagcattttcagggagtcttaagctatttagtttaaactctaaattgaaaagcagaggaaagaaatctttcaactgctaagtggataatatagtttataatttgtaaaccatttcctttatttcagtcttgctgactttccataacacactggatctcactgcacacccattgcctcctaaattatcaaagaaaaaaatggggctatagcattcccaaacaatattattgctccttttttgttcattcacaatgtaactgatatttgtaggtagtgcatgtaacaaatcaaaagatttaacaaactcgactggtgaaataagaaggtagttggaagcccagtttataacctagatatttagtgaaaaaataaatataaaatgatgttccctttctaatataattatatattacttgatggatttactagtaaatgctgaatggcctggaatgaaagcagtttaatctgcagagagatcaatttgctgttgcacttcacactgtagcaaccctgcaataataaaacaaaccctacagtaataatcatagcaattgagaggaaataaagcattattcttttaccttggacaagcaacagggtcaagaaattcacaacctcagaagtttttttaagaggaaaaaaaaggtgtcacgtgttcgctgcccaacagactcaaacatcctattactcctattaccgttatcatcatctttactgaatattcctactacaagacaggcagacatgtgacatgcggtgaaggttctactttacccaccaccaatctccacaagcactctcatctcagggtgcctcggggagggcagaggaggaatacttgggctcaaaagtcgtctttggaccactttcagatcagtctggtggaaacggtagtgtgagcgctatgctacttgagactgcgtttgaaaatctctttcacgttcccaaatcaaagccactttgaggtttaagaatgataaccacaggtgaatgccttactctttccacgagccaggcctttcctttgcatgacgcagaccggcggctgagacccgtcctgaggccccgcctttcattcggtttatgtggccccgcgcagttcacgcagttttctccgttcttaggcaaccagctcgtgggaaattcactccagaaaagcgtgcgccatatcattattttgcgattcaacaaactttttcaactgttgttcaggaactagattccagatagatcttgttgtgttcggccttcctagaaattccttttccagaggaagaagatccgggttgggaagagtgcgtgactatggccccgggctcattgaaagactcctccccacaaaagtttagggctgatactaaacgaagctatggagccatgcccacacaaatactccccctttacccgaattgtggggcctggactgtgaaggccttcgctgcaagagcgggcactggcgaacttcagtgcacgccgcggccgagaacggatgcagggcgggggatggctgagccgcctgatccttgcagagaacctgcaggggccctcggagggtatcccctgcgtccaagggagcgcccctccttttcagcactcgggggaactgagggcgacgtgccagccccgcactcaactttccccttccctgcaggcacagagttggccggcgggggcagaggaggagctgggtctccactgcgcccgtttaaacctggccaggggctgcgtttcctccccccaccccacgacgatcctttcttagtcttcgcttttcaacccaatcgttaatcattcggaacgcgcgggcggggagcggcgaggagggcgagctcggggttcgccgccgccgccgccgccgcgcgcgcgcgctcaggaagcggtgtggctgtcaccccctcccgggcctcctcccccctccttcctgctttgctccccctccttcctcccctcctccccgctccgccgcccgcgcccagtgtatctactccctccccacgtcactcgccagcgcgccatgcaaatcaccgccgccgccggctcccattggccgcggcgcgctcatttaatggcagcccgggcccggcgtatggctgctgggccccgcgcgccgccggccccgcgtgcgcctccgctccgagcgcacggccccgggcaggcagcgggcagcccatcccgggctcggcggccccggctctccggccctctccgcgagcccgcgctcctcccgctgtccccgggcccctccctggctgcaccgtaatcgccccctgcaggcccccctgcgcctccccccccccgccactggcgcctggcttcccccgggcacctgggaccagcacatgcccagcgcacgcggcgcgccgccctgctagaagttgcagcctccgagttggaggccgctgaggaccgagcgcaggaggaaggagacagcgcgcagcggcggccggcgaggagacagcacaccccgggccgggcccagcgcaccgctcccggccccaaaagcggagctgcaacttggccacgactgcacctgtttgcaccgctccgccgagggcgcctgggctgcggtggcggcgaagacggcgaccccgaccgtcggcctctttggcaagtggtttgtgcatcaggagaaactttccacctgcgagccgaaccggcgccgagtgcgtgtgtttctgcctttttttgttgtcgttgcctccacccctccccattcttctctccgctaggacccccccgcccccgtctcactccgtctgaattcctctccgtctccctcccaccccggccgtctatgctccaggccctctcctcgcggtgccggtgaacccgccagccgccccgatgtacagcatgatgatggagaccgacctgcactcgcccggcggcgcccaggcccccacgaacctctcgggccccgccggggcgggcggcggcgggggcggaggcgggggcggcggcggcggcgggggcgccaaggccaaccaggaccgggtcaaacggcccatgaacgccttcatggtgtggtcccgcgggcagcggcgcaagatggcccaggagaaccccaagatgcacaactcggagatcagcaagcgcctgggggccgagtggaaggtcatgtccgaggccgagaagcggccgttcatcgacgaggccaagcggctgcgcgcgctgcacatgaaggagcacccggattacaagtaccggccgcgccgcaagaccaagacgctgctcaagaaggacaagtactcgctggccggcgggctcctggcggccggcgcgggtggcggcggcgcggctgtggccatgggcgtgggcgtgggcgtgggcgcggcggccgtgggccagcgcctggagagcccaggcggcgcggcgggcggcggctacgcgcacgtcaacggctgggccaacggcgcctaccccggctcggtggcggcggcggcggcggccgcggccatgatgcaggaggcgcagctggcctacgggcagcacccgggcgcgggcggcgcgcacccgcacgcgcaccccgcgcacccgcacccgcaccacccgcacgcgcacccgcacaacccgcagcccatgcaccgctacgacatgggcgcgctgcagtacagccccatctccaactcgcagggctacatgagcgcgtcgccctcgggctacggcggcctcccctacggcgccgcggccgccgccgccgccgctgcgggcggcgcgcaccagaactcggccgtggcggcggcggcggcggcggcggccgcgtcgtcgggcgccctgggcgcgctgggctctctggtgaagtcggagcccagcggcagcccgcccgccccagcgcactcgcgggcgccgtgccccggggacctgcgcgagatgatcagcatgtacttgcccgccggcgaggggggcgacccggcggcggcagcagcggccgcggcgcagagccggctgcactcgctgccgcagcactaccagggcgcgggcgcgggcgtgaacggcacggtgcccctgacgcacatctagcgccttcgggacgccggggactctgcggcggcgacccacgagctcgcggcccgcgcccggctcccgccccgccccggcgcggcgtggcttttgtacagacgttcccacattcttgtcaaaaggaaaatactggagacgaacgccgggtgacgcgtgtcccccactcaccttccccggagaccctggcgaccgccgggcgctgacaccagacttgggttttagactgaacttcggtgttttcttgagactttttgtacagtatttatcacctacggaggaagcggaaagcgttttctttgctcgaggggacaaaaaagtcaaaacgaggcgagaggcgaagcccacttttgtataccggccggcgcgctcactttcctccgcgttgcttccggacggcgccgaccgccggagcccaagtgacgcggagctcgtcgcatttgttataaatgtagtaaggcaggtccaagcacttacaagttttttgtagttgttaccgctcttttgggttggtttgttaatttatacaaagagattaccaccaccaccccctccttcagacggcggagttatattctgggttttgtaaaactttatgtatctgagcatttccatttttttttttgggttttgtattatttcttgtaaatgcattgtgaaaaattttattttcggcgttgcaatgcggggaggagaagtcagattatgtacatagttttctaaaaagcctttcttctaaaaacgaaaaaagaccccccacccaaaatgtttcgagtcaacaaatttaagagacagagcccattttctccataaatttgtaacatgctatttttatgtgcatgttttatgagttcaaaatgcaatgaggaaatctgacagggaaattatctgtatgaactaaaagtaagggaaccccggggaatgggaggacaggatttttcaaggaacctttttcaatgaaagagaaggaagttaaaacctataggttattttgtagagctgagtgttaatacgggccgagaaataaaagtatcttctgctccggctgtttcactgcggacggctggggctgctgcgcgttaccttgctgcaagcggggcgccttccacctggctgggggtctgcgccacagtttggtccagaggagggaggaggaagggaagaccccagtggtgggaccctggaccaggccatggatgaaggacaaagaccagggcaggtcacgggtttcccaattccccagcaattaagatttcgagcagaatttatctaaatgtgtttcaaggaaacacaatcgctgaaccaaaacgtactgcagccgagccccctccgtccatcctctgcccctccccctggcttctttctcttgggaaaacgggcaaaataattgtgctggattctcacacacacagaaatatcgaccatcaccctcccccgcgtgaactgggatgcaagttgctaaccgatgtgaacgcaaaatgccttgttcattattcctgacgagatcttgaggttgtttgatgctttaaattttttaattatattattttctaggtgtttattggtacattgcagttttttttttgaaatttaaaaatttctgtaaaactttgtcttcaagtaatctgacagcattaaatattgcatttaaaaattatactgtagcaaatacatttaaaaattaatcacaacgttaagatgaaattatatttttggaaaaaaaaaacacttgaagcccagatggaaatacgtttatttcagcagccttaggtttcccctcgctttctcaacacccttccttgtcctggagtatggactgtccgtccaaaagtgagcctatgctataagtttaatgagaaccgaattcagcctgcattcgagaatagctttaagtataatgctgatctgacaattgacgtgtaatttgggaagtcattttgataattttgcttaaaccactcattcgttaaagtgattacaaaaaagttcaagaatgatgtccactgctttctaacaagataataaaccccccccctcttttctttttctttatttttatttcttttagctatttgatcctttctgaagcagttgtttctggaagagtctgtgcgcccatggatggctgagcaccactacgacttagtccgggataagggcctccccagtcctctccgggagatgatttgggaaattttataatgcttgttctgttaactcaccgggaccttgagggtccaatgggaccttgagggttttctctgaaatatacaaacttaaaggactctctctgaggttctttgactgacgtccactctcagtctggcccctgtgctcccctgtgtgtaccctggagtttctgtgtccaattgttggcatctaggtcttggctcaagattaggatgtgggccccactttagaggcacagactatgaaaagctgagttagtgcgcccgggacgccaggcaagcagcttttacagtttggcatcttattgcaggtgcttcgtgcacagtcagctgaaatagccaatgccaggtgctccaaccaccttatttccttgttttgttgattagaacaacacagaaaaaagcaaatataaatttttaatgactccatttaaaaatatcacagggtgggggcaaggaaattagctgagattcatctcaggattgagattctatccccccttccccgcccccagcagtgtcgctccaattcaaattagtggagaaaagattacagtaggccctgagccgactgtgaattcggtgcttggccaaggtaacactcatcgtattcacggagtgaaatactatatgatgatagttattatattatatgacgacttcattcacttcccaaatcacagggtggtgcttctgtcgcttagtccaattatgtttgcaacccgtgtagggaaggcggataggagtctttgaggcctagtgcaaagtttgcatcagtttctgcgggggcgacagtgtgacttcgtaaatctgccattgcgctcgggccctgccctccaaactgagggtaggagggtttacttgagggtttttttgctttgttttgttctgtttttgccttgttttgtttttcaactcacccgccccttttgttgttgagattttgacgtccccttccccggagaaacccacccgtaacgtactagatggattagttttaaagaagactcgggcacagcgtgatctccagatgcgcgtcgggagcgtgactgataggtctattaaaatcacgcgtgtgggagaacggcactcatgctcccgcgtttcattcccccggcaaagactgggcgccgcagatttctgtctccggaaaattccagttaattcaagaaacccatccccggacgtgtgcccgcccccccccgaaggctcgcttcaggccagcccggactccagcgccccctcgaccccgtcgggctccggccgactcccgccccctccccacccacgctcggcctgggcccgggggcagcggctccagaggcgtcggcggcagaatttaacccccggtctgagtccttggaaacttcaagtgaaaagcagacttggccttggcgcggctctctttccagcgtgactatctggcgagactgaaaggccaggccagatggggaaaagtgagcggggtgcgggcccccagtatccggcggggtggggcggcgtcaggacggagcgagggccggcgggggggctcgcgtggaggcccaggccgggaggtggggacgcagggacccctcacccagtcctctgctcccgcccgagccaggcctcgggatcacctccccttgcctgagggcgagctctcctcctccctcttcctccccgcctcccccgttcttccctccctctctccctcctccctccccggcccttcctctccagctgcgcgcccgccgggaccacgctcctcccgcccccgggagccgagcggcgtctgcggctggtccggacgtgtcccctccgggcgggggtggccgggcctcctcggggcctcgggcctcccgggcgcacccccctgcctgcgcctctccaagtcgccctttctccggctctgcccgcggctgagccccgcacaccgcgccgctgtccttggggtcccggcacacggcgttccctccccgcccccgccatccactcccaccgcctctccagtccctgtgccgtctccaccgccctctgactcccgcaccgagctgcgtctccgccgccggcctctctcagcgcggcccggcctcctctttgtctttgaagctcccccgccgaggcccgcgcgcggctcccctctccgtccctctccggcccttgggcgcccagtcggaggtcggggcgggatggggcacgagtctcggggcggcccgcgctccccctactagtcccctcattgcctcggccccgtccccgcagcctcggggcgggagggcgcaggggtccccgggcgccctgggagcccatctccctcaggtccgcgccggtgtcagccgccggcggggggcgggtggagattaagatgagtgctgcgagggacggggccgagggttttgtgtagaaggagagcaggattagtggagagaaagtgctgacccggggtcagccgcaagtcaaacccttttacactcagccggcggaacgagcacggctcgggccggacggcaacaagtgggcgcgaagggagggggaggggaggccgggtaccggccgggtccggcgtgagagaggggagggggaggggacgcggccacagcgccccagggcctcagcgtcatcggggacgggcgccgaggggagcgcgcaccagcgacccgggcgcggactggggcctgcagggcgtgactggctgccccccaggactccatctccttcataaacacctgccttttccattccccggggccgcttcggctgctcctctggagggaagactggggagaaggttgcctgcgctctctgccccagaggctctgttttagaaactgtttcttaatttccataagaaacaaaaaaatcacaggaaggcctggttcctctcccggacgactgcgtccccaggctctccaggaatcttcgccttatccgagcttcttcgcagccctggatctatttctggggggcgtgtgtgacgcagaatcggggtataaaatatcaatgctgtttgtcacgacaccgctttctccacccgggcagagctgcggctcccgggcgttgcgcgtggcgtttttcatcacggagggaaagccgcggctccgcgggaaaggagtgaaaaccgagtgtgggtgaagaggagagggaggtcagggggcaagggaagaaagcagataaatgcatcttccctagcagccaagctggaaatttgtgctgaaagtacaacagcaagagttttcacatgaaaaacacgtgaagaacccgagcaagtgatagatccaaagacggaaaatgatcgtctattttgatagtaaaaataaaaagaacagaattgacatattttcgtctaaattacttttcatctgccgatatgaaacaccaacactcaaacaaaaacaaaggacaaagcagtttttaaaaacaacacaaaacaagcaactctgagtgaatgacctgtccacagcttaccctgggtgacatgggggcgctgtgatggaaaatgggttctgggttcaaaatcaagccacagaacgctgcctggcgagttgctaagtgtgacttgtggggaaatcgtgtctgcggcagaaacactggaccttgtgagtaattcccgatgcccggtaggcagctggcgaggctgtaattgccctcggccacttcagagcaaccatgtgggtgcattgaagacgttgtttgtggagagcagcaggtcatcacatgcaaagccctgaaatagtcagccagtcaaatcagtggaaaaaatccgcttttgttagattttgcagtttcaggaattaggcattcactgcagagctgcagttttgagaaattgcaatgtcaggcatgttcccaatggggaaatattgtgagtgtggaggaacgtgagatggggtttgacaatggggagactgacaagagtcatcacccagacattgttttctctctgagcaccccggaaatgctaacgagagatgatatttagtggcagcaatagcactctgcgctagtcctatgcactcctaagacacagaaacgagtctcgggcagctaaggaactgacctgggatttcccaggtcaggatgggtccctggaatttgcagggcagaggtgccttctaggtacctagaacctagaaacattagactagtggtgtcaggatcaacctgaaaaaattcaaagcagaggccaacgtatcattttcgttctaagtaacagaacagaaggaaagccaggtgagcaatattttaacctcagaaagggtttagcaaccccgtgttttaggtaattcaaactccagtgggacatttcagtaagtggaaaagcctgaacttcagtggtgagagtgtccaggtagatggagaagcagaagccagctctttatgttagaaattgaactgaagaatgaagtttccttgtaaaaactggccgttttcaccgtgtcatgcaggccagagattagctctgtgtccttgggcaaatgtccttacctctgagtccatttcctcagatgtaaagcagaaattacaaaaccagcttcccagggatgcatcatctaaggtgcatgcagggcccagcaaataggaagcactcgctccagaatcatctggagtggaagcccgtgtgagctcagggcacgtccaatggacaattgggacattaagtgccagatctgccctcggcaggaaacaatggaaatgatacaaaccacagtctttccatgtatccatattaatagtgatttctctgtaaagttgcttgacagttacgacattcgttctttcatctgttcaacaagcatttattacaagtttgttacgtgttcaagttgagtatgaacacatgctatgtatgcaacctgtgtccaggtgctgaggatgcaaagatcaacccgacagggctcaccatctggtgggtgagactgatgatcacacaggcaagtatgatgtcgagggttatgggtgtgggacacaggcccatgccagatgctcaggtagggtgctctggcccagtgtatgagaaccgaggaaggttttgcagaggaggtacacccacggtggagcctgtgacttcctggtgctccaataaatactccctcaggtggccttcccatgagatgtgcatgttggatgttctttatcagtagatacagattgcaatgtaaatttgaacagagtgtatgtgatagttgctttgttttttaatgaatgattgcttcggattggtcttggtggtcaaagattgaaactcagaggtttgcaagggcaatggtctttcagcatcaaggtgcatgggatcactaggagagctggctccaaattcaggttctcagacccagtgccgctggtaggctgcttctggggctccagcgggcctcaaggatctgccctttcttagacacacttgggggagattttgaggccagtcctggatgacacttgggaaacccgtgttaggagatgggcctatttttttttttatggtaagtagctactaagactacatcatttaaatttgagtagctatttattatttataaagtgctcttacttaattgttcaattgagatgatttttgaaaaaaattaaattagtggaagactaaaaaaaatttttgagctgaattattagaatcttcctaatagaaaagactgatgtactgattttagttccattttcctacgggttgtgttagctgcctgtaaatacatcctaactctcctgaagtgcagtcagtgtggaacaagggaagcagaaaccacatgtgatctttgatttaaagaaaggttgattaaaaggactacacacagtcatggattgtgtctcatcaatttctaattgtaacaaactaatttgtatgtaagtagactggctctgtgcaatccttatgaatacaatataggccaaaacactcatgttgttgagggttattttaaggacctttgaaatgtcagagaagggccatgtaatagtgccgcaacagggttgaactgcctctgtccaatagatcataactataataataatgatgatatggtatgtagctactgaatttctcgatagtatcatctgtaaaatgggaagatcttattagaaaggcttgatagaataagtacttcagatttctttgagacaaaggggttatgcaaatagaaggggctaaacagaataaattattgtgtatcaacagtattttatctacaaagcatttaatttggcattatggatgttaccatactgctgctcataatgaagagagcattcattatatttctagatagagatacagattaggggatggttgtggaggaactcattctctgtttgaatagcatgtaagaaaaataaattttaaataagagaattttacaaatattttaaaatttaaaatgtttatttagaagagatatattttagtttttcaaactgagaataatgctttaaatatgttcttaattttaaaatactgaccgtgaaatttggataacaaaccaagttatttacttacttgggaattatataaaattattgaaatgttttaaccaacactttattatttgaaaatgaatatatcacctgtagcaactatttgcagaaaaataaaattatatttaaaatcacagctcaaattaaatcatgcaattgcattaagatataataaaagcaaaatggatcattttaaatcaatctataaactaaaagctcaataccaatttgaataacatgtttttacttaatttgagccaattctgatgatattaaattaggtttgagaaaaacagaacatttgcaataacattttaaggtgatttcatcacttgagaatttttttcaaaacttaaccaaagaagggccaaggccccatgcctgcccctgcagcccctgccgcagcgagtcctcctccactgggtgagtgaagccttcccccctgtggaatgtgtcctgaggcagcggtgctcctgggtagaagcacatggaggcaggtccccccctcatcacctggcctccccaggcacagcaactgtgtctggctagacttttaaagtttttatttccagaatcagcacagccctgggcacatagcagaggggcaataaatatttactgagtttaattcagtacagcagggcagacgcagggatcccagagccaacacagggaaaggctggcccgtgtcggcccagggagtccctctgtccctgtggacatgggaccagcctgtcctcatgagggggccgtggaccccaaaggctctgtcacagaacaccaggaacgtcagtcattgcccagctgaggctgctgttgctgtggttattaagagacagaaagcgcagtccggcgcccagagatgaggggctggaaaagccggggagataagcagcctgctcccgctgcatggcggggcgtgggcccctgctcaggtgcaggagagctggggagggtgcctgagctgctgcgggaggaagccacagggcggggcgggggtctgtgtgaggccaacactggacctgggactgcgggccagggagcccgctttccagccctgaattccccgggacctgctgcataattccccacgtagtttggtgcaaggaatgcttgtaggttgtgctgttgtgttgtattgtgctgtgctgttttgttgtattgtattgttacactatgttgcgttgtactgtgctgtgctgtattgtgttatgctgtttggttctgttgtgttgtgctgtattgcgctgtgtgttgtgttgtgttgtgttgtgctgtattgtgctgtgctgtgctgtgttgtgtgctgtgtattgtgctgtgctgtgtgttgtgctgtgctgatgtgctgtgtgctgtgctgtgtgttgtgttgtctgtgtgttgtgtgctgtgtgctatgtgttgtgttgtgctgtgtgttatattgtgctgtgctgtgttgtgctgtgtgctgtgtgttgtgttgtactgtgtgttgtgttgtgttatgctgtgttgtgtgttatgttatattgtgctgtgtgctgtgtgttgtgttgtactgtgtgttgtggtgttgtgttgtgctgtgctgtgtgttgtgttgtgttgtactgtgtgttgtgttatgctgtgttgtgttatgttaattgtgctgtagtgtgctgtgtgttgtgttgtactgtgtgttgtgttgtgttgtgctgtgctgtgctgtgttgggtcctattatattaagataaggtgcacagggctagttcaggcacacagaaagagcaggccaggcagggaacaggcagccccactccctcccccagactgaaaccagaactgtgagggaccctgctgggccacactctggctttgtcatggagccattaggaggcctctgcggggcacaccatgagacagaatcttgacgtagaaataggcccacagctagtcccacctgctctgcctccggggccgggttatgattccactttgtgccaacccttgctgcagtgtggatttgactgtgttacttgcttggatatttgaaatatacaaacctaggaatttatttttgataatcagaatgattggtgtcagcacagtgcaaaagcagcaaaaatagataatgttatatcaattatgtcacccttccctggtgacagggtggtgcctcgggacccacctcaacctggtccgtgatgcctgtggtttctcaaactgtgagccaaggaaccccagagccccacaagctcagcatagctttaaattctgagggaaacagcaacgccggccacttcccaggccctgtgagctagctggaggcagttttagacttcacttcccaggccctgtgagctagctggaggcagttttagacttctcttcccaggccctgtgagctagctggaggcagctttagactcccagggtgaacttgcagctacactccctggatgacatcatatctttgtgaaactgggttcttggcagttgctgtgtcaaaagcaattcctgtgggaaaagtgcagaccaggaaatgcagggttgggcggaaccagaggcaaggctggagaggccgtgcggctcaagacaggcacgtgcagaccaccagtatgcaaggctggtgtgcaagaagtgaggtgaaaatagtattctttatttcagtctatatgtgtcactttaaaaaatgactgctacgttattagaacagaaatatatatgaagttgtttgaagttaactatttaacaaacagaatagttaggcatttcagcttggggcactgtaaaaaatccctgggggtgctaagggtgttatgaaaacctatactattcaaattgatatcaaacttgtagccaacagattgatgtaaaattatctatttttgcctacattttgtgtttatgcaattataccatttaattgaagctgtggttttgaatacaattttagctttttgcaaatagttgctacaggtgatgtgttcatttttgaataataaagtgttggcttaattattttaagaattttatataattttccttcgtgtggataatttgctttgttatccatatttcatagtcggtattttagaattgagactacatttctagtagtattctcagtttaaaggctgaaataaatttttttttttaatgagcaagaaagcttttacgttaacatcttactcagattaacataaccaaatttaaatctatgcaagtcagacagaattagagatggcagaatgctagcatgtgcgctcacgtgctgaagaacttctaaaccgtgtccatcagcttgtcgcctattttggtcacagatgctccccatgccaggatttctacgaactttctaaagaagatgcttagtctaatagttttgaccatcagcaaaactgctctaagagttaccctagattctacctttctatttcattaactctcctagaaacaattctgttccagtacattctttctttctttctgggttcagagttctcttctctctaggaaaaccatcaggttacacagtgtttgtagttccgaacgtcacgggcggttatgagggacagttgatgtgtcccaccagcagcaagactgtgaattgtacatgacggtgacagaaatgaccagtccagtccatgtgcaaaggcaggagtttacaaagtaaaggggtcagtactaattgatcactggcaccctgaaaccacaacttttcattcacctttttatttttttgaataattattttatcttatatgttcatcaaatatatatgtatctggggaaaatgctccctttgaaaatgataacttttagttatacatgttaaactacttttttgagacaggatgttgctctgttgctcaggctggagtgtagtgacaccgtaactgctcactgcagcctctggggcccaagtggtcctcccacctcagcctcctgagtggctgggaccacaggcacacaccaccatgcccggctaactttaaaaaaagttttttttgttttggctgttttttgttgtttttgtttgtttgtttgtttgttgtttttttttttttttttgtagaacaatgtctctctatgttgcccaggctggtcttgaactcctgggctcaagtgatccccctacctcagcctcaaaatgtgctgagattacaggcgtgagccaccgcatgtggccaaaggcattctattattttaaaatttactttcttatttttttcttgttgagtaaaattgagaaagactgaggaaaatatggggcagcagtgagagaaggaagtgaacgagagcaagaaggtgatttacattttagccagtatttcactggaccccaatttgagcaaaaaatgaaagacatcaggcttccttacctgttgttacccatgctcagtgaaaaggcataaaaataaccttcgacaaccttatgcctattgaagtcagaaccctgtagtgtagtcatttaattgcatttgtattagatgtgattaaatattttagttgtatgtattcatcacaatgactggacgttagaaataaataattcaggccaagaaatacatggaacgttaaggaagttattagaagcaagggattacctacaagctagaagtgaatccaaagcagggtcagagatgggtcacattggaaagaccaaatgttagaaagacaaggagattttggtgatgaggccaccctatccagagagatgctgctgcagagttgatcagggctggaaagcatggatcaaagatgaagagcaagtgttaacagcctctccttatgctttcaaaggattattttaggaggattaagttaggagactttaaccttcccatgtgtactaaatggggcctcactgtgttagtttctgggggctgccgtaatagtaccacaaactaggtggctttaaaaaaagaaatttattctttcacagctgtgtagagaagtccaaaatcaaggtgatggcagggctggttccttctgaagttgtgagggggtcagtgccaggctccctccagcttacagtgttgctggcatcctcagcattccctggtttggggacacgtcaccctgattgctgccttcaccctcacagggcttgctccccgagtgcatgcatgcctggttcaagtgccccttctttcaaaggacaacaggcgatggattagggcccactctaatgaccttgtcttgacctgttcatctgcaaataccctatttccaaataaaggcacattcaaaggtgctagggttaggacgtcaacatttttgggggaaacaccattcaagccataatgggtggtgattgataatgacactgagttttcttgcctagtaaatagtccatattctaaaggccttggtactgctgaaaaaagaagtagtttagtgtttcatgagcttttgaatacccttactatcccctagacctgtttgcaaacaggagcttttaatacgtattcctaccaactggttaccctctcaatgaccttgaatctatcctgaattaatcacctacatcatggcactgtagaagccacagcaggtcagaggggacttacttcttgttgccatgttaagacagcatgtagtggccactaatgtgaattctactccaaacaacacggtccctccgttacagcagaaaggaaactgaataaccctcagatgccacctgggagttatttttatttttactaaaccacctttaccccttcggaagaatgcagtgcaattccatgcagttcacataatctcatactatccccactacatctctgagatgtatagttattcccctttttatagagtgaggagactaacaggggttaagtaatctaccaaagggcatattatcaatgaacagaagattcaggatcagcccagagctgacagactctaatgctaataatataatccatatgaacatttctttagaaggcaaacagtatcataggctcccaaggaaaacagcagacccacgctttgttcaagcccatcccttggacccattccccagcagcagcttcatagaattcttttggcattcttctcacatatttatctccatatttctggattatatgtttgtattgcttattcttgatttattaattgtagacatcatctattcagaccttagcaggactataaagctatggtgttctttcacattctttcctactcccgtctttcccaaagtaggtacatcattggattttgttaagtgaatgccagtgtttaccttattttgaatgtagaagtattgttcatggctgagcccagtggtaaacaataacatttccattcttgggaaactgttcttttacctaaagtttttaatggtcttgttttgtgagagttgatgttgttcatccttcggttttctacggtcctatcacaaattctttccaaattctgcatccgtattagtaaacacctttaaatagtatgtcctgcaaggttgaatacatcagggacttcatcagctcagcttcttcttgcagccaggcctggggggcctctgtccccttgctgcatggtggttattgtcacatttcatgtcatctctctgccacggatctcccattttccatatccatgttttttcttgctggatttcctttcttgttttggtaagttatgccttctaataggctgtacaaccctagagtgatagtttagctaggtatagaaatctagattaaaaaataattttcccttgtgattttatctccaacacatgatgttgcttttgagcaatctgtactatttgtgttttacaccttactgagggatacttgatatgcaataaactgtacacatataccataaacaatttgatacagcttgacaaatatatatacccatgaaattatcatcacaatcaagataacaaacatatccatcaccgtcaaaagttcacttcccttctttgcaaaccctctctcttacctctttccacctgcaaacaaccacgaatctgctttttgtcagtatggattggtttgcatttattagaattttgtatacatgggattttatagtgtgtgctctttcttgtctggcttctttcacttagcataatgattttaagagtaatccatatatagcatgcatccataggccattccttttatgggtgagtattctgctgtagggagagacagttgtttatccataagtaatgtccttcagtcaaccagccacatctccagtgctgagtcgtcacagggggctactggcaatcatcttgatcagtacgacaaatagtagtgccatcattgcaaaatgttctaatgagcaatattctaacattctatagttttagctctcacatttaggactgtgatgcattttgaattaatttttgtatgtgacatgaagtaagtgttagtatttttttgcatattgttactcattgttccagtatcattttttgaaaagattattctttacccattaaattgccatggcacctttgtcaaaaatcaattgaccatatatgtgtggttttacttctggactctttattattttacattgatctattgatctatgtttatgtcaataccacgcaatcttaattactgtataagtcctaaaaacaggtagtgtaaatactccaactttgttaatgttttttcaaagttgttttggctgttttatgtactttgcatttccatataaagtttggaataagcttgtcaatgtctacaaaaaaaaaagccttctgcagttttaattgaggccttatggaatctatagatgaattttgggagaaccgatatcttaacaacattgagtcatcaatccttcaacatgttatataatctccacttatttaaatcttctttagtttcctttagtcatgtttttcagttttgagtgcaaagatctcatacatcttttgtcatatttatcccaaactattttagttttggattcttgccatggacatcccgtcatgtgcaaataaaggcatttttatttcttcctttctaatctgatgtcttttttttttttcttatcttattgcactggctagaacagcagtccccaacctttttggcaccagggaccagtttcgtgggagacaaactttccacagatggggggttgtggggggatgctttcaggatgattcaagtgcattacatttattgtgcattttatttctattattactacattgtaatatataaatgaaataattatacaactcaccagaatgtagaatcagtgggagccctgagctcattttcctgcaactggatggtcccatctgggggtgatgggagacagtgacagatcatcaggcattagattctcataaggagcacacaaccaagatccctcgcgtgtgcagttcacaacagtgttcacgcgcctatgagaatctaatgccatcactgatctgacaggaggcagagctcaggtggtgatgtgggcattggggagcagctgtaaatacagatgaagcttcgctggctgcccacctcctgctgggtggccttgttcctaacaggccatggacagggacaggtaccagtcaatggctgggcagggagctgcgattcctgggctagaacctccagtgcagtgttggagtgaagtggtgagacctggcattcttgtcttattctttatcttagggaaagctttcagtctttcatgttaagaatggcattagctggctcacacctgtaatcccagcactttgggaggctgaggcgggcggatcacgaggtcaggagatcgagaccatcccggctaaaacggtgaaaccccgtctctactaaaaatacaaaaaattagccgggtgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaatctgatctatggtttttctatgcaaactattttgttgtctgtttttattttctctttttattactggtttttgaagttgcgtgatgatgtgtattgatatcttttttgatttcctgtgctgggaatctgatgtactttttccatcttgaaagtcatatccttcaattctgagaaattccatgaattgtttctttaaaattttctctatttttctctggtctttctttctggaattcctattagagatcacatcttttgcatcatcttttgatttttatattgtttctctcctttctctctcttgctcttttggctctgttttcttggatagtttctcacatttatctttcacttatttcattgatttgtttttgttcaacaatcatatttttacattccaggacatattttgtcctctgagtttttcttatatctttttggtttaaatactgtgctggtttcatttcatgaattataatatcctctttatgagtttttatgtaaatgcctctacttgtcccgaatggctttggctgcttctgaatccctttacctgttaattttggactcagcctttcatgtaggggctttcctctaatgtatgtttattctttttatctgttaatatttttaaatgaggcacaaaaaagctgattggaagctttgggaggggctgtatgatacctggtaggtttactgcagcctgaaatttgaatgtttcattgcaggaatatccagatgtcagttatgtgtagttttggggatctcccctcttcttgaatccttttgtttctctagagaaaaattttgccatcacctacaggcattcttgcaactgcacagaagggacggagggacccccagtccaggacataagctctcatgtaacaggtctgttctcagggcagcccttctcccctcccatctgctacgcttactgtctcctcctctactgcctctctcattccattttctgtaaatgaatctgctgcgttggaggaggggtcgctgccggtgtgctggggaggggaggggacttccaagtctggcctctctcctgtggacttcagactccttttagttctatcatttcagacactggaatttcaggttccgggtcctttctggttctgtagtaagattagcatggttcttatcatatcactcactttaggcattgcgttggctttcttaggtctgctttctctttatttctgatctccaaaaaatttactgctgttcataagccagtaaagcctcctctcctttttgatactatttaattttcatgtgagtggggttacaagaaagaaaaaaatcaataaaacacgtgttgaaatcgccaggtttaaccaggagtcccctgcactgcagtcatcatcctaaatggctttccttggcgatgctgcccccttaccagaaacctagagaaggtctcaggaggtctcgcttctctggcttgtagtccatcgtaaggttttgcattgctaactggaattttctcctttatcaggtcttggacattcactgttttctctcaccaaatcctctctttttttcctctgtctccctgtgtccttgacccttatggaaaaccagagccagcttccgttcctcagcctttcttctctaaacaccaagttccaccattgacagaacactgagtcctgcacagtcacatggacacgagtaaggagagttcagaggctgcagtggagttccacacgaagcacaggaggtgaaacccctttttcctggctcctcaggagacatgtgaagacaacgcgattagaggtccttcaggcacggatagggtttgtatctgctgaatcccaatccatctcacatctccatctctaaatgcgcactttcggatatctgtgaataccccctgtgaagttcctggttggcagcgggcggggtgtgcagctctgtgtccaagtatgaaatgccccaatgccagttgcaattgttttgattttggtgttagagtctaatgttagctgtgaccccttcctttcccttttcatcttgaagagactgtcttcatttgaaatagggaaaggaaaggagtgtaactctcataggagtgacgggagccaccccacactgaagctgcggtagaaccttgaggtggaaccatttctgcaaagggtgttcttagaaatagaaaccacagtgctaaacaccaccaccacctacagccccagcaatgaggccgatcaccaggcagactccggcagatggggagaacacagccacagagggatgccagtccctacagacagcaatgaggccaatcaccaggcagactccagcagacggggagaacacagccacagagggatgccagtccctacagacagcaatgaggccaatcaccaggcagactccggcagacggggagaacacagccacagagggatgccagtccctacagacagcaatgaggccaatcaccaggcagactccggcagacggggagaacacagccacagagtgatgccagtccctacagaggacgagatgatctcagtgctattacataagcgctaacagggtgattattccacctagtccacgaacatggaattttatctagtggccagagatgtccaaagaattgccacagaaagcttttcacagaattattaagtgattcatgggccctattcagaaatgtccagaaatagaaaatgcacgtggtatttataaaggggttaattcattaatctcttctctatcacaaaaaagtaggctactgctggaaccaaaggtccccaaaataaagtcaatgaaactattgtgacccaaaacttagagacgttctttgagcatataagcgaattggactcagggacccaaaaatcaaacaaatactgaaaaaaaaaaaaaaaaagcattttatggcaggccattgtataagtgtcagaatttggataaagaataataaggaaaatttttttttcttctcaaaatacacatacatagctatacttaaatataactgtgcccttcttctcactggtacataacatatacaaaaaagacaaaatggaattatggctggtattgggactatttagatgattcctatataatctggaaaatgtgtatgatgtagcatttatagggcacaaatacaccattgtgtgatgtgtcttccactattacaccaaaagcacaaaacactacaacacaaaacaatttggtttggcttttaaaataaaatgaatttaattaagcaaacagacaaaaaaatccttttaaatataaggttggaaaaatctttctaaaattatttttatagacacaatatcctgcagggtttttagtttgaagtagaagaaacccagtggttcaatgagaaatggatgtgatgaaacattggctctggcaggcttaagaggtagcttgccaactcagtgttgaaaaagttgatgacaaaaggttcctgaaatcaaattttcctctttggactccttctagaatgcctccaagtctgattttcataaaatgaattcaggaagccaaatctgtctttatcctatgttattatgtgagagaattttccatgacctcgaagggagaacacacgttttggtgagtttgcgagtgaaaatcttattataatttatttccaagagaaaaagacgaatgatccagaatgtgctcacactcacacgtttgcctgtgaaatgtgtcctgccaacacagaagcagggcgctcagctggaccaggggtctcaggccacactcagttcactcgtgtgtggagcaagtgtgttcagagacagcatccctaaaacatctctcgcctggatttgctcactcaacaagtaaataggacctctgtatcctaagttctagtacacagaaacatgacattttgaatcatctgagaaatgcagtttgcttttaatagaataaggaaaaaataaaaaactttttttctacatttaaaaacagcataggccgggcacgatgactgaagcctgtaatggtagcactttgggagactgaggcaggcagattgcctgagctcaggagttagagaccagcctgggcaacatggtgaaacccagtctctactaaaatacaaaaattagccgggcatggtggcaggcgcctgtaatcccagctactcaggatgctgaggcacgagaattgcttgaacccgggaggaggaggttgcagtgagccaagattgtgctactgcactccagcctgggcgactaagcaaaactctgtctcaaaataaaaaaacaaggagggaaggaagaaaagaaggaaggaaggaaggaaggaaggaaggaaggaaggaaggaaggaaggaaagaaggcaggcaggcaggcaggcaggcaggcagttcaacaccaacaaaagttacaaaaagaaaaattagataattgtccacaccatgcatgtaaactcacactgattgaagtggcaacatttggtttgaatatttgaatattttttcagcttttcttaaggcatactcatgtatcagaattacctaggatgtttccaaaaaatgtggatttctgagtcccacccagtagtagataaccatattaaataccccttaatctgggggtgggtgtatcttagaaatctttattataacaaaccctccaactaactgctttgcctatgaaactttagaaccactgagttcagataggtccttcacttctttcctaacatattaactaatgaaatgaaaaaaaaaattcacacctgaatttccctagtgtataaatttcttcttatgcagtcattgagtcattccaaactctggaagttgagttaattatttcaacataccaaaaaaaaaaaaaaaaactgggccaggcatggtggctcccatctgtaatcccagcactttgggaggccaaggtggacagatcacctgaggccaggagtttgagatcagcctggccaacatggcaaaaacccagctgtactaaaaaaaaaaaaaaaaaaattagccaggtgtggcagcaggcacctgtaatcccagctactcgggaggctgagacaggagaatcgcttgaacccaagaggtagaggttgcagtgagctgaaattgcaccactgcactccagcctgggcaacagagtgagaatccatctcaaaaaaaaaaaaaaaaaaaaaaaaagatttttacaaaattgactttaagacctcagagctgtgttatgaccacttgaaatttggctactgctattgaggaactgagtttttaattaaagtaaatgtaaataaccacatggggctagtggcaggcgtatgaggtagtgcagacattgatcatttccatcatcacagaaagtcccatcaacagccttgtcttagacaataaactgcagtgcccagtgctgcccagctgattttgagagtgcctggatatgtgtgtgaagtccctcagcttctttgcaggaaacatgcttgagtcaaacgagggattactcacttacattgtattttatttacacgagacaagctattttgtatactgcattgtgtttacggatgagacaggcattgtaatcagaaggtttatagataaaacggaaatgttcatattcaattgcatttttcagttctagagttctcgtgtgttttctttccaattgtttttgcttctctattgatatttcctattgatcccacaatatttttacattttcacttaaatctttcaacctatttataatggtcgtgttaaagtccatcgtctttgtcatttccagtcagtttcttttgactgatttttctcctcacatttttctcacatttccttgcttctttatatatctggcaagtttttattgcatgctggacatagtggatgccagctttttgaatgtctgggtttcgttgtcctcatttgaagaatattgaagttaatggtggtaggcagttaatttacgtgcagctcaacttgatcctcttaaggcttgattttaagctcagttagtgaatgcctgcagtagtcttgactctagggctagagtaaccttattcctaaatcacgtctgctccaggatattaactggagtgcttggtgtgttcaacgaggtctctccatactggtttgttggtcctcattgtcttccagccccatgccagttctggaatttctactcagctcctctccctggtagttggtctttgtctgctgttttggagtcttgccttagcaggtagagctgagtattcaaagatgccagcaggcctccctgtggatttctgaaacttctcctctgagccttcagcctgtgctcccctccagctccactgcatctcctacacttctcgacctagcaggatggccttgtcctgcccgggctcctctgggacctgctttgggaaggctcatggcaggacactgggcaatcctggggctcacctctgttatggcccttctttcagggagcacaggcctgcactcttattgtcaagcatctgaaaacactcgtttcacacattttgtccaactttatagatttttaacagcagaagttctagtttgataccagtttcatcatgaccagaagtagaaatgcacatggaaattaactgtcacagctaaaagaacagtgagaattttcaaacagtttaaacagtagatctcccactaaaagaaatttgcctaagaggacacagtccagataagtcaaatatacttaagtagagacggttttcagaatttaacagaccagtaacttgttacataatttcatcaagttctggacacatgtccactgtccatttataaatgaaatcagaagaaggacctcgtccttgcatgaatatggttcacgggactagaaagcaagaaccattggttcttctggatccagggcacctgcttgtataacttaggcgacactttgctccctgtgtgccaaggtaccctgggacctcacagcaagctcacaggggtgccaacaacattgatattttcaatgttcaagggaaacacagtgataactgttgtctgtggacaccgcacaaactagtagcccgatatggttcatggttccatatgagacagggctacaaccctcatggcagcagccttgtctctgtgaatctgggttttgacatttgctgcagtataaaagcaagtaccccacaaaaatcaaagcagaaaatgaaacgaaggtggcagctgcaaaatctccttccaatggcaggcacacacatgccattagtaagaaattatgattattaaagaatttaattacaatctcactcttctgtctctctttttggaattctttggaaaaaaaaaaaaagagggttatttaccatgcagagtttcccacggtctgggttgccaattgcatccgtggtatcctttatcattgcctcttccgtgacttttctgggaactgacagttggcctcagagtcctgatactgttcaggtttgattcaagggcaaaagggaagcagcgtgacttccgggagttggtgccattgagggttaatgcgtgaatccattcgttaattaggagatgcgaaatgctttttcaaattctatcattactgtaatgtattagctataatacttctacaaaggaaaaaatatgtcttcttgactattaggttacccagtggtagagttagtacagaaaccagaatgcacatgctacaatctttccctttacttaccagttttcaaaataacgaatcagttccttatatgcactgtattttgtgcatttagaaacattatcctgagaaggggttcagaggcttcaccacagtgtcaaaggggctgatagtgtccatggaactcccattttagactattccaggagtcacagaggtcaatttgacatcttgggcttacaacaaagatgttcattttaagccatgacctgatttaagtaaatcaaatttgcccttgggtttttgccaatgtcaaccctcccagagtccactgctgttcaacctcttctcttctaagtcccagtggatctacagagtgattccaactgatcgcttcctttgtctccacagcactcaatctttgcatcttggtggttggtgaaattccaccttagttgtactgtgatctacaccgtatgtagaccctacagtggtagctgtggtatagggatactgatttgaagtcagatgatctaattcaaacgttgactatgctacttactagctttgtaaacatgaagcaaattgcttcacgtctttgagctggtttcttcaaatggaaaatggcaaaaatgatatataacttgaaggactgtgagaactaaagaaggaaatattcttgaaagattgagccattagaggttctcagcaaatatttgttaaatctgattctcagttcccaaatgcaggggatttgttcattagatctttggtactggccatcgtagtaaaagaaaaaaaattattgcactgtgagatagttccgatttagggctgtaagcgataacacattcccatccatttcagcaaactctctctctcccttcctctctctccttccttctccttcccttcccttctcttgttcttcttcttctctctctctgactcttcctctgtgtctctgtctctctgtctacctccgccccatatgtgtctctctcctagaggcgcagggctgagctctgacagtcagagctgtgtgattccgaaatgctcctgagagcaagttacactccactcacggcacagctgatcttccctgggctcaacaaggctgccccagtgaagacattcaatgcagttggcttctcaccaccctggcttgaaatggccacatcgggctctaacctcgaatccagtagcttctgtactgtgtctcagccatccctacaccatcacggtccatcccatttggttagtctgaaaaaccagtgatgtcctcagcactccccaggattcttttttgtgcccctccctggtcagaaagcacgtccatttctgagaactgcaacctcctccagccattcacccaccaggcccttctcttctcttccagatggcttggcatcttcttccgagcaagcgcagctctcaggccgggcctgagcctgcagcctgtgtgccctccatcatcagggccccctctcaggacaggctacaccgagggtgggacggcggacttccagggacacttccaagtcgtgcccatgcaggtttggatattactgttcctaccgattccctgtgtctccctgaacctgtttccttatttgtcacaagggcatgagaaacactcacctcagccttgttaataaggataaataacagattttttctttttttttttttttatttgagttggaatctcaccctgttgcccaggctggagtacaacagcgtgatctcagctcactgcaacctctgcttcctgggttcaagctattctcctgcctcagcctcctgagtagctgggtttacaggcatgcgccaccacacccagctaattttttgtatctttagtagaaatggggtttcaccatgttggccaggctggtctcaaactcctgacctcgtgatccacctgccttggcctcccaatttgctgggattacaggtgtgagccaccgcgcccagccaataacagatttaaagtgtctcatgcctggtatgtgtcagcaaccgtcagaaacttaacaggcagcagcccccttcctcctccctccccttcctctgtccagggaaaggttctccctcgagtttggtctgaaggcactcctcctggtcccacgttaccctcaatagtgccccacagctccatggtgaaagcccagctgtggagtcacactccttgggtcaaacccaaggctgacacttactatgtgatttacaattaggaaaaggagacagggctcctatgaagattagatgaggttgtgaaggtgcagacagctgggctcctggtgcacactgtgttcttattaaacactgtggtcacagttgtccattctctgggatcctcagtgcctcctgccattggcctcctctctgcactgctgcagcccccacagcactgtagctgccctcactccccactctgagctgagctccttgcagagctgtgttctctgagcccctcctcctttccggtcctgcccctccactccccccggagtcatcctgtgagggctcacaaaggccttttacttctccccacacaatgaacatgctgggaacttccaccaactggacttcctatggcctttgagataagtgatagttcttcctccttgaagtctctcctcccttggtatgtaactccaagcaagctatactcaatgtacacaaaaccatttagcatctgtcatggtttctcactgtctgtaggatgacgtctaaactctttagcatggcattcacatggcttacgatatgattcctggaaaataaggttctggtcttattttctctgttccttcataggcaccctactccccagcaatatcaaaaaatcttgcaatttcccaaccccaacatcttctcctacaactccatgcatttttgctcatagtacattccctgccttctctgccctcaagcagaaaattcctactcatcctttaagactcaatccactgccaaccttctcagagaagcaaggcctcctggagccatgcagcaagggactggcagaacagggttctactaggttctccgagccgcacctgacctgcgtggagccacctctgcccacggccctggagtgtgtcagtgtgcacgggtcccacaaatcctggcacacataacggtaaagacaatagcaagcgtgggtgccgtgctcactctcagactgaggccaggatgtttccggatcattctctgtctttgagagcatttccctgaccctattctagtccccacacagacagttccaaggcctgagaaataagctgagttctgagctcagccgcgatcccgttcatggtaagtgaaagtgaaatgtgatcattccacagaattagagactggaaagagcttctgattttggaagaacaattttgtaaaatggatttgtatgcataacatccattgcagttggtgacggtggagtcagtgactaataaaaatgtcatttcctgtgatttttataaattacagtaaatatgccagtaatcacccacattagctgctaaaatgcaggcagccagctggaatagaggccaggggaccccactgaggcctcaagagggagaccccacaggtacaaattgacacctaggcaaacagtagttaatacatgctagaatttggagaagggtaaagtgttaaaataaatgtatgtcaagcagacgaatttggacttctccatgaggatctgtcacgtcaaacaggaaatcgctataaattacttgtaatagtaaaaatcttgtcatttataacctttaaggcgacgggctcatttaacacatcaactcacagatcataatctaggcgagtcggcctgggtatttatttcacttttaatgtgtagaagctggggcaagccatgcatgagctgcgaaagccctcacagtgccctgtcggctcctcaagccgtgggacaggccagagagataactgcctgaggcttgggggatgaacacatcaagataggaaagcccttcctgctcctgtaaaaattaagacatgcctgaaaatgtcatgccttggttagtctcgtaatgaataaatccaaataaatcccaccattattctgtttatttgttttacttataagctatttgaagtcattggagctgaaagtgtgtttcaacacgccgagcacatttagagtatcttgtaatcatcttgctaaccagtgcacaggcgaatgatgagtggaattttgtgtttatttcagatacctcagtatacactgcccacagttaagaaaccacgacctgagacattgttttgaagaggtgaaaatgcctccactcaagtggcccaggagcgtgatccaggaagacgaacacacagaaccatcttctgcatggtttgaaaattcagtggaaactaggtatttatgaacgagatgcttactgcagtttgcatgcactgagtagacatttgtggattaattcatctagggttgggggagaggttccaagaggagggtaagaacaaagaacagacacaggcccagctgaccattcccttcagtgagaaaaagacccgcaggcagagttgagcacgcggctcacattcgcacatgcttggcatcatgaaccgtaaggaagagcaaagctggtttccagaaagacgttaactcacagtcgtacttctctccacttcccttgctcctctccctggcctctctacatctccctgctctctcctgcaccagggcttggtcagtgcttaactctggcaggtgccacgagtgctgcctgctgcagcttgctaggattcagatgccactcatgaggcatgggcaagtgtgagcacacagaaacacacacgcacacctgcacaggcacgtgcagcctctgtggggcatgtttagaactcctgggtctgctggcgggtacctttccccctcgtgctttccacgtgcagccaaggcctacttctattgcagtaaaaattagtctccgtgtctgcctgtctgaacacaagctaacttacaaggaaacatgaaatttaattttaaattgaagttaaaaattttccattagacttaatttaaaaatttttagcttcattttaaaatttaattaaattagatttaactggttccttgaaaattgctgatctctctctgaacgtaatcctattttcaaaattatggttggttttcttagattgatagggtcctcagtgtggggagggagaggtatttgaaggtgaatatgagagcatctacaggtaaagagtttaggcacagtttagatcatgtagagaaaaatctgtcatttagggggagaagctgattcttggaaccaaattattcaaattaaccatatccaatctgcagtgccaaaaccaaaaccaaaccaaccagcctaaattgttcactttactttggcaggcaccaaatatgcatatgtgtatcaaataaagtgaacaattggagttctttctctaatttagataatttctggaaaaaaaccagcaatccacatcttttgcctcaattgctagattattactgatgagagaatatttatgtttttaacttttctttctcctttgggtgaggtggctggaatggataaatgtttcaattctgcatttctaaactctgcatatctatagagtcgtgttgcatgtgttactcacatatgattattgacacatttattaatttacaacaaagttaatttctatggaacaatggataattttgaaaatattctggataaaatgttacaaactcattattcaatgaactcaacaatgcatattgtatttctttggttctaagacactcattttaaatatttttatcatctctggaatctaaatgcaccattaccatcagcggcaacttagaattacaattggcagagttttttctttcatagcagcatgtaaaataaagatgcatcttataaatggcatcttaggcttgttgaaatagaaaaagtgtgtgtgtgtagaagtagcctacagataatttcttgtcccgatggtctcaggggtaaaaaaaattgtttgtgtcaaatatcagctattcttccctaatatttctttatgtagggattataaattataaccccaaacttttgcataactatttttattctaaaaacctcttgtccttataatgagtggttcatgctagtttgcagtgtgtattcgacagagaatttctgttgctttgtcccccgctcccatcaactaaaaaaaatctacaaatgaaaactctaggagaccagtttcccattcggtaccaaagctaaaaatgagttccctcaactcctcaaaaaaaaaaaaaaaaaaaaatcaaagttagtaccattgaatggggtttagctaatcttataaatttttaaataagcatgcccacttgcaaccaaatcctgtgctacatttgtgcttgttctctgggaagtttagaaggcaatttctgtaatgcagaaaagtctgtaccactgacctcccagccacgccacaagatatttctggtctgaattctttctatgtcttttctcagagccagaagtcttggagagcattgagaggcaattgtaaatattaagtcagttggaggtgatgtgggaatagtggagggaagagaaactatgtttagtgtttttttttttttttttttggtggggggacggagtctcctctgtcgcccaggctggaatgcagtggcgcgatctcggctcactgcaagctccgcctcctgggttcatgccattctcctgcctcagccttccgagtagctgggactacaggtgcctgccaccatgcccagctaattttttgtatttttagtagagacaggtttcattgtgttagccaggatggtctcgatctcctgacctcgtgatctgcctacctcggcctcccaaagtgctgggattacagacatgagccacggtgcccggcctagatttctttaaattttaaatggtcggggttccagaaaggaaaatcatccatattagtgctacactagaacacctattcttaccacaagcatgctggctgtggagcttacagagacatgtgcacacatacatgcagtgaatatctaaattttgtttcctgacagctatgccatttaagagttgaggttgatatttcttcactttcagccctctgctctctacctcatctcattctttctgggaccatcctatatgcacgatttaaagggaattacctattacttcaattatttgtttcttatcaactgatgttaaactacaaggatttgcattgaaaagacacaaagaaagagcaagccatggcacgtcgccagatgaaagagtaatgttctggtgaatttaacctaaataatttactgctatataaaagtggaaaagtggaaggtgaaccctttgaccaataaatctctcctgcccatgaaacccttatctggtctcctccaatgtattccacacgcggaagccatcatcacgggctcgggcttgtgatttgtaaaccttgatcttctgcactccgtgtcctaaatatggataattagcatcagtttatcacgcctctgcatattttctcttctctccaaacatgcatgcttctgttggctgccattctgctacagaagattatggagacagattgcagagagtgaatgtgctaaacgagattaggaaggaatagaaatagcaacttggccaataaattcctcgtgagagccttatcatgcaattacacgttgacttgcttcacactctcccagcctcttaatccaacacccccaccaggaatgaaatttcactaatttctgaattactgcatatcctcctgacttgttactgagagtggttggaaggagaaacattgctgaaaacaacatgtaaaactttatcataaaaagcaaactttaactgtcaaaatgggcggtatgaatttggagtgtttaaagcatttcagcgtcgacgaatggatgcacaaagtcttggcatagagagagattcaacttttctttgagattcaccaattctgccattgtgccacctttggggattcagaactggctgggggtgggggtgttccttgctcttaaacgggactatctgatgtgtttaaacacaggacaaagcacccactgatttttctgacttctcattattactgataacagtcgcgatgcctctgggtaattctgcgcaaatcacttgacctctttaagtgtcacctcctcctagcttaggtgcaccccttcaccaccacagcccctcccggcgccagcgtgctgcagcttctcatgcacattaatgtacataaataggaaaagtcctgcctgttccggatctccaagaatgctgtaatagggcatctacagggggagctctcttcttgctcttctctgcctgttaatgtgattctcccagggctttataataagttaggtatttaaagaggcccattaaacctttcgatccaccaggggactatttatagcacagagcagcagtcagacattgtggtgcccctacaaaagcaaggttctacagcaggagaaagaaaacctggcaggcctgaacgtgtgtttactagaaggaatggaaatctagctcacatattaaaacttgtgcttaatatttgtgcttgcagaaaaggaaaggagtccaattcatggtggcaagaattaattagcaaaagaaatgcacagcgattgtaaaaagagttttacacgtagatcataatgttgtcttcactttctttcccacaagtaatgcctatgcgggttcactgatgagagggccctatgagccatccagagaaaagctgccatatttcccttccagaagacctgcttgcaggccttgaattttgagaggtaaaactggacagcattcacttgatgaataggtattgagcatctcctctgcacacactgccatgcactgttgcaggaccatggggtgaaacagcaggaggaaggagccctgccctggaggagctggccacggggagaaagccgccccgatgttgttgcccacctgcttgccttctgcaagctggttgcttttctactggctgccaagaatctccttttttggaaagaaagccagcctggaaccctcatttaccttgattgggagggagggacccaaggcctgggaggcagccctgggaggcactggtctgaagggctagacccttggtaagaacctctggaagaacgcctgtcttccggaaccagacagggaggcgtgcaacggggtggggtggggggtactcccagctgcaggcacctctactcctaactatctgcaagaggacacacacacacacacaccctgggtgtcagagaagtcctcccttccctgtacctcctccttcccaagcccctgaaatccagaagtgcctgtttccaggcgccagccctgctgagtggatgtggggatggaggtcactggaggcccagggctggtttgttgtttttgtttcctgttaggagtactgtgaaggctttgcagggctagttttgggaaatcttaggtttggcttcatctgactcctctactggagcgaggcgtgcagccaagcctgcttagacctccccaggccacgggcccgcggcagcccagctcagcacctgcaggcggggggaccgcgcgcttggctcgaagaccccgccctgggcaggggacagaaaatatgaaatcagatggggagttatgaataactgtcctcccctcccctctgccgtgtttcctgaatccgtacgctatgcaggaggggggcgggggcgggggcgcggggaggaggagggggccgtttgccattaatctgggaacaagcggctaacctcggtgactggtattttcgcttttcttttctcacttttctcagtgtggggaaagcagtcaagcccgcgcggagcgattgtgaggggctctgctggaatttggcagcgcggaggcttggagagaagccccatgctggctcccattcagccggcccgttttcctcgagctttggaagtttcactcagccgtgcactcaatggcttcacaaagctgattacaagcttcagcgcattcctgaaggagccaaaagcgacgcaggtgcaaacgagccgagggagccccttatcccggtgacagaatgggacaagctgggaaaggcttagaccacacaagtccaaggctcaccaggccgcagaaagcctgccttgggaaccgggggtcattatccgccctattcagcggggcccggggaccctgggggccgagcgaggccagcccgggcgggagcaccgccgccagcgcgcgccggcgacaggggggaaccccgctgggcgctgcggccaggccggggctcagggcgctgggctgtgcgtttgcacaaatctgtgttccggcgggccggtgtcaaccctagtggggacacgggagaaagagcacgccagtaggccacgcggcgcgtgggcagtgcgcaacttctgtcggcgtccaggctgtacggccacgtttcagccggtgcccccaggccatggacacccagctccagggtcgctctgcgccctttctccccagcccacctttcccattggtcccctctcctgtccgagtggcagcgcggccccgcagggagcgaccccgggagggacagtgaccgcacgcgtggagtggggacggcggggcacaggacggtagtctaagagtgttcgcatggccgaggacgctttcgctgcgagtttggggtcgaggggcagttccctcccggagtcattaacttcgtctcctcgtgctcagggaccagcaacttggtgctgcgggcgccagaaagaaaagggtagcgcctcgcggagcgcgcgggggaagagggactgcggcagcgggacgcgagggcgggaggggcgcagcagcggggagccggagcgcagcggaggggagcgctggggggcggggagcgctcgggcagccaccctgtccccgtctggagccccgcgctgcgtctaggagggcgcaacacgcagtccccgcgggggccagagctcggagccccctagtgcatgccccctctcctcgcgccctgccgaggcctcggccctgcctgccgtgccctgggcctggttgtgcccgggggtccccgcgggcagggcgcggggcaggcagggcgcgcgcgccgacgctcttttgtctgataactaatttgagttaatgcgatctttatgtaaagctaacagcggataattgtctattttctcgccaacagtctccatcacaatcacttatctggaaacctgcggttggattaatcgttatattcccgagatgagcgtcgctgcaatccgcagcgaacgcgggtagggacctggagacgcctcccgggcgctggcggggccggtgtgggccagctccgctaccgcctgagacgcggtgtgcccaggtgttggtgcccgcgggagagggctgtggggcgccttccccaggatttgcttgacttgcttttcgctcgagtgggtggtgcgcgggtgcgggaggcggagggaggaggaggggtgaggggaggagggcctgtggggctgcggacccggagcagcctgggtggagcgcggcctcgggaggccctgggtgcatcgcggcggggcctgggggggcccaggcgccggaggagccgtcggtgccggaatgcagcgtgtttcacttgggagaaacgttgccctcggtcccttgcctccctcctgttgtctcggtttttctggcttcgtccttcgtcccacccacccgttcccacctcaggtccctcccccaggatcccctccttaaggatccaggtctctgaaaattattggcaacagttacacgccccacgattgaaatccacaagagaagagtcccagttctgcaggccgctccagggctaggggtagagatggtggcaggtggtgcgtcaactctctagggaagaggaacttgcattacaaagacttgtctttctgagctgaagtcaaaacgggggcgtcaagcgcgctccgtttggcggcggtggaggggccgcgcgcccgcgctgtcccagccggagctgccctggctggtgattggaggtttaacgtccggaattcaggcgcttctgcagctcagatttgccggccaaggggcctcagttgcaacttttcaaaatggtgtttctggaaaataacaaattcagactcaactggtgacagcttttggctatagagaatgaaactgcttccctttggcggtggaactcttaaacttcgaagagtgaaagaatacaatgaaataaaatgccataagatcactggatttttcagaaaaaggaagaccccaaattactcccaaaatgaggctttgtaaattcttgttaaaaatctttaaatctcgaatttccccctacaacatctgatgagtgctttaagagcaaacgagcaaatcccacctcgagaatcaacaaacccaagctctggccaaggctctccccgcgttttcttctcgtgacctggggaatgtcccgccccatcgctcacctggctcttgtcatctcgctcatcttgaagtgacccgtggacaatgctgctccctgccgcagctccgccggtcactcaggcagaacggggtatgcaaatggcctggagaggccgaggccgaacactgcgcccattgtcccgggcgctcaaagcgccgagcagctgcgcagactttctgggctcggaccctcggccgccacgctaatgtcatcattgcaaaacatcagattttgagaactatgcagtctgaattcattagcagccttctcggcgaaggttcttttccccgtgacaagtttcaaagtccagaccccctccaacgttggtaggggtaggaagaggaggaggggcccagggaggggggtctttcgcaagtggggcctcgggggatccctgctctccttctggtgcattccgcaactttaaaagccttccttggggttctgagcgcggatgtctgacttgaatgacctgagatttggacatattcccgttttctcccaagagttgctttaatgttgcgagtttaaattcactgaaagaggcccagataccaagtcgagtgaatttcatagacatcatcttctgttttaatgatcgcggcagtgatcgtttctgaagtcataccctttagggtgaactcacaacaatgcatgtcagagaggctgcgcgccctaaagcaaaacagttaaaacatcaggccacgctcctcaaactgcaggattgcaagcagctcacaaacttccagtccccaccccaaggtgaggagagtctcagtgacttgaggacctgcttgcactcccgctttccacgcccggtcccctacccgcacctgcccaagtggtctcgttcctctagaatctgaatggtggggaggggtgctcctgatgccccgggtgcagggcgggcaccagcgagcgagacccaagggcgctagaacccaggagcgcaaaccaccgttagggcctgagggacgcagaggcgggtggagtagtgtttctcagattcgtgggaggccgcaggcgccagcagaggcaattttcctcccctgagcaatgctagttctcctcaggcccaggatctccactaacgtgtccttccacctcctcacaggactccaagctgctgtcccctctctgccgcatctgaggctgggaaaacttcctaggagaaggcaagagaaagccaccagaccagagccgaggactaaactttaaggtcgaagacggcagaggggcaggttctcccctgcacaccccaaggcctctcctgcacccgcgaggccttccttgagcgcccaggcccccgaaatgcctgccctccttctgacaaaaggagggggtaggatgtgaaggggtagtgcaaccaacaatgtttttgtaaacacaacaacagggaaatacatggaggaaatctatttattgggtgtgtcatttttggtggggggcgggattgaaagtggcgccatctagacccaggaaaaagctacggggtgggcggggtaagcgggggactcttggtaaatgtggataattttgaactgggacaccattttgtttccttcctagagcattgtatgatgtggcctgaaggctctggaaagtcacagatcacacccagcaggaggttcttcatgtgtgccagcccctggctgggcctgggcagccttgcccccatcctctggccccagctcctgccaccccacctgcagacaaggctgccaaaggctagggacagggctccaagctagaggccggctttttggagatgtggctgtgggaggggaatcccaggaagttgcatagagagggagtttttgccagcctgggtcactgatggccagtccgggtcactgatgtctccccaggggcaaggggacagtgcctggctaattgtgggtttcaaaatctgtctgttgaggggatgcagaggtcatcattggggggtgaagctgatggtccacagaagctctgggcacaggttggacctctttcctgcacaaagaaccctccagggtgcccagtggttctggccagcgccggagccagtgacggttggcttgttctggccttcctccccttctcacacatgcattctcttgcacacgtgtcacacacattcctacacactcacacaaattctcacacaaattcccagaatcaatctcccacatacacatccaagtcacacactcattcttacatgcgattcacagattcacacgattcacagatgcaacagactcacaggcattcactcttacatatgacacagttgcacacttgcacacacacacacacacacacacgcactgcaatccccttgcatctccacagtgtcgaaggctggctgaacaccaaggtggctcttggtggcaggacttctcatgggagggaaagtcacatagctggaaggttactagcttagggacataatttccttattgactataatctccttatagaaattcaacaactatagcagaaaatggagaatgaggacattttatttctcaaagtcaacagttccttttctcctgcaccttcggagcaggctcctgcctgaggctgctgaggtgctctgggttctcgctgtttgttttcagcatccaggttcaggcttttctcagtgcattttcctcggctgcccttggacttgtgttgtccggggtggtggccactggcccccagtggctactgagcagggagagcagggcccctctgtggtgaggcgtgctgctcagtgtaaaacacacacgagattttccagatgcagtactcaaaagcatgtgaaactcctcagtcatcacttaaaatattgatcacaggttgaaatgattatattttagataccttaggttaagtaaaatatattattgaaatttcaccttctttttgctttctaaaaatgtagctcttaggaactttgcaattacctacatggctatttgtgtgttatcttcctgctgggcagtgtgagaccttctcacagatccttcagaaatgtcaaaggaaaagcaaaaatggtggagaaggctgagcacgtggcctcgcgggaggccggctcagagctgttctgaagttgcttttgtaacacaatctattctcaaagctccttttctttcaatggggcaggttgggggtgggggggggggggatattacaccttgtattttacttctcgattcattttctttccattttaactttaattccgtctaattactgtattgtgagctcagtcagcaatcttgcatgaactctgcagtaacttctgaagactcttgctccaagtgtttgataatgaggagatgtgcaggactaaggcgactgtgtgatgtctgcacagttcgaaagcccgctttcctgttactttcaaatctcgggtcagcattttggaacttttctgctttaatttttccacacacacctctcactgcgaccacctaccatcaccacaacccaaaacaaagcaaacaaacagaaagcttgaacaagaatttacatctgggaaaacgcttctactcatcaagagtggaattcctttttattcctataattgactcacagcttcaaaaatctgtgaagtcatactttggtcacggaagttgcaagaaaccatatttgcaaacgttttattttaaagaaggtatttaaaaatatttcacatattagccacagatttctagaagtgaagttataaaaattagaaattatattttgccttttgatgatagcaagtgaaaagagattgctccaagcatgttttcaataaattcagtataactgcaacacaaaaattctgcatgcaggcttcatacacacacgttataattttatgcatttatcttgagagttgtataattaattttaaaaatgcaacagaaatgtgaagttaagtctactttgccaataatggaaatgtctcatagataattttgaatacaattaaaattttgtttttatcataaaaggaactgtcctgttgctcattattagtatgttgtccacttactgttctatttttagctaaattaaatttaactagaggaaaaagaaaatgttgtgcaataccaaggatgagcaaagttttgtgggtaaactaattgagatggttaattttggtattaactctttgggcaatatcattcttgttaaaatttaagtaaggaactagtagaaatactttattccttaatcaaactacctgtttttgaaaaaaattgccaaagaagaaactaaaaaattagcacatatcctgttaaagagccatcaacatcccattggaaactctagcactctgactttggatgtgtacgatggtctgttcatttagtatatgtattacacagcctcatttgcatcatcaccttataaagccagagagactctcatttgctttctgtttttcttctttcccctaaggactacaatggttatatactttcaaatattcacagacgagatattctgggtaaataatctaagattaactaaattaggtcaatgttcatacagggccagtgtgatatatcccttgtgctgaaattatctggcgtcagctacattgattgaaaaagcactacagacccaaaaggaaaaaaaaaaaaaacacaactcttattacaagatgtctcaaaagcagataagaaagcaacgaagtcttctggtaaatgagggaccttatctagattttaatatggcagtaggcaaattacaaatgtttctgcaagttagacaacttgcacgggaaaacagacgttcctaaggttcccataattctaagccagttatagagtttgcacatcgtctgtgctggtgggttctttgtgcttttcctcaagatacattccatataagggcagaaaaaccatcaagattcaggtcacactggctgggctgtttgactcactctaggatggagatagctcaagagagggacgcccgaatgtcattgtcggagggctactttctgcttatctacatattgtttacatctacttcacacattgtttctctctttccgaaaacggctattaatataacaaagtccttataacaaaactaaaatgtcaagggttggaaaagaaggtccttgaggctttcatacagagaccacatttgctgaagtcagtagcataactcagcttgttttcactgggtagcctctttaataattttgcaggtgagaaaatgatttctttgatcattgtgattatcatccgtttatcagtcaaagttcactgaattgttgctcctgtcaccattataatctattatcacaaaaggtatttaacaagttgataatttgatagaatgaacagaatggctgtcagaacatatatttcagaaacagacacagactcatctagcaggctgctgcccacagaggatgccattccattcgaaaattactatctttagagcatatttctgagtggcaataatgacagtaaccttcatcttcatcttcaggacaaaattaaatttctaatgcatgcctgggcatgcaaaaaactaacaaaataaaatgaagaaggaagcccaacagcctaaaactggaatttctgattgcattctaatacaaaagtgagtactttgagggagagtatcatagttgttcaaatactgcagtgagccgcagctgcaggtgggtgtggactctgagaagcagctgctgaaacaagaattatataaagcaaaataagtcagaggccgagatctagaatgaggaattaaaaaaaaaaaggaaaacattaagcttcatgaaaaacaagagagttggagctttgcctcacccgtctcctgttgaggtcaggggtgagctgatgcccatggggtcagtgttctccttcatgtctttagcttacccagcatttccgtcctgtagccagcgcagccttgctatagtgtttgtctggggcaggtgagatggggtcacctgcatccgtgcaaagaggggtcagcgagaattgaacgtggcccatgaccttttgccctccttgactcttagaagcttccagatgcaccaccatgatttgacctcacggtcttgagcatgaacccctatgtggagttgcggagaagccttcagaagacccaccacaggtgtcctttcagttagcaggctcactgcccactgcactccactggtttgaccttccacgcaccgtctcactgctcttaccagcccaccaccctagcccatcaccctagcccaccaccttagcccaccacattggcccaccaccctagcccaccaccctagccagcaccctagcctacctcatgcaccaaacccaggaccatcccagaagcagacacagcacactgagccttcctccaagccctccagtgcttctactgaagcgtatttctccccagaagaaaactaagtccattccttctttcccgctgtgcattttgtgaggacggactggatggaggccacagagcatgagtcagatgcccagcacacccggctcctctctgatctgagacgcccatcacacccggttcctctctgatcggagcaaatctaaggtttgtggcttttaaaaatgtctatttcacgtgtttctctgttaaagaggaaaggtggaggcaagggtgggaagggccctcaaagctcctttcatgggaggatctttctgaagatctgtggcatggtcttttatttctagtccaaaaaaaattaactgacaccttcactggagattattcataagcaaacacggtaatttatattctttgataagacaggaaaagatgatagggtaagaattcaatgcagtagatgtttgtcaggtatctaccatatttatggtgctttgcaaagtgcaggatacggaagtaaagacgttggtcatgaatcatgctctcatgaaatttacaaccttgtagcgaagagacagtaaacacttgttcagcaggacaactgcaattacaggtaattcagtggggcacttagaaaggagtggcactctcctcctgggagaggagagaacgcttcccaggatctcagtcttgaggaaagaggagaggaagggaaagactttcttgcaggggaacagcatttacagaggcacggggcaggacatagcaaatcgtcttcgggaaagtgggccccataccaaggggcagagctacaggaatagacgctttgatgattctgcagaggaaaggatggttcagagctgggtagtcagagaaagttcccagaggaagatggaatctgctcagggcctccaagcaaagcccctgcctggagggcctgattggaaggtagcagcagtccctcggcagaggaagtgagaggctgcactggcttctttcctgaatgcttgcagtgtgggcatgcctcagcttggctgaagccaaagacgctgttgagtatgtgagcagagggtaaccatgttggaggagaagcatctggctgtgcaatggagggccttggacggcaggtgcatgaatgctgacctgattctctgggcagtgaggacctctggagtgattctgagcagtggaatactgctcagtgcagtactcctgcactgagtgacctgcagcatcttggtgtatgtatcagtgtaaggtccaagtggggacagctcactatgacagccgctgtgaacctagtcttcaagcacctcttggtccatgagaatcagcccttgagaaaagtcttagcaactgtactcattcagggagagagagagatccatgcctgcactggagcaggtggggagtggccacactcaggattcttggaacaggtgagtggcccctgcgtggtacacatggcacctgggcctgcctgtatgaccttccacaatgtctccactatctggccccttgttatccctttggttgaattttccatttacacttccctctgctcaacccacattagccacttgaccgcttcctgccccactacgggctctggcaccgctgcttccgtttccccagaggactctgcccctcacctcctcgcctcctaccatcggccctttgctcagaggccaccttgtcagtgaggccctcctgaccgcctgtttaaattggccccaacctcttttcgtcttctttcatctccgtagcacttaccccaggaccaagccaaatccctccttggctttctttgtgtggtctccgcacccagaaccacacttcacccgggagggattcctgcctgtgcagtgcatgctgcatcctcggcctctgtgcctggaacaagctgggtgtgtcctggatattttcgaaggaaggaggaatgaacatgtggctgagggtgaaacatgatgaaggccatgaggaggaggccagctttggagacggagggagccatgtccttggatgccgggagtgaatggcctggggaaaccctgcgtgtttgggcagcagcctctggcctcctggaagtagacggtcatgattttcgggtgaaacaaggaggcaagggcgtgatttcctcaagccatgcagcgggaagtggagggctgatgagtgccatgagtcaggggtgagttttgccaggtgagtcctggggcagctggcactgtgggatcctgccaagtgagtggaagggctggccatgggtgagagacggaaaaggcgggtgtaggacagcccaagtgcaacgccattcactgaggcactttctgaagcacagatggggcccacatgcacagaagaaggtttgctacattgggtaagaatcattttccgagcttttttgatgaaaaaattgaattgccaaaattaatatcttgatcaaatataaaatccttttcccattatgatgggtaataaaatatacatctatacttaatgtttaagtgtttatagatgacatttttggttgatttttcaaagaatgaaagaaattaaaacttaataaatgagagcatttcaaaacacatctcagtacattctgtattctggtctggaaaaatattttcactttaaaccttgtgaacacaagcttt

SEQ ID NO: 400 - DNA, 88180 bp, Homo sapiens
cactctctgtaaccaaaagactagaaaaggggcagttggcaaggcaaaaacaaaacaatgggacaatagtcactctacaccagccaaacactacaaaaaaaaactgcggccacactcacccatgcctcaaaaacccaacgggcaccctgatttccaacctcagaaggtataaagaggtattccaatgccctaaccacctcataacctggggtggtgtccaagaatgcttaggaggaagctgccagtggagattatctggggagcatggactaagttatagaaagggagaacaggagagttctcccggattcagaatagaatccccagggattaagaagagagtcagcatagctataaaagggtgacagagagattcttgtggggatggaaatatttatcatgactgcattaataccaatcccacggttgtgacatcaatgctgtaactttgcaagtcattaccactggggaaaattgcgtaaggcacacatgagatccttcttattatttccaacgagtgtatgtgaacctataattatatcaaataaagtttaattaaaattatgttagttactttgtaaacactttatggttactaacacaatacctgggccatgcattttatatttttatactacaggattttcctggggctccagagtgacctgggagcagctcagccggagctggccctggagctaagagtcaaagaaacaaagcagcatcgatcaccatgaattaattaccaagggctggggagatcacgtttatctcagaaggcgcaacagaaacaggtgcaaccagaggaccagaggcccttcttcctggaccttggaattgatatggcctcgaaaaatggcagagaaatcgctgaactgcctgagacgagatgacctagaatcagatgaaaccaagttcctaccactcagcacaatggggatttgaagtagaaatacattcacttaggaaagtagaaacgtgcatttctggcacctgattgtgtggcctgagattcctgtctgctacagtgacatcgctggtgacattattagtgccccactttgtcagcagcatgcagtagctggcctaagatgtccaggtcactaacagtattctgatgggttcagccagcacaaaggtcaaacacctcatacacagccctgcctggggagcagtatctggttcctccaccctcctatcatcgcggttaagaacagttgattcatagtccaggaccctggtaggaaacagacgacatacatgagttgggaaaatcaggggaaaaattaacaaataagactatgtgcaaaggaacgtgcaggtcaacaccaaggactggttctagtagggcactgtgcccttttctcagcctgcagagacaggggtttgcagaggacatgggagcacagagacagggagggctgtgcttagaaggccaccagaaaggaactggggctgccagtgaaggatgcagccagcctgcagcaagagcatggtgcagggagcatgccagggaaatcaatgcattgacttcattcttctccctttctctgatctcctgctggtgtgtgccattgtcagatagccacataaattccagggaaagaaagccctctgatgtgcagaacacagagcagcaagcgaaggtggatggtactgcctactacaattcattctctcttttcttctttaggataaaaaactcgatcctacgatttcactgtgtccaacatcctgtgccctgttgtcaagtattgaataacaggaactcagctatgtagaagttccggaaaggagcagatgcaggtgagagggtgtaattcatttggttttcctgcctcctactctttcttgctgcttagaacatggatgtgataactggggcactagcagctgtcttgggtcatgaagtcaccttgactttgagttatgtcagctgaacagaaaaatagaagcagtttgggtcctttgcatcgttaaagacaccccaccagcctcagactggctgacttcaaattgctttatagagagaggtgatttttaacttattcaaggcactgactctaaccctaacgaatggggcttcacatataaattgcctgtaaagctctgggcacacaacacctcccagactctcctcacactccccgccttcactcaccacgctctgtgtctcagccactcctgccgatccttatgccggcaaatgctgcaccatctctgttctctaccatcctttttgtccaagattttattttattttccttcttctagttcagtgaaacacttttctaatgtggcagctattaggcaaaagaactctcgttagctttgaaactcccttggtttaccgtttggggtggaaaaagcccaacccccaagatatgcagtaaaaagaggccagaaaaacaggggagtctcaactgtgtctcatgccaaggggataaaaatttgcaaattgagaatcacagttagaaatgcataaaaataaaatggagctaaaaagaaagagaactaagcaacgggtgacaatgaaggctgatggaaaatctccagcggggtcacggcgggattgccttcttttttaaggctgaataacattccacgtatatgtggaattttatatatatgtgtgtgtgtgtgtgtcatttgagtcattcgaggcattcaaggcttcccacccatctcagatgcctgactttaaattgctttatgaggctgggcgtggtggctcacgcctgtaattccagcactttgggaggctgaggtgggcggatcacttgaggtcaggagttcgagaccagcctggccaacaacgctaaaccccatctctactaaaaatacaaaaattagctgggtatggttgcatacgcctgtagtcccaactactcgggaggctgacgcacgagaatcacttgaaccccagaggcggaggttgcagagagctgagatggcaccactgcactgcagcctgggtgacaaagcgagactctgtctcaaaaaaataaaaataattttttttaaaaaaaattgctttattaacagagagagagaacttttatcttattcaagccgctgactctaattttaactaatagaccttcacatataaattgccatgtaacatattatgtgtgtgtatatatatatgtataaacacactacacacacacacacacacacacacacatatatatatatataattttatctattggtccatctgtccactgacatttagattgaatctgtaccttggttattgagaataaagctgcaatggacatgagagatgctgattttatttttagggggataagtattcagtagtgggattgctgaattctatggtagttagagagtaaaatggtggtttccaggagcaggtggagagtgagaaatggaaaaatatttgtcaaagaatacaatgtctcagttctggacacctaacatacagcaaggtgactgtagttgataataacgtactgtagacttgaaatttgcaagaatatatcttaagtcttagtagcacacacacataaaaatggtaactttgccaggtgatgtgaatgagcttgatggtggtgatggtttcatgatatatccatctaccaaaatacgcattgcacaccttatatgcatacaattttgtcaattatgcctcaataaaactttaagaaactattaaaaataaagacatgatattaaagtcgaggcgagaaagaagagcaggagtcgtgtggggaagatatggtcgtgttcctggaaggtgactggagaagagcaaggtgaacattctaggggagatttttcctgctgtgaatagagccatgtgctaaaggtgccttttgatttgtttttgtttgtttcatcctgtttttaaaaaaagattaaattcacatacaaataatttatgtcctaggctcaggaaattaacaagcaaaattctcacagggaaggttaatcccacattcactcagtgatgtgggtggtggctgagacaggacttggtgccacgtgggagagtctctgaaagtcgttaacagacttgggttctgactctgttatttctggaactcatcaaagcacagtaaagccagaaaactgaagtgaaattaccttttctttcctctgaagataatgtaattgacataaaccatctgaacccagaagccagcaaagtgttctcttttttaataacttctcagaaaggcccagcagccagggcctctgcatggcaattatcccaggaactgtgggctcctggacacgctgtgctctcctggagagcatgtgggtgtagcccagggaggtgagggcagagtgggcagccaggaggggccgctgccaggctttttctgtcttatttccattttggtaaatgatctcacttttcttcttgaacaaccaatctgtaactggaagatgaacacggggaaaaactgcatgtagtggctttaagcactgtagactagaaagacttgcaaggccagagactcaggcacttggcatggattttacatcccctggggaagtggccttgctaaggtctgcgaggctgaagcttgttaaggcttgcgaaggtctgtgaccatcattactgctggtttgatccctttggataactgtatcccttccaagagtttttgcagaacactccgtagataagataccatttagactcttccctgagctctgggaacacatcagagaatcctatgattaaacatatgtaaccagggccattttaactgagagagagaaggagagagaaagcatactagaacaggactttgaacctccatgcccattgggctgagttgatgtggagggaggaaagagatcattcctgctgtcttggttggtttgactgccacaccccacatcacggcctgtgattcttgtgcatagttaaccaactgctttatattcaggggcttcgatgtaatccacctgctactgaaacagacccaatagtcccacagaactgatgtttatggtttcctttgaataaacatagaagtggaccctcctagtcttgaaagttgagaaagttacatttttcctatctgagttccttgctgaggaaaccaaccatcaggcctcccagagagtatcaaggaactgaaactcaccacgtctcagcatctgcataatgagacaccagagccctcgcccaccgcgactgcctaacccaccacctgcttcctgtggatcaattccttttccttccccttccatcagtcctgtttacctgcatgtagctacatttctgctatgtaaacccctaataggattcagtcagggagatggatttcagactgatctcccatctccttggctacagcacctgattaaagccttcctctatactctggtttctcttcaaattgtatacatcttctgattaaagccttcttccttggcaataactgtcgtctcagtgattggctttctgtgatgtgagcagcaggacccagaccaaacccctggtgttttggtaacactgcttctgccctgtcccccactgggtggggaccccataaagtgtttcatctttaggaaaacaaacacaaaaacttgacttttctaggagtacctgattagatccaatgtttggcttctgttctaacttcagaatgcaactcccctctggagagacaatttctgtctcgattctgccaggcagctccatgatgccctcagtgatcactacaagtaaagctcggggtccccagcacttctcttcctcctcaccctcctacctgcttcatcccctgtctcctgtatcagtgacccgggatggatgaggggtgatccacctcaacccctcaggcacctttagcacgtggctctattcacggcaggaataacctcccctagaatgttcaccttgctcttctccaatcaccttctaggaaaatgaccatttcttccccacatggccccttcccttctttcttgcctcaactttaatatcttgtctttattttttaatagattttttaagctttattgaggtataattgacaaatcaaaactgttaagtatttaaggaatggaatgcggtcttttgatagatggatacactgtgaaaccatcaccaccatcaagctcattcacatcacttggcaaagtagccatttctatgtgtgtatagtactcacatttagggtctgctctcctggcaaatttcacgtgtactatatgttattgtcaactacagtcaccttgctgtatattaggtgtccagaactgagacactgtagtctttgacaaacgtttttccacgtctcactctccacctgcacctggaaaccaccatcccactctctcactaccacagaatccagcaatacactactgactacttatgcccttaaaaaataaaatcagcctctctcatgtccattgcagctttattctcaataaccaacatacagattcaatctaaatgtccacgaacaagatggaccaatagagaatatatatatatacatgtgtgtgtacacgtgcacgcaaatacatatacacacacactatgttatatggcaatttatgtgaaggtctatcagttaaaaccacgtgctaaatgtgctcccctcgctccatcacactagaagtcagacgggaacttagaagcccccccgtcctcactgctctgccccagcctccattctacatgctaactttctcagtcctttcatgagatccacgcgtttcccactctccccaattgtttccctaccagctctgaaatgggaaacctctttctgctccagtggcttctgtcctgggctggtctttgctttctttacctgaggactgggataggctcctgctatcctctgaacgtttgtgtctcctcacgtttcatctgttgaaatcctaacccccaaggagatggtattaggatggaggccttggggaggtgattaggtcacgagggtggaactctcatgaacgagatgagtgcccttaaaagggtccaaagcgatctgagttttccccttcctgccaagtgaggaaacagcacggagacaaccggtgaatgaggaagcgaagagccctcaccgtgcaccgagtcagctggtgccaccatcttggacttccagcctccacaactgtgagaatggatttctgctgtgtatcagcagtccggtctgtggccttctgttacagccacactcatggaccaacatgtctcctgcgcaatccctgctttcattctttcagcctctccgaactgccccaggcactgctcctgaacgcacccatctgctccctactcaaaaccttccaagactccagtcctctgctgcctgcagagggaaaagcagagcacccagcccgctctcctaagtcctccatgcttggttcttccctgactttccagtcttttctctcctcccctcttgcagctccccaaagtccccactgtgtccggaattggttcctgctgggttcttgctccggctgacttcaggaaggaagccgggaccctcgcggtgagtgttacagttcttaaagatggtgtgtccgggatttgttccttcagatgtgtctggagtttcttccctctggtgagttcgtggtctcgctgctgacttcaggagtgaagctgcagaccttcgcagtgaacgttacagctcttaaaggtggtccgaagttgttcattcctcccggtgggttagcggtctcactgacttcaagagtaaaaccggagaccttagaagtgagtgttacagctcttaaacgtggcgcgtcgggagttgtttgttcttccaaggggtctggtggtctcgctggcttcaggagtgaaactgcagaccttcagagtgagtgctcataatagtgtggacccaaagagcgaccaacagcaagatttattgaaaacagcaaaacaacaaagctcccaaagggtggaaaatgacccaaatgggttggcgttgctggctagggttggcctgcttttattcccttatttggccccacccacatcctgctgattggcccattttacagacagctgattggtccgttttacagagtgctgattggtctgtttttacagagtgctgattggtgcatttataaacctttagctagacacagggcgctgattggtgcatttacaatcctttagctggacagaaaagttctccaagttcccacgggaggcagaagcccagctggcttcacttctcaccagcaggtctccatctctgagccattccttctgtgcacttgacctccatgaactatctcccacacattgcccaggtccaccagccacacctccatgctgaacaaaggcctgtttgttggatgaataaatgaatgtgtagctagagcaacatttgcctctcagtcactgaggctggcggttctggcatgggctgatagttttgtctgttgtattggtttcttgtgttcacttttgttttggtccataaggtgattttaaaaattgaatgtgttgctggcaattgtgagctttcatcaggcatcatgcaacttgttggttggagctgagtctaagttccttctaagttctttcttaactctgctgcttttgggtagccgtgtgctcggttctatgtcccttgcaccacttggttcatggtagtgctcagtcacttgtgggatccaagctttctttgtttgtgctagacactccctgaaacaaccaagacatcctgtgtgagccaatcaaacacgcctgcagtgcaatctgaccttagggcattcattttgcaacctgagcagggctctcctgaagagatggctgcaaggaaaggaagctttgatgagtcttttccttctttaaagtctttctttcgaagccaatgtctcactcgactgttttcaccaaggtacccgagggctcgatagcaatactacgtaggatttgaaacagctggacttgaacgacgttaagattactctgttggattttacctcctcctgctctgtggccagaaccttcaataattcaactggttgatatttttctttaagtgaagcagaggacgtctaggactttccacaccagagaattaaggacaaacctgatattgactatccctgctccagaaaagtacaataaatgactcaagggctcgccagagagcatagacttgagactaaccagatgcctgggatgttcagcacagactttcctaaaagcagcaagatcccgaggtctggctgtggtgggaagagcccacttgtgggtaccacctcaaatattagacaggaagaagactgggccaggtggtgggagccccgctgccctgaatgcatttggggtcttgatgacaatctcagcactcagaggaagacctctcctctgccggaaggcagagggtagagtctaggatgtccagactgtgcatagaactaaccacccccttatattcaggggcttggatgtaaaccacctgcttggatggaatttagttctcttctgaaaataaaatgtggctcatcccagcttgattatcaaaaaacctgaaaacatagattagccagagaaaaaaagtaaagcgctcatcctccctgggataaccacttaacttttagcacttaagtatgcctactgcaaaccttatttgtacaagcatacatatatatgtgtgtgactatacatatgcattatatgtacaagtacacacacacattagacatgtaggtaggcaacagatatttaaacaaatacacgtttactcttaaagggatactgtaaacatctatggtagatgatcttttccttctcaattattcactctctcttagcaatagaaatagaaatccaccccccattgcatatgacttcggagtaccttccactcaagtcctgaccctctgatttggatctttgtcgcgagatatgtttcatacatgcgatgttagccatgataccatgaacagagctctaaatgtactttgtgtgtgtgactagcctttgtgtccctctgccagccaccgtgaggagagcatgcctcgatacctgctggtccgagggggagaagaaacaggaggtgtgtgcagcagatctgacctctctcagccaccgctgacaccggccctccaccaaaaactacatgcttgcggtgggaagtcactgggatctggagattgcttcgtatgcagcattattgtagcaatagctgcctaatatagcctatgccatgtcaattacaacacttaaagtattcttaaagctgtggattattgcacgcgtgcattcactcaggcaatactaacacatttctgtaaagagtgttaagtgtttagcacagtgccagccattgtaagtgctcaattattgtagctattgctgaaagtgatactcctatttatttcaccaacccttactgttcaacatttaggtttttgccatattttaatacttcaccacagctgttataatctcctttttgggaatgtcattggacacaatcttaattatttgcttgggataaaaccctataagcaagattgttcaaagaggatatgttctgttaaaggtgccttattttttgaaacttgggtggagttggtgatatctagcacttctctcctatgatggatgaagaggcaggagctaggaatagctcagcattgggagtggcccagaattctgcgactggagaaaaataaatgatcaggctctttcccacacacatgtgcattggacattgtcccaatgcctattttaaatgttggagaaccatagaccaagctaatgccacaaaaaaacccaggagttctccaagtctgtctattagaagtgtaaaggggtcccagtcccttctctcgagtgggttactctgaagaattccacccgagccatctctttctgagactcactcgagcttgtgtgtacaagtattattattggtttatttttttaaccaataaaaatactggtaactgatttataactaagacactaccattcaattggtattagaccctggaatcacgtgtctccattctgaccattctctgtaattgttaaaatgcaaaggaatgtggaaatatttatatccatgaagtccttggattcagtgctatgtcagtaactggccctagcattttgaaaaaaaaaaaaaaaaggaaaatatataaaggaagatatagttcctaaggtggtaaagtcatctggaacttggactaatgacattgttttgttggaaagatttgtttatatatataaaaggaaatgttggctttcagttcatcacatttcagggaacaatgggttctttcttcaaagtgaaatgtcatctgttttcctagagaagagaagctgctgcagctgagctgggaaattaactgctaaaatagccggagagaaagaattgctgataactgggacagattagctgttctagtccatctcatgcctatttatttccacgcaattggtgatggggtttcagctcagtcctgcatcccccttttcttacccctttggcaatacataactgcaggtcctcagtgtggactcaagcccagtggttggggagttgatttctgaatagaaaaggctgtaacctgggaacatttccaaattcacaatttcattatataattggattgactcttttaatttgtttccagacactcaaggtaaggcttcactcagttcaaattttatgggatggtttccggttttggtcattctttaacttattaatttagcaaatatatgttaaacatcttctgtgtcctggtggttgccaggggaaataaaggccaggccctgtcctcaaggggcttatagtctcaatgaggaggctgacagtaaatcaggagaaagaaagaataatacaatttctggaagtatcaagtgtgaccatttttaaaataaatcaatcaaggtgaggggacaaaggatatctgggagaagtgtgttgttttagccaaagcatcaaggaaagtccctctgagaagtaatatttaaatagagatctgaatgaaataatgagagagtcatgcggagatcaggggaaacagcattccaggcagagggcacagtgaatgcaaagggctggaggtgtgaatgagttcagtgcattcaaagaacagcaggcaggccagattcactggaatataaggccaggaaggccaccaggaccagaaatacaggaccctgaagactggtttacattttactcaaagtacaaaggaagttttagcgtaggggaatcgaatgatgtggctaccttagaaatgtcattgggggttagaggggctatgtccagcagatagtcacatagcaaaactccatacagatgattggaatcggatccatcacgtgcaacaatgtcataatttttaaaaaaaaaaaacagtttgatttctagatggagaactttacctttactgtgtttataaaacttttataaaatttttaaaaatgttaagaaaatgctcctaaatggtttaatacaattttattatcattaatgaagcagaattttggggaatttcccacattgccacatactatttagactatgcaaatcctatcccaaacccaactattcaatattatgtgttttttttttttccattcaaaactgacagaagaattttgaaatgctccctggactccactccccttctcccacatgcactgaaagaaaacacacacagtctgttggactttcggacttatactcccaaaagtgtcatccctgtataggggaacatttgggatgacaatgaaattctttgagcaaaaacctgaagagataaaaattacccccaagtctagagaaagcacggacatggagaagagtgcacagcaaggctgtggggcctccgtggattcctgctgccaccctggggggcatgtggacctccgggagctgctagcagagaacatccaacaaacacacctttcttagtcctggctgcatattagtggagatggcccagggaagttgatgtcttgaagggatactcacagttcatgattttgccatattttaaatctccactataaaatactagattaagcggaaattaatgtagattcaaaacaatatgggctgaaatatcttagaagcctattgcttctgatgtgaaataggtacagggctcagcagtccaaggcttgtggtgtggctcacagcatcatcggggacccaggtttctgtctttaggtattcctatgcagtgatacttgaatcttctgtgcctcagttttctcatgggtagaatgagtaaaataataagccccactaaccaggttgctatgaagttaaaattaggtttaatccaaataaaatgcttttaagattgatgtctagcaaaactgattgttcaatgaacgccagcaatcaccatcatcatcctccccatcatcactaccatcactattgccatcatcattacattttgtgtagtcaactataaattttttcatttataatcaccatcaccatcaccatcataattttcttcaacactatcatcaccatcatcatcaccatcaccactaccaccatcatcatcactgccttcatcatcaccatcaccgtaaccatcatcaccgtcaccaccatcatcatcatccatcatcataatcactatttccattaaggcttaggaaacatttatagttctgcactaattctattttgatgacagactgattgaataataaagtttctgacttgaagtaatctttagcccatctagtgtaacccatcccatatgtaaaaatgttattagtttgtctaatagttaatcccatattgcttaaagcttttctaaaattgggaactctttacctcacaaaaacacctctatcataattcccaccttgattacttgcttgaaataaatactaagaagtgaaattaggaggataaatatgatgctccattcgacctaaatccttatcgtgaaagtgttcttcaagacactctcactatgcaagtgccattttagcatattttaccaacaaaggaaattatgtctaaaaattatttgccaggctgaggagtaaaacatatcatgttgaagttttgtttagtgtttttttaaattattttatatttttagagacagggtctcactatgttgcctaagctggtctggaactcctgcctcagcctcaaagtgctgggattacaggcgtgagccaccacaccctttctagcgtatttatttgtatgacatgcaatatttttctataatatatattccctacattatattattttcattcctcacttgcttattcgtgaccttaacctatttttaattgaagagtttgtatttatattggttgatttataaatgttctttggatactaaggatgcaaatggcttgtcttctgtattacaattatttccccaggtttcatttgccttttagtttatttataacgaattttaataaactgaagttttaaaatgttgtacagtggcctatgtaagttctcctttatggtttattaattttcttttaggatagaaaaacgtttcatatttatgtatcagataaatatgcaccctttattttttgtgttgattaaaatgggtttgcacagcggtgtagtaatttatgaacttttgtgtgctcctggtcatcttttgctaggtcatcgtgtggttcttcttttatttaagccacgccaggaggcactctgaaagaacgggctggtggacatggagagatgatggaggctcagaagccgctgtgagtgttccgggggaagcactgccttctgcgtcctgccgcccccagtatttctcctccggctgaccctgaggactgcggggcagggagtgaggtgggagagaaacgcgaggatgtccgcgccgtgtttctcaggggctctgggggatgccaagactcacagtgcgtccagctcccagcccagcctgaggcagggcagtagagatgcttccctgaccccttcaggtcccggggttcagatgctgagatggtgcccacactttcctcccatccatgcgctggagggagcctctgaatgtctcccactgccgcagtgcatgaagaaaagatgatgagagagctcaggagataccctggccgcgagggcgcagtagtggtggagacaggctcaagggaaagacagcagcgccaaggacctggcgcccacccccaattcccggggctctctaagaccctggaggaccccccaacatccctgggccctgggctgagaaaaccctaatgagaagtcgattacatacctgccacgttacggcaggaagattacaaatgaaaatgaagcaatacacagaagaataaagaggcatttcctgtacatctgaatgtagggggtcaagctttgtatccatgaagttattttatgaagtgtgtgtgtgtgtgtgtgtgtgtgtatgtgtgtgtgttactccttaattcagtgaatttctgtaagagtataatacaatataaagatttgccattttaaaaaattaattccaaatagatttataagccagctatttgccatttagaagtgtgtgtttgtgagtgtctgtgtgtgtgtgtgtgtgtgcgtgtatgagaaagagatttaccagtaatttaaaatggcacagttatcatgtatcaaattctaatggcattttaataaattctggatctgtcctctctgggcattttattctatacattacctagtctctgtcttaccatggacattacatggttgcgggtaattgctgaaatcttgaaatacgttttaggattgggctacgctcttgcccaataactatactcctgctgacaataattttcttctcaatatcttcttggaattcttgcccatttggaaatttcttgtcataactttggttttaagaaatgctttagtaggtgggatttatacctttactacattgatcttattatgggatttatgcctttactatatggatcttacaatccaggattacaacatgctttgctattgattcaagtctccttttagtgtcttcagtacagttttatagtttcatttatgcaggttctgtacatcacttcaggatctattaccaggtagtggaatcttttgtgttttctgattacttttatattttcattgtttgcttattggttgtgttgtcattatattggggaagagataaggactgtatctattctagcaaaggaacttcacgtctctatgcattttctacatattggatgaagctcttttaccagaggcctcatttcctgtgatgttttgtttttttcagtagggcgtccacaccatactttccgtgtgtttggggcagactggttttgtaccatggttcctgccctctccctgcctcaaggagggccctctatatttaggagaggccctgttctcaacttatttaaaatccttgcctctacagctcccagacagtgacttttacatggggttgtccactgcagcaagtgagaactcttcctctcccctgtatctcatccccttgcaaatcaggacaaccgctgagactgggcagagattctcccattttcttttcagaatactgcactcctgactttctgaagaaaaaattaaattctgtcctgggccacttgctttgatctaaccaggaactgtgttttgaatggtgagtgttgccactcccagggcattaggaagtctgttagattgtttgtttgtttgttttttaatactcctagagtgtttatttttatttattttttatttccataggttcttggagaacaggtggtgtttggttacgagttagttcttcagtggcgatttgggagattttggtgcacccatcacctgggcagtatacattcaacccaatttgtagtcttttattcctcacctccttccctttttttcctccagagtccccaaagtccattgtgtcattcttatgcctttgcgtcctcatagcttggctcccacttatgagtgagaatatatgatgtttggttttccattcctgagttacttcacttagagtaacagtctccagttccatccaggttcctgcaaatgctattaattcattcctttatatggctgagtgttagttttttttttttttgcttgtcacaatgtctggagggaactaaagcgctttattggatcttgccatccctgcaatgtgtgggacaggcccgtatggcaaagaaacatcctatcccaaaagacaatagtgaactgtagaaaaagaggtcattctgactgcactttagtcgcagaaatcatcatagatttcagtactcaggtagctatggtttcctaatttcctgtttggatgtttccctccccccgcccctttttttgtttcctttgctcctttttggaaagaacacacagcgctggtagagggcagtcatttttctgggatgaagtttttttctttcccataatgaagtggcatcattcatttggggtgatacctgaggttcattgtcccatgccaaggcaatcaaggatgcaaacacacaatgagtgaggttcacagcagaagttaaacagacaaaagaaagacaaaagctctctcctgcagagagaggggtcctgaacaggtcttccagtccatggtgaagtgcagatggttctgcagatgagcttgcggagttagtgtcttgtttacacagggcaggaaagattggttggaccaggtgtgccatttgcatagcatgcaaagaactggttagcagtaggtgtactgtttgcataggtgagaagaagctgccaccccaccccaattttttattatgcggatggggtctctacctggctggcgccatgttgcctgtttctttactgtacacgtggtgacaaaagagaagatggagcctctatatcgaacatacttggcccccaagtagcccctttctattggcacagctgccagcattcccccatgcaagcttccagcttgcttatctatgtctgcagcttgatcttttttattttactttaaattctgggatacatgtgaggaacatgcaggtttgttacatagatataacatgcgccatggtggtttgctgcacctgtcaacccctcctttaggttttaagccccgtgtgcataaggtttttgtcgtaatgctctccctcccctttccccccacctcctgacaggctccagtgtgtggtgttcccctccctgtgtccatgtgttctcattgttcagctcccacttatgagtgagaacactgcagctctatttttcaggctgctctttgttagaaaagaaatgatttggggactgctttttcttaaaagggaagccttgctgaggactcctttaccctcactatctgcctaaataatttctttctagctcctgtatcaatacgacttttccatttgtggtggtcagtgttttgcaccagcttgagtgggccagtgtacccagcaagtcaatcaacactgacccaggggttgctatgaatttatctcatcgatgtggctcacacctaagagtggccctcccttatctgtggctcgcttttcatggtttcagttactcactgaaaccatggtctgaaaatatttagtaagaaattccagaaataaacaattcataaaatttaagttgtacaccgttctgagtaacataatcaattcttgtgatgccaggtcccatcccatctgggacactaatcatccctttgtccagcatatctgcactgcatacatcacccaatcataagtcatttagtgaccttccagggtttaagatcaaaaaacatagtatctgtgaagtttggtgctacctgcagtttcacgcatctactggggaccttggaatgtactccctgaagagaaggcaggggtggtcactgtacttatttgactttaaagaaagtagattattctggataatcttagtgggcctgatccaatcagctgaaagtctttaaaagagaaactaagatttccctgaggaagaaaaaatcccacctgtgcacagtagcatcagctgggtttcccaagagcttccagcctgcttactcgcactacagatttcaaacttgccagcccacaaatatgcaagccaattcttgaaacaaacctatctcccctccttctctcttgctctctcaatctcctctccttctctagacagatagatgggtattatatatacacatatatacatataatttctagatatttaatttctagatgatatgttggttctgtttctggtggaaccctgactgttgctccactttacaccacgtggtgtttcacatgtgtgtggtgcatggagaagtctcttaggtgggaataagattcaaacaccagtgtgagaatgcatttggccaaaactactcttgaaactcccttaggacagctgcagacacctttgaggagtgcaacgtagctgctttgctacactccaggattgaaagagtttaatgattccctgtgagcaacagacaatgagttggttgtattttgggggtatacaaagggctatgtatagcattgttgggattacacacagttggacaaaatattcacagggccaggttatttgaggactgaggaagttgaaggagcatcagagatacagctcccatctcatgcccatcagggcttatgctcattaagtgagatggtgcacaaaattgtccaaataattaaacttgctggctcttggactggaacacatagagtagaattggagtcagttccaggcacctgccatacatccccactgtaggaacaaagggtcttaagacactgggagaggagaagtctgctctgaaattgcctgggagaaggtggtgcaggtcgctccaggtggcgagttatgaacaggtgctcagcacacttgagaaaatgaaagaattctagtggtgcctcctttggatgagacccgaatctcatgggtgaccaccgcctgctgcagaagcccagcctgctattccccatgccgtgctggaccacatggtagtgtcagaaccgccagcccaccgggatgtcggtggtgctaagagttcagacgcagcccccgtaccacataggcatgacgtttcagcttgtcacttggtagctctgtgatgttgtaaagtttcatagcccttctatgtctcactatatttttaaccggtaaaatggaggtaataacgcatgtttcaaaggctcactgtgagagtcaatgagcctttgaaggacgtacccttattatccacattttcccgctatttcaacctccctgcaccaccccacaggggcgaaggacatgccactctttactcttcatatctctgctcccttctctgggccacattttccctgagggtctgggctaactcactgtgtgcccccagagccccatataaggcctggttcacacaaggcagccagtagatgtgaataatagatattaatagaatggattaatacagattaatgtctggccccacttagaggattggaggttttaagcagtaaaagcctaccctaaactcagcttcctagatatgcacatgtcttgagacctttggggccattgaagttttgcttaaggaaatcctaaatagatgctagcaagattgcagagaaaagggaacacttacagaccattggtgcgagtgtaaattagtttaaccattgtagaaagcagtgtggcaattcctcaaagagctaaaaacagaactaccattcgacccagcaatcccattacttggtatacaaccagaggaatataaatcattcccccataaagagacatgtgcacaaatgttcactgcagcactactcacaatagcaaggacatggaatcaacctgaatggccatcaatggtagactggatgaaaaaaatgtggtaatatacaccatggaatactatgcagccataaaaagaatgagctcatgtccttgacagcaacatggattgacctggaggccactatctttgacaaacgaatgcaggaacagacaccaaatactgcatgttctaacttatgtgtgggacctaaattatgagaacacatagacacatagaggggaacaacagacagtgggacctacttgagggtggaggctgggaggagggagagaagcagaaaaagaactattgggtactaggctgaataatttggtgacaaaataatctttataacaaacccacaaacccccatgacatgggtttacctatataacaaacctgcacatgtaccgctgaatgtaaaataaaagttaaaataaaaaaaaaaaaaagatcgcaccctgttttccactgggcttggggacttttattttatttttatttttgtttgtttggttttggttttcttttcagacagagtcttactctgtcgcccaggctggagtgcagtggcaccatcttggctcagtgcaacctccatctcctgggttcaagtgattctcctgcctcagcctcctgagtagctgggattacaggtgagtaccaccatgcctggataatttttgtatttttagtagggacggtgtttcactatgttggccgggctaatctccaactcctgaccttaagtgatccgcccgcctcagcctcccaaagtgctgggattacaggtgtgagccaccacgctcagcctgggcttgggtttttaaatggagctttgaagtgatcctcatttctcactgaacacgataaactcagattttaggagattaaccacgaggttctcctttactattaaacagacatacaacacaggcatatttcccaacagtggaatatttttattagaactcattagttagtaaaaaagattgttgaacagagaggagatgatggttggaaatgaatactattaaaattaattattccttgatttacagactatttccctttttcatctgaagtcttatagaataaatggaaaaagcaaacttatgactttttcaatgctgctggaaaaaatgacatatagcaatatgtaattaacatataaatagccatatgttataacacataactaaaatgtttaaataaaatataattcttggaggaagtttggcaacacaatcacttactaaacataaaagaaagttgcttgctcttctgtcttattgttagaaacatgacaaaacttcaaggacaagcgctgtacttggaagataaaaggctcactcaagaatttcagattggggggtatggcttagtaagcattgtttaagaatcaaagactggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacgtaggcatgggcaaggacttcatgtctaaaacaccaaaagcaatggcaacaaaagccaaaattgacaaatgggatctaattaaactaaagagcttctgcacagcaaaagaaaccaccatcagagtgaataggcaacctacaaaatgggagaaaattttcgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaagacacatgaaaaaatgctcacatcaccggccatcagagaaatgcaaatcaaaaccacaatgagataccatctcacaccagttagaatggcgatcgttaacaagtcaggaaaaaacaggtgctggagaggatgtggagaaataggaacacttttacactgttggtgggactgtaaactagttcaaccattgtggaagtcagtgtggcgattcctcagggatctaaaactagaaataccatttgacccagccatcccattactgggtatatacccaagggccataacatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaatcatcattctcagtaaactatcgcaaggacaaaaaaccaaacaccgcatgttctcactcatagatgggaattgaacaatgagaacacatggacacaggacggggaacatcacactctagggactgttgtggggtggggggagggggtactgatagcattaggagatatacctcatgctaaatgacgagttaatgggtgcagcacaccagcatggcacatgtatacatatgtaactaactggcacattgtgcacatgtaccctaaaacttaaagtataataataattaaaaaaaaaaaagagaaagtatccatttcctgaaatctccaactctgaatgttactatcttttaaaatatttaacaattggacaaaaaaaataatatttcaatgatggttttaatattgtttgactggtctttggttcctaataaactagagcatctaatataaaaaaaaaagaatcaaggacaatttcagacttttcaaactcttacctctaatgagatctccaaatccacaatgaactcactagagcatcgtcaaggggcctgagctcctcctaaggaagccggacaccgtctggatcatcaccagggagggaggtgaatatgtctgtgattgggacagggatctaaaagaaacacaggtctcaggactgtacctaaatcttccccatccttcctctcacaaaaaggattgcacttagtccgctctgcgtccaagactcaaaaagctaacaacaggactataatgccacctttattttcgttgttggcaggtagcaaggacacaataagcagaggtctatttgcaggtaacacaaattagcacaaacagtggctgtggcatctccgacaaacagggtacatgcccagagaagctcagcctgggacacagaaggagaggaaggtccctgcgggtagcagtgaccacttcagcacccaggaggagccatgtgctactggcatcactattgtccttgatccatctttttcttttcttttattttctttcttttctttttctttttctttctttttttctttttttttttttttttttttttgcaggatctcactctgtcacccaggctggagtgcagtggcaggatcataactcactgcagtcttgaacttctggactcaaacaatcctctcgcgtcagcctcttgaggaactaggactgcaggagtgaacaatggcaccaggacctcgtcttgacaattaggcttaagcctgtttttatgatgaaaagagaaactccaaggatatgaaagaatctcccccatagataaatatgttttctccattttatttttccctcactgtctgaagtacattcatgaatttttagagcaatagatagagagggttttacaaaatacccccttttccagtccagagactcatcagagtatgaaaacaagtgagaagtggctgggtatggtggctcacgcctgtaatcccagtactttgggaggccgaggaccggcggatcactaggtcaagagatcgagaccatcctggccaacatggtgaaaccccgtctctactaaaattacaaaaattagctgggcgtggtggtgcacgcctgtagtctcagctacttgggagtttgttttgtgaaatgttaatgctagctttcaatcaattttattatatagccttcccatttaaaagaagtcctaaaacatggtctgtccttcaacacgtttcctattaaaattatacgtgaaacctggctgtgtttgataggataccatttgctgtggcttccttcgattcacaaagcatgaagggtggctgagaacataaccttagagactgatgaccttctaggccagtgctatccacgtttaaacaaccagagctctcgagaactcactcatcatgacaagcacagcaccgaatggatggtgctaaaccatccctgaaggatccatccccatgacccagccaccacccatcgggccccacctccaacattgtggattacagttgaacgtgagatttgggtgggaatacagattcaaccatatcaaatgaatttaaattaaataaaactgaaactcatgttctcagtcacacagtgctcagtagccagctgtggctagtggctcattcactggacagcacagatgtgaaacatttccatcgtcacagaagttgctattggccggtgctgtgccttctccaatcagcaatagatcagaaaacatgtctgtaaatttctttgcaaaagagtcttctttagacgctgcacggtgaccttatttcaaaagatcattcattttttattgcatgtaacttgaattcagtggttcacagtttttgacagttttatttgtgttgctatgaaatttatatatttttattctagaaaatttggaaaacacaaattaaactcccccccaaaatcattaaaatcaccaactcctttgagactcagaggtaagcactgtaaaaatttggatgtaaatattttcagtgatttttttattttttaattttactttttttttttttttttgagacatagtctcagtctgtcacccagactggagtgcagtggcgagatctcagctcactgcaacctccacctcccaggttctagcaattctcctgcctcagtctcctgagtagctggaattacaggtgcaccactgggcctggctaatgtttaaatttttagtagagatggggtttcaccatgttgaccaggctggtctcgaactcccagcttcaggtgatctgctgaaccttggcttcctaaagtgctgggattataggcgtgagttactgtgcccagccttcagtcatttttttaaataaatataatttgagggcaaaataggattaattatatataacagcttggaactctttgccacctattactgcattatgcacatcttttaatgttgctaaatattttatgattgatcatttatagtaggtgactagaattgaattattggaatctttatttgatccaaaagtcatgaattcaaacaccttcagagcttaagcagatagagtgcaaggctgaagaacctggatcaagtacaataagaaacagtgggtgctatggagaaccaagggagtgatactgaggggagggtgggcagttgccacttagaagtagaattttttaaagctttaattacttatttattttgagacaggccctcactcgatcacccaggctggagtgcagtgctgtggtcagggctcactgcagcctccacctcccaggctcaagtgatcctcccacctcagcctcccaagtatctgggactataggtgaacaccaccacactgggctaatttttgtattttttattgatacggggttttgttatgttgcccaggcaagtctcaaacttctaggctcaagtgatcctccctcctgcctcagcctcccaaaatgctaggattacaggcgtgagtcactgagccgggccataggttttttttttttttttttttttttcatgtccaaatgcagtgatactagatattctaatcttccaagaggcaccaaaattctgtaacttcatgtgagaaaaaaagctgaattaatttaggctatctgttcgtgttaaatcactgatttggccatagaaaacaagtctgcgtgctagatatccttcgaggactaccattttgaaaattctgattaatttattttgcatagattgttagatggtaagcaagttttcattgttataaacagtgcagaagtgaaaaaaatacacatcaacaatttaaaaatttattaactttgatcttcattaccacttcttggcattgatactaacaaagtaacgacaactatttgcaaagataataaattttaaaattgttcatacatattgcaaaagtgctttgtaaaattgtactaattgacaagattaccaacagcttatgaaagtatgtcccctgacaattttcctaacacaaacttgtttttcattttaaaaacctagcatgtagataatatctatctttataattttgttgtctttggtaatggtaggatttattttcacatctgtttattgtttatgtatgtttcttcttggatgaaatgtttgtctatgttccatgtgtatatatgttggttttgatttgctatataaatatatataaagctctttatatattaatgatgttaacaaaggtttagattctgcatcattttaacacagatttaatattatccatattaacctaatcatcttaacattttttgtgcaccacaagacttccaaatttgaaatctatgaaactacattctaaagcagaagtatactatttgatcattgttccattctttgattagaagtacatttgatacttgagaaatgggaacatataatgtttcaacagtaaaagaagattaaaaacattaaaataaaacactgtgggaaaaaataagattaaaacttgccttctgtcttggcacagttatgtgtccctcccactgaaatcactgtaaggatataaattatctcagaatcccgtggctgtatttagtattcctcctccagcctaccacagaaccccatgtttaatgatagcaatattcaaatttatctacatcatcattttatgcattggtctttcacttaaaaaaagttacttgaataatatttcattatatgattacactacattctgtttagttattgatcagctgatggacgtttggcctgttttggctatagcactaatagtgctacaatgaacattcatgtacaagttttttcttgaatacatggtggaatatggatgaacctgacacggattatgcaaatgatggaaatcagacacaaaaggacacatagtgtgtgactgcattatttgaaatgtccagaacagataaattcataggaacagaaagtagattcgtggttgcgaggggctgggaggagaggagaatgtggaatgattgcttgagaggaacagggctttattttggaataatgaaaatgtcttagagttctatagaggagatggttgcctaacattgtgagtatcctaaatgccacttaattgttcccttgaaaatggttaacagtcaattttatataatgtgaattttaccttaaatgtgcacacgtttatatatgcatatgcatatgtaatatatgtataaggaaatatatatattatttctcatacatattcatattagaaagagagaaaaatagagacagagagagaaaaaggagagtgcatcatttacttctaagtcaccatggtttatctcagtctctcaaacacagaagccacccaagaaatgtttgaagtaaattacaggaattaaaattcaatcacttataaaatccatttggggtctgatattttatattatctattgtgtagctggctaaagaagaacccattattcttaatttaaggtgtatgaaatgtcaggctgctggctctagtttaattcacagtacaaccaccattggtaaagttccttatgatttattaaacctgcttatcctatgtgactataattcatcccatctagcccaggtagcatcatttctccttgggactgggagaaatggcatttagaaggtacaccacctattctagagtttgggaacttaaatttctcctactcgataacatcctttggcttaagctcacaggtgctatccttggattttgatgtctggataatggccatatctccatgggttgcttggacttggagaaaggtagtagaaacaaagaggtgtttggcaatagtaaaggtgatgatatcctctttctcagcagacaaaccctgaataatcagtagcttgacacaattaaggtttatttctcagttaggcctgatgtgagcaagacagctctcttccatcctgcagttcatggggtgacgaaccagccctatctgtgcagtattgtcccattattagcagtaaaagtcccagaaaatctctcccacaggacaaaatgtcctgatttttggcaataagaatgtaaggttaggagaaaagtacaaaaccccaagtctgcactgaaaaattaggaccaaaagcagcatctttactcactctgagcgatgagactgaagcgtgcaactggaagtgtgttgtcatcgtgatgttaccagcccatctttggctttgcctgtagaataactgttgttctttgtgtcaaagtaactatagtttgatattcattttttaacaatgtgaaaattatgactatgttttcaagagtttagatgataagaatgatatcaattgcaataccaataccatatgaccagacatcaccaaaaaaaaaggtggattagcagataaattattaacaaaaagcatactgcacaataagcacaaaagaattttggattgggcatggtagaggatatcagaatgcatatggaaattcaatctcctaagtccaagatgagccaggcaagtacttccacatcaatcaaaagtatttttgtctttcaggagccaccaacgctcaagtgaaaatagtggccactgaattcgcttagcaaaccacacaagcatacatatatcaacattccatccccttaattgtactaggactgagaaaagctacattttctatttcagagattgcaactaacatgtcctttaggcaaacaacaaaattttgataccagatatgttggccctttatctgtagaactgattttatcatgctttctgcagtatatcaaatgatgtgttaaaatcagaacagaagaatttccccccagctctgatgcagtttgctttatttttttattttgagacagggtcttactctgtcacccaggctggagtgccgtggcgcgatcttggctcactgcaacctctgcctcccgggttcaagcaattctcctgcctcagcctcccgaatagctgggactacaggtgtgcaccactaccttccagtgaatttttgtatttttagtagagatggggttttgccacattggccaggctggtcttgaactcctggcctcaaatgatccaggcacctcaacatcccaaagtgctgggattacaggcatgagccaccttgcctggccctgcagtttgctttaaaaaatagagtttcaaattgttttcttggttttgttgaagatttttttttaacttttattttaggtgcaggggtacatgtgcaggtttgttaatacaggcaaacttacgtcacaggggattggtatacagaccattttgtcacccaggtacgaagcctagtacctgatacttatttttcctgatcctctccctcctctcaaccttctccctcaagtaggccatttctcttcttcccttcttcgtgtcattggttctcattatttagctcccacttataaatgagaacatatggtatttggttttctcttcctctgttaatttgctaaggataatggcctctgggtccatccatgttcctgcaaaggacaagactcgttctttttgtatggctgcatagtatttcatggtatacattacacactttctttatccagtctatcattgatggacatttagggtgattccatgtcttgctattgtaaacagtgctgcaataaaaacatgtgtgtgtgtatctttacggtggtatgatttctattccttgggtatatactcagtaataggattgctgtgtccaatggtagttctgttttgagctctttgaggaattgccacactgctttccacaatggttgaactgatttacactgcaaccaacgatatataagtgttcacttttctctgcaacttcgccagagtctgttattttttgacttactaatgatagctattctgactgctgtgagataatatctaactgtggttttattctgcatttctttagtaattagtgatattgatcattttttcatatgtttgttaactgcatgtatttcttcttttgaaaagtgtctgttcacgtcctttgcccactttttattgggattgttatttcttgtaaatttgtttaagttccttatggatgctggatattagacctttgtcgaatgcatagtttgccaaaatattctcccattctgtaggctgtttactctgttgatagtttctttagctgtgcagaagctctttagtttgattagattccatttgtccatttttgcttttgtcacagttgctttcggcatctttgtcataaaatcttcgctaattcatctgtccagactggtacttcctaggttatcttcctgggtttttatagttttaggttttacatttaagtctttaattcatcttgagttgatttttgtgtgtggtttagggaagggatccagtttcaatcttctgcacacggctggccagttatcccagcaccacttactgaataggaagtcctttctccattgcttgtttctatcagcttctttgaagagcagatggttgtaggtgtgcagcattatttctgggccctctcttctgtcccattggtctatgtttctgtttctacaccagtaccatgctgttttggttactgtgtaccctgtagtatagtttgagtttgggcaatgtgaggattttaataaagccatagaaatcatcagagaacagatttatttttgcatcttgtcaaaataccaactagattttactcatttatctgcagattcagccagtgtgcaaatataaatgttgacaaatttcactcagtctgtaaattcttagcaaataaaataatagttattatctgctaaagtcttgaacattttgtacacaatactgctaaaaagaaatatttactggccgggcgtggtggctcacacttgtaatcccagcgctttgggaggccaaggcaggcagatcactaagtcaggaaatcgagatcatcctggctaagatggtgaaaccccatctctattaaaaaaaaaaaatacaaaaaattagccgggcatggtggcaggcgcctgtagtcccagctactcgggactctgagtcaggagaatggcgtgaaaccaggaggcagagcttgcagtgagccgagatcgtgccactgcactccagcctgggcaacagagcaagactccatctcaaaaaaaaaaaaaaaaaaaaaaggaaaaaaagaaagagagaaatattatttacttacctatgacatagaggctttaatcctaaaaaatgtttagtcaattttcaggttcctcaacatttgcagaagtactttctatgtttttgcttttctttttttttttttaactttataaaaatgaaagaagatagccttcttacacatgtaccccagaaaatccacaaaatgatactaagatgtcagcctgccataatatgtgtccaaagggcggggcaaggagaacgtccttctctagtctgtaaatacattgagaatgaggatacagaaaagtataactttgaaacaagaacctatgtgggtttttctaaaactgtttgatgatctttgaagaggatataagaagcttataaaagaagggaccgatgcacttgactttttctatgttatgtgtacaagttgtgacagtagttctcacaggaaagaaaaaaattcctttttctcagaaagactgcttcagaactcaagagagtgtcactaaaaaagggcaaccaagctaaacaggactttctcctttttttgtaaataaaaactctgactcctagactccaactttgattttatacgttgaaattacctctatgactttacatcattttctctgacagaagaaattcaacttatagtgacatccaatgtgctacagagtgttttaaaatgacatgaaattaaagatgtaagtgaccagtccaaggagtttattgatgcaaatgaggtaatggacaaacagctggtttaccaaaaaagacagatgtgacacaaagtgaatggacatttttggaaagcaggaaaggaatgcctaaagggtttaaagcacattgttgccagtgaggaaaactctgtgtattccagtcaaacacttttccctagaggatttatagcatgatgtcgacccattgggccaagcatcattttaatgtggatttagtaagagtgcattaaattatatttagtttcagaaccacacagaagaaaagaaggactaggtattagtcccttctcacattgctatgaagaaatacctgacactgggtaatttataaagaaaagaggtttaatgtattcacagttcagcatggctggggaggcctcatgaaacttacaatcatggtggaaggtgaaggggaagcaaggaccttcttcacatggtggcaggagagagaagagtgagccaaggaggaacttgccaaacttataaaaccatcaaatcttgtgagaactcactcactattattagaacagcatggggttttaaagctgcccccacgatccaatcactttccaccaggttcctccctcaacacatgggattacaattcaagatgagatttgggtgaggacacaaaccctaaccatattagacttccttaaggccacaggcagcttcaagaaccatccccctgttgtgggcagtaaggcgtatcctttcatccccactggcacaatgatcacatctccaagttcttttgttttctatttaattttagggcagcatatctggcctgatttatcaacgacagccattgtttactgcagattaatcagaggcaggtgacgaccaaagaaggtcattcggggatcttgaagccacaattacagtgatttcaagggagattatgtaatttagcagaaacttccattgttttcttcctttgtcaaatacatctcacatgtttgcttgcaaaaactcacagatggggcaagctctttcaagttactatttcaaaatcacacaatgaaggtccccaatctacattcctcagcacgagggccttgactcctttctctaaccccagctccatggcaaccttttcttctggcctttgcagctgcagcttttgaggagccctgcttgggatactattttgggtgccctcattagatacaaggtcagtgcgactatgtgtgcccattgcagctgcacagaggggagagatctaggacactgaaaacaaacccaggatgccatctcccttacttctcacttcgccaaggcagctggaccctcctgagatatcatttatccacgacaaacttgctgttcagctcaggtgaagagaggggtggagaaagtcagctccaagcagcaccctttgtgaggggcaattgttttgagtgtgattgtctttgggacacattctgtctggctctcttccccaggcacatggtaggaacacccctccaaaccctcttgaaattaaggatagttgcatgacttgcatcggccaaggaaatgagcacaaaagtgtcccatgcattctttgctatctttcctctttcattctgctgtgaacacctgtgttttccaacagagctgctgccatagccagggtcctggggtggggccaacgtggcacagagaactcagggcctacacccaatgggcacacagcataaaggagaaatcagcctttgtggtgaggctctatgcctctaggattttggagatagagagttaccagaacataacccaaattatcttgactacaacaacgtagttgaaaaagggtgtgaaatctgaagaatcccaatgccaggtcttagaaacaacttctcagaccagaagtcctaagactacactttctgttgaaaaggagatgtcattcatgttgtgtgcactcatagagggaacgattgcagtgcgggcacatggagagcaaccaaccaagcacagaagcatccaagggcaccagatgatcattagcgttttcacatcatcttctccaccacaccaaatacctggacttccctttgcaaaactctcacacccatcaccacatttgagacctccaggactgggatatctagagccactattatccatgagaaaatgaaaagagaggttgaaggactggaccactgattttatgaattgtgctggttgtttcctttgctgtgcagcagcttcttactttgatgtggtctcacttgtttatttttgtttttatggtctatgcttttcatgttatgctgcctttgtttggtgtccaaagggagaaaaaaatcattgccaaggccagtgtaaagagcttttcttcctacgtgttctcctaggcattttatcattttagattctacatgtacatctttaattcatttctagttaatttttatatggtgtaagatgaggatccgatttcattgacttgcatgtgaataaccgatttactgcaaaccatttattgaagagactttcctttctcctttgcatattcttggcacacaatgagattccacttctcacatgttaggatagttattatccaaaagacaagagagaggtgctggcgaggaggtagaggaaagggaccctgtctgcggttgatgggactgtaaattggtacagtcattatggagaacagtatggaggtgcctcaaacaactgaaataacactgcgatggatgtgagagtgtctgttatagcaacaagggaaaattcaccaaaaatacgtgaaaaatctaagcatttccacaggcagcctgttgtgtcattgataagagaggatatttcacacagaaacaattttaagggttgttattaataatacgctggcactatttcaaacacagtggcacctggaacaaacacaggttcggctccagtgcagaagaagagggaagggtatcatttagcggacatgatcataactggagctcaggaggagctgaaataagatccaggcagggaaatcattggatagaatcttcctggtgctgaattggaggaagtctgattttatctaaagatgattttaggagctttgatagagagaagggaggaaagcagaaaggagagggggagaaaacactgcaaaaaaggaggtacaccgcacaggtatagctgataagtgcaattccacctctctcccccagcaggaatgggttcagcaataagactgttatgtaagttggtctgagcaaatgtgtttcccagggagtaggacagcagttatcagaggcaaaattttattcttctataggtacaagaaaaatacattacaaaaaatgatttctttttttttcagccagtttgaataaacgtttcaggtgtgtgcatttagaagggtatcagccagagcagctatcagggcagagctcatggtcatgccccactttggaggggaagggcatggttaggctgttcttgcactactataaaaaatacctgaggctgagtaatgtatacagaaaagatatttaattggctcacagttctgcaggctgttcaggaaagcatggtgctggcatctgctcagcttctggggaggccttggggagcttttactcatggcggaagaagaagggaaagcaggtgtctctcatgacaagaatggcagcaagagtgtgaggaggtgctgcacacttttaaatcatcagatcgtgcaagaacgaactcactattgtgaagacagcaccaagccatgaaggatccgcccccataatccaattacctcctaccaggcccacctccaacactggggactgcaattcaacatgagatttggaggggacatctcatatatatcagagcatgagaaaggagcggacactcaagggagtgggcacgtctttctggagagtccacttctttagcaaatcaacagctgatgaagcaggaactgatggacactcccaggcaggtgcagccaggagaccatgcagacacagacactgtgtggccaatgctccccctgacatagcagaagggtcctggcctgatcacgtggtctaccaccatggggaagagaccacatcagagccggatgcagagagctgagcttactgcagcagagccgccatgcagaggaaccactgtccacctacacccttctccacccccagaccaccaggtctgggtgaatacacattgaccagctcacccaagtagattctttagacctgttggtagcaacataccagccctggctagttattttctcattcacaggtgagtcagtcgggggcacaaaaatcacgtgtgcgcttatgaaaagatccagcaccataagagaatggagagaagtaagccttaaggggcagaagaaaagcacactttagtaacattttagtaaatgaaaaatatatggatttgagacatcacctgctttgagcccacaaacaaggctcagctacagagcagaaatgagagagcgatcgctcttttcacagaggcagctatccagatactctttaaatattgcctctggctgtcatctattttagcaaatgaatggtattaggtagaggaagctgggaaaagtgtgaaagatggacacagcaaactgagcaagcctccttcttttctctgtttccctcatgtattaattaggcagtgagcagagatggatgaaaccactcaatctgtccaatccaaaatgcccacctaatcccttgctccccttctctttctccagcgaatgtgcttcctcaaggccacatcaactctatactctgcttttcccaaattcagggcttactactgacagatacaatgattttttttttccttagtgtaagtacgtccccatgaaatatttgggatatacttgtactaaaaatgtattcatggttggtctgaaattcagatctcactgcctgtcctgtattttatctggaaactctgacagggagtgatgcatgtcatggggcttccaaggggaatcaattgctcagaagcagacagctcgcaaattagaactcctgggaaaacacaaggagggaggaaattaaatggaagacacccagaatggctgcagtaaggattctttaaaaacttaatcaggagaaggttccttgggcagaaagtctggagtcaagagggcaattatttttcctttttagaattttgcttcttattccacagaggaaacagaaaatacaatttttctttcgggtgattaaggccaaaggaaagtctgtgctagaggtctggccttaccatctgataacagcagcaaagaaagattaacttattaatactttcataaatatttaagactatgcatccaaacactattgtggacccctacacagacacccttgacttccaagccaactcttagagtttccccagggagatgttttatgttcttatcattgggaaaattaagaaacatttcaaatgagctgcaaaatcagaccaagatataaataattcacaaggagactagcagattccagatatggaatgtttatcagaataactgctccctacacagtttttccttttactttttcttctctccagcagctgctgcaaagctccatacaatcaagaacctttcttctctagtttgtttgttttgctttgctttgctttgtttcattttgttttgagatggggtcttgctctattgcccaagctggggtgcagtggtgcgatcatggcttaccacagcccatcccggttttaaaccctaaaaatctattttggtcagacttctttgacatacctccaaaggaaggagagataagttcaggaaatccaagtgcagacaatgtgggtatttcctttcctgggtagatcccaagtggaactgaaatggactttggtgatgtaatccagggatagaggtggctgggtcctatgtgtgtctttgcagatgaacctgagacagcgtgatagagcatcttttgtcccagcctagtccgttgggttttctggaaaccagcatcttgtgagaatagcagaataatttccatgttactaagaaagatagtagggtagaaatagaggccaagagatgcaatggcaaccctccagtggatgaaagagaagacacagaagacatctgcatgggaaatgggaaagaaaaaaatagagcaaacgtcctccgagacagatcaagaatggaaaggaaggagcttcccctctatcccacatcccttatgcccagaacatcacaagttcctcggatttagaggagatgaagggggaaaacacgcaggaatcccagaatgcataagacagcctcagtataattcagtattcattgaccaaaggccttcacatgacagcttccaaaacccaaaagacagaaggacagaaatagtgaccactcctcaggtagtcctttcttctatgaaagaacaggcctttcctggaacccgccaactgacttcctcttatgcctcactggaggtcacatgcccactgctataccaccaatcactggcaaaggaaaagtggctgaagcgaatggcttcatccaatcaaaattcatctcctacagactggggctaccttcttggagatgagggcattaatcctaacacctgaccagagacaagaagaagggggaaagacttttggttaggtcactgacaatatctgcaacttggggcaaaatggtaagaacgaggactgttgcgtcctcccctccaaagagaacccaagtaggcatcatccccacctccttacatcctgaggtcttcttattttcgtatcacacatgaaaccaaggagactacaggagaggtcatccgaacagtggcagaggtgagctggccatgacctccttcactcctgactccggttctttccataacactgtgttttctcatataccatggaatactatgcagccataaaaaggatgagttcgtgtcctttgcagggacatggatgaagctggaaaccatcattctgagcaaattatcacaaggacagaaaaccaaacaccgcatgttctcactcataaatagtattttcaaagggcattgtcaaagttttaaaaaatacgttattttcacatttttctaccataaaaacgcatagaaaattgcatcacctttgctatttagaagaactcctttcagactccttctttaagaactaacagaagcaagcacataaagccaaggcaagacaccgtgcactcttccaacaatgtcacacacaacaactcacctcgtcattgcaacaacctatgagaaaagcatcattatctcaactttagtgatgggaacactcctcaaagagattaaatatcttgcccaacatcacaaagctggtgagagtcacagccaggatctagctccagagaagtatatcataaaagatgttacgtttactctacaaacagagtttagtgcccagtgggattaagtgcgtatatatggatttcagaaaattcacatacctggaacaaggtaagataataaaatctaacaggcaataagtttattcaagcaaataattggtaaaataaagttttaaatattattttaaaaataaaattaaaaatgaaattaataccacccctttgaaaattgtttagtactctctattaaagttagcacctaccaaagctaaacatgtacatactctgttacccatcagccccactgctaaatctattatcaacacaattttttgtgcataattttgccaaaattcatgtactagaatgtttgagaaaccagtatttgtaacagccagaagccagaaactacccaaatttccaaatggtagtttgtggtatatgtgtatatatacataaaattatatataacattatatacatatagcttatataattaaatagactattcaacaatgagtatgggtaatctaaaattgcacgtaaaggccagtcacggtggctcatgcccgtaatcccagtgctttgggaggctgaggcaggtgaatcacttgaggtcaggagtttgataccagcctggccaatatagtgaaaccctgtctctgctaaaaatacaaaaatcagccatacatggtggtgggtgtctgtattcctggctgcttgggaggccaaggcaggataatcacttgaacccaggaggcagaggttgcagtaagccgagatctcgccattgcactccagtctgggtgacagagtgaaactccatctcaaaaataatgatacaataaaattgcatgtaaaaatatgaatgacatgaatagatacaatgctgaatgaacaaagccagaacctgccagccagaaaattatgtctcaaaacactcttatttctgcaataattatacctactatgtatactgtataaatccatttacataaagcacaaacaagcaaaatgtatctttttgttgggagttgctgcctatgggcagtcaggtagacgtggttagaggaaggggagatgaggaaggcctctgcgggctgagtgtgttctgtctctccagtacagtttgagtgacacaggtgtgttcaattgtgaacactcaccaggtgggcggtgaggatacaggcaagcttctacatgtacatggcactttaattagaatattttagagggtcaaatgatttgaacttcttcaatattacctgtctttaaattttgcatattttatttcttttttgccttcctggcacatctgtgatatcaaaaaaaagtctaggttttatttattgttaatgttctcccttgaaaaagcagttttcttgctgtgatacataaattaacctcttggcataacgattttccttttcattaaatggaactgtcaggggagagtaaaaagcaagaactttactggaatgaaagaaactgggattaattttttttccctgttctcaagcgctcctggaggacgggttggatcaagtcttccccactctgggaggaactctggcctccctgcctgcagctgagggctgactttgaaccagcgcatgtgctggaatctcctcctcacggaggaaacttgagttggtcactgatggagtttggagcctctgggattataactatcgctaatctgaaatcaaggaggcagctatgcatagagagaggcatctgccccagtatctctctaagggtatagagaaacaggcccatgtacacacctggatgggaaatgggtacggcctccatcagaaaaatggtcaaaacaggttaaaagccttaaagactgtgcaaatcttcaactcagtaattctacttctaagaaatgattctataaaataactggacaagtctttactccatattaattatatttccattgaaattctatttcagttttgcttgggataaatacaattttaacttaactatcatttgactaagtaagtacaagttagggtaacttaacatagttgttgtaaattattgcagaaataagagtgttttgaaacctataattttctggctggcaggtgaagcaaaagtcattttctgatgaaattgtggagatgagatttctaagaaatgtgttcatgttcgtcctggaattcagaggccagtctggatttattgtatcttccagaaaccaatttatccccaatagatcacacagagaaatatgtcttgattctcctcttgcaactaacactcaatattttagtttattttatccacaaaagaaatagagatttttcacagtttattatgctgcacgctccctgatggacgttctttgaaacaaatatatgtttttctttgctagaatgagcataattacgtcagtggatagatcacatttaccaacagctctttttggaaatcttgagacatctgttgtagctgcttgaggctttagtgaatgcaagctggagtcattaagttaaggctctgagagtccctttctctggccagtggaggactccagggtcatccattagctttggaatttgtttctgtcatcctggccttcaaggtcattttttttcctgaaagctggaacctcatcaaaaggcacctggatggagaccttgtaggctgagggcttgctggtcagcaacactggcagctgggctggtgaaaaataaattaatttatcacacctgcagttctgacctacacagtcgaaggcaaagaaaaaacatggaacatcatgatcattcattaaggtgttgggttttatgcccggagctcaatgcttcccccccaccccattatggagaataagcagacaattatataaccatctgacctaatttgaggtttctattcaaagagtgttttaaaatgcaacttttattgtgattcagggagagtgagaccaacagatcagctaccattaaacagatggattgttacagttcccgagaggtagggcacacagcacaggggcaattggaagccgggtaagttaaaacgcagagggagtgaggggatggtgcgggtaagagctttcactatggttactatggcaactaacaagggaggtagggtaaataggaataggatcgattagttggaataatttcagccagccctttggtgtaggtgtattctccagttttctggtacctggccctggggtaattagggcaggtatatagtatccctgagtataagatactcaccaagaaggttgttggggtctaggctccaggtgggtattttatatatgaaaggagtgcagtcttttgctatctctaggaattacctaaccccaggtggggcagtcactcccttgtcagcaagatcccagatgtcaaagcatttgcttttggattctttgtcatgaaatcctaattttcagcaaacagaaattacattgtaccttttttaagtttttaattttttgtttttgatttttttgaaacagagtctggctctgtcacccaggctggggtgcagtggcgcgatgacagctcactgcaacctctgcctcctgggctcaagcaatcctcctgcctcagcctcctgagtagcttggactataggtacatgccactgcacttggctaacttttgtactttttatagagacagggtttcgccgcattgcccaggctggtctcaaactcctgtactcaagggatctacctcccttgagctcccaaagtgctgcgattacaggtgtgagtgaacgtgcccatcccaaacaaaaattttaaaaatgcacacttaatacaagattcatctcacctacatggccagggaatcagaagatgattcccttcttgtcctgcagcatcccattccacaactctgtgagacgagctgatgtttccacacccttgaaattcagggtgcacaggtatgtgggatcaaaaaatgcgaccctattaaaggcatctggacttccttacctgctaaactggcctattctattatctgaagagagaaaaataacttttttgtacatatcaaatattcagtcttgatctggttgcagagccaacgaatgtgttgtttttctcaatcctgtaggtttattggttgcattaaaaaaaagtctaaggaaattaggaacacaaattcctaggccatttcagggcaagaattcactggacttcttaaaaacaatataggaactaaaaaattaccaacaaaaaaaaaaagcccaggaccagaccgattcacaccagaattctaccagacattcaaagcagaattggtaccaatctttttgacaatattccacaagttagagaaagagggaaccctccctaatccattctatgaagccagcatcaccctaataccaaaaccaggaaaggacataatcaaaaaagaaaactacagactgatatccctgatgaacgtagatgctaaaatccttaacacaatactagctaaccaaatccaacaacatcaaaaagataatctaccatgatcaaatgggttccatactggggattcagggatgatttaacatacacaagtcgataaagcttatacaccacataaacagaattaaaaacaaaaatcacatgatcatctcaatagatgcaaaaaagcaaaagtcagcatccctttatgattaacgctttcagcaaaatcggcatacagaggacacacctcaatgtaataaaagccatctatgacaaacgcacagccaacataatactgaatggggaaaagctgaaagtgttccctctgagaactggaacaagacaagatgtccactcttaccactcctcttcaacatagtactggaagtcctagacagagcaatcagacaagggaaagaaataaagggcatccaaattggtaaagaggaattcaaactgtcactgtttacctcaaaaaccctaaagactcctccagaaagcccctagaactaataaaagaattcagcaaagtttctggatacaagattaatgtacacaaataagtacctcttttatactgtaccaatcatgaccaagaggagaatcaaatcaagaactcaaccccttttacaatagctgcagaaaaaaataaaaaataaaaaataaaatacttaggaatatacctaacaaaggagttgaaagacctctacaaggaaaactacaaaacactgctgaaagaaatcacagacaacataaacaaatggaaacacatcccatgctcatgaataggtagaatcaatattgtgaaaatgatcatactgccaaaagcaatctaccaattcaatgcaatccccaccaaaatactaccatcattcttcaaagaattagaaaaaaaattctaaaattcatatagaaccaaagaagagcccacatagccaaagcaagactaagcaaaaataacaaatctgatacaaaaagaacaaatctggaggcatcaaattacttgatttcaaactatcctataaggccatagtcaccaaaacagcatggtactggtataaaaatagacacgtagaccaacagaacagaatagagaacccagaaataaacccaaatatttacaaccaactgatcttcgtaaaggcaaacaaaaacaaaatggggaaaggacacccttttcaacaaatggtgctgggataattggctaggcacatgtaggagaatgaaactggactctcatctctcaccttatacaaaaatcgactcaagatagattaaggacttaaatctaagacctgaaattataaaaattctagaagaaaacattggaaaaatccttctaggcattggcttaggtatggatttcatggccaagaacccaaaagcaaatgcaatataaaaaagttaaatagctgggacttaagtaaactaaagagcttttgcacggcaaaaggaacagtcaacagagtaaccagacaacccacagagtgggagaaaatcttcacaatctatacacctgacaaaggactaatatccagaatctacaaggaaatcaaacaaatcagtaagaaaaaaaacaaacaatcccatcaaaaagtgggcaaaggacatgaataggcaattctcaaaagaagatatacaaatggccaacaaacatatgaaaaaatgctcaacatcatttatgatcagggaaatgcaaatcaaaaccacaatgtgataccaccttactactgcaagaatggccgtaatcaaaaaagtcaaaaaacagtagatgttggcatggatgcggtgatcagggaacacttctacactgtttgtgggaatgtaaactagtacagccgctatggaaaacagtgtggagattccttaaagaactaaaagtagaactaccatttgaccagcaatcccactactgggtatctatccagaggaaaagaagtcattatacgaaaaagatgcttgcacacgcatgtttgtggcaacacaattcgcaattgcaaaatcgtggaaccaacccaaatgcccatcaatcaacgaatggataaagaaactgtggtattaatatacaacagaatactactcagtcataaaaaataattaattaacggcatttgcagtgacctggatgagactggagactattattctaagtaaggtaactcaggaatagaaaaccaaacttcatacgttctcattgatatgtaggagctaagctataaggacgcaaaggcataagaatgatacaatgggagggaggagccaagatggctgaataggaacagctccagtctacagctcccagcgtgagcgatgcagaagacgggtgatttctgcatttccatctgaggtaccgggaggatctcactagggagtgccagacagtgggcgcaggtcagtgggtgcacacaccgtgcgcgagctgaagccaggcgaggcattgcctcactcaggaagcacaaggggtcagggagttccctttcctagtcacagaaagcggtgacagacggcacctggaaaatcgggtcactcccaccctaatacagcgcttttccgatgggcttaaaaaatggcgcaccaggagattatatcctgcacctggcttggagggtcctggcccacggagtctcactgattgctagcacagcagtctgagatcaaactgcaagacggcagccaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcatgcagctggagatctgagatgggcagactgcctcctcaagtgggtccctgacccctgacccccgagcagcctaactgggaggcaccccccagcaggggcagactgacacctcacacggccaggtactccaacagacctgcagctgagggtcctgtctgttagaaggaaaactaacaaacagaaaggacatccacaccaaaaacccatctgtacatcactatcatcaaagaccaaaagtagataaaaccacaaagatggggaaaaaacagagcagaaaaactggaaactctaaaaagcagagcgcctctcctcctccaaaggaacacagttcctcaccagcaacggaacaaagctggacagaggatgactttgataagctgagagaagaaggcttcagacgatcaaattactctgagctacgggaggaaattcaaaccaaaggcaaagaagttgaaaactttgaaaaaaatttagaagaatgtataactagaataaccaacagagaagtgcttaaaggagctgatggagctgaaaaccaaggctcgagaactacgtgaagaatgcagaagcctcaggagccgatgcaatcaactggaagaaagggtatcagcgatggaagatgaagtgaatgaaatgaagcgagaagagaagtttagagaaaaaagaataaaaagaaacgagcaaagcctccaagaaatatgggactatgtgaaaagaccaaatctacgtctgattggtgtacctgaaagtgacggggagaatggaaccaagttggaaaacactctgcaggatattatctaggagaacttccccaatctagcaaggaaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccataaagggaagcccatcagactaacagcggatctcttggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccagtaccagccactgcaaaatcatgccaaaatgtaaagaccatcaagactaggaagaaactgcatcaactaacgagcaaaataaccagctaacatcataatgacaggatcaaattcacacataacaatattgactttaaatgtaaatggactaaatgctccaattaaaagacacagactggcaaattggataaacagtcaagacccatcagtgtgctgcattcaggaaacacatctcatgtgcagagacacacataggctcaaaataaaaggatggaggaagatctaccaagcaaatggaaaacaaaaaaaaggcaggggttgcaatcctagtctctgataaaacagacttgaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgacagaaagtcaacaaggatacccaggaattaaactcagctctgcaccaagcgggcctaatagacatctacagaactctccaccccaaatcaacagaatatacatttttttcagcactacgccacacctattccaaaattgaccacatacttggaagtaaagctctccctagcaaatgtaaaacaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacaagaacaaagacacaacataccagaatctctgggatgcattcaaagcagtgcgtagagggaaatttatagcactaagtgcccacaagagaaagcaggaaagatccaaaattgacaccctaacatcacaattaaaagaactagaaaagcaagagcaaacacattcaaaagctagcagaaggcaagaaataactaaaattagagcagaactgaaggaaatagagacacaaaaaacccttcaaaaaattaatgaatccaggagctggttttttgaaaggatcaacaaaattgatagaccgctagcaagactaataaagaaaaaaagagagaagaaccaaatagacgcaataaaaaatgataaaggggatatcaccaccgatcccacagaaatacaaactaccatcagagaatactacaaatacctctatgcaaataaactagaaaatgtagaagaaatggataaattccttgacacatatactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttttgaggccagcatcatcctgataccaaagccaggcagagacacaaccaaaaaagagaattttagaccaatatccttgttgaacattgatgcaaaaatcctcaataaaatactggcaaactgaatccagcagcacatcaaaaagcttatccaccatgatcaagtgggcttcatccctgggatgcaaggctggttcaatatacgcaaatcaataactgtaatccagcatataaacagaaccaaagacaaaaaccacatgattatctcaatagatgcagaaaaggcctttgacaaaattcaacaacccttcatactaaaatctctcaataaattaggtattgatgggacgtatctcaaaataataagagctatctatgacaaacccacagccaatatcatactgaatgggcaaaaactggaagcatttcctttgaaaactggcacaagacagagatgccctctctcaccactcctattcaaaatagtgttggaagttctggccagggcaattaggcaggagaaggaaataaagggtattcaattaggaaaagaggaagtcaaattgtccctgtttgcagacaacatgactgtatatctggaaaaccccattgtctcagcccaaaatctccttaagctgataagcaacttcagcaaagtctcaggatacaaaatcaatgtgcaaaaatcacaagcattcttatacaccaacaacagacaaacagagagccaaatcatgagtgaacgcccattcacaattgcttcaaagtgaataaaatacctaggaatccaacttacaagggatgtgaaggacctcttcaaggagaactgcaaaccactgctcaaggaaataaaagaggatacaaacaaatggaagaacattccatgctcatgggtaggaagaatcaatatcgtgaaaatggccatactgcccaaggtaatttacagattcaatgccatccccgtcaagctaccaatgactttcttcacagaagtggaaaaaactactttaaagttcatatggaaccataaaagagcctgcatcgccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaaaggggaaaggattccctatttaacaaatggtgctgggaaaactagctagccatatgtagaaagctgaaactggatcccttccttacaccttatacaaaaatcaattcaagatggattaaagacttaaacgttagacctaaaaccataaaaaccctagaagaaaacctaggcattacagttcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaagttttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacatatgaaaaaatgctcaccatcacgggccatcagagaaatgcaaatcaaaaccacaatgagataccatctcacaccagttagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaactgaacaatgagaacacatggacacaggaaggggaacatcacactctggggactgttgtggggtggggggaggggggagggatagcattgggagatatacctaatgctagatgatgagttagtgggtgcagcgcaccagcatggcacatgtatacatatgtaactaacctgcacattgtgcacatgtaccctaaaacttaaagtataaaaaaaaaaaaaaagtttgcaaaaaaaaaaaaaagaatgatacaatggactttggggtctcgggagggggatgagggataacagactacaaatagggtgcagtgcatacttcgcgggtgattggtgcaccaaaattgcacaaatcaccgctaaaaaacttactcatgtaaccaaataccacctgtattccaacaacttaagaaaaaataaaaaataaattagaaaaacaaaataggaatcaatctcaacatggaaatgggttgcgctaaagattgcattttgtcctcttcgtttttgaagataatttcctatgcacatttctggtatcaatgtcaactctgctacttgctacctgtataacacagtcatgacattagtttgtgcaagtctcactttcttcagctgtgaaatggagataataataggttctagctgggcaaggtggttcacacctgaaatcccagaaatttgggagactgagatgagaggatcgcttgagctcaggagtttgagaccagcttgggcaacataccgaaaccctatctttattataaataaataataggtcttcctcatatgaccactgtgatggagaaatcgcattacaatggagcatttgtgaagcatgtgatgaatgttaactctgacaatcatgaatcttattactatggcagactgtcttttccaaaaatggccacaatatgctcttcttaaaatttggagtgtttgtttgtttgtatgttctttttttttttttccctctccctttgcaacgaagcaggcttttgtgactgtcctaatggataggatatgtcacaagttaggatgtgggactatcaactgtagcatagaaacgactctacaactctgcctgatcatcgtgggactctcaggctttgaatccagccatgatgctctgaggaagtcaagtagccacatggagagacccagctaaggttgcagtggatggccagcatcatccccaggcatgtgtaaacaagccttcaggtgactccatcccatacttacctatgggactaatgctgagtgcagggagaagagcacgcccctcctagcccagcccacatggattatccacaaggaaaatcaatgctgttttaagccactgagtttggaatgatttttgacatagtaataatgctaaaataaaaggtttgtaatatataggaatcctattaatgtttgtgctattatttttttctaattaactaacctcaagcagcccctctccccaaacctaagatagaaaaactaaaaggtgaaaagaaatcttgattcttagcaatacatgaattttgcataaaatatattaccgtgtgaagcaatatttctttaacaataatatattgagaggcagaagtttctatttctgctaatttgcataggtgtaggtatatctgtacctatatatttatatcaatacctatatacagatctatattgatagataaatacataattattttcttacttcagttttacccttttgttctataatcaggataaaatagtgataacttttaaatgattgaattaaagtacattcctgtatttaatagtagtttaacaacttaggcagcataaatatgttctcttataacaagcaaaaaaaatgctgagtacatctaaatcaataaaatggtttcctttttttaaagactgtaaaaaatacaaagggagctcaagaatagattcagaaaataaacgattgaaattataatatacgtgttacttgtatctttaaaaaatgctattttaaaaaatgtaaagatttccctaagcaagagagattctcaatttactttgaaatgactgttcttagtttgcttgatgctactttttaatctttgtcagttaaagggcaacataatatccttcaggatgaaccagagaagagtacaaagatcagctcagaaccaacatatcttctttctgagtagtttgacccagtgaatatttcttttagaatgtcttatatttcaaatggtagcactgccttctccttctttacagaaataatattttagaaatactcgctttgatcaagttatggatacttgctagctatatctgttatggaaaatcactagacaaagttaactcatcacttttttatcgtggtgtatataaaacatgaatatcttttctaaaactgactttccttggtcgaaagatgtctgcatcaataggaaggtagacacacaaatctctaactctgaaattttatagtgtgtaagcccatgatttttctgtccagatagaaagaataaaatttagaatgaacatcttcctttcaccaaagcatggcacatttgcatcttttaaaacaggtagttctctaagttctttgtaaacgctcactgacagtattcagatcacccaggaatccacctaagaacctacagcagggctggaagcactgggtgttccaatcactgtctggagaacctctcatttgtatgcctaccgatagtgacctcatattctcacttttcaactatttttgactatttttatttatttatttatttttatttattttttgagacagagccttgctctgtcacccaggctggagtgcaatggcaaaatctcagctcactgcaacctccacctcccgggttcaaaggattctcacgcctcagcctcccaagtagctggaattacaggcatgtgccaccacgtccagctaatttttttttgtatttttagtagaaatggggtttcaccatgttggtcaggctggtctcgaaatactgacctcaaatgatccgcccgccttggcctcccaaagtgctgggatgacaggcgtgagccactgagcccggccctgttttctttttatagtctcagattaggtgatttatcggctgaactatgtcatattcaaatgtcatttcatatccaacactcactcacttggacacagattgggaggagaaaagtttattcttctctgagattacagggaaaagtgaccattttcttcacgggaaaacataaattcccagaagtttttgtttgtttgttttttgttttgttttgttttttgtttggttttttttttttttttttgaaaaagtgtctcgctgtgtcactcaggtgggagtgcactggcgcaatctgcgctcactgtaacctccacctcccaggttcaagtgatcccatcacttcagcctcctgagtagctgggattacaggcatgtaacaccacacccagttaatttttgtatttttgtagagacagggttttaccatgttggccaggctggtcttgaactcacgacatcaggcatgagccaccacgcccggccttatttttaagaataaagcctaaggtcattactgagactatcccttccaaatatcattgccattgtgccttacttcctgtaaaaaatagaaataaaattcaagtggatagagattttggatttcgagttactcgagtcaaggttccatgggccaattgcagaggctctgtgggtctaagttaaaaaaaaaaaaaaaaacataaaacaaaaagactccaaagttcttcagcttttccaagtgctcaggtcactcatggtcactgatgctcaacaaggtgtcctttctgattcaccattctttctaaggtccaaaaaaggtccttgagttatttgcaggatcttactctctcaatcctttgctttcttgttcaagccagcaaatttacccgtttcctgcaacctgctgttcaccaaattcaaagcctgtcttcatactactaccgtatcagttatctgaaatgattcctgaactcattttccaattagctctagcaattaagtctcaaggtctctgagatcagagatctatagacccaaaggaaatacttctgagtgaatatctttgcaaagagattaggaggaaaaaagacttgaatataaaaacttttaggcccataagtgaaaataccaacaatcttcttgtaagatttcagctatctgggccgggcgcggcggctcacgcctgtcatcccagcactttgggaggccgaggtgggcggatcacaaggtcaggagatcgagaccatcctggctaacacggtgaaaccctgtctccactaaaaaaatacaaaaacattagccgggcgtggtggcaggcgcctgtagtcccagatactcgggaggctgaggcaggagaatggcgtgaaccgggaggcagagcttgcagcgagctgagattgcgccactgcactccagcctgggtgacaaagcgagactctgtctcaaaaaaaaaaaaaaaagatttcagctatctgaaatagtaatagtgtgcattttttacttcttgtaatgctttcttttaacttcaggggaacatgtgcaggatgggcaagtttgttacataggtaaatgtatggtatacagattatttcatcacccaggtattaagcctcgtatccattagttatctttcctgatcctctccctccatcctcctccctctggtaggccccagtgtgtgctgtgcccctctatgtgcccatgtgttctcatcatttagctcccacttgtgaaagaggacatgcggtttttggttttctgttcctgagttagtttgctaaggataatggcctccagctctctctatgtccctgcaaaggacataatctcattcctctttatggctacatagtattccacagtgtatatgtaccacattttctttatgcagtctatcattgatgggcatttaggttgattccatgtctttgctattgtgaatagtgctgcaattaacatacacgtgcatgtatctttataatagaattattgatattcctttgggtatatactcagtaatgggattgctgggtttaatggtagttctgcctttagctctttgagaaatcaccacactgtcttccataatggttgaactaatgtatactcccaccaacagtgtaaaagtatttattttctcccacaagcttgtcagcatctgttattttttgactttttaatcgtaaccattctgaatggtgtgagatggtatctcatttgtgtttctctaatgaccagtgatgttgagctttttttttttttttcatgatttttggccccatgtatgtcttttgagaagtatctctttatgtcctttgccactttttagcggggttgtttgttttcttcttgtacatttgtttaagttccttatagatgctggatattagacctttgtcagatgcatggattgcaaaaattttcctcccattttgtaggttgtctgtttactctgttgatagtttcttttgctgtgtagaagctctttagtttaattagattccatttgtcaattctattttaaattccaaggcacactggtgttccttcagggctacacaaaattatttgttctcgtcttgaaattatctgatttatcaactttctcgctggatgcccataactactgtggaccaaagtaaatacgcaaagtcattaaattcctgatttcttcctgatactgcatcacggtgtctccttgctgatggagagtagcagtttgttcagtccaagattctattgcactcacataatctcatcaactttcaaggtgacctttagcatcaacaagtatttctcaattgtgtagctcatttcctaatcagtggtagcccttgagtctccaagtctctgctagcagagatctgtagccccacaataaatggttctatgtgtctggacatttccccaatcaataaagaaagaaaagaaaaacctaaatgtgtaaatttttaggcacatagttacatttactcatttagttaaacctattctatcactgtattatatacaaagttagaagtgttgcttttactcattctcatatttcctaaagcaatttacttaaacacatcatatgtacatcatatgtatgcttgacatcaatatacttttcagtctcgaaacacctgtctaatgcagttttccagagcacatgtgttaagttgcctgagatagagtgcaagctatattgatgttttgttttgcctggaaattgtatctcagaccaccagtgcctatttgcttaacctcaggatatttatttttttccttgttcaatgagtatacatgatcacaacaaaacaacttcaatattgttctattagagttctttgaatgccttataaagtttaatgctcgcagttttaaattcatagccctaaaaatagctactaaatctttgttaaatattattattgctattgtttgttttccttctcctccttttcatcttggccttttcattttcttattttcttctcaatcattgtcttttttttctcttccatcctcttcctttcctatttctcttaataaatggtgttgggtggttctggctcaaggaagcttctgaggttgccgttaagatgtcagccagggctgtagtcctctcaaaatcacctaaaacttgctcatgtgatagttgcagtcttgaggcatttgccatttcaacccctcaacagagctatcttatgacagctgctttcctccagaaaaaaaataagaagcgacacccccaatgaaagccacaggttttttggtcttctttttataacctaatctcagagcagatacctctgagatttggcctattctgttcattggaagagagttcttcaattcagctcatgttaaaggaaaagggattccacagggagtagacaccctgaggcaggggtcagtgatcaccatcttacaggctgccatggtcaccatgtgcaaacttagggaaagctgggagagcagcaagccaaaataaccaagtatttgcatcaaaaaccaaaaattaatcccttgaagtaatttcagtagttgaagctagaaacagataaaggcacagttgagactaagtaaacctttcatttctaccaaaatgatgagttgactcaaagaatatccttgtgtatttgttatagttgtaggaatgtcacaaaggtgtttaaaatatccaaatattctccattgccaaagttatatgactgaaattaagttacctgtagattttgttttagtttttctagtaaattttgttattgttaatgttgccgtcagctgtattttgaccaataccatagggtgttgtggtagacgtagttctcactgtttctggggtatgtttctgcactcagtataatactgagccaacagggaagacctgcatgacctgtggggcctgatccattgcggaaggtaagattgtagacagcttctgtctctgtttttggtagagactttgctatgctaactaataatctgagttataatattccaatgagaacacaagagctcttagtacataacagagtctgcttgatttccttgagtttccccagcttcttgtcctgtggttagccccacccgagaaatctgagggtagctctcacattctgagccagactccattccaggcagggaaaagcagcccatgttggagagcagggcaagtcagatcttgtgaagccaaatgcagggaggtaagagaggtggagaaaaagacatggacaccctagcacaatagacacgtggccagccagcctctagtccactggtttccaagctctgagaccaggcaggacatgtaacaccagccatccctcctcctaaccctgtgttcaactcccaagtgcctgcagtcacagagcaaggagcagtggcttgtgaggttccatttccacatacaactctgtgagctagaaacagaaagagcaaggtgcagagagaatgcattgatatccacgtgggacgggcaagagaggtttccatcccaacttctgtcctccggaatgacgtaacaatgacctttggtgtttttttgctcagtcattgccaatttccctgaatcaaagttttggaaagaggtccataaaggctttttacttctaaaatagcttgtgaaagaacagactttgctgggggaatcagtgacatgtccaagcttacgatgatgcaaatgtagtcatctgaattgaatcagagagtcatcaccaaaggaaattggccctttttgtggtcaggatcatatttctaataatatcagttatgttttacccattttccgtggaaacagcacacaataacagatagtctataggaagctgtcctgcagtgaccttcatggcaggggagtttttaaaggctgagagtaattgtccaaagcagtacaacagatttggaggagacctggtgaaagagcccaagtcttaaggatgctagaacactcaaatcaattctctctgctgcaagcaaatgtaaccggattgctgcaggggttcgactatgattttccagagtcttagcatcctggatgctacaagcaaagtgaggacaaacatgcaactgacacagcaggggaggtgagaagggggcttcattccatattgtttttatataactcaatccttaggttctctttatacacaccaagcatattttaaactttccctggcttactttccagttaaagtcattgttagttttagagtaatctcattggaaaatcaaagatctagagtcatcaccaactattctgggtcattcactagtaaaattctaactcttttaaaacaaatttgtcagaaattctttattatgttggttgtactaaataaaattcactatgagtaaaatctcctcaactttctctgtaggtgcttcattcactcactaattcatccatgcatccatccatccatgcatccatccatccatccatccatccatccatccatctatacttacacaaatccatccatccatccatccacccacccacccacccattcattcaaccattcttctatccacccatccatccacgtacccacccatctatccatccatccacctacccacctatccatccatccttctatccatgcatgtatccacccatcaatccacgtacccacccacccatccacgccccatccacctacctacctacctatccatccatccatccacccatccatccaccctttcatttattcattcacaagcacctaccatgtgccgggctttggtctaagacctggggatcccatggtgaatgtgagtcacttccctgccctcatcatggtcacatgcaatgaaggattcagacaatatgcaagaaaacaaataaacaaacacaatttttaggttatgataaaatgctatgaagataataaatgggtaatttgatgaagggagactggaatgggagtgacggagccacctgagacagcgagtcagggaaggctccccagatgaagacatgggggtgctgtcctctaagcagggaaggtgcaaagcagacaggccaagaacaggagctgcaggcacaggatccagcaagggaaagtcctgaggcaagaataagcttggttagtttcagaaacaaaatggacatgggtagatggtatgtgtatttgctgcctgaacacatttcaaaaagtttataggtcaggtttgaagcatttaaattaaaaaataatcaatgaatatacacagcatttgaagatgtttttgtgtgtgttatttttatttctagttaagttttatctgatcaatgtaaggaatgcacgaagattcactgatgccacagggagatcaatttacatcacaaaagcagttagacattgctacatctgttattttgccaggaattcccccaagtacaacttttgctagacggtctttcctgaaaccatctgaaatcatgagtcagtatgtgccagctgtatttaagaccaaaggcttaatgtatccacatctggggtaggagtcagatgtaaaacaagcccaacattgccttggaagttctatagggtaagtaaatgctaacattcactttcttgcctcagtggctgtggctctcacctctactactataactagaagcttaatattcactttcattctttgaaaaggtgacagtgtttcttccagtccaataatggaactttccactaggttggtaacacaattcaatttttaagccaagctcagcctggttttgtcttaacaattgggttatttagcttgactcctacagaaaaacaagctctttcatgatgggatgtgcagctgtgaatagtacaacatggatgaatgtaattatgggatttgttaagtttggtgaaaagaaagtggattggaaggctgccatgcttatctatggaacgaaaaaaatgaaacatgtacaaatgatatattagaggtttaaaaaaggctcagacatgcaaggaaatttgaacattgactagatatttgaggatatttatatttttaattctatttatgaatgattacagtattacagtcatattttaagagttcttatgtttttaacacgcataaaaatatttacgtattctatgaaaaaacctctcagtagggcttttttaacctttgcaaaatcttccgatcatgttttgttcccaaattttgttctgttcgtattgtttgttgttgtcattgttggtaatacactgacctaaccaccaagatatttggaattcaactcagaatttccacaatcatagatagaggtcatattcattatgctttattcctaaacaattgaaaatttctccttcaagaatttgctagtattttgacatttaaccaagagttttcttctgaatctacagcaatggactctttcgtggctagatttgaatcccacgtacaacagaagcttccaaatgcgttgtttggccacaatgaagaatccttattgaaatatcccttgaatggcataattgaatagacgtaattgcaaagctctgcaccatgtaaaattgtaaatagcactgacaaaataatttatgctcatttatgatacagtagctcattatggctccaattttcatttccttcattagccaagctcatctgtttctctagtagacattccttttgtctattatctacaatccttttcccagagaaatggactcttgtgtatgtagatgagaagaactgagcatgagagggtgctgataacaggggatatgggcaccgcataacctaaacagactttgacaccacaacaaaagagagacagatactgtagaacaatgacaggtaaatattgtattagaatagtgcctatttctgctttggtttcaggaatgtcttataataaatgaataaagtgggtcaccactacaattacagcaataatgataatgagttcaataataacatgaaagaacaagaagcttgcaatcaagtcccatattccttgtgggtgtgtttaaggaaacctcgtgtcatatatttgttttactttaattacttccctcatcttctagtttattacttctctccaccttgtgtcaggttagaaaccatcacttccctatgtctcccatccttagctgcaatattccttctttatcttgagcagcaggagatctcttttctttctttccacttgttccagctggagaccatgacatagaagcctctcactttctgggattgttgaaataaaactgaaccccttccccactttacttgttcaacccagaggaaggttgaagaactgtggagatggaggatgcttacagtatttattctcctttttctaactagcaaggttaatatgtgaacattgtggtcatgtgtgacttacttgtaaggttcctggattctctgtgtttgacaaggtgagaggtggccctagtcctctatacgaatgggcccaaagaaaaactgtacttacagagtccaatgtagaggataattttactaaaggcccaaccatgtctaccaaaccagcaataggagcaatgaaattgctatgtttgtcatatttttatataaatatgcctctttttatttcaattggttccaaactcagagaggaatgaggtagggttaactgttgccctcctaaaacccaaaaatgaacagtaacattatattaaaagggtgggttgttggctaaatcaggtttttaaaagtatattaagacagagaacctcattaaggtttgtggtgtcgtgttaatggcacagatatgttttgctcatcctcatatttaaaacatgcaatatttagttggtgggtctcaatgttttgtctgaaaattttattagttaagaatagtgttcatttgaattagaggctaaaattagctgcttatatgagagagaagtttgtttctctctcatgaaaacatcttaagaaagaggtctgaagctggaatagtggtttggacctaaaggtcgtcaggaacccaggcttcttccagattgttgctctgcttctgacctccattcctcttcatctcattagcaagatggcagtaacagctacagacaccacctctacattaaagtatataggagaagacaaataaaaaactaggttgtagtccataggaggagcatgtccttgctatgccttggaagctgtcatgtgacacttctagtttcatctagaatttagttagtcacctgacattcccttgacccaatgtgtactgggtaatgtacgctttattctggacagctacctatgaagtcaaaaaaaacacaaattctattcttatgggggaaatgcatagggagaaaacgagtagtctcttccataggaaatacagttgcctttaaatggtgaagactaacatttaatatacctgcaattctgagctcaggtcaaggtgcactatattgtctgtggcagtgtaggtgcatgacgggacattttcagcatcacagccaactgtatggttgttcagatggtaacaaagacattgaatagaagcaaatgcacctaaacttcagcagcaaaacttctaagcaccctgcagagcctcagttcccttctttctaaaaccagcataatattatgtaacattgtgattataatatttgtcatgcctactttcaaaggtgttataagaatcaaatggccaggcgcagtggctcactcctataatcccagcactttgggaagccaaggcaggcggaccacctgaggtcaggagttcgagaccagtctggccaatatggtaaaacccagtctctactaaaaatacaaaaattagccagctgtggtggtgggcacctgtaatcccagctactcaggaggctgagacaggagaatcgcttgaacctggtatgcagaggttgcagtgagtggagatcgcgccattgcactccagcctgggtgacagagcaagactccatcttgaaaacaaaacaaatgagagaacatttagaaagcagatagcaggtataaaaatgaaaacctgtatgattttactttacctgtcatactaggagtccccagtccactgggtatttgagactcacgtaacataatacatcctaagtacttagaacaggggctgggaaagaggaggcactcattgtatgggactcatctttaggaggttaaatagaacttttcacctgtaaattaattgttagttgatataaagttggtatcttttggataaaataaagaatatacatgcctaggattataagatgtgggggaattgagataaaatttaaatccactgattccaatcatgtcctccataaattttccccattcttccacatagtgtattaccaggacccctgcctccctacctgatggacatttgcttggttgatatcctgggatgagttcatcatttctacctcacaccatattatctctgacagaaaccattaaagagaaagcctctttgttttacattgaacaacctgaagagccattttaaagtaaaagcaaataatgacatttttataaccagagtacatttatttgccttttccatcttgtcaaatgcagtgtccctattcacggatgtttattgtttagactcaggtagattagatttccacctcattttccctcttcctaaagccatgggtgctgatacctgctcaagaagttaacaacaataacaaagtatagctcagtttgtgcaaaattagagacaatggaatgctgagttcttgtagaatcaaagttgagaaaaaattctggagcaaaaaataatgtatcgtttaagtggatcctttccagtgtcatggaggaaacatcattttatttctcatttaaatagatcataatattgaccatctcatgggggttttgtgaagattctatgaaatagtattggcacacagttactgttgagtaaatgttgaatattactatgagaaacaatgggctgcagtgaaggttctcagatgtccttggatggaggaatttgatgacagttttcccggcagtcaggggactcagagagtaagcagcctcccacctggaccgtggtcttaggaagcttcaccctaggctcatgtcgggggtgcaggtaggaagagaggctctaaaggggctgggttatctttgccaaatgggagtgtatttcctgtattcacaaatcttctaacgtttcacagaaagccagatattgctattttttgtaaaacattttatttttacatgttggatattaattttaaatttttaaacattctgcaaggcaaacacaatgtgattgcaaacagcattgggccagataaccaccagttcaccgcctttgctctgacagaatacagtctgttcccagggatactgtttcatgggagaatctcaaagcaaatgaatgtaaaaaacattgcttatgttttgtcagcatatgtaaaatggaatcttggtggaataaatggaatttggagaatgcatgagagtatccctatagggttgaccagcataaagtttagagagggttagcctcagttatattctggcttctattgttatatccagttactgaatttacctctctacattcagtattttgtctgtgaaacagggatgataatgctccccgcgcacacatgcatgcaatcacctacacacatcaggcttttgtgaggatctcgtcaatgaggcaggttaaatctttagatcatgagccaaactcagtgagctcctagaaatggcagctgcttcctagctgccaatacccttcattcagctcaagaaaaacagcctttatttaactgagactggcttgtgagcaagactagtcttcggagcccataaacttgtatttgctcagatttggggtttccttaaagtccagtggaacacaggtccaactggcactggtttttatgtattcatgatgtgcactccttagtaattccctggaagggacatatgtgttatgtgggttttcaagctatacttacttgcaagttaaaactgcagagaacttgatagtttcaggactggtgggaactggctcatttaagaaaatctatggtgagagagatctccttctgtctgtttccctgacactacagccttgcatctattacttatttttctatttattatactcattggcacaacgatgcagccacaccagggggagaacatgctagtgggaattagagtggggttagctttcccccaccctatgcttttccaatccctggataacattttcccccttttccactgtaaatgcttacttcagatattattttgatgtactttccccaaaaaaaccctttcgtaggcgtagctatggaatcttagattcatgggctggaaattgatatagaaattttgtcgttggttctctggggaaatagctcatgctgttactcctgaatcctaagtagctgccttatcacttggcttggaatgctaagagaaagagcttgcaaagagccatttcaacgaatgagtttcctcctcattctttatagatgagggagggaagccttcccaaagtgggttgcatttttcccaatgcataatgaattagcaattgaaatttaagagaacgtacatcttttctaaagtactaaaaccttttattgtcatgaaagtaaattttatcatagaaacacttaaagacacagtaaaagcagaaggtaggaagacgactcaactaaatctattgacagtgaacgttagtccatttccttaatttccccctgtacattttaattctgtcctattcatgtcggcatatagttttgaattctgctccttttgctcagtattaagtataaactttttctgtgttattattccatattctttataaacacattcatgatgccccaaatatttcatatgtagacttgccataattaagcagtgtcttagtttggcatcttgggatggtttctgatcattactattacacatagcagtaatagtaataaccaacattattgagcatttgcctatgtcagccattgtgttcagggtttcatgtacattattgcatgggtttctcaacagcggctgagaccatttctattgtcatccccatgggcaaatgaggtcaccgaggcctaaataatgtatttaatgagcccaagggccaatggctcacacgtgttagaggcaggattgggtggttggagttttccattttttctgtgtttggattcatgaccagaataacaatgtggagccctgcctagatttaggcgcatgacaaagtgggtggagcattcaaagtgcagctggatttccagagactgaccttctctattgcctgaatgaaccaaccgaagtgatgttcttaatggaacaggtgcttccttggatcagttggttttttcctccttgttacttcggcagttcctgtttctgtcagatagttgggggtctcattttaggaaccagaggaatgttcaatttctatttcttttggggaggcttgggggtagagtggcattaggtagagtttggggttgcctctgaaacgtctcagaggactgactacacttccacactgactgactgaatactcttccacagagagatcaatagaggctacaccagcccagaagtcctgagattgagggtttagtctgacctccaccttgtggtagctgtgggaatgtgggatgtccattggtactcacctcaatttcctcatctcttaattaaggagggcagtgttttctcctcctatgtcctaggaagagaatattttgagaaccagtgggagaattatgatgtcctgtttgtttcttcctctctgggttccatttcttcttctgataagagccctcagctttcctctgaagatgaactccttcctcactcacagtctatgtccttccagtgggctgagtcaactctgtggctctctgcccatgacctttctgaagccaaggaaaaatacacaccctcaataatggcttcagatatgtatctgtgatccaggccagacctctcagagcaatgtttgaggatgaggtaatcataaagcaatccaaaattgagtacacttcccagcctgttccatggagcttgttccatttataggccatcagtccctcatatctctgtcatggtgtacacagctctggctgcctgggttgccacttttcatcttcatccctgcgtaataatctgtgttgactacaggcacatgtgttgcgtttacctgctcagcgtccatcctcccctccaccccaaccctgtctgatgtactaacttcctggggctgtcaatcaaaatgcccaatgctctcttggctgaggggtagggagaaatctgggccatgcacatgctctcctcagaaatgtaaatcttgagtcggaaaggctgaaaacagttggagctgctttacccatttgttgctgtggcaacaaatacatcttagctcctattcagttgctgtttcccaaagccagctttttctctttacctttgatgctgtgatcaatattatttttctttcaataggattctattctgggctaagataaccaaatttgtttcaaagaaaaattgcacacaacctttaccttctctacattcttgatactctttgcttctttccttctcatagaccttagctgtccgtctctttatctcctattccattctctccagtcagctttatgagaagaacccaatagtacattgttgttgctgtttatttgaagattcctctttcaataagctgggatgtctttgagcttctgactgcctgataacctttaacacccagtgctgatgtctgcgctggacatgagaaggaaccaaatattattgaatgggagctgtactttaattagttggtaaagcaacaggtgaaaactaattagggaggtaagtgagcgagagctgtcccagatcagttgcccatgtgttctttttgttttcatttttttgtttttgtttttttggtttgtttgtttggtttttgagacaacatttcactctgtcacccaggttggagtgcagtggcacgatcttggctcactgcaacttctgcctcccaggttcaagcaattctcctgcctcagcctcccaagtagctgggattgcaggcgtgtgccaccacactcagttaattttgcatttttagtggagacagagtttcgccatgttggccaggctggtctcgaactcctgatcttaagtgatctgcccgcctcggcctcccaaagtgctgggattacaagcgtgagccaccgcgcccgacctaattgcccgtatgttcttgatcctattccaaacaacactccaatcaaaagcctaagtcaagtgagttgagatgaaaacacacagaaccacaaaaatctgaattattatcttagattcactactaattttcacttttatgtatattgttctttttttaaaaaaaaagaagatacagaggtgtgtgtacagaaattcttgaaaaggtaaatcaattaacctttaccaggaagctagtacaaaaagaaggggtggtaaaacaacatcatttgtaaagatcagacttctcgctcctgccaaaaatatgcctacgaatgccaggagatagactacatttactctaccttgtaatctacaggtaacttcttaatgtaaagctaattttttcttgtcaccctgttattcttgctttcacatttttggttaattgtgggttatgtgggctacacataaaaagaaacaaaatatatctttacttacattagcctttttaaatatggaacttttcaaacatgcatgaatatagaaagaatgacatgactaatctccctgtactccttgaagattttccactattaggctgggcacagtggctcacacctctaatcccagcactttgggaggctgaggcgagcagatcacctgaggtcagaagtttcagaccagcccggccaacatggcgaaaccctgtctttactaaaattacaaaaattagccaggcatggtggcacatgcctgtattcccagctactcagaaggctgaggcaggagaatcacttgaacccgggaggcggaggttgtagggagttgaggtcgggtcactgcactccagactgggagatagagcaagactccatctcaaaaaaaaaaaaaacaaaatttttcttccacaattatcaatattttgtttaatttgttttatctccactaatacttctcattattatcaccaacaaagcaagattattattttttaaatgcccagacctccagtaattttacgtgtaaatatggtggtatgtattgctaatagagactcttttaagtaactaagatacatgatcgtacataatgcaatcatagtcagcaatattcatttcatagtattcaataccaatctatcttcacacttccctgctaccttaaaaatgtctgcctagagttcatttaaattaaggtccacacaaagcaagatccagatattttctttggttggtgtgttccataaatcctttaagtgtttacagtttcttgtatttttcctctttatccatgccatttatttgttttcttataaaaataattttccaatagaatttcccagattctacattgggctgtgtgcagaaatgagttagcatagcaggacggagactactctccatagaaaggtgttcttgcaagtcggcccttggttgatgtctaggaatttggattttggaaatgtgcctgccattccatggtaagactagctcactatgcctggaccattcaaacaatatgatttattctgaacacctgcttttcttccgggagtctggcattttggtatgtgcctggcagaagatctttatgtgaccagctcccaaaaaaccttgggtgctgagtctctaatgggcttccttgggcagaaacatggcctacctgttgctacattttcatagttgggggaagaatggattctgagaccctcataagagggagagatcactggaagccgacatggagattcccgcagacgctgccagtgtctttgacccctgggatctaatgtgtattcttatcacttccctgttacaaatctgagtcatgagcacaactatatgctagccctatgaaactttctaggaaaactccagatggagggtggtcctgagggccctcaacagaagccgattatgttatcatggcatttttaacatattcttacatccccatgttttctgtaaactggattttttaaatattgaggctcaatagtattagggggaggagtagattagaggtgggcttgtacttcttttattgcattatctcaggaggcagataatagcaagtcatcttccctccaattatgttctgattgatcagtagatggaagcatagagtcattttgtcatggttttaaagaagtcaaaatatgtgtagataggtgtgtgggaagctggcttaccacaggtgaggctggagcagttatcgagttcttgactttcagttctatacccatccgttttgatttcctctgtaacactgggactgaactttgtaaacattgcacatctgttagctggaacaatttacaaaaggattgtgcttctcctcctgatcccaatactctccttcttattcccataaggaagtagtcaccaggaaactctcttccagtgagcagcttctttgccataatgcatggggcttcaatagtacatccatccaacaagttttgctgggcccccgtgggcagtttcttgcttgccaggcccagcctgttgcacctcactgaacccctctacctgggttcagagccacatcctttccaaagagtctgatctcaaacttggagatggccctttcccaagtctcttctgtctttggcatgctccttcagtcccagaggtagtgcctgctccccacatctgtgactgccatattcttcagattgctttttacccttcttagtacatgaccctgttttacaagcatcctttatacatgatatgcagccccatcccttccctaacatgaggaaaaacaggcctcaagtcattgcatcatccctggttgcattagatactcctcaaatttagtcagggtcccactgactattctgttacctgaaagctaaattgtataacaatagcatataatttgtatgtaaagtaataaagggaaggaggaaaagacaataaaaattattatttataaaaacaaacacacataacaaggaaagagaaactacgcaaaagcatagaacactcatttctgcttatatatacatgtgccattattctcaggatccattccatatttccatacttctcttgctctcagccaaaaagtcaattagtcaagattccttatctggtagagtaactcaagccttcatttctaaagagtctgaatcttcaatagtcctacttttgattgttgctttgattttcactaagaacttaatataatgatttttattttttaattgacagataaaatggtttgtattttctgtgtacactatgatgctctaaagtatatatacattgtggaatggctcaatccagctaattcacatattcattacctctcatagtcctcattttggtggtgaaaacactactctctcagcatttctcaagaatacaatatatgatgaacctttgttgtcatgtgcaatggacctcattcacttattcctcctgcctaactgaaattttgtatcctttgaacaacacctccccagctccctcccaggatccttgatctgatctgtcagcctttaccactgagcacggaagcaccaggagacatcaggatcaagaaattacttggttccagtgagtcccccttgctctgtgtactaaacacgaacccaatttccttttggtaatttggtaatttccatccccagccagcagaggcactcttttcttgcctgttcatttagcgacggctgtcttcatccttcaattcagtaaaaccattgttgaatcctctggtggaagcagtcccaacgtggggcctgaaacctctgaacctgcagagctcagctgctgggccaagacattgtcttacggcctttgcaattttatgattacaacagagattatttcaggaattttttcagagtgagcttattgcaaatttcatgcactgcaatttattttgttcgttggcttatttcagttctgagactggccaatgcaattagcattattcttacataggagcacatttggacaactttgaaaggccagtctcctactcctaagccagcagtgcctgttttcagcaatgcatatgcaaaacaggcagtgtttccccagagcaggatctgccttccagagggccctggctttcaaactactgctcactctgtgtcagtggcacaaaatcagtttaatggattgcaaccagctattaaaaaacagaataggctaaaacagaaccgaatagagaacagagtaagaaatgtcagagcacattataggtagtaagggtgtgtacaaatttatgaaacttctctttgagttttgaatgtgtatgtcgcataatatgtcattaacacaaaatgtaattcttactgtgggttatgctaaaaaagtcaagtttacttttctacaacttataccacgaaatggctagtgcatacacctaaatgcagagaacagccttgtatgggtaatacagtgatgttaatttaaaagaaacactcatccatagctttcagctttaacttaattttaaaaaagataatcgtagtaacacacaaaacgcacactcatatacatataattactatctcccaggccacgttcttagtgtgttttactacagacttgttcttcactatctcagtgactcaccaccaatccccttggaatcggcattattattatcctcattttgcaactgaggaaactgaatcacagaaaggtaaagtaatttcctgaaggttgcacatttaggaagaactggagctagaattcaaacacaaacaggcagcctatgtttccttggatctattggcaaagtttcttacctggtcatctggagaagagaggtgaatgggaatttgtttaataatcctatttgcataaatccaatttatttaagtgataggcatagttggtcttggagtaaggagggtgacatcgtgtttaaattgagcagcagctagctccaaaactgtggcagcaccagtaagaagaactctgatattgtttgtgaatctagtggagaagtgtgttgaacgattagcaaagtctgccatgggcacagaatcagataatggcacacatgccaccaagtatgtgctctgcagtctttctctaaagcactgtggcctaggcctaggttctagttcctgaagatacagaagtgaacaaaaaagacaaatgaactttcctatgcagggaagacaataaagacagataataaaatgaataattgaatacacatacgattttaggtagtcactttggatactaagaaggaaagaaaagcagtgcaaagaaaaagagatggcacagaggtaggcagtggccctctaaggtatcagggaagccatctctgaggaagggaggtttactaggacagaatgattgtattctcattggagagagtgaccccacaggtatctgaagaaagagcatttgaggcagaagaaatagcagagaaacaggccacttccttggcttattcaaggaacagacaagacctgtcctaagcctttcggccatctatgtgtaatttcaaattgtacaaaaagctcagaagcataggcatgagcaccctagaagaatttgtagatgaggaagtgttttttatttttgactttttaaaaaaaaaattatttattttgaaatagagtgttgctctgtcacccaggctgcagtgcagtggtgtgacccaggctgcagcctctacctcccaggctcaggtgatcctctcacttcagcctcccaattagctgggagccacaggctcatgccaccacacctggctaattttgttttttttttttagagacgaagtctcagtatgctgcccaggctggtctcaaactcctgggctcaagcgatcctcccacctcagcctcctaaggttgctgggattagaggcatgagacactttgtacatttcaaagtttttttaaaaaaaataatttatgagaagcacataaaagaaaaatattaaaatactttataaattgtgtaagtaccgtctcagttaataacacatttgaggttgcggtttggaactccttctaggtcttcatgatgtgcctgctaagaagatatttgctcatttctctgtggcaaccagaaccaatttcagaataaggtcatttttaaaatgtaaagaaaattatacattatatgacaccccatccaatttagttctatgttccaatgacctagttaagtgtttctcagctggaaatgatttcttcccacagaagacatttggcaatgtatggggactactgaggttatcccaattagagaatggtactgacgtctagccagcagaggccaggtatgttgctaaaaatcctacagtgcaaaagaaagaccctactacaaagaatcatctgacttgtaatgtcaatggatcgaaggctgaaatgccctgatttaggtagaaagcactggtcacaagtggacactgaatcctttgtctctgctctgattttctgcagttgccatggagaccaggtgatgcacacatgcaaattcagtggccgtgcagaagtttcaagatcagggcgagggaaaagacagacagtaaatgacactgcagaggcaacactaacaagcaaggttctgcaggggctgaacatcatattcatcaaactttggagtttgccctcagagatccccctcctggagcaggggaattcctgatctatcgacttctgtgtcaatattcagaactacagtcaggaggaccggcttgttttcccttcttctccatactcaagatgacactataatgagagagttggctgcaaaatcccttacaagagatgatggtcatcacagtcagagatatgtcaaagcacaggcagtgcagcctgggtggaaatgtggtttggaaattcagaaggagtttaccactttgataacagatgcattgtgtcatttcttctggtggtcattttgacatcgaagcattaaccttggattttgctatttctttttaattttaattcccttctatttggccttattattaatcctgagaaggcttttttttctttttcaaaaaacacaaatatttggtattgatcttaccagggagaacagaagagtatggccatgttacctgagaggagttagtgctattgcagcatagggtggaacaattgaggcttcatttgtgcagggagagaattcagtcttcttcaaagctgatctctctgtgtgtgtgtgtgtgtgtgtgtgtgtgtgtgtgtgtgtgtgtgtggtgtgtttgtgtgtatctgcctaaaagctaacaccaggatctcattttatctgtaattgaaacgtgaactaatggattaatattattagtctgtcacctatagacaaaaagagagtcttcggtgatcagaaatcaacttaatatactctaagcacttttaacatcttacaccatttaaaccacacagacacacgcatggggtgagtgtaaaaacaaatagacacatcatagaagacaattagcaattttgtcagaagtcttaaaatatatttccactatgcattcatatttcacttctaaaaatatatcctaaggaaataatttcaatgctgcagttaactattgcttctgcctgccctggaaaggttgttccttctgctactggcacccaaattccctttgggaatgtctctcttgcccactctccatccatgtgtttaggtggggccaatgccttcctctgctcagagagcagccccagtgtcaggtctaagaaattagtgaatttcatcgttttgcattgtaatctgttcaaagctgagaataaggatcagttaaattctaagccagggatgtcccagaacgttaatagaactgtggaaataaggtctctttttaattacatgtattgctggaaggatatgagcttggaaaggtagggtaccaccacacggagagaacctagctaaaaatgtatctgtcacagaaaatagtagggctgagcacgtgaacctaggatggactccaggcctctctcaccgtcagctagaatcttggcttgaggaagacagactttctatgtgcaatgctgtgtctctgctaccaagaatgtcacttgggaaatgctcataaatgtctgtgggataaagactttggggaacaaaatcctgatgaggccccttgagtacctcaacgaagccatttctgaagccaatgtactcctttccagttatgacagttaacatattcttgtgtgggtgtgtgtttgttttctagcttaagccagcttgaattgggttcataacaaataaacatttcaaatacaagaaatgtctgcacagcagtttattcactgatactcatctcacaatttgctctgtactgtgtgtattttgtatttcgctagctggtgaggatgaacatgagacagccaagtaaaaagggctcccggaagaagctccgtccggcctgctcattgggaggagtgcgcgctggggtgcggcctcgggaaattcgcgtcatttgcaggaaggaggagcctggcctctcctgttctggggtggaactggggattccatctgggaggcaggcaaccggctagcaggactctcgctttgctgagagtccctgttttccttttttattttttcttttcgcccagtgaattttatttttctcacccttcaaggtgtctgcgagcctcatctttcacggccgtttgacaagaacccggcttttagcggaaccaaaaagaaagccctacaacaaatggggtcactgttacagagagatgctcttagatgccatgcatttaatgagcaagatgtttagtcttgtgtaggttggtccacccatgcatttcccagaacccctaaaggggcttatgggtgtcaccttaatcaccttaaatttctctgagacgccttgagattttacatcccagggccagtttttctctgggtccaggggatcaacagcccctttatgccttgggatgggatttcacaatatccccttaggtccacctccctgtgaatctgtgaagtgagtgtgtgttaccaaatctgtaacataacctatgtgaggttcagctcatatccagccaggaaacctgtttacatttacaatgatagaaaatagcatcagcataaatagccaacaatagattaaataagaactttttttttttagatggagtttcactcttgttgcccaggctggagtgcagtggcacgatctcagctcaccgcaacctctgtctttcgggttcaagcgattctcctgcctcagcctctcgagtagctgggattacaggcatgcaccaccatgcctggctaattttgtatttttagtagaaatggggttttaccatgttggccaggctggtctcgaactcctgacctcaagtgatccacccgcctcagcctcccaaagtgctgggattacaggcatgagccaccactccctgcacatccaatagtttattatacagttattaaaaccaagttcatttaattcattcacttaacaaatattttttgtgccctgttcccagattcccaagctggccctggaagataatggtttaagaaaatgcctgcctcgcctctgagtaactgatacttgctttccagtgggaaaggtggataataaacaagtcaataagctaaataattacaaactatagcaactctataaagaaaagggagctgtgataagaaatagaaaagagaaagcctattttccacaggggtcatcagggaaggtctctcagaggaggcactgactctgagacttaaaaaaaaaggaggaaccagccatgcatagcacaagaaagtcctcgtgcacgcagggaaccaacaagttcctgtgtggcgggcatgtcgtgagtaacaggaaaacagtacgagatggaactgaggtgggggcaaggaagaagtagtcttcctggttcctttccacctcagtaaggaagcatgatttatgtttgtttattttcatgagaatgtatcactgaagaataagtaaagaaaaatatattacatgcatgcaaaaaaatacattctcattcatggatagaaagaaatgttggaaaggaatacttcaaatattcaagaatgtaatgggtttatgagtgatctttttgtgacttcttttggcctatctacaagggacatatgtaaaaagaaaaagacccatagtttaaacacaatgacactgtagaaaacttaacggatgcctgcgtgtaatatggttggcaaacacagatgactcggcatgtgaagcacaggcaaatcctaatgggggctgctcaccctccagagaagcggacctgtcattgctgctctcccattaagatgtgaggtcatgtgcacagatcctcaaagacgactctttaatgggatgtgggcaccatgatatataatactcctattttcatattgtggctcatatgccatttgaaagctggcagaaataaacccttgagaactgaaatggcatctccctagaccccagaaatattgtcacaggaaatatttggattgtgttaatcactattgaattccccattccctgtcttccagtcagcccttgtttaaagcttattttctgtgccaatcaaagatttctttcagataatcacaaaaactcttctttgggaactaacaaatgtactccttgggtttcactgtctacacctccaggtgaatgctggaagacatgatgtttatcctaatgctactcactttacagctgtactcagataaatgtgaatttggtttcaatcttcaaatacatcgtctgagatgagttgtgtagaccactgctccatgattacattcagggagattcagaggttcgtgattgtgtctaagccaaaaatggtggcagtatatgatacgaaatgaaagtgagtaaaagattacataacggaaaatatgaaaagtgaattgctccagggtttgcagccaaccaaatctcccaacaagagaaactaaaagcatatagccaaaatatttttaagcttttttttttttttttttttttttgaaagagcctcgctctgttgccaggctggagtgcaatggtgtggtctcagctcactgcaacctctgcctcctgggttcaggcaattctcctgcctcagcctctcgagtagctgggactacaggcacacaccaccatacccagctagtttttgtatttttagtagagacagggtttcaccatgttggccagaatggtctctatctcctgaccttgtgattcgcctgcctcggcctcccaaagtgctaggattacaggcgtgagccgacgcgcctggcctaagctacctttttcaagacattggagagccctaagggtaggagaccatgagcgacaaagacctcggtataaaggagcccggttggtgtcagctactgttttgcacaacctttatccattaggcacttaccagcttaagtgtgatgggatgggggactgtgaatctcagtagaaatcctagcataaaacagaagcaaggtagcattctcagcagcctctcaaggacaaggaaataaaaattggagttcacggtcatcaaggtagctagaactttaaagactaagatctcagagaaatgggaaaaacagaaatgaactcagagattcttctcaactcaaggcatttgagaatgccttatttgcacagtgaaagaagcaaagaacctgcagagaaacctcattaaaagactgaaaagctaaacatagctttcagcagtctcgtagtttcggggagatgaaaattacagttaatcgttgtcttgatttatgacaagagtgacaccatagtacagtggcggaaagaatcattctttggatgtatggtgctagatcaaatgaatattcatgcagacaaaaaatgattcttgagacttatctaaaagttatacacaaaactctaaattgcctgcacttctataagttacagatataatgataatccttctagaaaggagtataggagaatctctttatgacactgggtcaggaaaatattttctcattagttcatggaaagtaaaaaccttaaaggaaaaaataaatttagctacattaaattggagagttttacttaacaaacaaacaccaataattagcttgactatggtcatttcacaacgcacatgaatatcaaaatatcacactgcacacataaaaaatatcagtttttgtttgtcgataatacctcaatataactgttggaacaaaaataccagtaggaaaaggcaagctgtagaaacactataaatatattttttaaaaagaggagattcaacagaaatgctgggaaattttggaacaagcatttcctacaaagaaaaaaaaacacatccaaatgatcactgaaagtcagtatagcagttagttaattctgggtgtggtggtgacttacagggttgaaaaggggtctttcttgggggccagtagtatagtaagacttaattttgatggtggttatacaagcatgttaactgtaaaaaaattgttgagttctacacctatgatttgtgcctttttctttatatcaactgtatatataattccatttaaaatcatttatttaaattttactatacaaaagagtaggaacacttccactttcaatcagtatggagtaatgagagcaggttttaccctcccacctgatacagacaaaaaaaaaaagcctagaaataaaaatatttaaaacaatagattttaagacattggacattagccaacaaggaacgctgatccctgagggatggaagacaaactagatggatactacaatgcttctagttcacgacctcaagagagtattcttgtggtacagggaaaaagaaagctctttgatttgaggactctgagagaccagcagaccagaatcaagaggacatcatactgaagaagagagagagcagcactctcttgagagagagaaagaactcccacattcttcaggggagcctcaatcaacatgaaacagaattccggtcatcagaggaatgtgaagaactccctgaagccagaggaaagaaatatttgaaataatttgtgataaccgtattcagggccaagtgtagttgttgttctcgccagcaagaacagaaagcctcatgcttcatggagtattacacagagtgcagaatggatctcactcaagaagggacgaatcattagacctacaatgagcactgttcaagttgcaacgaaaacgttgtaaaagtaagttctaaaactgacaaaccattttcataaaatataatggcatcccagaacaaaagccaggattatttctagtaatgccaaaaaacaaaaacaaaaaaccctcacccaactaggtaaactgtacagtgtctggcatctgatccagatttattaggcatggaaataagcacacaaatatgaccataataaagaggaaaaccaatcagtcagaaacaaaagagaactgacacagacgttagaattattagacaagtacatgaatgaagttgttataactgcatttcatatgttccacgaggtaaataaagctatttcctctctttctttctctccctcacataaacactgacacgctcacacacatacagatagaaatgctcctcaacttactacagagttatgtccagataaactcaacataagttataagtaaaaaatgcatttaatacacccagtctacggaacatcatagcttaggttagtctacttcatacatacacataacacttactttagccttcagttgggcaagattatctcacacaaagcctatcttataatatagtgttcaatatctcatgtaatttattgaataccacactgaaagtggaaaactgtattgtatgagtattcaaagtatgatttctactgcataaatattgcttttgcaccatagttcagttaaaaaaatcctaagttgaaacattgtaagtccgaaactatctgcgtaagtacgtgcatttgtatatacttccatgcatatatgtcaaaatctacatatctacatatgtgatgaatagatacaagtgttttaacatgtagaaaatcgtatctctcccaattaaaacttctagagataaaaaccacaatgtctgagatggaaaataccctggggaggaataacaacagactaagcatcacagaataagaactgtgaacataaaactgtaacagtagaatgaaattatccaaaatgaaacaaagaaaagagaaaacagaaaaatgagaagagcatcagtgagctgcacaacaatcccagtcacctaatatttgagtaactgaagttccaaaaggagaagatgaagagggggtgacagaaaaaaatagatttgatatagtgactaaattttttttcacctagttttatcaaaactagagatccaagaggctccatgaacccaacccaaagcacaagaagcaggaagaaaaatacacaaaagcacatcataatcaaatcagacaaacccagggataaaatattaacagcagtcagagaaaagaagtatttgatacagagtaacaaaataatgatgagaaccatttcttgtcagaaacaagacaagcaagaggagagtcggacagcatattttaaaaactgaaaaaaaatggtttgtgtattagacaattgtctatccgcagaaaaatattttaaaagtaaaggcaaaataaagatttctttacacaaaagatcgataaaagaatttatcagcaacagacccacactacaaggaatattaatagaactcctttaggcaaaaataaaatgatttcagaaggaaaaatggatgtccacaaagaaataaacaatactagaaatgataatttcatggataagtacctaaaatttttttctcatttctcattataaatctctttaaaagataattgactattgcaacaaatacaaaaacaatgtaatgtgagttttatgtaaaagtatggcaacaattgcaaaaggtttaggggaagaaatagaagtacactattttagtttcttatacttaagcaaagtagtataaatcactttaaagtatactgtgattgtcctttgccacacctataactgtagatcatcatattaagtgaaataactcagaaatggagagtcaaatacggcatgttctcatttacaggtgggagctaaaaaatgtgtgcacatggacatacagagtgaaaaaatggacactggggaatccaaagggaagggaggctgggaggggaatgagggatgagaaattacttaatgggtataatgtgcactattcaagtaatggctacactaaaagcccacactttgccacactgggcaatatacctatgtaacaaaactgcacttataccgcttaaatctattgaaaaaaactacactgtgataagttacagttgtgtaatttaaactcttaagaatgcatcaaaataacaaaacaaagatttaatcagcaaacatagaatataaaatgagatcataaaaatattcaattaatccaaaagaaggcagaagaggaaaagaggaagaaagaacatttgaggaaactataatataaatagtaagatgatagatttaattctaaacatatcagtaattatattacatgtaaatgtaaaaatactcccactaaaaaggcagatatttttattttgaatataaaggaaggctcaactatgaaacccactttagtataaagaaacatataggttaacattaaaataatggaaaaaattcctgctaacactgaaccaaggaaaagtaaaattgatacattaatatctcatgaagtaaattttacagcaaagaatatcatcacagataaaaaagtttatttcaaaatgataaaatagtcaatgcattgagaggctataataaccttcaatatttacgctcctattaacagaacttgaaaatatatgaagcaaaagctgatagaactactagaagtagacaaaaccacaattataatcagagatttcagtattcctccccaaaattgataggcctaatggaaaaatctgtgagaatataatatacttgaacaacactaacaatgaacctgacctaattgagcttcatagaatagtccactaaagaagagcggaatacacagttttttcaactgtacattgaataatcatcaagttaaaccacatcctgtgcaacctagaacttcaagtaatatatatatatatatatatataatctgtgaccttggggaaaaaaaaacaagtttcagtcaatataaaagcatttcagtaatacaaaatatatgttgtgaccacacaggaattaaaaattgtaatcaataatagagagatttccgtaaaattttcaaatttttcagaaattaaatatgcagttttagatttctatgggtcaaagaagacattaaaaggaaaatcaggaagaattttgaaatgaatgaaaatcttaacacaatatcaaaatctgcaggatgtcaatgacccagaatttgggagggggaagtttaaatgcctgtatcagaaaagaagaaaagcccttcgatgacttcagcttccatcttaagaaactagaaaaaacagataaaactcaaaggaagcagaagaaagaatatggtttttaaaagagctcagagtagatgtcaatgaaatggaaaatagaaaaaaaaaagagggaaattaatctgaaagcttgtttttaaagcat

SEQ ID NO: 401 - DNA, 64805 bp, Homo sapiens
tggaggctaaattaacatgtttatatgtagaaattaaagtacttttgcagatcactcaggtaccaagcaagaggagggactgcccactctatgctggtcagaccactgatgcagagttctgtaatcagttatgagtcctatattctaagaagccaagtgacaattgtcaaagtataaagaggaaaatgagggcaatcaaaaggcagttgcacaaggaacattagatctggtacaatgtggacatttgtaaggctgtcaagggagctgccttcggatctcagtgctaagtacaaagtcagagggtggatgttacagacagacagcttctgactgcacacaggaagatattgtcagaggcataaaaaaaaagaaggtatggcctctcacattcataaacatctcatcatgaaggatatttaaacaactccttggcctctacatttgaaagtagatttaatcataaggtaaagatggaaccaaggccactagcaatgtatttaatgtaaaactctttgcagctcctctagcaaaggcagatgtgccaaaaatgttcgcccaggccctgttctggcagggtgggaaatgtgtacttggttcccccactacctgtgtgccttggatcaaaggaacttgctccaaggttctgtcccagctctgaggtcttttaacaaatatatgatagactcctaccagcttgtcatgaggtcacctagtcatgacctcgaggaagtcccatcttgtctctgagccctgatttacaactctgtgaaccgaagacgttgaattagatgagcctaagattccctcctgttctgacattttgtgattttatagacatgcatgaagcagagcaggagaaaaccttagaaacccacttactttagctaaaacaatttagctttaagaatcctccactgaaaaatataccattttcatccattctcagttcaaagcatcagagtacagatcagggttttttttgtagtaaacagggattcaaggaaataaaacatattcgggaagttttattttattttatttttatttttttggtttgttttttgagacagggtctcactctcttgcccaggctggagtgcagtggtgccatcacagcttactgcagcctcaactttctgggctgaagtgatcctcccacctcagcctccaaagtaactgtgactacaggcttggccctccatgcctggctaatttttgtaattttttttctttttggagatggggtttcgtcatattgcccaggctggtggttgagctccagagcgcaagtgttctgcccacctcagcctccaaaagtgctgggattacaggcatgagccaccacactctgcctcagggaacttttacaaagcaagatgggaaagatgggtcaggggcctggagagcaggatatgagctctttgaggaacaaaggatttgggaatgggagtggggcttggagggagaacatttcccagtcagtcccagcaagggtcggagtccaccaaacataacccgaaggaagtgaatagaagaagcggcattccaaagccatttctgggctgcctcttaaccatagcaggaagccttctctgataaccattcctcctctggctgagtaccattgtgtgatgtctctgttgctgacactgtttcaatttccctagctggactagactgtcacttgtgaccagtttctactctctacaactcttggatgtgatggggaaggcaaacctggagtttggagttccaaaagatacatggtgagctggattttctctaccatccacctcaacaaactaaccctagacttcacacccaccccctgtagctgagctgaatgggtcctgcccattctcagggacttacccaggagctaacatgtgcatagatcccacctgtagatcctgatgggtctacccgggcttgagctcagggctagctggaaatgggagccagtacccttccatgagcagcactctaccaatttaggaaaagagctgctggaagatggaccaaggtttgctggccccttaggtccccttgcagtggtttcttaaagggttccaagtgggtttgggcctacctatccacagcaatacctcatgtgtgacactcttcattggcccttttcctttcctatcatgtgagactccctaacagtgttccttggaatcagcttccaaataaattacctgttcgcaagtccccatcaagggggctacttttagaaggaccacagcctagatgcccattaaactccacaaaggccattttggatcctgctggatgcagctatattgctaagtcccgtttcatggaacttacaagggaaaacaatggcagggccccagtggaagttgctgtgaaaactatagccctgggcaccatgttcatccccccacccccatcccatgcattcatctctgtcttctttttcaaatttgattttaaatatttacagcatcatacatcttcccccaccagatattactaatgaactgttattgtctgcaaaatctcccagatgagtgatggccaacttaaaaagagcatcaatgttttattcgtaaaatagaagctggaaacagagaatgcttatgcgcttttaggcctttgatcattattaatattgatacttcagtacaaagaaggcacttgggcaattagcaaaatcaaacagaactgaagattctatatagcagcaataaaaattatataaatatgtaaatgcttacaaacgtttaaatcaataagtagggcacatttcaagaaaatgtaaatgttcaacctgtacatttcaagaaaaatgtggaatgcgaaatgccttttctgagggtgaatatctcaatggcaaagaagaaactccagatactgcactatcctgccagagagagggctgtgccactgtgaaattgtatttctggattgcaatgaaatttcagagaccctcatggccattaacatcagccttctggagttgacttgcattctgtccccatctgccctgcctttcttctcttactgcttgttcacaatgtgaaccccagatggaggttcctcttctgattctgacaggcagcctggtttagcagacagcagagggtgcctcttggtgactggattctgggagccacagaaattagagtgaaaatcttagctggcctttccagctgtgtgacttggagcacactagttagtctctctgaatctcagtttctttatcttttaggtggagataagaataccaacctaatgcagaccacatgcttagtgtggtgactggtgcctcataagtgctcagtatgagtggctattccctgcccagcatacagtaaatgagcacaatttctacagattctgcaggctctgcttatggcaggacctgcatttttaaatggtttgtctttgcccagtgaatctgtgatcccaggtatccaagcctagatgagatcacagcattcaagtaagctagaaaattctcatcaccacagatttaaggcttttactgggaatagtttccttctaggtcgataggcagtggctgagagcccatgcccaccactcagcctccttgaagtggcagccagcacaacttctccagatgccattttgctaagtaggaattcaggaggatgaagaccgtactgggaaaatgaagcaatggagaaatactagagggtgggagtcaaacccttgggttcccctcccagacccaccactcatggctgtgtgaccttaggataaaataagatagccagggtctctaaagagtgaacctggcgtctaaaagtcctggtctagaaactcagctttactacatccttatctgtgtgtcttagggaaaaaggcctatcctttcttggcctcagtttcctcatctgtaaaagttcaaaatgcctggtatatggagagtgccccgggcagcagcagactcatagaagtgttcatagccattattgctcgagccttgtttcctcatctgtataataggatggtcatctcttgccctgcctacctcagaggcctccagagaaactcttcataggctagctcttcataggatgaaatcatctacagcctcaaatgatgattgatgttcttactgtttctgcagcagattctggattaccacttgaaagatcatgcttcaaattagcactcaccaattacaataatgaaagaacacacatatatgatttcatttaactgtgtcctagttgaggtcattgaccaagttatggaaaccgatcatcttctgccctcatgacaagttcatatctctctattcttccattttgctgcaattttctgaaacaagaggcccagtcctctccagagggaagaatcttcagctagaccttgggaacagtaagcagaaatacaggcatcctgggaaatggtcagctttctgctgggatggggtaggaaaggaaggtggtgatattcccagtgctactgtgcccttccttccgggttaggctgattataaagcagctagattcagtcaccaagcttaacagtgtgggtgacagaataatttaatgtcttctccaggagggctaagtaagccccagcatagacttttcacaatcactgtgcagacagagcctgaatgcccctggctgttgagcatgtcatgggacacaagaggttggctatttgctagatgctctcagcaactaagaaatttccacccttctctgattttttctaggtctaccttgagactgagtcacttgcctctgtgtcccctaaaacagagcacagtatgtggcacatatgcataaaacaagtgtttgttggttgaagaaataaattcatgtactggtgggggatgagtatggcagaaaggatgaatggattgatgactcctaggcagaaagcaacaaaaatagaaaaagaatatactgaaatgtcttggaatgtagtctagaggcagtgctcctggattgcagatcatgtactaagctaactgcaaggaaccctgcagtatttggctacacaagaggaccaattctatagaagctccagcaactggatataaatgctgccatgccccctctggtccatctatgtgccaaaaatctgaggcagaatgagatgttgggagtaggatgaggggcacaggatgcattgctgactatcactttccagccccaagcaccaggctccttctcttctgccctcctgtccttactgctgcacaagtgactcacctgtattggacctccagggcaaggcagaagtcatagaagcccactctgtcacaaagatagaaaattgaaataataaatgggggctttgaagggagaacataaagaggatgagtagaattgtagcctccacatgacttccctgttccagctgtacctccaaggagccccaggacccacttcctctttccactattctcaccaggctttggctcagtcaattcccatttgcagcaaaggatgcttgagtaccacaaggcacaatgttccccttttaatctgtgtaattctcagggttcaaagcaatctttaataagctagctattggtgctcttttctccttggagagaaaataagtaaatctcataaagatatttgccttctaaacacctgatctactcgtttctctggaagtatttagccaaaacctattatatgtcttctcctttctcagcgagctggataaatggactttgctaaggacctggatgccaggagagagaattatggaggtgatgattagcatgcttcctcatccatgaggcactctgtgcctccaagtgatgggtaccagacatctagatctccacagtgggttaggaaatcaaaggttctcaaccatcaccaccacataccccagtgaaccagctaccctggtaactagatacaaattctgtcacagtccctttggggtttaattttcacaggtctctggttacaaatcatcgaaatttgaaccagtggcagtgcacatacagttaattgagtcattttttcccaggatgtcagcttttgttgctatttctattctgaaacactgactcacactgttaatttaaactgtgtgtgtaaccgtggagatttcattacctttggcattcttttttttttctgtcctagaaaatctaatttcagaaaagagagtaggtaaaagtcacttccataccctgcactcaaatctttcatatacacaaaagtttccattggtctactggaagaaatccccactggtgccattttctactttgttgcctaatgaaataagaaaggtgtggctctgagagatgccagccgatgtgccattcctgccaaacgagatagaagagccaactctgcagcaaccttaactctgagctgtggcttaccagtccataagagaagaaagttgaaccaggtgatctctaaggaaatttcctgcttggacattccagaaaaatcaccccatggtagccttttcctgaatgtgcatcacagaatactggtttagtccttcactgggccattcaaaaggtatttactgaacacctcttttggcaccatggggtgtctagacgcttgtaaactgcaatggtcaagagcatgattctggtgtcagaggtttatgtctgagccctggcttcacatcacttactagctgcatgaacctggacaagttctgtgcctcaattttcttatctacaaaatacagtaatcatcatatctgcctcatagggttattgtaaatatgaatgagttagttcatttattataaatatgaaagagtcatgtgtcaaactgcttagaactatgcctggtctgtaataggtgttgctttttgttgttgttataacactggtgagcaaaagccaatgcagtcactctcttcatagagtttacagtcttatatgggagacagatatttatcacacattcattcaaacaaagataaaattgcaattatggcaagttttatacatgtatattttgctataagagcttataatatggatattttgacccagggagggaaggtttccctaagcttgagcttagatgcagagaataatacaggagttacttcaaggaatggagggtgtattttaaatatgggcaatattgaaaaaaataaaagaataaaaggaaaggcatttcaggcagaggaatcagcttgtttaaaggcctgtggaagaaggaagcaggtgcaatgtcctgatgtggattctctgtcctcctgggtacctaggtacctgctggtattgcatgtccctgactctgtgaatgtggatgtggacatgtgactttttctgcccaatgcaatgggaacataaatgtgtgtgtatgcacaccatgcctgcatggaagcctcaagagctagcgtgcaattggctatgctttcttctagtgcacacacactcctgcagggtgccacttctaatacatactggatacgtactgtgagcaataaatgagcctttgtgcttttaagatgctgtgatttgggggttgcttgttgctgcagcttaacctatcataccctgattcatagagaaggtaaataaaactggcaataagagagtaaagaggatgaaggggtaaggtaagatagggcagtgtttagggtcaatagtcaagagctttgtttgtcaagttaaggagaggtgatgccatcctaagagcaaaggcaagttactgaaggatctgaaatgtggagaaatgatgggaaaaagggcaaagagtaaggaagcaggaataaatagacctggggagtcaactgcatggcgcaggcaagagaccatgatagttttgctatagcggtggtagcagacaggaagtagtggatatctttgagatctatttgggaggttggaattgatgggactttggtgatggactgactacaagcagtgaaacaggaggaggcttccatattgctggcttgtccaactggacaaatgatggggccacttactgaaatggctcataataaaagaggagccaaaagcagggtttcaattagaaaactttcttgtgtccaagaacagtttctagcagaaggcttatgccaacattaattcatcagcaagaaaagagttaactttaactgacagtgcaggtatttctaaaaacaattccaagtactctatcatgcaagcaaagaatgtgcttcagaaaaaaaatttctcccccaacaacccaaaggaaaacatccagaaaaaatattattcctgtcatttttgtagagggggggattcttcctcatgatatattatgataaatatatcatgcctattaagagtccaaaaagggaagtaaaatttgtttgttctatttgactttattgaaagtagtagaatcaacacgaaactttcagtcagaggagcctgtgtttgaacccaagattttccacttattagctgggtgaacttgggtcaattatgacatttctatacatcccaattcactcatctgtactactaatacagagaattaatgtccatatctcagctgattttatcagataggatagtatatatgacttgctgagtacctatatccttaggatacagaggcactcattaaatgttaacctcttactggagggattatctgatagagttattaacagggggtttgtaatagaggtgtgagacctggataagaccattcacttctctttccctgtgaagatcttgttcaaagaattctaaatagaagatacagtagctaattgggattatgacttctgcttcaattccttcatatagaggttaaaactgggttgaaccacattgcttaagccaaaaaactaaagtagggctctggctttctgcttttgctttgaatctgaggtggctagtagtcacagacagcagagaggaataggaagagagagagggtggccagtcctgattgggaggctggctctttccagacgttcctgctttgtgcagacagagcatgcaagaggaaagttgtatttccctttgatcccttacctaagtgagtctgttaccagtaacacacaggccagtaacattaataagatctactggttaatctaagagctactatgattttgaaatgccattgagcataaataatttttctcaaatccctgaggtaactgtaatataaaatgaaaatatcagggatttctactggtgaatacaatcacatgtaccattagtaccattgcagtttgttatgtacattcacaatagaagattacaattctaataggtagaagttagcagaggtatttttttcctcatccaagtttattcctgtaccctactgggattctacccaggtacctacctgcttccccaccccaccacagtgttcagtgcctgcagaagcctgttttttttttcttttttttttttttgagacggagtctcactctgtcacccaggctggagtgcagtggtaccctctcggctcactgcagcctctgcctcccaggttcaagggattctcctgactcagcctcccgagtagctgggattacaggcacccaccactatacccagctaattttttgtatttttagttgagatggggtttcaccatgttggccaggctggtcttgaactcctgacctcgtgattcacccgcctcagcctcccaaagtgctggtattacaggtgtgagccactgcgcccagcccatttttttaatgtaatagttttattcaggtgtaattaacataccacacaattcatccatttaaagtatataactcagaggttttagtgcctttcagagaggtgtgcaactgtcaccacgattttagaacagctttatcatccccagatgaaaccccatacctgtagcagtcacttcctccccactttcacccagacctaggcaacaactaatctactctacaattttgctattctggacattttatataaataaaatcatacaggctgggcacggtggctcacacctgtaatcccagcactttgggaggctgaggtgggcaaatcgctggaggtcatgagttcgagaccagcctggccaacatggtgaaaccctgtctctactaaaatacaaaaattagccaggcatggtggcaggcacctgtaatcccagctactcaggaggctgaggcaggagaatcacttgaacctgcgaggtggagctaagatggcgccattgcactccagcctgggtgacagtgagacaccatctcaaaaaaaaaaaaattgtataatatgtggtcttctataactggctttttacacatagcgtgttttcaggcttcactcatgttgtggcatatatgagtacttcatttctctttttttgctgaataatattctgttatataaatacaacaatgtggtttattcattcatcagttgctagacatctgagatgtttctggttttggctattatgaataatgctgttataaatattggtgtacaagtttttgtgtggacataattttctcttgggtctgtatctaagagtgggatttctggatcatgtggtaactccatgtttaacttttgaatagtcattcaaatatttaaagtgactgtaccattaattattcaaatattcaaataaagtgactgtaccattttacatttccaccagcagtatatgagagcttcaattctccacaactaatctaagacttgttttacctatctttttattatagccgtcttagtgggtgtgaagtggtatcttattatggttttgaagagcatttctctgatagctaatggtcctgcacatctttttatgcacttattggccattcgtttgtcttctttggagaagtatacattcaagttctttgcccactcttaaattggactgtctttttattatggacttgtgtatgttctttatatattctaacataatttttttatcagatatttgattttcaactattctcccattctgtggatgtcttttcatttttgatagtgtgcttcgaagagcaggatttaattttgatgaggtctaatgtatctattttctcttttgttccttgtgcttttaataccatagctaagaaagctttgcctaatcacagatcatgaagatttactgctatattttcttctagtagtttcataattttcactcttatgtttagatattgagttactttgggtatatagtatgagtaagggtcaaactttattcttttatctgtgaatatccagttttcccagcacctttccctgaaaatactgtttttccccattaagttatcttggtaccctgataaaaaatcaattgactataaatgtaaaggtttacttctttatttaagactttgtttttttctagctttattgaagtttgattgacaaataaaattgtatgtatttaaggtatacaatacaatattttgatatatgtatacattatgtaatgaatacaaaaatcaagctaattaggatacccaccatcccacaatctcacatatttttatagtaatctcattatttttatagtaagaacacttaagatctactctcttatcaaatgtccagtgtacaataggtatatattaattatagtcatcatggtgtgcattaggtatctagaactttttcatcttgtaactgaaaatttgtaccctttgaacagcatttcctcatttctcccactcctttgcccttgataactaccattctactctcttcctacgggctcatttaaaaaaaattcaacatataagtgagatgatgcagtgtctttctgtgtctggcttatttcatttaccataacgtcctccagcttcatcatgttgcaaatggcaaggtttccttcgttttcaagactgagtaatataccacattttctttatctgtttttccaatgagagatacctaggttgcttccatattgtagttattgtgaataaaactgtaatgaacagggaagtgcaaatgcctctttgacatactgatttccgttcctttgggtatatacccagacacaaataaattattgctggatcatacggtattctatttttagttttctgagaatcctccatcctgttttccatgatggctgtactaatttacatttccaccaacagtacgtaagggctcctttttcttttcatagtaaccaacacattaccttttgactttctgataatagtcatcctaacagatatgagatgatatctcagtgggattttactttgcatttccctgatgattagtgatgttgagcaccttttcatatacctactagtcatttgtatgtccgcttaggaaaaatgtctctccatgttctttctcatttttaaattgagttatctggaattttgctgttgaattgcttgaatctcttatatattttggatattaactcttattggatatacagtttgtaatccattttcatccattacataggttaccttttcattttgtttattgttttcttggctgtgcagaaactttttaatttcatgtagtccctcttgtttttgtttcctgtgatttttgtgtcatatccaaaaaatatcattgccaagaccaatatcaaggagatttcccccgtgttttcttctaagtgtcttacatttaagtctttaatttattttgagttgaattttgtttatgatgtcagataatggtccaatttcattcttctgcatgtggatgtctagttttcccaacaacattcattgaacagactatccctttcccactgtgtgttcttggtgctttctcaaagattaattgactatatatgcctgggtttatttttaggttctctattttgttctattgatctatgtgtccatttttatgccagtatcatactgttttgattaccataggtttgtaatataatttgaaatcattatgtgtgatgactccagctttgttctttatgcacaagattgctttagctattcagggtctttgtggttcgatacaaattttagaatctttttgtattttttctatttctgtaaacagggattgcattgaatccatagaccacttcaggtagcatgggcattttgacaatatcaattcttcaaatccatgaacacagaatatctttccatttatttgtgtctttttcaacttcctgcatcaatgttttatagtttccagtgcatagatttttcacttgttaaatttattattttattctttttgatgctatcataaatgggattgttttcttaatttctttttcagatctttatcttgttcctgatcttagagaagttttcaggttttcactgttgactatgatgttggctgtggccttgtcacatatagcctttagtatgttggtgttcactccttctatacctaaattattgggagtttttacatatgtaggttgaaccatccttgtatcccaggaatagatcaaggaatagattccacttgatcatggactgtgatccttttaatatgctgttgaatatggtttgctactattttgattaagatattttgcatctatgctcatcagggatattggcctataattttttttgcagtgcccctgtctagatttggtattagggaaatgctagcctgataacataaatttgaaaatattccctcctcttcaattttttttggaagaatttgagaagaattggtagtagttcttgttcaagtgtttggttgaatttatcaggaagacatctggtcctgagattttctttgttgggagatttttgattattgattcaattttcttactcattattgatctgttcaaatattctgtttcttcatgcgtctgtctctgtaggttgtatgtttctagaaatttattcatttcttctagcttatttgatttgatggcgtataactgttcatagtaatctcttattatccattgcatttctgtggtatcagttgtaatatctcctcttttctttataattttatttatttgagtctttcttttttcttggtaagttaaataaaatcttgttggttttgtttatattttcaaaaacacaacttttagtttcattgatcttttctattgtttttctattttctattccatttatttctgctctgatcttgttatttacttcattcttatctagttctttggggtttaaagttagattttaaaaaatattcctttattcttaatgtatgcatttgttgctacaaacttcttttttgaactgctttttctgcctcttatgttttggtaagttgtgtttccatttttgtttctctcaagacagtttttaattcccttttggtttcttctttgacccattggttgtttgagagcgtttgatatccacatatttgttaatttttcagttttcctcctgttattgatttatagcttcttactactttggtcagaaaagatacttgatatgatttcaatattcttaatttttttgagacttatcttgtggcttacatgtgatagatcctggagaatgttcccagtatacttgagaagaatgtatattctgtttctggtggttgtcatgtgtgtatgtctgctagggccatttggcctaaagtgccattcaaatctaatacttccttattgatttgctgtctggatgatctacccatcattgaaactgggatattgaagtctcctactgttattgtattgttatttatttatccctttatatccgttaatatttgctttatgtagttatatgttcccatgtttggtacacatacatgcataattattatatcatcctgataaattggcctctttattattattatataatgaccttcttttgtctccttttacagtttttacttaaatactattttgtctgatatagatatcccactctctgttttcattggcatagatatcattttccatcccttcacttgcagcctattgtgtccttaaagctgcagtaagttgctgaggcagcttatatttgggccttgtttttcttatctacttagcctttttatatattttgattagagaatttaatccatttatatttaaagtagttgtcgatagttaaagacttactattctaattttgttcattgttttctggctattttgtagtttcttcatttctttcttcttcttttactatattcttttgtaatttgatgattttcatgtcacagtatgctttttttccattatgttttatgtatctactataggtttatgatttatggctatcataaggcttacataaaacatctaacagttataacagtctattttatgcttaaaacaagctaactttgatcacatacaaaactctatattttacttcgctttccacattttatgcttttgatgtcataaatttcacatttctaaattgtgtattcattaacaaattattgtaactataggtttttttaaataatattgtcctttcactttttattttttgatacaaagtctcagtctgtctcctgggctggagtgcagtggcacaatcatagctcactgcagcctcaaactcctgtgctcagccacccatcctttaacttttatactagtttaaaagcaatttacatactggtattacagtattagagtattctgattttgactacatacatacctttaccggtgagttttatattttcttatgtattcatgttactaattggtatactgtcagttcagcttgaagaactcccttttattgtttcgggtctagtggtgataaaccctctgagatattgtctgcgaaagttttaatttctccttcatttctgaaggacatcttttctgggtaaagcattcatccttgacaggttttttttttctctttcagcactttgaatatatcatccaactctctcttggcctgcaaggtttgtactgacaaatctgatgctagcctgttggagagttccttgcatgtgacaagtctccttgctcttactattttcaaaattaattgttttttgttttttgatagtgtgattataatgtgttctctttacaattaacctgtttagaaatctttaagcttcatataactaaatgtatatatttcatccccaaattagaaaagttttgtcatcattttttcaaataaatttctgcttctttctctttctcttttccatctagaactcacataatatatattagttctttttatgatattccattatcctatagactatttttttattcttctttgttctttttaattttttttctcctctgactggataattttaagtgaactgtcttcaacttcacagattctttttttgtagcttgatcaagcctgctctttatgctatttattgcattttttattttattcattgtattcttctgctccagtatttctgttaagttctttttgctttataaattctatctctttgttgaacttataattttgttcatgtagtttctttatttccttcagttttttataaaaactattatttttaagtctttattaggctatttgcagatctccatttctttggggtcagccactgattattgcattccttttgtgatgctatggttccttgatttttttcatgtttctattttttttttttttgatggagtctcactcttgtcacccaggctggggtgcagtgtcatgatcttggctcactgcaacctcctcttcccgggttcaagagcttctcctacctcagcctcccaagtagctgggattacaggtgcccatgaccatgcccagctaatttttgtatttttagtagagatggggtttcaccatgtcgggcaggctggtcttgaactcctgacctcaggtgatccacccacgtcagtctcccaaagtgctgggattacaggtgtgagccactgcacccggccactttttttcataattcttaaagtcttgtattgctgtatgctcatttaaagaagcagtcatctcctccagtctctactgaccaggttttagaagagaaacaacttcctcagccaatctgcctaggaattcttaggttctctaagatattttctatgggtgcacatgcttcacacttctcctcttttggatggtagttcttaagattgtattccttttcttgatgctaaaagatcatgccagggtctaagagtctcctgtttgtttttcctaaagaagtgtcctgaaatgctcaattttgtatgcattctccaaatcccacagagtcaatctggctgcctgtatgtgtccacaagatatctgaaaaagctcacacttggcatctgcaggagtgcatgcagggggctggccacagggggaaggcatgtgtgagacacatagagcattgggaatctttgtgggtcagttggtggggttggccgactagacattccaagagactggtgagcaagctccctgatggagtctgggatccactgccgtttgttgacttctgagccctggttgcattgagaacctgcctctcttccctattgctaacctctctcaatcactcagccatgccaatcccctcagtattctgagtggagcaagaaataaatgggtctttgggcacagtgtcctgcagaactgaggaagctagatgcttactcactgcactctaactttcctccccaggaaaaactgcaggccaagggggtgtctcttaacactgatctgtgcagccttgggagaggtgatacagataaagtaaaactgtttttcttatgctctttaatatatctattcttggagttttttgcttcaatagtgtgctaaacttctccactggactcctatactcccacaaatgtgctctttttcatgaatggttatcaaaaatctttctatacgaagataacagagaaaacttatatttcaccattttgctgacattcttccacttaaagaagccaattttatcctcacaacagtcttatgaggtaagcaccattatttttctcattttccagagaagaaacctggttcagacatggtaagttatttgttaaacatcaaatacccagaaagaggtgaagctggaattagaacctatgcatgtgtcgctacaagccctgtgcagcttgagattcagcaatagccttgattctggccattcagccaatcaatagacttaggcttgatttctttcagaaccgagttcttccatatgatatacaggtagaggagttcggcctatcaatatttcaaggtacttaatgtcctagaaatattcaaatgttgttgacacattgaaacgtgtttaagcatgtttcagtggggaactaaaacctcataagagcattactttctcattgccaacctcagtgttagcccttaactgcatttagctgtccagtgccaatagacataaaagctcaaaaagatttcagcagcagaaacctccctcttccccaggtgcctaccctcaggttaatggaaaacaaatttttaaactggcattttcaaggacttctctgcttgatttgctatttgaaatatcaaaatattgtaaactttcaaaggttgcttttctgatgacaagcacagagattaatggatttttttttttacttttttttgttgttgtttgagatctaaagggtattttacatccctgagaaattccaagttgccctccaagctcttatctgacatctaaccaatctttgagtttgactaggcttatccaggatataactatagattgttcattgtcagaggaaatatttttgcccccagaagtatatatgtatgtctctcagaggatgctagagcataaatgatcaatcagagagaactgtgtgctcattcacaaatgccagtgcatactttttctctagctgactgccaggtttctctcaaagttaaagaagaaaggaaagttataagttcttaccttacttggagcgtggctaaacaggggtcataaaaatatactgataaattaataccaaatttccaaatatctgtgatattcttgtttatgttcttgaattattattaatggtatgcatggcttaatttcctatggagtataaaagcataattgtttttatcatagggtcataattatccattgtcacattgccttagtttatcagattagctcttatcacacctaggagataataaagtaagaaatgttaacaagactaggaaaattgtgtttgcttattctaagatgaaaggagaaaagaaatgttcattaccttgagtattttccaagtggactcttgcagatggtgctcataattgggagacactggaaagttagatatattgaagagactaaggaatataatacaggtaaatcctgtagcacagtgcttaactgtggtaggtcttggtaattaattgttttctttttggctatacatagaaaatatttgccagagctgagccggtttgatctggcttgtcccagggaagataattgtcaagagagttctaaagatgcccttacattgatgccatgttgcttccctcccaggaggtgtgcagaaccacttagggccatatagttttctcctagactatgtaacctacaaggagattccattaaggggtacttcttagaccttctaagctccaaaaggtcaaggacaaagtctctttttgctcgccattgcatcttctacagcacctggcccaaaataggtgctcaaaaatattttttcaatataagaatgctgagtatggacaaatcatattgaactgaacttctggatcagatgtcacaagataaactatgtgcttcattgtcatgtgcaggggaaatttatgtttgggttctgggacagtctcattcttcttcaattaaatggcaagaaagcataccactcattcctagttcttaggagaccaagagttcccttcaaaaaggagctctccttagtggtgtttaccgagaattccactgatatcatgcttgataagactctctgacagcagagcttcaagagatctgaccataaaatcctccaaaatatgcagatattaagcccctgactcattcaggcagtggaagcgtaatttccaccatcttgactcttcctctcctccctaacctagggaaggtttgaggagttgactgggagtaagtaatttgaagctattgatagcatggaagggagagggaagagaggcatctggttctattattttctgtccatgcagaaattctcttagacacaagccaccttccgctttttggccattgttccacataggtctcgattttccctttggctcatgcctccttcaggttgggtggctctcaggctacttgagacatgcttaacattgtgagatttattttacttcttccatgacactggggcatggttatctctgctagcctgtttcaggcccttctttgagttatccaaatcctcccctctgtgtcctccttgaccctcacttccattcctagcccaaggaaattttacctaatctaaggagaagctgactcaatgcacttttttttttttttataacattttgtcttctccgtgtttctcccacatcctaaaggcttagtcccttaaaagaaaaacctggaagacattcacttttcttctctgctttccactctttcatttcctctcttctatggctccttttggagcagagaaaacctagcttctcgaatgaggtggggtgatgtgtttagggtgggtagggggaaaatagagggaaattgtggtagatatttttttgagaagatggccacaataaacctttccatccctttgccctgtccccctgcaatgtgactgctgctccctcaacaagaggtagaatctatttcccaacccctcttggatctgggctaaccctttgttttactttgaccaacaaaatgtagaggaattgatattgtgtgattctcaaggctagacctcaaaagtcctttcagctttcactttcattctcttggcatgcagtggcatgatgtgaaaaaaaccaagctagtctccctgaagaagagagaatgagtgaagagagaaactcagctgatggccagcaccaaccgcctgacatggggtgaggtcatcttggacttcagcccagttaagccacaaaatcactgaagatgcatgagctcacctcaggcaagaccagcagaaaaacccattgctgagcccagcctataaggcttacccacaggattatgagaacacaaaattacagttatttaggccgctaagttgttgcacaattttttatgaggcaagatacttgatagagacataaacaccaggaagaaaaacattgggtaatgtctcaatgtattattacagtacagctatgccttaaattttacttccagagattttagcattttctaatgtcacacttatggattatatgttaggaaagtttacaacatttagaattggggtttccccaaggacagtggggaaaaaggcagagggtggaaatggcagggatgacatagaagtagcaatagtttctgagaagtgtagggaataatggtcaactcagcaagaatataactgatatgcctagtatatgcccatgtccatggtactgggatgccaaaataatcccattcatcaaaaatttataatctacttgctggtagggtgacaaatattaaaaccagttttccttcaaaaccagagttacatcttctcaactaattgtgtatgtatgtttcatgttgagaacatgtccctaggggtctgcctgacagggcacacactgcctcttctatcacttttggtatattactgtagctcccagagaaagagctatcatcaggaagcatttataatacgttcgttgaaatatacccaataatttactttctgtgtaacttctattgatcatgaaaactcttatgtgatctgtttgttaggtctgggcttccttgatgatattgatcaagtagattcctttgtgaaaacctacattgattagtttcctgacaagctgttaaggccacttgcaaagctgtcactggtgatacttgcagtcggaagagtggggctcacccataatgtctttctgaaggaagattgaatggaagatagatgaatgcagacaacattctctgtgctgggtaaccactcagtgattcatctcccagctcctttttctatggggagaaaattaatatccaggcagtgaacaatctctacaacaaccatgatttgcaggtttgctgaaaaatccacatgaaacacagaaggctaaggggagacaggtctggtcatttttagctgccttgttcaagcatacctttggcaaagccatgctcctctgctcctcctcagaatggcaactgctcaaaaccccacaaacagcacttaaaatctggatggaagacaataaatatgctttgtcatcagaaattcaatgtgaacatgggaagggttagaacaataggcctcagtgctttttgacaaaagaacaccagatcacaagcacaatggacagttggcaatgctcatttctttacaactgaaattaattaataacttgtgcactcaaaagagaacaagaagctatatttaagtgctgcatgttacaagagctaagcaagggtctctagtgttgaaggacagagggaggaagagggtagctggtaaaagagtctgactctagctggagcagctgttcccaaagcatgtgctttagaacttattcccctgaaatggtcttcaacagggttccatgactgactaggttcaacaaacgttggaattcctattagtttatctgagaaatcccagataaaagaagtcttcttggcttacatggggtagatattggttaagctagttgtcccttgggtctagttgatagaattattaattcagtcagtgatcatttcattaactctgtgttaacatagtttaggttgctcacctaaaaagaatgactgaggccctaattctgtcactcactaacaatgtgacctcgggcaagttaggtactcactctgagcctctgttttgaggattaaataagagaatatgtgtataagtgattattcacctgaagataatagattaacattgattattaattctaaaaatgaacttgtgctttcaaagatgctattttagtatgtagaatattcctgttattaaggcaatgcctctatctttaaggacggagcaattgtataagctaggatgcttaaccaatgatgggacaaagaaacaaaaaacagattgcacatctaagtaaaaactgaaagtattacagaaagggattattttcttgttgatacccagtggacaatagatacagcaaaaatgaagtcagagctgttgagttagtggttttgtttttatcatgggcttgttgactgctataatagaggagaccatgggaacacttaatcttcacctaataggcaagaggcctgaaattttcttctataggtctgtagagttttgtctgacagcagccattctgaactttgccttctgttacacaaacaccagaggcagaaagacaaaaaagcaaacattatttcccaatgggatcctcatctgggaaagcagtaactttttctttttttttttcaaaaagaaggtaatcatacaaatcaataatttctatgataaattatcatagagaattgagactagtagttaaattccaaatttgtaaaaactataaaataattttacaatccctatgtattacataaacctcctactactgtcctgggtgggatccgataaaaaggcatctctgtgtccactccatagctgacaaatctatgattagtagttatttatccaaggtcacatagatggtaccagaacactcaactcaaacctgtgtcatggacccaccaagtctagtccttttattaatctctaaaaagtatagcaataactcaaattcagaaggcagcagaaggaagagaggttaaaaatttgctctgaaactgttgggttagagccatcttaaccctcagtgggttaagtgatagatgagtcaccagggaaatgggtgcaagggagaatctatctcaggagaaataaaggtaaagtcaccacaatccaagactaatagctctaggattctcctcttccaatttggacctaacagcctctccctttcctgaattttcccagctctcgcccaaattgactatgagcagaacactgcaacagactgttctctgtacatgtgtgcagctcccaaaatatctgacatcacagttttcaaatagagaaataacagttttacttgtctacttgttttatttttaaaaatctttttgtcagatgaaatcttttgtcaagttacaaaattgacatgtgtctaccacaatccttaaaaccagtgaaataatataaaactatgtaaagaaaatgttaatcatacttctacccccaacaagagtaaataatatggcagtctggtgtctttctacttaaacttttttattttttgttttgttttattgaggcagagtttcactctgtctcccaggctggactgcagtggcgggatctcggctcactgcaacttccgccccctgggttcaagcaattctcctgcctcagcctcccgagtagctgggattacagacgcccaccactgcacccagataatttttgtgtttttagtggagacagggtttcaccatgatggccaggctgatcttgaactcctgacctcaagttaatcccaaagtgctgggattacaggcatgagccaccactcccagacacatcttttcacattaaaaaaaaattgaaataagggatttggagttgttattgccatttgatgcctttctcacatgacaatgcattatcaacagtcctccaggtcaatagagagaggcttatccatttcaggaaacatttaatgttccataagaggattataccagactttattcagtatctccctcattaatgtacatccatgtgtgtgtgtgtgtttgtacttgccttgacaaataatgtgataaacatccttgtttattaaagtccagctgttgtttcattaggatagattcctataagagagttttctgcgacaaaagctatggatatatcttaaatttaagatatgttgccacattaccaaaataaaacccaggaggattaaagatttaaattttatacataaagtaataaaatcttagctacacagaagggctaccaccagctacttgaagcctctgattataaatcctaagtaaatgtgaatccatatgaaaacaaagatgaaattctatccttgaactaaaattagactttcagatgagttagggagattgggggagggagagagagaaaaaggagcccacaaaacctcaggcattctactttaattatgacccagtagaacaccaagatgcaacgaagtaccatcattttgggtttctgggatgaagtaccaaaaaacttagatttattctcattcaaattttgctatattcctataaatcagcagatctagtgtggttatctggtctggtggtcccaaaagctgtgtctgaggaacagtcaatggccttgttcagttatctacaaggactttgttattcagagtaagatttccaaagtgagggagaatctgagtcattctaacttatagagaaaagtctaaaaccctgtatggggaaaacagaaaggagaaaaaagtgaccaagcagatgagaaaccagaaaagaattgaaaaacaacaaaaaacatgctgtttttgctggagagtgatcaacatgacttgctgagttttctacaaaaccttcagaatactctactttatttgctattctttagagtctgacctgtattggaagaagggcaggagatggtgggagaaataggaagaagtacccactctcgtctcagggtgggcaggagcttcccaagggagactatcacatttggccagagtttgaagtgtggctcacaagttggattaaaactgaaaccacattccaatcttaaacccctaaacctctcaattaatcatagtttacaaagaatctaaagagaggaaatttttaaccaactgatcaaagcagcactcagaatggaaccactgattgaatattgacctcagcaggcactgtaattgcatcttattggcaaatcattactagtttatcttagtgatagaaagcacagattgaaagtagagaagcacttacttctcgggtcaagtgaataattagcagggaaaaatctctctggccttttaaaacatggcagaagtgttaggtaagggggtgaggacttccttgctgggaagattagaggtcagtttagccggcctccctgtaactgtgataacagtatctccactaccatctgagtcctcaccctctcttcaaaaatacaattctagtcacatcctccacaacaaaacttccttgacatccctgaccctcatccacccccgtctccctctatattgttccagcacattacagtgtactggtcaggttcacgctatgcaaaatattcacttttaatcttcacaaccactcagtgaagtgcgtattaataatatcaccactctatcactgtttctgtgctgtttggctaagatcaagtggcataatacaactaccctagagatgaagaaattagtgcatagagttggctaaaattaaaaataaatgtaataaaaataaatatatagagaagttcaaatacaccttataaccccagtacgtaaagatgcactttctaagaagtatgcagtaaactttgccatctacttcttataaaaattggcaaactttttctataaagggtcagatagtaaatattttaggctttgcagatcaaagagtctctgtcataactaatcaactctgttgctgtagggcaaaaggaaccctagacaataatgaaatgaatgggcatggctgcattctaataaaacttcatttgcaaaatcaggcgagaggccagatgggacccatagccatagcttgctgactgtgttttagataatagactccttccaggctcagcattatttccaacaggtataaatgcaatctctagtaaatgcaatctgattccagaatgtaagttggtcatgaccttctataggaaacaagaccatcttctgctcctcccccaagcattaactagctctgctagatgattgttcagccacagctcaaacatctctagtaacagaaagctcatgcctgcacaatttactcattttcattaagggacagatgaagatttggagcacttttgtattaagatttctgtttgtttgactcatataacactaaatttataactttccaaatattgaaatcttaataaagtgaacaccttctgtccaagaaggcacttgaaaatttttttctactgagcaggcttgtgtggggtatcctaaaaatattcatacctgtgaacatatgaacgttcagactttaaaaaactctcacccagctagaaggattagtaacactgattttatttgcattgctccagtgaaaaagcatgtatgaaatacatatgcatgcatatggcaggtatgcctactcagactattttttctattgtttccttagaataagaataataaccagagaaattaagtttaccttgaatttccacagatggtaaagtttcctacaacaacacctacccatctttctttttatccaaatagtccctcaacacatatttataagcatctacattgtgcttgattctgagaaagaaacaaatacacatacatattatagtgtgaccttaacatctagttggagagacaaagcataaagttgcaaaaattttcaaacctgcatatggcctcttggtcccatgccagtcagagcacttctgagaacttttgctgaaactcaagtgctaatcagctcttagaaatgttactagtgtaaaaggctgtatgatgaatatatttttattttggccaaacataataatgatgatttgcatttatatattgctttgtaaacttttaagtcactttaatttgtattatttttatatatcctccttgtagaaaagagatatggtaagcaatattatccccgctttatagatcgggaaacagagatccaaaagggtgtttttgcccaaggatgcaaggtaagtaaatggtagtactgtaactaaaacatatcacctgatctctaactattagccattcccattagacaaagctatctctctcctgacaatatagattaaacatttatgaatgctgctggagttccaataatacaggcttgggttctaatcaaggctggaaagaacaggaagtctctcaagctagctcaaatgaaagatggaatgtatgtaaaagaaccacttggagcagaaaagccataggggcatacaggttttatagacatgaaaattctcagtaatagaagaatctcgcttcatctctcagggtggcctctcccatttctgcttcttggtctcctctatctctcacccgccagctacttcttaaaaatggcctgacctggccaccagccactgacctgaatctagaggctctgctgcccaggctctccttctatgacaattgcctctaattatcctcgttcaattactgggacagataacctggaacttcaccaagtctttcatggtgaagggttgagcgtgaggtttatcctgcatgtccttacagaggctgcaggcaggttcagcaaattgaccttcttcatgggtttattgaaaaaagtaaatgaaatgttccaactaaggcacttacagcaagaataacaatagcctgagacatagcaaaaggccaataagtaattactccagtcaagttgcaccaaatatttattttacttacatgaattcaaccatgagaatcttgcactggaatggagttgtccagggaacacagaggcagactataacaaagatggaagagtctcgttaatcactccaagaaaacagctggtaatagccaaaccccttttaaaattcacccctcccaccccctcccccgacctcaacaggaataactgaaagtaattaagagtggatggtaaaatagaaaggagattcagggtatgtgtggctgtaaaagttgggttaatggccacagatgtgaagctctctgcttcttccacctcctcttgatttctccatgcctgtgttgacccatccttattggatatcaaagaaagagctctaacttttaaccacttcctagtgcctggcacacatttaaaataagtgtatattcaatgaaaaacaatgaaatgaatgaatggacaaacaaaagagaagtccagggctctctgccatcattgtataggatgcctgcaggaaactttcagagtcattctgactttagaaaacctgaaaatatgagggagttgacaccccacaaggccacccttatccaatgagggacagaagctggtgggaagataaacctcccctctgaggtgcattcctcatggctcctctgtgcatctctaagggatccactccagttgttcacaacagtgaagagcttgataatcagctttacttagcttttcctcctttccttccactccaaaaatgccccactcttgttctttgagaacacttcccaaaataaaccaactgcatggaaacaactgtgctaggctctgtttttgtttgtttgattgaggctttttttttgtggggggcattataggggggaaggggatgggatgtatatcacactaatgaaattatttgcttgaattttctcctctcagtatatactctccctgggtatttcattctctcctgtggatttaccaccagctacattccattgatttccaaatctatagctgtagccaagacctccttgctgagtcttagacaagtcaactaggttttacataagaaatttgactttaatatgtgtaaaagtgaatgttccaactcaccacctactgtcttccttctgctatagtacacatttctatccaaggtatcatcataaagcttattatttggattaaaaaatgcatacatgcttgtattttcattctcccctgtattgactgtatgttccagcagtgagctcaggctagagggaggaaatgagttgcaattgcaatagacaagtctacggttccagtacttgaaaaagagagcacaagcatatttgagatagatttggggaataaatgttcctgcaaatgggcagaacaaagaagacttagagtacttacacagttttttcctactcacatagcaagatcatggttgagaaagtttggaatcctggattgctgactactctctggtccaatattctttttactatacaattctcttttgtcctgaatttttataagtttttttcctagaaattttagaagaagctcaaggtagctaggaagctacccttttggagtagcaattatatcaaagtacaatccagttaaaacccattagattgaaaaaaagctggtcaaggaagcagagagcaggacccatcatatctgcagaatggagctatgaactaaaccgtttacagaccctcgtgaaaaccaactgtaattcttgcccttgagctccaaaagatgccctcatatcctaccaatactgtttatgtcctttctttggaatcagagctgaaatcaaagaggcctcttaaatcctgacctagtatatttcaaaatgccatagtttctttttatgacattcaaattaaatccctaaattgaaagttttgtaaggtgctaattacagctagacacttattattttgtttgtatgaatttatctaacttgtggcccataaaattatcctgtatatggatatcaaagggcaaatattaatctttgagtacatataacaataatgaatatataatagacatctcctacataataaatatgttgaaatgtataaggtgtgctgctcatatgaatctaacaacttttcaattatttcatggaaatcctaataatgagagagttaaattatttgagttgagatttttttccagttggtctatttatctttttcagaatagggtacacatcttccaacccctctaatgtttataaaaatcatccagtaacatattggattacattctttcttataacacctttggacaactttcaacttgggctgttttagctaaaatgcagcttaagttattttaatagagaagggtaacttgccattggagcagttaactgttactcaatttgtcataaattgaataattgggaaagtgtttaacatattttaaaggaaaagaacattttaaacaaattagtagcaaaactaacataaatatgctaacagcaaagaactcctacctgcttattaggtgagttattaaaatattattgcatgtgctatccccaagttagcacttacagaatttgataacattaatattctaccttaaagtgctatgcttagcactttgcaatttataacatgatgtaatctaatagtgatattaatagaagttaaaatttggttaatgctaagtgctttacatgaaacatcattagatcctcaacagcacttcatgaagtatgtttatcattatccctaaattataaatgaggaaactacagctaagagaaggtgagaaacttactcatgtctgccaattacaaatgtataaactctttaattcaacaatcccacttctgggatattttcctactgatacttgcaaatatgtaaaattacttatgtataagaccatttacctccacgctgtttgtaatagaagagactgggaacagtattgtgttcataaataggttaaacaaattataatatatccatatagatatatctcacaagtggaaaaaataaaaacaatgaaggagccttctatgtgcacatagagaatggacttcaggatacatttttaagcaaaaaaagaaaagtgcaatatgatgtatataaaatgccatcttttatgtaaaatatgaatttctatgttttgtcttcaatttcataaatctggaatatacataagaaactaagaacagtgggtacctatgggtgcatgtcacagggaggggatggcagggggaactaggcagatatatgataaagttaagacaaagacgtgtcactgtttgaaattttttaataaattattgagttttaacacatatgagtgtattccctggcaaaatttgcatgaaaaaggaaaggaaataataaatggagtggggaaagttaggcagggtaagcaggagagaaattccccaaaatgacacagccagcaaggaccacagccaggtttcaaaccctgcaggtcaccctaaagccctgctttcaagtactgtcgaatagtgactctgagttctcacaataattccatgagatagcataaaagaacaaacagaacctgaaaaaaaggtgttctcaagattacacaaacattaaaactgcaaatattgttttcttcctactacaccacagccacaataatgaacatgacaattatactgtaaaaatattacaaaattttgacttggtactaattccaactcactttccctccagtatgtttatttcacaggtaattgtagaagaccaaaaataagcaagggggtttttaaaggaagtattaaagcagacagtctgtgtgttagtttcctgttgctgctgtaacaaataccccaacctcagtggctaaagcaacaccaatctattatcttacacttctgaagtccaacatagatctcaacaggctgaaatcaaggtgtcagcagggatgcatttctttctggagtctttggaagagactctaaagggctctcaagaaatccctttcttgtctttttcatcttccagagtctgctcacattgcttggttcatggtcccttcttccatctgcattgccagcaagggcaggtcaagttattctcacatcattctgacctgtttttatttccatatgcctttctctgattctctcttcggcctcccttttccatttttaaacccctgtgatgacattgagcccttctagttaattcaggataattgccttatctgaagtcagctgattaaaaaccttaattcccctttgccatgtaagataacatattcatgggttgcagggattagcacatgggcatcttgggaccatcagtcaggctgctacagccccttatgcaacttgaaggagagaagcatgcctgcattgagccgtgtattttatgggatgttagtggataatacctaaaagtaacagtgtgttcccttgtcaagtatgtttggggaaactggtttaaaccaaaaccaggttgctttactataggactgcaaaattgttaatatgttaatgtgcatggtgaatcaccattttctgaaaatatttgatgtggaattctccttaataaatttcaaaatactggccctttctaaaaattttagaataaaatgttaaacatatatatttttttcttttaatacttggctgtattttctttgctaaagttgtattagatgtttgcatttacatttttaagtaaggttaggttatggctttcttttagggtgtaatttctattcggttttggtatttttttcaaaggaatttggaagatttggcttcttgaaaatattcttgcattatctggataatttaggtgttagctgcccttaaacgttcaaaaagagtgccctataaaaccattcatccatggtatcatttttaaatttttattcattaattatatatatattttacaacatataatttatacatattaaaattattagacttcattttagagcaattttaggtttagggaaaaattgaggagaaagtacattgagttcccataggccccttcactccccaatacaattttctctattattaacatcttgcattactgtggtatatttgtttcaactcaagagccaatattgatatattatcattaactaaagtttgtggttcatattaggattcattcttggtgttgtgcattctactggttttgtcaaatgtattaatgatatgtacccaccattatagtatcatacagaatagtttcactgccctaaaaattcagggctccacctcttcattctcccctcccctccctctgcacaagaccctggcaaatgctgatcttttgactgtcctcatagttgtgccttttccaggttgtcacatagttgtaatcatacagtacatagccttttcagattggcttatttcacttaacaatacgcattaatgttcctgcacatttttttgtagcttggtggcttatttcgttttattgcaaagtaatattgcattgtatggacttcccttcatttgtttattcattcatttattgaaggacatcttgatcatttctgtgttttgacagttacaaataaagctatacagacactaatgtataggtttttctgtggacataaattaatctattcatttggctaaatatccaaaacagcagttgccgattgtattgtaagaacatgttgagttttgaaaaaactgccaaactgttttctaaagtggctgcagcattttgcattcccaccaggaatgaatgagagcttttgttgctccacatcctccttatcatttgtcagtgttttagattctaaccattctaatttatagatgagtagtggtatctcactattgttttaatttgcaggtctgtagtaaactataatggtaagcatctgtttgtatgctcatttgctacctgcatatcttttttggtgagacatctgttcaggtcttttgctcatttttaaatttggctgttttcttattgttgaatcttaagagttctttatattttggataccagtcctttattagatatgttttttgcaactatttcctcccattctgtagtttgtcttttcattcccttgacagtgtgtttgtagagcaatttttaattttaatgaagtaagtccaacttaccaatttttttgatggatcacaactgatggatcacaatgttgttttatggatcactaagaaatcagtgccaaacccaaggtcacctagattttttgttgtcttctaggagttttatagtactgtagttcacatttaggtctataatttatttgaaactaatttctgcaaaaactgtcagatctgtatctagattcgtttttttgcatgtgatgttcagttgttccaacatcttttgttgaaaagactattattttttcattgaattgcctttgctcttttgtcaaagatcagttgactacctttgtgtagatttatttctgggtactctattttgttatattaacatatttgtctctgttttcaccaataccacagtgtcttgactactctagctttatagtatgccttgaagttgggtagtgtcagacctcaaattttgttcttcttcaatattttttggctattctgggtctttttttaataatctgcttgttgacaaccataaaatgatttgctggtactttggttggtactgtattgaatatattgattaatttgggaagaactgacatcttgatgatgttaagtcttcctattcatgtacatgcaatatatgttcatttatttaaatattcattaatttttcatcaaagttttgtcattttcttcatatagatcttgtatatattttattagatttatacctaactgtttcattttcttttatagtgctaatgtaaatggtattgtgtttttaattcaaatcccaactgttctttgctggtatataggaaatcagttgacttttgtatagtagccttgtatcctgcaacatttctataattgcttaatagctccaggagttatttatttatttatttacttatttatttattcttttaaattttctacatagacaatcatgtcatctgtgaacaaagaaggctttctttctttctccaaacctttatatattttatttccttttcttgtcttattgcattagctaggggttccaatatgatgctgaataagagtggtgaaagcagacattattactttgttcctgatcttagaaggataccatctattttctcaccattatgatgttagctattgatttttttgtggaactctttatgaagttgaggaacttcccctttattcctagtttactgcgagttttcatgatgaatgagtgttggattttgttaaatgattttttttccacaactacttatttgatttaactgattgtataatttttcttctttagcctattgatgtgatagattatattcattgactattgaatgttgaactagacttttatacctagaataaatcccacttggctatgtgtataattctttatattgttaaatatgattggctaatatcttgttgaagatttttgcttcgatgtttatgagagatattggtctttagtttcctcttttcataatgtttttgtctagttttggtattatgttaatgctggtgtcatagaatgagttaggaaatattccttctgttttctggaagaaactgtaaaaacgtagtagcatttcttccttaaccatttgaattcactagtgaacatgcaggtctggtgctatctgttttggaaggttattaattattgattcaatttggttatagatatgggcctatttagatagtctatttgtctttgtgtgagttttggttacatcattcacaaagttggttcattttctctaggttatcaaatttacatacagagttattcataatcctggtatctttttaaatagtagatctttgacaaatatttacatgtattttctggttattgaaatagtatggatgcttcctcggtttatctttgttgagccaattttaacaatttatctccttaggaagttattattttgatctacatttttaaatgtattggcataatgttgcacaaaatatttcttctagctcatctaatctcttaacatttatatttccagcttctgttttattttaaaagttgtagttctctttcttcttgtctcttcttttaaagactttcaaggaagagggggtaattttaatgctctgaagaagtttttggttattaattgcattttgttttctaatttattaaattcagctgttattatcattagttatataataattatacttggattgttttggtgttatctttagtttcataagttaaatatttaatttatttcaattttttatatctttcttgtttaataaccaaaatatccacaatgaggctacatacttttgtaaatgatttgtaaccttgggtttgagttgttgtaaggtttgtatgttataggatttcttaagattttctttatggtaatatgataaatattgacaaatgtttccataataaaaaagaatatgtatttgctatagattattcagttttgcatatatttattacatgtgctggttaatagtttccaattcttactctgctttctcttcactttcactacatttaaagatctaattctcttcactttctagaaacactttttagagattttttacttcagaagtctaaacccagaggatccagacatatgaccaatcacattagattttcaaagtttgtcctagctgcctttctcagatggaagaatatgtgattgttctgatggccactggcagtttcctgccaagggaacacagactgattgtttactgtataaacgagttgctgggacacactgaattttctggggtagaatttgatctccacacaatataaacagcaaagcagagaaaagggaaaaaaattattttcttctgtgtttccaaggaatgagatttcaaaggcggcaatgtagccatcccatgaaacagccaataaacactcaacagccaacatctcatctagatttgttctctgtaatatcctcatcaacctactactctgcatcccaccatcatctctggtctgtctcaaggtctaattaattcagaccagggcccatgtaagaacttcctaactgatggttctgctttctgtctctgttccttcctgtcatttaaccccaataacctatattcctaaagcactactctgagaacagctttcccttaaaatctccctaaacaatgaagccaaaacttcttagacaccagatttccttgagaataggaccagccctcctttctaaccttttcaacctacccctttccattaaccctcatgatatcccagtcataaactcataaactgcatacccattttttactttgtcatcacgaaacattgtcaagctgaaaatcttttgtttcctacattaaaaattgggatacctaaagtcatagttccataagtaccttgtgatgtactaggcattgtagtgaatgttctacatgtattatcttcacttaatcttcacaacattttgatgcgataggcattgttattatcactggccatttaacacacaagggcatggacacttagagcagtcaagtctgaatccaatgcatacttggttaagtgttacgctgtactcttccttaattaccctgccaggaccaagagaatccttgcagtctagactaatgactcacataaagtaggcactcattatatagtgaataaatggttgaatgactgaggaaatgtgaaaagacatcttaaaatgctttagaaatggtaaattactatgcaaatattatatgtcatccacaaaatcactattattaagctgcttttatgatgaaagttgataccttttttcatttatttctatgccttgtattaatatttgctaagtgaaaacattgatctaggtttttgtcaattgtttttcctctaaagccaagcagaaacttcatcttccatcatgtgaacaccttgtccaattggcaaatattgacagtaagaaaacatcatgttgaaattagccttctattcttgtatattattgaaaaatcagaagtacaagaccataggctgtagaggagctgtgtgcacccacctgtgtgtgtgtgtgtgtgtgtgtgtgtgtacgtttgcccaacattttcaaacatttagttttactacatttactctttctgacccggtacaatctcaaactgcatacaagcagcagatgtcagtgttgtgcaactttcaggctgactgcttgcagaggcaagctgttctttgtcgcctagagacagaatcaacagtcatttgtacccacaaacaaacacccttaggtgctaggtaaatcgtagaggtcccccataaagaaactgtaatttgagaaattacacagcaacttataaagatgtagttgtgattcaaaggttgcaatggatgggcacagcataaatagtggaacctatcgtgttttgctggccgagaaggagatagggacacccagaaagcactggtttggctcctttgtcacaactgctgtgagccaaagcaaaggaaggtcagactaaatcggcctcgtttgatgaaagaacagtgttttctatttgcaacccatgtggtcagatggccaaactcctaatatgtcctcaaagcccaacataatctggtttctgactgcttctatagctttcttgggagccactctttctcctttttctctgctgcagccactgcattcttcccagctcacaggctctgcttgtaatgctcttgccacatgcccctgtctctcctttagtgtctactcttcagatctcagctcaaatgtccctttatcctgaaaggtcaggctccatacatcaggtctttcttttatggtctcatagtaccctttaatgcccctccatagacttatcacaattttcaattatatatgtgtctgattctttaattagtatctgtgtacccagctccaataaaagtgccaattccataaaggtagattatgtggctgttttgcccattactgtttccctagtacctagcatggtacacggcatatggaagattctcaacatataaatgttaaataaaaaaaatgttaagaggatgaatgaatggataaataagtaaattggtgaatgaacaaatacgtgaattgattccatctactcttccactgaatagacatccatgtaccagtgagcgaatacaaggtaggctggcttaagaagaggagagtatctcaaatacctggatatagagtgatcactgttgttccaggattctgagaataactcagcaggttgagagactgacctgcacaaatggattctgacttgggcctacattctggtggcagagttcgagttctcccctgcagcaatgaatttctgtctagcacttctgaatgcaaccatcacatactggtctcctatcagtaaagaaaggggatcaggttgcaaatatgtgaggaatacaggcctttcttcagaatcgtgtatttgggatgtatcatgtgacagagaagagcttatagacaaagataaagagagataaatgggttgatttttttcttctagggtatacacccaaaggggagaataatctagctatttttccttcttccacaagatggggcaatcggaatgaatttaactacaaaggcggactcaccagtaaatgtcttttccatgttaaacagccctattcggtcagaccagaaaaatgcagctggttttgaacttgtttatgcaactgtgtagcatttcctgaaaatggtagacctggggtagacaacagttaggctggaggggaaagcctagggcacttgcccactctatattggagtcaaagggtgctgcccagcttccagaacccccagcattccagccccagggagttgcaagggtctctggctcagaaacagctgctgcaaaattgagcaaatttaccattcagaaacattttcttacattagaaggaaattctagatgagatataatgatgtctactttgaaataaattattgtaatataatcaatcacagtgtacaaattctaattcttaatattagtctgctgcttacagtctgcaagatgatttcattcagtggaatattccacaatgcattaaatcaggccgcacataaaataattatgacactagagttttattattctacctatgacctatgtgcacataacccttcttgcttcttcctggttataggtctattactagatcattataaatttttctttggaaagaaattagtggaaatgggcttgacaacaatttctagattaaattagcactgttcagaaagataattaatattggtatggtacttttttgatcattgtctcatttgattttcccgacaatctgtaggctaaatattactttcatcatcactctttcacaaatatatgacatgggatatttacttattcaagtgtcaatatgggatatttatttacttaagtaggcacagcaggtaaaacctggagatagccatgaacatggccttcaggttccagttctgacaggtcatggaagagagtagggaaaagagagaaattagagaagggaactagcacatgcttttatgagggctaaatacacattgtataaggtaggaaacccagccaaagtggcttaaacctcaaaaataatggattggctcccataatagaaaaatccagaagttctagttccaaaagatgtcatcatggatctagtccttgaggacagctagtttcacctgatattttcagttcatccaggttatttccttgtggtaacaaaataatctaagcaggttcgtgtctcatagggtcccactgaaccacattgttctggggaaaagagtgtctcttcctgaagttctctcacctgtgactcaccctgtcattggctcaaacggggttaaaggtccattcctgaaccaatctcagctgggaagataggcatgacttatcgtcttaacccaatcagaattcctacgctgaagccaattgcactcaaactttccttgctaacagtgggagagctgtacattatacaaaaagaaagccaggagaaggagaaaatggagaaatcataaaatatatctacattttttggagtttaacaaattagaaaacattgtctcttttaatatataaaaatttataagagtactagaacaatcctggttgatacacaattattttttaaaagcaataaaccattgtaaaatgttctgaagaaggccttaagcattagctttagaaaacttaaaaactaaatttatagatattacactagcaacacctgatgcctaaaaagcagaggattgctcagtaaccctggagaattcagacatttagagcaggcaagtgttaagaggtgggaaaaaataccaaaaacaaaaacatccacttaggttgaaaacttgctaggtcctttatataaacatcttcaagaagtactatccaatgaaacctccaagggcactctgtctcctcaaccactaattttttcaagcacctctgtcctcattactacaagcgtttggagtgataagacctccctatctcacagggttttgtgacaaataaaggcaagaatgtgcataaaaggctttgttaatgtaaatgctcacaaatgtaagaattatattgatgagaattttatgtatagtttttaagatgctgtagaaaaaaaagacatacctaccaaaaaacaggttctacattgaccttaacaaaataaatggatgtcagttacatatagctcgcttgcaccaacctcccattttcccacttcatcaatctcaactctctcagatcttcgcctaatgcactccacatagtacactctgaactttttgcacaacccagatggtatacatggatccatatgcctgttttcaagattggctaattggcctcatttgcacaataaactattaagaactctctaataaaagtcgacaatgttgccacactttgttaaagagctaaaggttctgaaatgcaatgcctatcatcactttataaaagagctgaatttgagagaaaaagctcttacaaacccttattgaaggagaattttcccaatggacacagtcttaggaacagttgggaccagggactccaatgccaccaggattctctctttttcccaactctgcttctctgtttgctggcttcattctttccatgcaaaccagctttcacaacatagtgaaaaacatggctgtctaagcttccatggctataaacttctatctcctatttccaatttgaaaaattccaggaagagattggcatacattgggttggatgtccagccctttatcaatcaatcatgtccagggtataaggtctgataaatgcattgtaactgtaaacaaatatttgtagttgggaatgtaagagctccccaccaaaaagagggcctatttttacaaaataaatgaatagtttgtcctggtagtggttgtcctgggtaggcaaaagattagtgtccacataaaaaggcagagttagtaaagacatgagtctgcccctgtaaaacagtaccagtcaaacatttccccaggtccgagatttgtttactctataataagaagaataaacctgcccattccaccaaactgtggcaacaatcgcctgaaacgtgagtgcatagtaacttcaaaaatattacaaaatttcaaggtatgactgttgctattactatctatataggttactaaatttcccatttttcacactgatgcctggagtcagactgacacagcaagtagtttgaataaactgaagctcatctaacatcacaggctgtgagtacactccttctcaagccatattgccgtccagctgtgtgtggttattatgccaagttcatcaagagatatttgagcttctcagggagcaggaggaggggaagacagaatgagactcagatggaaggaaataactcaaccaaaaaacctctgattagtctacttcctagagaacttccttctactttccaaactcttagtcactgttctatcttccagacaattatcagctaattaatttccatgcggacaaagatcgctgtttaataggtcagcagtgtatcaccttgaagtgaaaatcagcaaaggaaagaagggtaaatgataaaaggcatcaatagtatgatgtctgtcctaagtcaacactgggaatagggattcagtcactgggcaccaacttcactgctaatgaatgatgagtgactgactataatactaaggcttgttatttctgtgctacccttccctttacataatatcaaagggaaagtccccaaataatgacaaaacacaccacttatattgcacactataatttcctaggcatgttcccatatgccatttatcgaaaatggtgtacttacagtctattagaaacattgctgaacttgggagccttaagtacttgccacttaaccagtttggtggccttgggaaaagtcttgacttccatttcttcatttgtaaattggggataagagtatgtttttcaacatcttagcatgaggcttgactgcaaggatttataagttatctgtaaagtgtgacataaatatgaagagtttttcataaggcctagtgaaaatctcagcaaaggacgcaatgaaaataaagaaaacctatgtttgaacttaataaaactcggattcaaacgatgccaaggagttgacccgaagtcacccacaggtagctgaaaggtacaagtcttccagttccaagccctctttcctatactgcctcaccgatgatccaccaggggtgaacgtcaatatctttcctctgaaaatatatgttttattctattatgtaagctgggaaaagaaaatgtaactgaagacatagaatgagtcatccagcaattagttaccctacataatgccactgataatacatagaacaatggctgtattgcttcagcacacaatctgtctcaagcaccagactaaggaatttacatgcattaaatcatttaatcctcagaattagcctataaggtaggtatgattaatgtccccatcttgcagatgaggaaggtgaggcacacgggaattaagtatcctgccccaagtcacttagtgagtggcagagtgagtattcaacacagacaaattagcttctgtgtctgtaatcctaccattatgctaggccatctcccaaggacaccaagcctagtgcaccatctgattctaccttttaaaaactcaaacaagagaaagatggattttatccagagttttgagctgtatctcatgtatttccagaggttttcccaccagtttctggcttcatactgtccagcattgatctcaaatatccatcttatcagcattgatctcaggggtttaaaatcattttgaaggtgataaagtgaagcacttgtccttctggacagcccacctcctgtcttgctttgttagttttagtaaatgtgtgttcaggcaaagtcaaaggccccgaacagagactcaccaggctcagcaccatccttgcctttcccatgtgggaagaatgcttctccagaaacaaggttggcctcggaagttggctgttgcccaaatggcaggagagagcggcataagggagtcacactgaaagtgattttaaattacacaaattcagcaaatacagaaagagaaagaaaatttaaatcaatgatactagaccgtgctatacattagaatcacctgacaaagcttaaaaaacaactatcaaaacttggcccactctggaacagctaaactagaatgcttgaggacagcaccttgctttaaatcctgcaggcattttctacacttggctggtgaacttgagatgggaacaacgctccctttggtctcagttcccaggggcctttcacagtatgaccatctcgctgcactgagtgtaattcataatacagtgtaaaattgtatttagcatattaaattattatatgctaaacattaccgaatatattatacatttataaatatatttaggtatattaattttttgttttgttttgatttgtttttttgtaccaggacatcagtgagtacaggcttaaactcagaagttgcaataggctttgctactgttatcaatttagctgaaggacaaatagaggaaatgtacctagcacaccatcttaagctaagtgggaggctaggcaaccacctaaatacacatctttttttgtcccctcatctattcaggacaagtatagctactgcacatgagtaccaatgtgagttcaccatctttatatggagaacctgcagcctcagtttgctgccagtctttagcctttctggtctcatgagtcatccccaaactcattgttgtccctttccaggaatagtgtcacagatgggagttaaacagcacacaggtagacataccaactctgtagtttcaaagagctggtactgtaagaagacctggtagcttttgactcagttctatctctatctctatttttatctatctctatttatctctaaatctatctatcatctatctatctatcatctatctatctatctatcatctatctatctatcatctctatcatttatctatctatgaagagagatattaccaagcaagtaggctgtgaatacctctgtatttgcaatattttgaagagtactagctgctgtgaaacctaatctctaagggagttgcaattttgcaattaaaattaaaaatttaattctgccagttagttctactgagattctatcagtaaatttagccttcagcctggccgacgagaggttctgatttaattgggcaatagcaagataatttaaagatgcatgaagcactgtaatgcttctctggggagcacatgcgattgcttacttctttgtgcccattacacagaggcattcggaaaagaccggtcagagtttaagagaaaggtggtgctgcagcagattaagcactaccagcaccgacctgactaggggctttgctggccctgtcattaaggagcaagacctacacctgggctcctgaggcttcctggccaggaagattcctaagactcctgccctgggttttgaaggccccagccagccctaggttcttacttgtcaaagggcacacataaggatctcagtccttcacacttggcggttactgtggctgtgtgtctcgaagatggtccctgctcgccgctgggcaagaggcccttcctaaacgtcagttgtcaacatgaaaccagttttgttatgggcaaaatggtgtttccttctcccagtaccagcactttgctaaaccatatgtccacaggccacacaagtcttatttatttatttgtttatctttccagaaatgaactcaatggttctgctgagactcaaaggccaaaaaaaaaaaaaaaaaaaaaaaaattataaaagctgtagagtacaaatagtcctgttttaaaagcaggggggtggggccccgcctggagaacaaagccctactttgaagacttagcgattctaatttggagccatttcccactcccaattccaaatctgcatcattaaaccatgaaagagtgaagagtaataattgtgagcacgctgagtatttcttaatgattttctgtcttatacccaaagcaaataagccaaatgcttactcaaagcctagagggggagtagggtgggacttggttttgcaatttctttttttttttctatagtctttcttcttccactgaaagtgtctataaaatttttaaaggaaagtaggttgctaaaatgtacttaatttgccatgatagattgagtccatgcttcagtgactgtaattgaatctgtgacctatttctttagtaaagtagaaatagtctctggggtttttgtcactaccatcttttaatgaaattcaaaaagactgtcaaaatgtctacactttttctactggttgttaatgttattactttacaatttgttactttttaattaatcttaataaatgtgtacacactctacctggtcattggaaatgctagacattgattcttcactcttttaaagccaagcaaaattaacaggacagaaaaggcccggcagccaggaaaggtcttcatatatatttggttgcgcttttaaaaatattttgaggcatcagtttaaggatctgcctccaagaagagggggttgtggagagtcaacagcaaaaggctgaggggctctgcctgtggctgtcctcttgatgccaccactaactgctcccactttgcttaagggctgcatatgtggcaagccgacagcctgggggagcaatattttattgacaaaatgtaagagaaaatatgttcggctgcttttaagcagtggtgtaggagggtgttacagaaccagatggtctaagttagtctttcatttgccaggatgatgggaaagcactgccttgctctgcaactgaaatggtggtggccgctttgccaatggacggttggctgtgatttccagggacagttgttcttccagaagcaaagtgcccaaggctctgggtgagctctgaaattcatctcctacggtgtctggggtgggagtggggagaatgccttcaggtctttgccatgatggtgttaaaagggaagttttgcagcagttctcaaacgtggccccagatcacagcatcacttaaactattaaatctgaaatctggggatggggcccagcaatcggtggcccagcaatagttctgttgatgactcttttgtgaaccattagattagagaaaggaattaaggtggctggagcctggaagtgggggtaatggatggaagatgagtcacattagggtcagattgtgaactatcaggagtgctcatgttacctaactatactcaggactttgctatctctttgcctgtgatattcctttggctagaaagcatcatctcccacttcctgtttacctcttccctatctctatttttcaaaatgttagccattttccagtggcatttggagtgtctcttaccctgtagacttttctgactacttcaagagcatttgggctgtctcttcactgaaaccccaaggctgtgacttttcttgcagcacctagattttgctttgtttctctagaaaacaaatcttttgagggcaggtggtctgcctggtcattagtggatgctcataatgcctattatgatgcaagcaacacaagagatgttaaaatgacttttgaaacatagagatttttattcagttgaatatgtagacaaccaccagctaatctctattggcttggtaagtactccagttctcccctttgtctggtaatcaaagtagacttccactcatgaaccaatgaatggatcacatggtcagaaggttctagaaacacaatggttcagtttgacacacacttactgagtaggctgccaagtctagtgctaagtgcttggagataaacaaaatacagtccttgtctttgtaaagcacacatttctaatggaaaaagaacacataatcagatcatttcaatgtcctatgataagcagagagctacgcacaaagactgatgtgagcacaaagcatgacctccctcagataccactctggaattacaaacaaaggtttactgtaaaaaaaaaaagtatgagttaaatcttgaagaatgaggaagaatagcaaggaaaagagagtatagaaggaagttctaataaagagaacagcacaaaggcatggaggtgtaaacagtgtctttgtaagagggggagggccttatgaatggtgtgtactctggcattggtagaccataaatttctagttggagactagcagaaggctatgttgcagagcagggaaccagtcatagagggtgttgtagtccatgctaggaaatttggaatttattctggaagacttagagaataacaggagtagtggttagatttgcattttaaatagatcattctggctccagagggaggaagggttcaaggggatgaggctggatggtgacaagagaggacaagatgagccctgggcatttgcagatttccccagggacacaaagtagcattcactctcaaatcaatgacaacaatgagttctttctcattaggaggaaaacctaaacagagtacaagtctgagtgagacgcggcaggccttgctcctggtaaatagaaggatagccaggctggtttggataagaataagctcatcttgtatgagtggccactctgccccacctcatttgattaacaagaatttccagcctgtggacttgaacctaacagaccatgatggcttgaacaggcattcatcaatcactatatctccccaaacctccagacagactgacttggagtgataacaattccctctctcattcttgccatctacacatttataatttcctagtacatttcacttgatcagccaaatagccatttttttacatactttcctatagcaaatgctggaaagaaaaagaggtgttttcacctgcctgttcttcataactacatgcaataataatcacagcactggcattgctgctgagtaatttaaagtcccaaaggcagtttgttcccataatcaggcccctgaggtcctaggtgtgtggagagagaaaagaaaaatcctgaagaatctcatcactcaatggaaaactaacatttaaaatgtttcttataggattttgtggtttagaaaatactcatcacctgcattgtcctaatgatttatgatgagtgggatcataatttgtgagtgctggtgtcctctgcaggaacacaggcttaacatcttgttcaagggtaccagttggtaagctccagaatttaaacctaggacatggattctactgccttactctgctcttcacgtcacactggagcagaataacttgactcaggatggttggagaaagagaggtggaagaaggctgagaaaaatagtgaagatggaagactttgttttgggatctttcagaatctctactctcaagtggtccattttcttggactactatccagagataagatgagaataaagagacaaaaaaattgacttcctatttaatcagtgagaaaccccactacctattcaaattctagtttagcttcaagacctagcacagactcgtaaaccttctttcactattagagctttcagtcacttacttttccttagaacctatggaaagagatggcagacaatccagcatttaatgacatcctgccacttgctgtttactgttagctgtgcttcatcaacaatactaaaacctctgctatacagaaaaataaatccaccagagtggttgagtcttccagataactgatggttttctttcttaggcccgagcatttttaaaagtgcaaatattttggcaggaagcacatttatggtatatcttatacgtctctgtctttttaaacatgttatgctaagcatgtttttgccatccattattgcactgtgccttattactgggtatccctgtacttaatgccctgatagtctgaagtgtattgtcttttatctatttgtttttcaaatctcctcttactggggaggctttcagccattactgtgcctccaatgggaatcttattttttttttccttcactctgacacgatctcagctcactgcaaactctgcctcctgtattcaagtgactctcctgcctcagcctcctgaatagatgggattacaggagcatgccaccatgccgggctaattttgtatttttagtagaaatggggtttcaccatgttggccaggctggtctcaaacgcctaagcccaagtgatccaccttcctaggccttccaaagttttgggattacaagtgtgagccttcgtgcccagcctctaatgggaaccttctctcaccttccaactcactgctcctaaagcatcatgaactgggaaatcggaaagtcatgattgttaaacacatgggcaaagtatgagtaaacaggtctccagtcagggccagaggaacaatttccattatttgggatgatcaaaggtttgatcaaagattcatatctcttaactatttttagttggagaaatttcctgaatagctgagctctgaataggggaaatgtttctggcggtaaaattcatcaggtaatgtttttacagtatccaactcagtgccgagggcacagcagacactaaacaagggcacagcagacactgaacaagttacttggtgactacagtgtcctcaactgcaaaaagtgtccaataatgaccaatagagtatttgcatcacctgctattttgattgccctcaagatttcaggcagcatcattttgatatggtatctttgtaagcaaacttaaattctctttggaacatgagtacgtgtaagcaaaatgatgtggtccaactaactttgaataaatagtgctgcaacatccaaagacacaatggattgagtaacctctaaatcaactgcccttataaatgaagatagtcagtgttaaacttaaaaaaatctgaatgaatatgcatattatacttaagattgttctggttaatgtaaagaacaactgaggaaaagaatgaaactgaaaaaagaaaatgacatccaaacctttcttcagacagacaacctctgtgtcagttttcagggttcgtcatactgtttaatttcaaatctttatggagaggatatggggggaatatcaataaatggctcaagaataatttttcttgttctgttttactttattacatcattgtatcaagcgtagggtatcagtgagttttggaaattatgccacccagacaaaccagtgcagtgatgacgatggagatttctggctcctgtagtctttgcccaccctcctctgaacctgctttttagaattttagaagaattgagaggaactctagaaactacagctttgaccattcaaaggctatcatctgggaagttttaatggctacatggctagactatcatatttttgccccaagctactaattgagtctcaaaggtagcattcagcatcctttcctaccgagatctcattatgcacgtgtaatgtgagtaaacaatgagattctattaaattactttcctccccttaaattagccttaatacagaaagggaggagacagtgtgcttattcttacagagatcaagtaattaattttgtaggttctatgaaatattgaaggaaatcatgcaaatgaatttgcaaacaattagagcagaaactactcaaatatgtgtatttatggaaaaaagatataaagtgaatacagatcagttcattagtctcatggagtttcttcatcatggtaagagtgttgtacatgtgactaaagtgctaaataaaattttagatagatgtttattaattgctagatgttgacttttacttttaaaatcactttcagaaattctaacattgtgttcggttaccattttagtccaatctcatacctagaagaaattgtgttcataaccataatacgctcccctcctttatttatatagaatttcagggttttcaacttacttcataatccagggacattacaagcacctcagttagaaatgctatatttttgcaaagcaaagcttgaaacaaaaatattttgtggttaaacattcattaactagaaaatgtaacccacacaaaaagcacaaacccagagcatatcagataatcaaggtttaatcaaggtttattgtagtatctattatttaaaactagaagctaaatacataagagcatctctctggttttgtgcttcaaatatttatacacgtgtttccaaatgctccagcattagcattagggaaatataatttacagaaggaaatatctacatattgctcctgtcaacttctgggtattttccccacaatcgtttgaaatcacttgaaattagtcttgtcagcatccaaccttgaccctaggacagggtttcttctccttagcactatggacattgtggactgcataattctttgttgtggcagtggctgtcctgggcattgtaggatatttagcagcatctttagcctctacccataataagtcactagcatttctataggtgccagtagcatgtctctagatattgccagatgtccccggaagaacaaaaatttctgacacaaaataatgactaaagacatgacatcagagatctatggcacaataaagagagctccaacatgtatagtgactggtagcttatggcgtggggagggatgacagaaaaagaaattaaaatacatgattagaagattcctgaattaaaggaaagaaacacttaattgagaatagaaaggcctgttcacatcctgaagaaacaccaagatgtagtttggtaataaacttcaaggattaaaacaaaacaaaacaaagatacaaaggagaaaaatattctgcctcagacttaaccaaataaatgcgataagattatcaaaaaaaatttctgtttatttgggtgagttaccaaaatgaggcattcttctttgcttaagaagtggggcccatgacacagggggagactctactttgttagatcgctgctcaaattctggaccacaaacttgggcattggtggtcgttttctattcctagtggatacccccagtggattcactcattagaggttgtctgaatgcgtattatttcccaggagcatgtcaattaccccactctcttaccaacaatgcttttatatatggccggaagtgtccatttttatcttcaataaattttaatatttactaagcttgtatcttcactcgttaggaaagagcaggcttttgttgattaattgcgcattccttcttcttatatattgcctcagtgcatgttgcccattttcctaccattttctttattttttaagttggactgcagttgctctttgtgaactgtcagatgcgttgagagaatgggcttctccggagtgtattttatcttttgaatttgtttctggtgttttgctgaaccaaaggttttcatttgaacgcgttcaaatccttcagacttctccttcacagcctccgggtatctcatcttccttggaaaggtctttatatcactctgggattatgatattcttatactttcagtattaacatggctgaaccgcaaccgatgacaggaaatcggatgcttctgacccagtgagcagaagaaccctgggaaaaggatgacatttttttcaaagggctaaaaatataaaacatacagaccaaacagcagaaaactgaaaatccaaggtctaaggcagcgcttcttgcctacttgtaatttgtgaactgatagaaaggacacagaaacataccttaaggtccactatcagttatgctgccttatggtatattatgcatgcgtgtctgcacatgtatatacacaaagttggcaagttaatgatgtaaataggctcttctacatgcctagaaagagaagaaactctgactaagcccataattctttccaatttggcattcttctaagtacccaataccaacatcccatggtattcatcatcaactgggactctcagattaaacttttttgattctgaaattttataaccatctactctattcccccttctttccccaatagtctagtaaaagcccaaaatagagacttttctaaactactgctcctgatctcaaccccctaccctacctccctggattaagttcctcttgattgatggagtttggttgtctggattctgcaagctcagctgtcccaatttatagtctggctccaagccccacccactgctgaatgaccaggggcagtgtgatgttgaacctaaaggtctctattgtgacatacgtagctggtacaaaagaatgtttgcttgccctcttgaaggtcttgaacactgctggaagcctactagatatttaatgtaatcaccatgataatggctaagatttattaagcatctgctatgtgctttatggtgctaagaacttctcatgtatttactcattgaatcttcacaaaaaccttatgaagtaggtaaaattattatattatcattccccaatttagagtataagttaatgaaagtcccaaataaaaataactcaaaaagccttttccaaaaaaagggagaggatccatttgatccattgtaagaaattctgtgatagttatttatgttaaacttggctaccccaagcaatgaatgacacagtgataaaacagactcttgtctggagcttttcaaactgtaaatgattaataatgttcatttcttactaaatgccttgaagaaagcagtgccccttcatgagggagataaggtatacatagaaaggagcagagagtggaataaaaggcagggtaaatcactttaacacttgcaaataagagaattcaccaaggagggcttggaggctgttaagatttcctctaagacaagtctcaccttacatcaccactgggtatttcctaaggcagggatttcacccattccatctttggactagcagtgtctgtctcaggggaatgaagaagagtgggagggatgatcccatctctagtcttcacatggactagaaataagtgttgtgacataagagcttgtgaaatttctttaattcccccaatattatcactgtttggttcatgttcttatactatgctaattttcctataggaaaaaacagtaagacactcaaaagaaaccatttgctggttttgagaggcaatagaaagggtcaggtagataattctgtatctagtgccttcattttctgttactacataatgaatgactacaaacttagtggtttaacaccataaattcattatctcacaggttttgtgggtcaggagcctgacatgttttagctgggtacccacaaagctgaaaacaagatgttggtcatttacataatcatctggagaccaaccagataaatgtccaccaccaagctcccccagattgttggaataatttattttcttgtgactgtatgactgaggtttccattttcttgctagttgttggccagggacttctctcagcagctagaggttgctctcaggctcttgtcacttggccctttgcacaggtagtttagcatgtgactgtttaatccttcaagacaagcagaatttctgtttctttctttataaatgtcctggcctttgaagaactcatttgattagatgagacccatccatgataatctttcttgtgattaactcaaaatcaacttctctgggaccttaattacgtccacagaatcccttcacctttatcatagtatgcaacctaatcatgagagtaaacagcgcgaacactaggggggcaagaattgtgagaggcatctcaaaattctgcctaccatggctgtggacccagaactttattagggattagaggatgcaccatgagaaagcaactcaaatccttgaggaatgcagagagaaggcataaggacataagggaggtggtggcctggaatgagacagacaaaactgtgtttgcctgccaaaggtgtccctgctgtatctggaatgcttcactagaagcagaaggaggagggagctgcaggaaaagttgaatatttataactttcagactaaggttttcttctatatctggccactcatcctaagaagaggaaccacatcactggctgagcccagacctaggagggcaggttatcttatcttgcattgcaactctgatcaactgatagagtctgcatgcagtgtcaccttgagaaatattctgagactgtgttgtggttcagcaggaaagagtgttgtgcttgattagctatgtctttcatgaactctggatggtgaatggaagtatgttgaacaagtactggttattcatgacttagactgtacacatcacccgaagacatctcaacaaatattaaaacaaaatacaaatgcttaggaatatacactgtatagaaaagagatgacctttataagattgttttgaggactaagctctgatttttattttatcttgcccaaattcctatctaaggggtctggggagtcatgccctacaaaccatgaattctcatcagatgggttttatttaaccctgtatattgtaatttactttccaatctgactctggcataacaaggaagaaaatcaaaatgttttaccccagaatatatttccttgccataccttgaaattgtcctgcaaagtctctcgtaagaaaaatccacattctctagagaatcccttttcccctttgttttttttccccttcctttccagatccaggagacaatcaactaagagctaggcacccttttaggtccgataagaaacattttacaacctgccctctctgaagtctgctatctgagagcttcctcctcacaataaaacttggtttccacagtcctttatcttaacctgaacatttcctttgattccagatcttcagataaactcaaccaattgtcaaccagaaaatgtttaaatttacctatagcctagaagcctccacattttttcccacctttctgaacaaaaccaatgtatttcttaaatgtatttgatgtctcatgcctccctaaaatatataaaaccaagctttacaacgaacaccttgggcacatgttctcaggacctcctgaggactgtgtcacgggccatgagcatatttggctcatatttggctcagaataaatctctaaaaatatttgacagagtttgactcttttcatcaacagtttctttgcttctcatcccccaaacggtcattttttctacttaaagtctcccattgggaggttgtttacttatagacccaacccatacacgatttcttgggaaataccaggtaaatgtaaaaatgtacagacctcaaagagtgatgaagtcataaaacagaaacccttcaatgtttgaaaatagttttataagagtgaacagtctatcgactcaccattatgccaccaaagcaatatgtaaatgtgtatcttatttcccagtgctgcttagaagccacagaaagaaggaggtgcccatattaaagaaaggattcattgaatgacttcctgaagagtcggatgagccacatcccatttagcagatagagaaattcagggtcatgtctgagtctgtaggcctccactagatcttctcatttgatcagatcaagtctcctgagcattttaatattgagaacatttgcagtcctcgttggagtaatttctgctttcccattccttggggcttggcaagaagaagtcacctgatttttacaacttcgtggcattttcccaatcatgaaaatgccctcatgtttctcactcatacaacaaacaaaggcaagaaagcaaatccatctgcagaatagtgccatatgaagctagattaaaatgctaacgggtgagcatgcacagagaaaacagcacactgccgagggttaaagaaacatggatttcatccagaaaggccctttgcaccacagtctctactacccagctctgtctgaggggctggagacaaagaaagtaagatagaagtggataccaaacttttatgcctcctagtcccagttatagctcctttcaacactttggtttgttttttcttggaatgaggctatgtaaaccctgaagaaacagcgcctggcaatgctttctcacagaaatttcgccccttatatttcttccccctccaaccctttatgtaatagaactactttggtatagacaataggttgcaattatccttcggaactgagcaaggaaagaatgcaccaagatgggcacgggagcaaaactaaacacatacccttaaaatactaagcagaatgcatgcctctgatattctcatcactcctgagccaaattatttagtttatagctattagatgcatcaggacagttcttctgatccctgtgctattccttgggtatcgaatttagcaacaacatattggtgaattaatttcaaagatctttgggagaaaacagaattgaatccagtgaactcagggatgaataatatccctgaatttggaaatgaaatgtgtttccattaagaaattgcttcagaaatgaagtagaacaagatacataaattccaagtatctctcttaacagaaagacttgagaaatgtgtttaaagaaacatattaattatctgtagctattctaaatgcttctaaaaacaaacaaacaaaatgtctatgcattgtgccattgtgtgtttattgagtaagcccaagctcttacttagtgtgcattgattctttggttgccatggcagagggaatggtttctgtgatatgacagcagttgccatatgttcagcttcaagccaactgattccatcacaaaaagaaaagagaaaagaaggagatgtgcagcctcacctattccaagggtcctaataggaccaagttgtcatataagcttctgttccgggcctgacagtgaatacatgccatagccatgtcctttatgcaacatatttgcaaaagatttttacatggaagccactactccagtatcccaatcagcatctaactcagatacagtcttctataagttaaaacatggcctatgaagcgattttttaaaagatttgtagtcaagaagagacacattctttgggggaggatgaggcaactggagtcgccaatgaccttagagagctggaacttgagacacacagagggaatgtgtgaattctaggatcaccaatggaatcaataagcttttacctgtaggggataaatcctggaagaattctagagtttgaaactgtctggaccatttgaagcagcatctcagagggtgagttgggcatattcttgcccaactctctctctccataaataattccaggctgagtgtttcatggtctgactcattgtgactatcatgtatgtggttatgttgccaattaggatgccaatattcccactgtcagagcactaatgagtgtttttagtattcaagagattactttttggtattcttccaaggtcctgtgagtaagttggctattcactgatagagaaatttatttttttctggaactttatggtatgcattattaaatccttgctacaacaatctaaatgatccttgagggagtcagagcccttccaactgcaagcaaaggacttttgatgttgagatatggccccaatggtgctcttcagtaattcctattttctttactatggaaacctgtaagaatatccaaactagcagacttaagctaggcaatctacactaataatggttttgtctttaccatggttaaattgtgtaaaagttgcagatggcaacgctgagcactttgtacatatacacaataacagggctgttattcttttatcaggtcaccaaatcaaccagacagcccactccacatatgggcaaatggcttgaagagacacattaccaaagaattcccaacagtcaaaatgtgtttaatcttatccacatacatatctcaacatatcttaatatccatatccatatctcaataaatcaaaaatgtgtttaatcttatccatatccagagaaatgcaaattaaaactatagaaggataccactatgcacccaccagtttggctcaaatttaaaagttcagcaacatcaagtattactaaagatgtggggaattcagagctctcatatgctgctggtaggaataaaagttgctgccgacactttggaaaacagttgcacattatccaataaaattaaagaaatgcaaaaattcttacctaacaattataccctaaggtgtgtgtacaactgtctatttacaccaatgaggatgctcccagcaccatagcttgtaatagccccaaacagaaatttcccaaatgcctatcagtattattgacaattggcccaaaaatccatttatcatcattgaaaatgaacaaactccagttacacttaaggacatagtaaacttgatagggtggggggagagagttgctatcaagaagagtaggcagttggtggccacacagatttttatttgttatgtgtacgtataagtttatatctggatttcattttgtttggtctggcgacagtatttgtattgtctgccatagtgaatgaagtattggacatctaactgttcttatcaaccagatcgtaagctcttgaagaagaaatatatatgtgtgtgtgtgtgtgtgtgtgtgtgtgtgtgtgtgtgtgtatgtatatatgtatatatatatacacatatacatatttcaatttactctccagtaagttatattttccagtttaaaagaaaaatcagtatccaacagggaccatatgttcagcttcaagtcaactgattccatagcaaaaagagaagagagcagaagttgctgtgcagccctacctattccaagggtcgtattagcaccaaattgtcatatgggcctctgttatggacctgatagtgaatacttcttgtgatagttttcacttcttgtgaaaactttaactaaaaatttggaatgtaattcaaataaatctcagtagacacataggaatgtagttttcatttatctattccaacccttattggatctgcttgtttgtgtacctaacaattctttggggtaatgagtgtcacagagacacatgtaaagaaaaattgaccaaaagacagttccgagagctagggttctttagagaggtaaagaagaagagaaatgttattgcatccttcttctgtgaggtggcagtaactcgagagtagaggatcctcgtcaaaccatgtgtttcctctgatgaagtcttgttatgataattattatcactccagagatgttgataattatatttagacagtttttaaagcaatattgtataatatttttccccatttaacaccagcatcagagctgatgaatactcagtcagaagaaatgcaggcctgcaggtttgtccacaaagtgttcccatcaaccgtgtaagtgagtttgataatttatacattatattaggggggaaacacactcttttgcaaaggactggttcttggcgcataatcagttcccattgaatttaaatgacttttggtcctacaccaatgctgataaaatactttcaaatgtacagaatattaaccaaatgtttatattaaacaactcctttcaggtgaaaatgcgctcggcgaagcatagctccctggagcaagttagtgaatattaatgtttagcacattataaggctctacaagtactctgatgttggaggccaagggggagataaacgagcaaggttggtgcgtgggccctgccaggggaaggtacaatcacattggacataacctcaccgagatggaaatggaggttgaaatacatgcaataggggctgctaggaactaggaggcagatatggactgagaaggagagtaccaggctctcctgcgtgttccccactcaattcccccgaagacctagtctggtttcagacctgcccagggtcccatcagcagagagatttatggggcatgcctcataattaataccagccaatttccagttaatcatggccctcgatttcaggtaagtgaaggctgcttatcatgagaagcattcggacttagttaagtgctacagtatttcaaatctgccaaagcacaccggccatttccaatgatcattgtttatctgcaggtttcaggaaatcatataaatatgcaactcacagtgcatatacacatatttcaggggggaagacagctgttatcaaccaggctgaaggtcaaaacgaaaattcttttgcatatctcttggtgggtaaaaggccagactggggaccttgagacccagggacaatgcccagctctgaataggacatcggtggtatttcagtgagctagctcacatcttcacttctgttcctccatccataaaatgaggatatgaatatttcaggtaaccaaggtgaagtgctttaaacagcttggaagaccaatgctaaataagcatatggtattattttttagtcttgtgttaataatactttagaattcaatgcatgttcaacattttgttgttgtggttatagtttaattttatattttagtagctacttttaaaattagtaaggctaaatcttctcagatttattgaagttccaaatgaataatgataaagggaaaccaaagttattattcccattttacagataaaataatatcaggcctgaaaaatctctctctagaagatgttgtatgcatcttatagcctctggaatggctctcatataaatcatcctaaaatattggttctaattttcaaacactattttcagaaaagcagagtacagaattttccataaaattcaattctaacctctctacctgtatccatatctttttttttttttttttttttttgagactgagtctcactctgttgcccaggctggagtgcaatggtacgatcttggctcactgcaacctccatctcccagattcaagtgattctccctgcctcagccttctgagtagctgagattacaagcacccaccaccacacccagctaatttttgtatttttactagagacatgaattcgccatgttgaccaggctggtctcgaactcctgacctagggtgatccgcacaggcgtgagccaccgcacctggcctcatatctattgaagacttgtaaacttgcagatcctgacaccatagaacctggtcacacagtagccatgcttggcacatgaaataaatgttagggcctagagagggtaagtgaccagctcaaaatcaacacagctaggacctgagccaggattacaacccccattcgagtgtcttccttactatgttaaaccccgtagagtttgttctcaatcaagaatccaccatggcttcatgctttgcttgattgcaaggcagacacaggacaaccttcagcaaattctgattgagtagcaatgtgaaagctggagtagaaaaacaaataagtataagatattctcccttcttcttaaagagtttacaacttggttgagaaaaatgttaggtgttcaatacttcattcactatgggagacat

SEQ ID NO: 402 - DNA, 23933 bp, Homo sapiens
gctgaaagatggttatctttttttgtttgagatggaatatcttgtcactcaggctggagggcagtggtgtgatctcagctcactgcaacctccacctcctgagttcaagtgattctcctccctcagcctcccaagtagctgggactacaggtgtgcgccatcatgcctggctaattttttttgtatttttagtagagatgcagttttgccatgttggccaagcagatctcaaactcctgacctcaggtgatccacctgcctcagcctcccaaagtactgggattacaggtgtgagtcactgcgcccagccagttatctgtcttgaaggttaatcagtcattaggtgtgaatcattcctaaatgtcccatctgatgtattataccctgacattttcctttcttcctcccacagcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgaaacgggtgctggcaagcatgtgccccgggcagtgtttgtagacttggaacccacagtcattggtgagttgacctcagtaacccaagtgagatcccagggtgctgggacaggaggtctgtcctgggggggctccgctggtcactcacccactctccctccccgctccttgtccctcctcctcctcccccatcatgttctccagatgaagttcgcactggcacttaccgccagctcttccaccctgagcaactcatcacaggcaaggaagatgctgccaataactatgcccgagggcactacaccattggcaaggagatcattgacctcgtgttggaccgaattcgcaagctggtaagtatagtactttaaataaagtgggatgagagtttcttttgcagttctgagaccaaactacagaaatcattctttgcaactaaaatgagactatttgcattgcaactaaaatgtatctgttcactaaattaattggatttctgaaccagatgatcttggatttatgggacaactatggggtagaagtaagtgctctttagcctattttgcttcaagctgagacaccccttttgaggtcatcttagtcatactgagtgagtaggtagctgacttctacatgtaactaattgatcagagtcattttttaaaaatctgggatggttccttcatgtcaatacagaaagttcagagaacaagaagccagtgtcacactgacaagaaacagccaatactggaaacttccagtactgctgaaagtggagtcgggagcttccttatgaagtgtgctgtttggatcactttaattaagagcctggcaatcagatgactctttgctccttaggcatgtgggcagcttgtaagtaattaaccagagatcaagcatgatggtctgggcagagtaacttgtcaagaaaatcacattgtattaagcccagccatgactgctccattctaaaatagaatagcctcatcattcatggcttcatactttctcagatgtttacgtagtcttcccagcaaaactggactgatgtttccgatgcttaaaaactaagctttaggctgggcacggtggctgacatctgtaatcccagcactgggaggccaaggtgggcggatcatgaggtcaggagatcgagaccatcctggctaacatggtgaaaccctctctactaaaaatacaaaaaaattagccgggcgtggtggtgggcgcctgtagtcctagctactagggaggctgaggcaggagaatggcgtgaacacgggaggcggagcttgcagtgagccgagatcgtgccactgcactccagcctgggcgacagagtgagactccatctcaaaaaaacaaacaaacaaaaaaaaccctaagctttagttataagcactgacttggaaaatcagggacctgcctttaggacaaataaacctagtagctatttagggttctggaacgtgaggtttattgcctaccaaaacaattgcatttgtccttgtcattactgtgctcacaggaggcttaactggtgtaattggtaggcgagagtctgccctgtgcattgatctcatgtagttgatggacccacaggctataagggagctgagtagagaatgttcacaaatctgaggcccatcacttggagaagcaagagtttacaacagaatactttatttggaaggtcaaaatcattccttcgtaaagtagcagtttgctaaccaaaatagcccagttaggtggaggaaatccccaacaacctgaggtctcatggaattgtggttgtgtcactttacccaaaataaatgggcttcttggtacctagtgtcatatattggcttactgggccaatactgtgcttactgtgccaagcactatgctgagtacttacttaattctcaacctaaggtgattactattctcacttaatcagtggaagaactgagaaatgaatgtggtcatacagtaaggaactggtacagccggatcctgacacagcctgactccagtaccagggtgttagaactttggctattctgttgttccacctcagaaagcagctgccaaatctttacaagacatccactgtaccaggctggtggtcctgggcctgccccttaggacctctccaactaagaaactgccctgttctgtggccacagcaagagaaccagaggctgccttcccagttaccaaaacttgagccctgtatgcaagcccaggccttgtgattcctctgcctaaggcaatagttcatcttaaaatagtcttagcaaaggtttttctgctcaaggacttgattgtgaaaagttgttctgaatcacttagcacttaaaagcttttttttttttttggagacagggtctgctctgtcatccaggctggagtgcagtggcctgatcatcagtcttgaacccctgggctcaaatgcaaatggtcctcccaccttggacccccaaagtgttgattacaggcgtgagccactgcgcctggcccagaagagttttaaaattgcaattggagtagccatagatttatagaagtcctctgtaggtttcaccaaatgtgaacactaaatgaaactttcgcaacactaaaatgaaacttttttattttgcaggctgaccagtgcaccggtcttcagggcttcttggttttccacagctttggtgggggaactggttctgggttcacctcgctgctcatggaacgtctctcagttgattatggcaagaagtccaagctggagttctccatttacccggcgccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccacgaacagcttactgtagcagagatcaccaatgcttgctttgagccagccaaccagatggtgaaatgtgaccctcgccatggtaaatacatggcttgctgcctgttataccgtggtgacgtggttcccaaagatgtcaatgctgccattgccaccatcaaaaccaagcgtaccatccagtttgtggattggtgccccactggcttcaaggttggcattaattaccagcctcccactgtggtgcctggcggagacctggccaaggtacagagagctgtgtgcatgctgagcaataccacagctgttgccgaggcctgggctcgcctggaccacaagtttgacctgatgtatgccaagcgtgcctttgttcactggtacgtgggtgaggggatggaggaaggcgagttttcagaggcccgtgaggacatggctgcccttgagaaggattatgaggaggttggagcagatagtgctgacggagaggatgagggtgaagagtattaacctgtgtgctgtacttttacactcctttgtcttggaactgtcttatttttgttctgtaaatgtctattgccgtaaattgttaataaaattgaagtttccattttaaatgtcgagctgacttaaatacttgatccagttaaagttggatgtatgaggctggtagatgaaaccacctgagtcgagggtcttgctctgtcacccaggctggagtgcagtggcatgataatacatagctcattgcagcctcgagctcctggactcatgtgattctcctgcttcagcctcctaagtagctggggactgcaggtgcacaccaccatgcccagctatttttatttcttgtagagatggggccttgctatgctgcccagggtggtcttcaactggcttcaagtgatcctcctgcctcaacctctcaaagttttgattataggcatgagccactgcccagcttcttggtttatctgtttaatttgggcctgaattaagtggttatagaatcattttgtaagtgaggaaacgggttcagattgagccagtgcttctctaactaaaatggatgtgaatcacctgtagatattaaaatgcaggtttggggtcaacctggtggctcatgcacttcgggaggccaagttgggtggatcacgagcccaggaattcgagaccagcctgggcaacatggtgaaaacccatctctaccaaaacaaaaatttgcatgctgtgatggcacctgcctataggtgggaggaccacctgagcccaaggaggttgaggtagtgagccatgattgcaccactgcattccagcctgggtgacggagacccctgactctcaaatttaaaaacaaaatgcaggttctaattctataggcttgaggtgaggcttcagacacgtcttaaattttttttctttgagatggtctctttcccaggctgcagtgcaatggcaccatcatagctcacccccaccttgacctgggctaagccatcctcccacctcagcctcccaagtagccaggactacaggtgtgttccaccatgcctggctgattcttgtaatttttttttttttttttttttttttttttggtagagatggggttttgccatgttgcttaggctggccttgaactcctgggctcaggcaatcctgcctcagcctcccaaagtgctgggattacaggagtgagccactacacctggcccctagatacgttttttaataacctcccaaatgatgctgttggtctgatgtgaccacatgtacagtagcaaagggttagataacagtaactgctggagccaaaattcaagtgcccagccacactgccagaactattgctgtcagtctttaataaagtattagtcacacgagaagggcttggaatcctgatttattccatacttagctaagacctacagtggcaaagatggttcgtactaaaggggttattgtttagagaaagtggaaatgtcagacaaaataacagtcaccggtttttctggtattggcatttgacccaattgtatgtcatggagattatttgaagtaggagtaatatgtatgtgtaggaaagattggagaggggtgagttctctgatttggacttttttccaagcacctgttggaggaccgtggttcttgggggcagacgggtgaaggggcatgagtgttatacgtagctggagagcttggtgcctggtactcagttgaactaagcaatgggaaaggacaatgaccaaaaggtgaagcttcatgcagaagggaggaatcagttttggtgcttgggtgcttgcctgagtgggaatgcctaatgagtggtagcagatgggccctgggggcagagttgcaggcatactcacctctcctccgtgacttactttattctgatgtgtacccagttaccatctctttcccaaaggtgttttgtatcccttacccattgctcactttagcccctttgctctgagaattgcatctgaaagatgtgcatgtttaaggccagcgctggggttcacagctgcagtcccagcactctgggaggccaaggtgagaggattgcttaaacccaagagtctgagaccagtgcctgggcaagagggtgagaccctgtctattttgagcatttttttggccgggtaccatggctcacgcctgtaatcccggcactttgggaggctgaagcaggtggatcacttgagcttaggagttcaagaccagcctgggcaatatggtgaaaccccatctctactaaaaatacaaacaattagctgggcatggtggtgcacgtctgtggtcccagctgcttgagaggctgaagtgggaggattgcttgagcctgggaggtggaggtagcagtgagctgagatcgtgccactgccctccagcctaagggacaaaaaatttttttcccttaaatttttttttatgtctcaaatttttttaaatgtatatattatacctgcgtgcatagcacagcatgcttttgcagcctgagatgcctcaactatgtgctctggatggttttatatagcatttgtcgagagcaaccatagttttatgtccttcggggcaaggtaagaccccagcacaaattcagccactgctacttctcagatgagccaggttcttcctgcagcctgggcaggggagcggggtgggatgcctgaaatgaaggtgaaccttgaagacgctggctagcctgccagaggggattttgagaccttcccaggccaggagatctgctgattgccatagtgcaagcactggaggaaatgggaatgggacacccgtgtatgaaaaggagcagataaatcacaaagcttaggcgagtgtgacaccccatgacaccagcatttcccaagcagggtgccctgagaataggattcagggtgcccatataggatcccttcggcttttagaatgacatggtggaaactggagagcctgactcacccatcctccctggggccagtcaccctggccaggagtagccccctccatttacctctgtacaccttacagatgaattattttctacatgtgccaagatgtgaaaaaggttggaaagctttaagcagccacagaggtctggggtgaaagaaggtgagagaaaagtttagctgagaagaaatattccagtagaataaagcctggggaattggaagagcaaagtgccagtggttgggggggcatttgtccttgtaaagatgatttccccctcctgcgttggagggagagtgaatagaagttagcctgcagcaagaacaaatataccccaaggtctaggtcactgctttgtggctgacaatcatctgatctgcccttgagcacgaatggaaagtctggacccagagctgcgactgatgctgatgctgaggccgctgaagcttgatgggaataaatgcacacagcctaagaggattcgggctcctgaggctggcggcagccccaggtccggctgtgtggacagagggcttagtctgccctcacctaacctggccagaggagcaacctgcttccccccacagaggccgctgaccactgagaggttagcatgtctgggcagaggtgttttgggcagggatgagaagggggataatgactttgaggggctaagggcctgcctgtccacctgtcattctgtgtttgggaagcagctggcaagtgactcttctccagcaggaatctgtcaggccagaggatggccaagtgggttatgcaattacaaatcagtcttcaggcctctgctggaaggtggtgtggcagtcctgggtgaggctgaaggaggtcaggggaggcgctgtcagggtgggaggaaaaggtgccttcacagtttccacagtaccctgggaggtgatgttattatacccacttccatagctcacagagattgaatatctagcctaaggctacagaatgagtggcagaactgaaattttaccgcagagctctggctctaaagcctaggctgactccactctgtcgtccagccatcgaggagctccagaggaaatcggctctgcacctggcagcctttccagtcctggggggatagtgccacctcccaggacccttggggcatgaggtcaacaagggccagccctcacatgagcactggatggagctgtagtcacagagagatctcattatgccagtgattgtcagaaaacctcccaagagccccgttcctgggcccaggtggcagcccattgaccttaaatagcaaagccagctggtccccatgtccaggctgtagcttccctagtgagggggcatttttgtccaggcctccctctgaactcagttctcaggtcacggggagatacagtgcccttgcaggatggctgctgccacctgcctggtctcctgccaacagggacaccagctgaggcacaggcaggacagtgtacacctggagcctcgctcctctatgctccagggccagagtggtcagtgcccgtcagctgaggcggcaaggtgaagctggcagagatgacccaggcagatggctccaggagcccaatgccagggcgactatctaggagacacaaggcagcagaagctgaagagaaaatagacccttgggtgtgggggctgtggagcaggagtgggccctcgccccgtgaaataggtcccctttgctgacatctcattagcctgtcactgcccctttcatgccaagaacctagtgcccctgaatttgtcattgtcagccccaagcaggttttgggaaaacagttctttcctcctctacactccctccgagtctacagcaggagagcaatagtcagaatcaatgaaccttccagaactagagacatgtctgctttagtcataatacaaaaaatgcttttaaacagtcgtctccctactggacttttttttctctctctctcttatttatttatttatttattatttttgagacagtctgtctctgtcgccaggctggagtgcagtggtgtgatctcagctcactgcaacctccgcctcccgggttgaagtgattctcctgcctcaggctcccaagtagctgggactacaggcatgtactaccacgcccagctaatttttgtagttttggtagagacagggtttcatcatgttggccatctcctgaccttgtgatccgcccgccttggcctcccaaagtgttgggattacaggcgtgagccaccgcgcctggccttttttttttttaattggaacagactataaaggttttacagaatataaagatttcctaattacacaaagattttgtctacagaaattagtttaactcatggaagagggtgggtataaattcaaccccactctctctcccttcaccctctctgcacacttctctattttttttttttttttttttttttttttgagacggagtctctctctgtcgcccaggctggagtgcagtggcgggatctcggctcactgcaagctccgcctcccaggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcctaaagtgctgggattacaggcgtgagccaccgcgcccggccacacttctctatttttatcaaatatctcatttggcttccaagagatgtctagtccaagagtaaacaaatactgaaatgcccttggcaaaggtaatccaattatactattctggcaatcatctccagttttttgtttgtttttctttctttctttttttttttccaatacagagtcttgctctgtcacccaggctggagtgcagtggtgccatctcagctcactgcaagctccgcctctcgggttcaagcagttctcctgcctcagcctcctgagtagctgggattacaggtacccgccaccactcctggctaatttttgtattcttagtagagctgagggttcaccatgttggccaggctggtctcgaactcttgaccttgtgatccgcctgccttggcctcccaaagtgctgggattacaggcgtgagccaccgcacctggccgttcttctttctttctttctttctttcttttttttaaattaagcctgatacttgctaagtttatttttttagagactgagtcttactatgttgcccaggctggccttgaactcctgggctcaaacactcctcccacttcagcctcctgtgtagctgagacaacagcacaccgcactgggcttcattttcaactttcaagttttattcgttcattatttttgcaacacctgtttggtgcaagtcactgtgctgggtactataggaaatatatttagctttttgcttctcagattgtagagacagaccacacatgcataatcccaattcgaggcagcatatgccacatgtcacagaagaggctgtcacaggcagtagccactgttgcatagctacttcaaagccattcccagcttgttccacctgccaacacaacgcagctctgtcctggtgtgggacacccatgtgcattggaggggctgggcttcactaccagggtgaaccttcccctaagccaatcaaggtaattccagttgtttcgccagggcctggttaaggaaccagcatgtgatgtaattatggaaatgagaggtgaggtaatgtctgccggttgggggttggaaggaagatattcttgcaaaaatttccttgctcttaaaaaagaactcagggaaaggattttcctcttgcagccctgggcattactgcgtgagcacattgtgcttgtgcttgtgcttgtgcctggtgcttgaggttgctgcagccgtcttgtgaccagaatgggacaaacacgaggacaaaagctaccgctcaatagcaaggcaacacagaaagctgaaaagagcatgggccccgatagagtgttgagcccctgaattaaccaaccttgacaccaaaccttgctctgcctccgaagtttttacaagatttttagtccccttattgtttaggacattttgatttgggtcttctattttttcctgccaaaagcattctaactaacattaaagccttatgtaattgttaatagatttttttttccttattttctgccgggcgtggtggctcatgtctgtgatcccagcactttcagaggctgagatgggtagaccacttgaggtcaggagttcgagaccagcctgggcagcatagcaaaaccctgtctctacaaaaataaaataaaataaagtagaagaagctgggcatagtggtgtgtgcctgtggtcccagctactccgggggctgaggtgaaagggtttgagctgagcccaggaggcagtgagctgtgaccgcaccattgcactccagtctgggcgacagagcaagaccctgtctccaaaaaaaaaaaaagaatttttttctgtattttcttcttcctcctcccctcttcttcctcctcctcctcctcctcttcctccttctcttcctccttcttcttttgtaatagaaacagggttttggcagggcacggtggctcacgcctgtaatcccagcaatttgggaggccaaggtgggcagatcacttgaggtcaggagtttgagaccagcctggccaatatggtgaagccccatctctaccaggtgtggtggcacacgcctgtaatcccagctactcaggtggctgaggcaggagaatcacttgaacccaggaggtggaggttgcaatgagtggagattgcaccattgcactccagcctgggctacagagcaagactctgtctcaaaaaaaaaaaaaaaaaaagaaatggggtttcaccgtgttgcctaggctggtctcaaactcctggactcaagaaattcacattcctcagactcccaaagcgctgggattacaggtatgagccactgtgcttggccagaaatttgtggtaaaattattaataataaaaatatgaaggccctgctttcattcaggccaaaaaatattaaggcccttttgaatttgcagaacccctttgccagtgcaaaccttgccttgggcgagtgaagatcctgtcccctctttctttcctcatatgttgccttcttccacctgcagttcctagtccaccaaatggatctgctttttccttccagtcttcccaggtgccttggccaaactcaaaccataaataaaaggaacacagacaccaggcatggtggcttctgctgtaataccaacactttgtgaggctgaggaggaaggattgcttaaggctaggaattcgagaccagcctggcaacatagtgagaccctgtctctacacaaaatgtaaaaattaccctggtgctgtggcacggacctatagtcccagctattcgggatgatgaggtaggaggattgattgagcctgggagatcaaggctacagtgagccgtgttcatgccactgcactgcagcctaggtgacagagcaagaccctgtcccaagggggaaaaaaaaaggatagaacatctgcaagtccaaacagtgtgccatattcttccttttttttttttttgagacagagtttcgctcttgttgcccaggttagagtgcagtggtgcaatctcagctcaccgcaacctctgcctcccgggttcaagcgattctcctgcctcagcctcccaagtaggtgggattacaggcgcctgccaccatgcccagctaattttgtattttttattagagatggggtttctccatgttggtgaggctgatctcaaactcccaacctcagtcaatccgcccacctcggcctctcaaagtgctgggattacaggcatgagccaccgtgctcggcctcatcttcttcctttttacttgcagctatgagtggggcctgtggcctgatgtgagggggtagagaagagcaagaaggccccaacctgaaggaatgcccccctcctaggtacctatcaaaatgagcctgaccctagggcaatgccacagcttccagagcctcccatgctatttcagaccaaggatcttgtagacaaggagtggtgcagggtgacgcggatgagacccagaccagactctgagggctctgggatgtgaatggggttagctgactggttgctccccgtgtggaggctctggggcctgtgagaggaaaaaacccaagttcccatttctggcccattgttttcctctattcttcctccctcctcccctctttccaccacccctcacctccatttcccttctcctctcccctcctctcttccccctccatttcccccttccctctctctcccattcagttctcccgtttcctgtctccatctcctctgccactgccctcccctccagccaggggccagcacagatagccgtgtactatagaaagaatccaactagagagtgagagaatgttcttcttttgttgtttttgttttctgagataggagctcacttggtcactcaggcgggagtgcggtggcataatcatagctcactgcagcctcaacctcctgggctcaagcaattctcccacctcagcctcccaggtagctgggactacaggtttgcaccaccatgcccagctaattttaaattttttgtagagacagggtcttcctatgttgcccaggcttgtcctgaactcccaggctcaggcaatcctcctgccttgacctcacaaaatgctgggtttacaggcatgagtcgctgtgactggccaagagaatttctttttttttttttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaactctgagtggacacagcacatgtttcagagagcacagggttgggggtaaggtcacatatcaacaggatcccaaggcagaagaatttttcttagtacagaacaaaatgaaaagtctcccatgtctacttctttctacacagacacggcaaccatccgatttctcaatcttttccccacctttcccccctttctattccacaaaaccgccactgtcatcatggcccgttctcaatgagccgctgggcacacctcccagacggggtggtggccgggcagaggggctcctcacttcccagtaggggcggccgggcagaggcgcccctcacctcccggatggggcggctggcccggcggggggctgacccccccacctccctcccggacggggcggctggctggccaagagattgcccatcaggtcactgtgggtgtgacagccactggctccagaagctcagtcctggcggcagctgtcaaaccaacacccacatagcctgcaagcagagggcaggcggggcagtttgtagggcttcagaccctgtgaatttttctgttcagctgtcacccaacctctccctgcaagaggtagggtgagacggatggcagagtgtcatgactgaagaagagcctccgacgactggcctgatgggcacgggcccctgccctgtcgcatgtcaggcacacacatgtgctccagccactgcctggggaaaagagcataaccatgtgccagggtgagatctctccccggctcacagaattgcaagtactgctcccctctcagcatcttcagcaagaaacagggggttgggggtgaggggctgtgcctggtgatcccagttttcctccttctcatcatcttccagggttccaggctgaggagctcagaggttgtgtggaggagggaggggaataacagatgggcccgcatcagggctgcgcctcctcttggacagtcccagaactgagagttggcggcggtgaggaggatcgctgccctccttggacaccccgactgtgatctactctaaaaatcctcccttcacctgaggagaagattgcaggcatgttccacctccagcacggtcctgagatgagttgtccccatttccccctgccctttccttcctcagtaaagggattactgttcattcccacccagaggatcttggagcatccccctgagaaggaagagcttaggactccttccccgctccacaaagagcagttacaaaataaaaaataaattaaaaacacaaacaaaggctactctgggcacactgcctacggggtagccttgctccacagggggcagttaaaaaaagcaaaacaacaataacaacaaaaaacaaaaagaactactgggggcagtggtctgagacccacccctctctttaataaatgcctatttcattttatttttacttttaagacagagtctcactctgtcgcccaggctggagagcagtggcgcgatcatattttaccagtgaggaaagcaaggcccagtgactggcccagacctgggaccatatccttcctggtttttggttagctgcactttccttgcaacatgagacatctcaagtgtaaacacctctgcccagctttcccaccttctataaaccctactagggttctcacaccttcctcaaaaacctctttctccctagtcctgctggcctcactcccaataacttgtccttcatcacaccccctggagttcagccattcaagcccctgccattccaggcagattgcctgagcccaggagttcgagaccagcttgggcaacatggtgcaaccccatctctacaaaaaatgcaaaaattagctggggatggtggcatgcaactgtagtcccagctactaggaaggctgaggcgggaggatagcttcagcatgggagacggaggttgcagtgggctgagactacaccaccgcactccagcctgggtgacagagtgagaccctgtctcaaaaaaaaaaaaaagaaaaagaaaaagaaaagaaaaaaataatagtctgataaatattcatacaccctccacctagattaggcagtcactaatatttgccttttttttttttaatggagtttcggtcttgtcacccaggccagagtgcagtgacgtaatgtcagctcgctgcaacctccgcctcctgggttcaagcgagtctcctgccttagcctcccaagtagctggaactacaggcacctgccaccacacccagctaatttttgcatttttagtagagacggggtttccccatgttggccaggctggtctcaaactcttgacctcaggtgatctgcccaccttggcctcccaaagtgctgggattacaggcgtgagccactgtgcccagctgatatttgccatatttcagccgggcacagtggttaatgcctgtaatcccagcgctttgggaggctgaggcaggaggactgtttgagcccaggggtttgagaccagcctgggcaacacagtgagacccagtatctattttaaataaataaatattttaaataaataaataaatagaaaaaataacaagtaagatgaagacaaactatttttttaaaaaaggaaaaaaattaatagaagaaaaaatttttaaaaattgccatttctttctttctctagaacatataccttttctttgctaacccactagaaagaaggttgaggatatcatgacactccactcctaaatactttagcaggcagacattccattacacaaccacactccgatcttcacacctaaaagaagaataatcatttcatagcatataataccccaaattctccaataacctctttaaaaaaaatttagggtccaatctagctttgtacatacatttgattgtttcatctcttagtctcttgttgtcaaaatgatctcccactgtagtggactgaatggtggcttcccaaaacatatgtctatgtcctaggacatgttaatgtgaccttatttgggaaaagcgtctttacaggggtaaacaatgatcttaaggtgagatcatcctggattacttgggtgggccccaaatccaaagatgagggtctttgtaagaggaagaggagacatggacacaaaggaggagacggccatgcgaagacagagggagagactggagggatgtggtcacaagccaaggaatgcctggagcaccacaagctggaagaggcaaggaagggttcctctctgctccagccttcgggactacagccccaccaacaccttgattttggacttctggacttcagaactgtgagagaatacatttttgttgttctaagccaccaagtttgtggtaatttgttatgaaagctccaaaaaacaccaacaaaaaatgatataaacttattattattattattattattattattttggcattaactttttttttcttgtatttttagtagagacagggtttcgccatgttgatcaggctggtctccaactcccgacctcaggtgatccgcccacctaggcctcctaaagtgctgggattacaggtgtgagacaccgtgcctggccttgaccttaactttttaaagagtctaggactagttgtcttatagaatgtcccaactctgaaattgtcttcagattgaccttttaaaatcctaaatcagggcggagcaaggtggctcatgcctgtaattccagcactttgggaggccgaggcgggcagatcactaggtcaggagatcgagcccattctggccaacatggtgaaaccccacctctactaaaaatacaaaaaaattagctgtgtgtggtggcacgctcctgtagtcccagctactcgggaggctgaggcaggagaatcacctgaacctgggaggcagaggttgcagtgagccaagatcgcacgactgcactccagcctggcgacagagcgagactccatttcaaaaacaaaacaaaacaaaacaaaaattataaatcagattaagtcattccctgcttcaaaccctctaatggcttttcattgcatttaaaataaactctttactctgattttaaaagcctcgtgatctttgactccttgccatgcctctaacctcacctttcccgctctcttccctcatctgcctcgcgccagcctcactgaactttctgcaattcttcaaacatgccaagctcatccccagccttacccttctgctcgggtgatgactgaatacaattcatgattttcaagtcctagattgcatggaaatagctataaagaatgttattggggcaattgagggaatttgaatatgggctgtgtattagataatactgttatatcagtgttaaatttcttttttgttagttacaaaatttttttacacaaataaaggcaaatcgatgttaaatgtcttcagtgggctaatcctactgtggttatgtaggaaaatgtccttgttctttggagttacatgctaatgtattcagagattaaatataatgatgtctaacacttccagaggaattgtggcaaaacattgacaactggtaaatccaagggaaggatatattggtgttcatagcagcattctttcaactttgtcctgggtttgatttttttcaagataaaatagagtaaaagatggacaatttaaagaaaaaatatcttaatccaggaatacttaaaaatcagtagagcatttgtcaatgcccttctaaagattcagaagatgtgggtaggacccaggggcctgccttttcatggcccgggtgaccctcaggcagctgcccaggccacactttgaacaggttcactgagcactctgcccttggagtgtggcttgctggcacagcccattatttcccattctccagctgaggagcggctggctgaaagatcaagcaggcggatggagacgtgattttacagtgagggtggaaccggagattgtgggcacaacagagaatggtgaggagttgcggaaagattttgtcttcctgccctgtcttttggcttctggaggaacagaggaggctcctagaactcagggaatgaatggaatgagggctccaaactcctcataccagtgcttctctgactctattttacactcccttggataaatgtcatctgtaaacaaacaaacaaacaaaaaaagaaatcacaataagttttgaagtattccccaaattccagtgttccaggatccttgagtcttgaactcaacatagatgcagactgaacacgtcagcacgtcattctgacttctgaccagaaggtggcagcaacatacctcgctttattttaggggccaccaacaaagagattttttgggtgcctcacacgcattcaattgacctaggtcccgccgcagacaccacggacaaaaagatcagtacgatcttatcgttgccctcaaagatcatattgtcagggagcggaaagtcagaggcagacatataaacagattaccagttactagctgtgtgaccttaggaaagttacttaacctcgctgtgcctcagtttcttcaactatgaagtgggaatagtaatagtacctatgtcatagggttactgtgaggattaggagtgattaaataaatgtgttagacctagcactgtatcactatgtgatacagtgagagaagggatgagctggcagggatgcccacagtgctccctaactggaagcagtggagccccaggtggagataatgggaaagagttccactctggtaaagccactctgtcagtggggaccctgcagccaaactgggctgggagagtctaccttcaaaagtgtggtgctggatcccttccggctgaggctcaccttgggtcctgcaggcatagagtgaagaacaccagcagggccactcagggcctgatcaaccaggacgcgcccttccagaggaaaccaccactagctcactgtacaagctcagacatgcaacttggtccctctgagcctcaggtcttacctaagtgatggggaaataggaccacagggaccaaggaacagtgctgagttccacatctgggacatcgcaagagcaactataaagtcaggcaattcaggagcagcgaggacttggagctagggactcaaaaataaagctggggggccaggcatggtggctcacgattgtaatcccagcactttgggaggccgaggtgggtggattgcctgagctcagtagtctgagatcagcctgggcaacatggtgaaaccccctctctaccaaaagtagaaaaaaattagccaggcgtggtggtgcgctcctgcaaccccagctactcaaggactgaggcaggaggatcgtttgagcctgggaggcggaagttgtagtgagctgagactgcaccactgcattccaacctgggtgacagagtgagatccttctcaaaaaataaaaataaaataggccgggggctgtggttcatgcctgtaatcccagcactttgggaggccaaggcggacagatcacgaggccaagagatggagaccatcctggccaacatggtgaaacccatctctactaaaaatacaaaaattagctgggtgtggtggcgtgcccaggatgtagtcccagctacttgggaggctgaggcaggagaatcgcttgaaccccggaggcgaagtttgcagtgaggcaagatcgcaccactgtactgcagcccggtgacaaagcgagactccgtctcaaaaaataatagtagtaacaataataataataattaataataataataataaaataaataaatacataaaaataaaataaagctgggaagacaaaggaatcctggagaggaccctggacttcacctaggatgtggagtggaggtttagttttttaatttttattttgttttgttaaattttttaatttttatttttgagacggagtcttgctctgtcgtccaggctggagtgcagtggcgcaatctcggctcactgcaagctccgcctcccgggttcacgccattctcctgcctcagcctcctgagtagctgggactacaggcgctcgccaccatgccggtttacttttttgtatttttagtagagacggggtttcaccgtgttagccaggatggtctcgatctgacctcatgatctgcccgcctcggcctcccaacgtgctgggattacaggcgtgagccacagcgcctggctggttatttatttatttattttgagataggatctcagtcactggggctggagtacagtggtgtagtcacagttcacagcagccttgacctcctgggctcaggtgagcctcccacctcagccttccaagtagctgggactacaggtgtatgccaccatgcctggctaatttttgtgtgttttgtagagatggggtttctccatgttgcccaggactggtcttgaacttctaggatcaagcgatctgcctgctttggcctcccaaagtgctgggattacaggtgcgagccacttcgcctggcctggagtggaggtttgtgtcaatcctagacccggagaggcagagaccccagctgacagatgcaagtattagggatgtgctgaagcagagggtaaggctgggaggagcttagcatgtcttttttttttttttttttttttttttttgagacagagtctcactctgtcgcccaggctggagtgaagtggcgcgatcttggctcactgcaacctctgcctcccgggttcaatagattctccttcctcagcctcccaagtagctgggattaccggcgtatgctaccacgcccggctaatttgtttgtttgttttttgagatggagtctcgctctgtcacccaggctggagtgcagtggcgcgatctccgctcactgcaagctccacctcctgggttcacaccattctcctgcctcagcctctccagtagctgggactacaggtgcccgccaccacgcccggctaattttttgtatttttagtagagacagggtttcaccatgttagccaggatggtcttgatctcctgaccttgtgatccgcccgcctcagcctcccaaagtgctgggattacaggcgtaaaccactgtgctccactggcatgtctttgttctatgactgttctttggccagccatggatctctttactctcccaatctcccactctctcttgcctacatgccctcctaatccagctttgagcccgtggcctgacatttaatagcactcttggccaggcgtggtggctcacgcctgtaatcccagctctttgggaggccgaggcaggcggaccatttgagatcaggagttcgagaccagcttgacctacataatgaaaccccgtctctactaaagtacaaaaattagccaggcatggtggcaggtacctgtaatcccagctactcgggaggctgaggcaggagaatcgcttgatcccaggaggtggaggttgcagtgagctgagatcatgccactgcactccagcctgggcaacagagcaagactctctctcaaaaaaaatttaatttaatttaatttaaaaatagcactcttgccagtaacctaaacttcgttactcaccttccctgcaaacccctgaacacatgcaatagttgtttctcttccagccttcatcagagcagccaagggaggcaggaggaggaggagcgatgagaatactggcaaatacttctacagcatgtactaggtgccaagcacaagtgctttacagagggtaactcgtttaatcctcccaacaccatgaggtaagtactgttattatcattcccatttgtggataaagaaaatggggtggccaggcgcggtggcttatgcctgtaatcccagcactttgggaggccgagacaggtggatcacggtcaggagatcgagaccatcctagctaacatggtgaagcaccgtctctaccaaaaatatgaaaaaattagccgggcgtggtagcaggcgccagtcatcccagctactcaggaggctgaggcaggagaatggcgtgaacccgggaggcggagcttgcagtgagctgagatcgtgccactgcactccagcctgggcgacagagcgagactatgtctcaaaaaaaaaaaaaggaagaaaaaagaaagaaagagagaaagaaagaaagaaagaaaatggggtgaacagaggttaagtcactcagaaaacccaaagcacacagctaattaaggtgagcagccatgaatgaacctgcaccatctgcccagagtcccggtccaccaggggaggatgaggccagggaggacttggcttcttccgccttgggtccaagcactactttcagcaaccaggggcacagtccaaaagaagcccagactctcactgctcttggggctgacattatcactctggaggttaataataatagcaataataaaaccagcttccattttcaggctttaagatgtgtgtcctaagcacttcacatgtatttatttattcctttagtcctcccaacaacactatgaggtagaagctacagttagttatctcccttttcttgagggacatgaagggacgtagtgacgagcctaaattctacaacagagtggtggatcagatgggaagtgtggcagctggatgccagagcccggctcttaacccagactctttgcctacctttgctccgcctggagttgctggcctgctccttctgctttaggggaggagcctcttctgcctggcagttccccacccaggcctgatccacagctccagagccctgctgtggcagccctctg

SEQ ID NO: 403 - DNA, 30545 bp, Homo sapiens
ctgaggttgcagtgagccgagatcacgccactgcactccagcctggacaacagagtgagactctatctcaaaaaaaaaaaacgaaaaaaagaaaaatcctgatgctcttgttttcctagctggtgtcaagataatttcaaaactgacaaataaaataatagaggaataagtatttttaaacgttaaaagtaaacactaaaataataatcaactaaaatacagtggcgtaagggagacaggaacagtgtttggcagtgggaatacactatgttcattgttacagcagggaaataatctgtgctgtttgaacagacagaggagtgagttttgaataatggtaaagccataaagttcattgctgaaataaaaattaaataaaattctccaggttggaaaaagacacaccaacacaaaagtaaacaccagaaatcaaaaatggaaccacaaaataaattatgatagaattcactgaaattctaccaaaaccttaaaagaacaggaagctgttctaagtctatttaaactacccaacagcagaaaaagcagaaaatcttttgaagtatttaaataaaatttaccaaacatggaacaacaataaaaagaacaaaacagaaaaaaatcagactaagctgacacaaatgtcaatgcaaaattctaggtaatatatcccaattaataaaatatttcagcagacaatatcgtgttaccagatagaaggtcttgactgtgacttttccaggttcttggtgtgttgaacaaagaaatgaacaaaatgctcaaacaaaacaaccaaaggaggaagcaacaaaagacaaaacaactaaagaactgagtaatgaaagtacagatttactgacgcaaaagtacactccacagagtgggagcaggcttaagcaagcagcttgagatccccaattgcaatgttccttagggtttttattaggctaaaagaatttggtaacaaccctaggtgccctttagaggcctccatttggttacaccctatgaaggattggctggcgaccaatcagagcctgaagtggagacttggcctgctgtgaatcagaggctgaagtggaaacttctgtcttattatcgcaggagtgaagatgtgacctgtatgctgcccagtcttgcctagaaatggctgcacctgctgttcttgtgcttatgtcttaatctctggttaccctaattccctattctcctgacccataaagactgaccaatttctggattatttaaaggatgcaagtgtagttcaatactggaaaatctcttaatataattttctgaatataacacaattttattaatataatttatcatttatctataaaaatattatctctgtagatactgaaaagagatattttaaatatttgccattttttatcaaacccttaataaaataagaatacatacttccttaacatttaaaaatcgtgtgtgtgtgtgtgtgtgtgtgtgtgtgtgtgtaatctcaaattaaaggccagtgtcatttttaatgagaaaacacaagaatctcttccaaccactaaaattaggtaaaaaacaaggatgtgaaatatcactactagttaatattatttcaaaactattagccaatgcaaaaagtaaaaaaaaaaatgtaaaagagaagacaaagtggtcattatttgcagatagtatactttatatttggaaattctaagaaagttacaagacaacgttacaaatagaggatgcaatcagctaattaaaaataaaattaaaacagaaatatttgggttcatgtgtgcaaactacaactatttaaatgctttaatgacagaaaaaactattttttagcaacaataaatatgtatttaggaataaacttaatatgaaatgtacaaaacctatgtgaaaaaatgtttaaaataccactgagaagtacaaatcaagatactagcaaacccttcttgggtagaaagaattaacatcacgatgatattgattaccactatattaattggtatttttaaaataatttcaataaaataccaccagaatatatttgcgtgaactagacaagctcattagaaagcttgtattaaaaaataaacaaataataattgctaggaaaattctaagcaggagtgatggtggaaaagcaggtttatcagaagttgaaatacatttttttaaagttaataatgaaaagagtgcggtgcctactcatgaaaggaaagataaatagaatggatagtacctaaattgggtaaaaattgtagggaataaaaacatggtgactgtaggtaataacaatgtattctattcttgaaaattgcaaagagagtacattttaagtattctcaccatgataaataataagtatgtgaaataatgcatatgttaatcagcttgatttagccattccacaatgtatacatgtttcaaggtatgctgtactcaatctatacaatttttattttttaattaaatatgaatatttaaaaaattaatagggaataagtttataagtggtcttggagaatctgcatatccaaataaatttacatttttcaccaagtaaaccagagataggcaaatatttttatctaaaaatcaaaacaaaaaattaaaataaaatataagagaatgttggtagggagtggtgaatgccttttaaaatatgttataaaaatacagcaatgtaagtagaatggtggctgcctggggctggaggaggcagaatggagagttagtgtttaatgggtgcagagtttcagcttaggaagatgaaaaagttctggagatggatggtggttaatggctggacaacaatgtgactatatttactactactgtattaaatacatttaatggtatgcttaaacctggttaagatggtaaacttcatgttgtgtatattttgccatagtaaataacacatagcagcataaaacaaaaactttgaaaaaatcaatacatacagctaaaaaaaatcctgacaatcacccatcaccataaacaagatcagaagacaaataactgggaaagttatacacaatttatatcacagaaaaatacggttttcctaactgaacaaagagctcctataactcaataaaatcctcaaccagcaaacagaaacataaaaaaggattttaacctttttcaggaaaagaattaaaaattgttcatatctatataaatagtcaactcaaatgctcatgccacttttcacctagattatggaagatcaaggtgggtgagggcacgcctttctgggaagggtgcagggaccttggcacttgtatatattgcaggcagaacacaattgagccaaaactactagaatgtaaaaaaaaatccactttttgtcccagtgattccactgctgggaatgtagcctatagatacactcagacatgtgcacatggtatgtgtgcaggggcatttgctgtagcattatttgtggcagcacaagattaggaaaaataattaaatgaagattgtgcggccaccataaagagtgaaacagtgaattaatacgtgatgaaagccaagatttattatgaagtaatgggcagaacagagtgtactgtcaccatctgctgaaagtgcacgtggaggtgaaggttctagaaagatagatgagaaactactcagtgagtgctcaggaaaggaagtgggggacaagagacaagggctgtgtgtgttacattctttccttttgtatttatttcctgtggctgccataacaaatgatcacaaactcaggccttaaaacaaccgaaattcattctctcatggttctgaaggctaaaatctgaaatccaggtgtcggcagggcccggagctttctgaaggccccagtggaggatccttctgcctcttccagcttctggtggcctctggggttcctggttctgcagcagcgtctctccagcctctgcctccgtcttcacatggccatcatccctcggtgatcctccgggcgctttcctcttcttatgaggtccccggtcaacgacttgagagctgatgctaaatccaggataatgctatcttgaagttctagaatagttacagctgcaaaggccctctttccaaaaaagctcacattcggaggctctgggtggatgcgaatttttaagggacattgttcaacccaatacacctgtgtatatgcttttggagcatttgaaatttatactatgtatatttatcaccctttcaacataaattaggtcattaaaaactatgaaaaacacatctgtttacagatgggaatatatgatggcatttatttacacatatatgtattcatatttttataacgaacagttttagaacagtatttaccaggttaaaatgagccctgcagtagaactgttagagataagaaggaggagagggtggagggctcatgaccatgttctctgtaggtctctacaatggcttgtgatatttgatgcagtatttatatactgagatacattttatgaaagattatattttgaaataaacatgcttgagtcccaaggaaaacagatatagccttacaacttaggatcaattcccctatagaactcaagaatgacaatgagaagcttgacatggtctttatcagcacaatgttcatatctgagttacttggcaagcaacaacacacaggcgactttctaaacctgcatcctaagattaaatcctgttgtaccccaacaccaaaaggccacatgtgaccatcaccttgagctggtaaatgctgcgagcttactttgcctggtcagcaacagatgagtgcagcggtctgggcgctagggttagacaggcacacagcgggtccaccatctgtaggggagtggggacacctggagtgaatgagcagatgtaggacaggccaagaaagtttggggttccttggttcatcaagggggctgctcttggggagagcaggtgaactccccgaagtaagaattattttcaataaaaatcttttcctggcaaataattctaaaatatcccctaggttgacctggagctgttaatgtgcttttcttctcgccaccccaggtattaagggattcacacacataaccgttcaatattaaatgggaggcagtgttctggccacggatattacagctgggggatctctacctcatgggtgggcacagccagtttgaggggtgccaactgtccctccttcaaggaggtgttcctggtctgctttaaggaggtcactgagccagagccccaaatactctccaattaatcgagccgagatcacggtgcttattgaacatctaagaatgagccatggaggcagcttttgaatctttcttctggaaattttgtattgaaaattcacgaggcttaaacggagcctgtgtaccaggaggcggtcattgctaggaaaatctgtccttaaagtgatcctttctgggagttacttcctgctctgcagtcttctctgcagagaaactgagcacagagtcccttgaggaattgcagagaactcaagagacttggcagtggtgccagagccacgtgccatggcggtgggtgaccgggaagcgcaccctccccagccgggttacctgttgctgtacatgtgacgtcctctgtaccagactaacttcaaagcctctgaggacagtgggatgctgatgccccagaaagaatgtgcagaagacagctacctcacagggatgtggaaacgttcggctcctggaaccaggtgccatcgtcttccttgtcacacactgagatgagcacgatcactttacagtataggttgtttttcctttggattggacgttctagcgtgctcctgtgttctcctggctgctgcggctttgtaggtcatcaatcagggtgctgactggcaggaatgactgacgatgctgcatgccctctcctgccccacggttttccaaatcacaactcatcttcttattggcataaatgtacctcctgtttatttaagtagaatgtaaatagggagaaaggctgtgacccacgctaatattcctcctaggtgtgagcacactagtttatatatctgccctttgtctcttgctaaagtctctcattttcaatcatattctttacttaaaatgtctacttttcagtgtgagttatcacaaaaaagacacatttaatcgttgtgtagtaggaaaccctcttgcaggaataaaataggatggagaggagttgccaacataggccacagttcccaagctgacccttatttttattgaactaaagttgcatataaatcttttataacacataaatccttgctgcctcggcaccgctatgtgcttttttgttgttgttgagacaggctctcgctctgtcacccagactggagtgcagtggcatgatcttggctcactgcaatctctgtcccctcccacctcagcctcccaagtagctgggactacaggtccctgccaccaggccctgctaatttttgtatttttagtagacacagggtttcgccatattgcccaggctggtctcaagctactgagctcaagggatcctcccacctcggcctctctcaaactactgagctcaaggggttctcccacctccgcctaccagagtgctgggattctgggcatgagccatcacgcctgaccctgctgggtaccttttgcttcctacattacttatgtctttcctgttgtttattctacttattcgaagtttgttttattgatgatttcataaaatattattttggtgctgattatctcaaagttatgtctgtgggtttttattgaattaaattgtttttctccttattaattttcttctaatttatttgggtttattgtgctgttctttctcctggattcttgagcggaaagcttaatttatttttaatgcatctttgaatctaattaatgcatttaagaatactcatggttctcaaagtgtcttttgcctccttcatctcacaggattgaagaggcgctcttatttattattcagttacacaggtttgcaatttctacttctatttcatttttaattaagagttatgtaaatgtttgtttgttttctaattttattgctttgtgaaaataaatgtggttttaatggtgttaacttcttgaaatttatgattgcctttgtggttgagaataatttattttaaaaattacatgtgtgttcaaaagcaaagcatatgccctcctgaataaatgcagtcctggggattgtgaatttgaagcctttacattggtaatggtttagatctgtctctttctgagagaagtttagagctaccactatgtagaattaggagttctacattttgaagctatacgtatttttaaaaaaaatttttgtcacacatacctgtaaacaatttatgattaaaattttcatatttttggaaatcatcgacatggacacacacatttattctttccggttactcattcctgcttgttttgctcaccatgacgtttccagggttaatctggccggagcccactgtcattctgggacttctttggggtaaatgctcccctggagatttctgagatagcaggccacgatgaattcagagcacccgccccaggccagcctgtgattgcggtggtccttcctgactggtccccgccccggtctgtgccctttgggtaggtccctggcctggagcctcagcatgccctggctgcttcccctggaggtcgcaggcgtcctgaggaagggggcggggctacaggctcttgccaatctggtccctgttttcttttccagcctctgcactttcagaaatgattttccccactcacttaaaatatactttttaacttttctattgtttttcattgatttcagcatgatggtgtttcaggatatatgttcaacgtacagttaaaaaaggaaaccaataaacccatttttgtttactaaaaagatgtactcaaaacattgtaggaaacacaatatcatgaagatactaaaatcacaaacaactcaacaccaaaaaagaatccctcgtatcacatagatactttatctcctacgctttgtaaaaatccccgctgcatatacagatttttaggcaaaaaccgtagaactacactgttcctttacttttggtcttattgttaacactcagtactctttgatggccacgtccttacccacttctgactgccttcttgatctgctatgtccggagttggttccttccggcaggttcgtggtctcgctaacttgaagaatggagctacagaacttcacagtgagtgttacacctcttaaaaatggcccaaatccaaagagacagcagcagcaaaatttactgtgaagagcaaaagaacaacaacgccacagtgtcaaaggggactccaccgggttgccgctgctgtctgcgggtggccagcttttattcccttatttgtccccacccatgtcctgctgattggtccattttacagagtgctgattggcccattttacagcgcactgattgatccattttacaaactctagctagctacagagtgctgattggtgcattttacaaacctctggctagccacagagtgctgactggtgcgttttataatcctagctacagagtgctgattggtgcattttacaatcctcttgtaagacagaaaagttctccaagtccccacccgaactaaaaatccagctggcttcacctcagactgcctccccaacccccaaccgcctgctctatggtggcatgagccaccatgcccagccaactttagtgtttcttgtgacagagaaatctagcttaacgtttctccttggaattaaccaattggctgagcatcatttattgcatgactcttcctttccccaccagcaaaaattattacttataactccctggatacagtggggtcagtatctgtccttttatgcagttttaccgggtgccaatctatttctgtgctggaataatacttttgtaattgtaccttcgtgataaactttatgtgcactgatgcaagttctgtatcatttttctctttcaaagttttattttctattgtctcataaactttagaataattttgaaatgaaagttgaaaacaatccatataatactgtagttttttaggggtttttttgtttgcttgtttgtttagatggagtctcgctctatcacccaggctggagtacagtggtgccatctcggctcaatacaacctctgccttcccaggttcacgtgattctcggtcctcaccctcccatgtagctgggattacaggtgcacactaccatacctcgctaatttttatgtttttagtagagacggggtttccccatgttggccaggctggtctccaactcttggcctcaaatgatccgcctgtcttgacctcccaaagtgctaggattacaggcatgagccaccgcgcctggcctattatagatattttaaactcagttggctatttgtcttaatcttatccatgagaaaaaaaaattgatatttaaaaagttatagataaaccccatggatattcttctttatagcttctggctttgatgatgtgtcagtgtttaaactttggctgcttgtgaaaataatattaaaatattcacctaaattagcttgtattattttacttttataatttttttaaaattaaaatgtattttatctggagcttatctgttgcaaggaatgagttaaatattttgttttaaaaattgttttaataaaataatgatttgaggcctaacctatcttttcctcactgattgcaaagctccctttaccatatggtagattccggtgtatcctgagctggactctgcactctctggtgcctttcccagcacttttctccatgctgtgtggttactattgtcttttgaaacttcaaaacctatcggaatgtaggccactaggtcagggcgtcatggaaacccttgtgtgcagggagcagcagacagatgattccccagtcccggaacactctcggccctcttcagccactccctccccaacccacacgccatcaacctccagaccctctcgccgtggcttagaggtgtctctgacaacgtggcacactgggaaggccttctttcctgctaccaatacaaatgcattctgaatttgatatgtcattaaatgtaaaaatacagccaatttgaaacaagcaaatggaaattcccaggaaccaaaaacagaaagaaaaatcagaggtaggtagaaacccacgctgctgtggggtggcctgcggaggttttgcaggagtgtgcagtaaatgtttaatagcagatctccagggaggaacagctctgatttgtagtgtttgccaatttccacggtataattacttccatcttggttgttttccagctaccgcagtgctgtccctgcagacagaatttgggagaggtactcagagtcacctcctgtgagcctatgcaagccagctcctgcacaaccctggttttagtccaggtaaaggcccgcccaggtgtttgaatatggactcctcacatacttctgcagactccagctttgggttgacccatcggggagagggaacttagcatgaacccttgtataaaaatgaaaatctctttcattggaagggaagatcactgactgggctagtctcccaagacctaggaaagagcttggctgtcagagggtgagctagggaacgaactgtgcttgttgatatccacatccaaggctgatggccggaggaggcagttaagagcaaaaggcaatggaccaaactacatcaaagatgggattataacaaaactttaaaagttggtttacaatgcagaaaattcattcttctggaaacagacttgaaaaaaataaaatatttactctacctttcttgttcagaaccatgccttagggtaggtaaatatttgattatgaaaggttctttgtgtggaataaatctaagtaataattgctgaagaaatgatatgattaagatatggccatctttggtcaggcgtggtggctcacgcctgtaatcccagcactttaggaggccgaggcaggtggatcacaaggtcaggagttcaagaccagcctggcctacatggtaaaaccctgtctctactaaaaatacaaaatttagccagacatgatggtggacacctgtaatcccagccacttgggaggctgaggcaggagaatcacttgaaactggaagatggatgctgcagtgagctgagatcacgccactgcactccagtctgggcgaaagagcaaaactccatctcaaaataaataaataaataaaagatatgctcatcttcttattaaataaggtaatggatctagtcatcatttaagtcttccaaaacattagcgaaactgagacttttaatgacagacttgtaaaaccaggtgtctggtggggaggcatacccagcatagtttcaacgagcaatttatgccctagcacgcaggtccctccccaggtttctcataggctgactactatgaggtcacaatcttcctggatgtcatctattgattgttgggtagaggctttaggtgtttctttagggttgtcttactgcattttgttgcaacccacaatgcattgcaatcttagttagctcaggggctcttcaagtatttgacttatgacctaagtagctgggcaggctggtaagaacagacaaaatgagctatcttgcagattagtaaagttttatcttagactaaacctctttggtttggatgagggcaactaaggtgcaggagaaggggaagaaggggaaggctgacaagcaggcatctgctatccaagcagcggcctagtatatcctctttcttctgtagtttgctgacctaagcccattcaaggcactttgtcttggaaatggaccactgtatacattatttccttcaggtgggagacatgggaagaggcagaagatttgaaatagcccttgtcttagtgtcattggcagaagtgagtggggtttgcaggagtgttaagcctgttagtcattgtaaattcattgtgaacacagttagccttattaggtggttttcttcagaatcgccaggctgctcccaagccagttcctggcaaggaaatacttggttttcttggggtggcagtctgctttttaaaatgcaggccttattattatttatttatttatttatttatttatttatttatttatttgaggcggagtcaccctgttgcccaggctggagtgcagtggttcgatctcagctcactgcaacctccacctcctggattcaagcaattctcctgcctcggccttccgagtagctgggactacaagcacgtgcaccatgcctggctaatttttgtatattttagtagagatgatgtttcaccatgttggccaggcttgtctggagctcctgacctcaggtgatccactggccttggccttacaggctttattattattcaggtatggtgaggctgcagatctggtgatggttgtcactgacaagatagtttgtgatttgtggttcccaaggggaggagcatgacatgctgcatgctggtgggggccagacagaagcactggggcagccaggagtcagacggcaagtggggactgtggatggaaacctttactgcacttttagtgagaaagaacaggcaaggcagggtcagcaggtttagattgagttgtgagaacaatctctgtgggctctggggcctagagaatctcccttgttgtctggtacccagccctggggtgatgtgggaagggggatggtggcccagtgtgagagtccagtcatggctggacgtggtcgggggtgttggctgggattggcttgttcgtatttgaaaagcatacccactggcaggttgtttaccctgtcttggaattagctcgccctgggaggggcagtccctgcagggtcagcagggccccagatgtcgaagcgtcagagtacagaaatcaaagatgtttggtgcagtgtgtgtgtctgctggtgtgacaggaagacagaccagcagcaagggaggtaaggctagcagagatatgtgatggaggtggtgaatcatggaatctaagcttgctcactgggaaggtgaagaaagtacagggattagaaaaactgagttcctgttgggtttgtgggcaacaggctgacccaggaatgcccagagaagggaggctacagccatttgggatgctcacacttattcaaggtgggatggttttgcgtaatgctccaggtgactgtgaagggaagtggttcctggacgggaaggaaacgataggccgtacgtgggaaacaagacttgccaggatcctggaaggccatgacgcggccatgccccttccagtcaggcggcctgtctcagccacattgcttgctgtgccttctgtgtgggagcagggagagccttcacacaggagaaagagagccatgcttattttcaccaaatgccacggcaccaaaagaaagggtggaatataaactccacgagatttttttttatctttgaacttccaatgctcattataaagacagaagctgataggtgccctataactattagtagtttgaaataatacatcaaataaggagagaaataatcatacatgtacttttactaataaaaaaagagactgacagcccaccccagttaaggattgatgacataaggcgtgtgagtgaacgtggagacacacaaatcaacccacaatcagaaggtggcagaggcagtgggggtggtaacttaggttgaaagaaatggcattttagaaacggcaatgcaaatctgcctttgataaatacgaataaatcgcggagtgggcatgagaatggatagaatggtagcatagaaagagatggaaaagagatcccatgtacatgctggggaatatcaatcacccttggaaccttccatgagcctaaaatagaacaggaatccaagtgtctctatgtgggagaaacgtgaatgtggtcatttccacgtcagcctggctgcggaagcaggaccccgggtgaccacgggctcgtcagcacaggatctcatcacctggtctgccaaggcctggggtcctttccaagcaataaaattataggtgtgaaatgcacttaagctattttctccaaaacatatcacagaagatcacaagaggacacaaaagatgacttcctcccattgaaatggctaaaacaaaagtgataaaaataaatttgtggttaaatatatctgaggattggtagggcaacagggtatcattactcagaatctggcctgcaattaaagacttccaaaaatggcagatcgcctccttcttcaccaatttcacatttacccccaccagttctacttgcagaaggcaagacttccaaagaggcttccttacagccacgggattcccgcattagagtgtggctctcaccccaatactttcagtattctgggttcttacagtgtctatttctaagttcgtttgttttgatggatcacggaggaaattgttttcctgtgttgacgttaaccacgcttcacgcttccctgctagccatcctcaggtgtattactactgttgttgttattgacttcgaaagggaaatctccttaagagcctctacaatggctggaaacaattgcaaacaatttttcttttcccttttcttttttcttttttttttgagatggagtctcgctctgtcgcccaggctggagcttgcagtgacgtgatctcggctcactgcaagctccgcctcccaggttcatgctattctcctgcttcagcctcctgagcagctgggactacaggcgtccgccagcacgcccggctaattttttgtatttttagtagagatggggtttcaccgtgttagccaggatggtctcgatctcctgacctcatgatccgcccttctcggcctcccaaagtgctgggattacaggcgtgagccaccgcccccagccttttttttttttttttttttttttgagatcgagtctcactgcatcacccaggctggtgtacagtggtgcaatcgcagcttactgcagcctgggcctcctgggcacaagatatcctcccatcttagcctcccaagtagctgggactacgggtgtgcaccaccatgcctggctaattttgttgttgttgtattattttatagacacaggggttcctcatgttgcccaagctggtctccaactcctgacctcaagtgatcctcctgcctcggcctcccaaagtgctgggattacaggcgtgaactaccatgcctggcctcagagaataatttcacattttaaactctaagtactgggtgttggctgtgcagaacctgttctttttggtttgccttttagatgccatctttacacatgtctcttctatctggtctacctaaaagaatgcagagagaagatggaaattcaaatctaggaggatgtagatttcttaagaataagatataaaatttttaccatttaggattttcttgcacgtagtagttaatcggttagcatttcttgggtgaataaaatcacaccatgtaattaatgttaggactttaaggcaaataccaaagaggagaaatatacactcattaaatatcaagttacctgagcagaagctcagctgtctgtctgctggcatgacacacaaagagcaaggttcagactgccagcatttaccatgccatgcagacagcttttttttcttcttcttctttttttttttttttttttgaggcggagacttgctctgtcacccaggctggggcagcatgatctcggcttggctcactgcaacctccacctccactttccttcttgcatggctatttcacagcagaaatgagatgcttggaaacttcagcaactgcgcctcatagtttctaaatggtaaatggcttccctgcccgcttccaaccctgttgggagggcctttcaggtctcagggctggaggcacaggagtctgaggcccatttcctaaggagcaagttgctattgccagtcggagcacctgcaccaccctctgtgctcttggtagtgtcatctctgctgtcgtctggatgtgctgggtccagtgtccggctgtgggcgctgggatcatcagcctgtgtgatgcatctcctcatctgtcatgacaggctgataacagctgtcttgaggggatgttctaagagtacaaacaaggtggtaagttgcatgatccaccatgcctctgccttgcaggctcaaacagtcttctcaactcagcttcccaagtagctggtaccacaggcgtccgccaccacaccaggctcattttttttagctatttttaaaattgtgctaaagtacacgtgatacaaaatgtactatctttaccacttttaagggtgcagcatagtggcattaggtacattaacttagttgtgtgaccaccaccaccatccatctccagagctcttttcgtcttgcaaaactgaaactctgtacccattaaacacaagtcctcatttccccctccccaagctcttggaaaccatcattcaactgtctctatgaatttgactactcttgctgcctcctctaaatccaatcataaagtatttgtccgtttgtgactagttgatttcatgtagcataatgttctcaaggttcatctgtgtctgaatctccttcttctttaaggtagaatgacattgcttggtatgggtaggctacattttgtttatgcattcattcctcagtgggtattggggttgtttccactgtttagtcatcttttagctatcgtgaatgatgcgcctggggatgtggtgtacagatatttgtgtgagttcctgctttcacttcttttggatatttccccaaagtgggattgctggatcgcatggtaattctatgtccagctttttgaggaatctccatgctgtttccacagtggctgcatcatttttcatccccaccagcaatgcacaagggtgctaatttttctatatatttgccaatatttgttattttatgtgttttttttttgctgttgtttgtttatagtagtcattttaatgggtgtgaaatgggacctcatggtggttttcatttgcattgcattagtgataagtgacgttgagtgcatttttatgtgcttattggccaactgtatatctttggatacatgtctattcatgtctgaaacttgcatgtgttcaacgagtctattattattatcattagagagttttcacagtgaggcaaaaataagatagatttttagttagaattgaagtcaaggtcacagtgacacttatgctgaaaactttaggcaagttatatgtctccgccggcctactgcaccacacatccaacaggacttgtgaagcagctggtccttcactcagcagagcttcgtgtgcactgccactggtagaagccttataaccataacaagtgaggcctccaatactaatggcagagtcagtggacacgctgaaaggaagctcagcaaagatgcaaatgtgttccgatttaaaaattttacgggaagctgatggaagcacggagtagcctggcatttgccattggttctctgattttggagacgggaaaacttcctgctggcaaagaaaatttgcaatgatgatcctggttttgaatggaggctgaattcaggagatttaccagaacgagaagacgtaatcttgagtctggtttcaccaggtttgttataagaggctacagccagattcgtgtgggcagaaactcctaactccttaaaaaactgtgacactggccacgcgcagtggctcatgcctgtaatcccaacactttgagaggccgaggtgggtggatcgcctgaggtcgggagtttgagaccagcctgaccaacgtggagaaaccccgtgggaggcggagcttgcagtgagccgagatcgcgccactgcactcctgcctgggctacagagcgagactccgactcaaaaaaaaaaaaaaaaaaaaaaagaaaaaagaaaaaagaaaaaaaagaaaagaaatacaaaattagccaggcatggtggtgcatgcctgtaatcccagctacttggcaggcttagacaggagaatcgcttgaacccaggagtcggaggttgcagtgagctgagattgcgctactgcactccagcctgggcagcaagaacgaaactctgtctcaaaaataaaaagactgtgatgttaatatcttgaatatttgtccagaaggctttttaaaattttatttatttatttatttttttgagacggagtcttgctctgtcgcccaggctggagtgcagtggcgcaatctcggctcactgcaagctccgcttcccgagttcacgccattctcctgcctcagcctcccgagtagctgggactacagtcacccaccaccacgcccggctaatttttgtatttttagtagagacggggtttcaccgtgttcgccaggatggtctcgatctcctgacctcatgatccgcccacctcggcctcccaaagtgctgggattacaggcatgagccaccacgcccggcccagaagacttttatagatctttgcaaagcatatgtttgtaccttatttttatctttttggtttttttgagacagagccttgctctgtcacccagactggagtgcagtggtgcgatcttggctcactgcaacctccacctcccaggttcaagcgattctcctgcctcagcttcctgagtagctgagactacaggcaccggccaccacgaatggataatttttatatttttagtagagtcgaggtttcaccatgttggccaggctggtctgggactcctgacctcaagtgatatacccatctcagcctctgaaagtgctggaatatctttatcattttttttgtaatcaattcagtatttgaatagggataaaattgatttctgggactagacttctcatgtatgctattagcccctcagcagataagatccaccttaaaatgtccagacttccagctctctccagcaacaaatcaaggtgtcagccagcagctcgggcctgccttgagagtcactgtggggattaagtgagatgaacaccgcagtatggaaccagaggactccccgtgacaactccgactcagggagccttggtgtggctcgcagaggagacaggcagtgccccaagtcatgtgtcgtcgagaagccttttccacttctggtccctcgtgtccacttaacatccccctacattaaaacactcggatgcataatcgcctgagtagcctacttaataataatttgttaatatccttcacagtgtcaggagaaggttgtctggagaagttttattgtattttaagttttatatcgttttagtttagttcacttcttttgtatcaaataccttaaacaagagtgcttatatctttttcccccagccttctgcagaattccacattaaacaggatgaagaataggttgttagcagactgaggtacttggggcaacatttcgtacacaacaggagggagaaacgactccaggtgaggagtctaaccaagttctctggctgggcgagtgcacgggggaacactgtgggctttgagggggtgtgtgccagtcacacaggagcggcattgctgccctcttcactgtatgcaggccactgtgctggcacagccatgcttccccctgttagacacaatggtgattcttagggttgacattgtggctgtatagttgctgagttcatctttgtgtctgatggaccgagtaatgctgccccatggaggagaaccatgggtttaatctctaaatcaccacctccacgttgtttttagaaaaacaatcagattttggtgaaactgatgtttgcaagtgtgagtgagccccatgtgctgaagcttcaggaacccctgagatggcacaagttctgccgtactgggcaacggatggtcttgaagcacacaagacactggaagacatgagggcaattgctacacgccaagcccggtgccaagcacgttgtgcaggttgtttcgttgattccgggcctggcctttgagatctgtggaggataccatgaactggctggctctgcatcctgcttgcaggcgctggcaagctggaacctgcttttctacgccacactgcagagggccctgaatgtgatctatgattgcaacaagcagccctgatgcggatccggagggcagggatgacgtgggggctgcctttctggttgacctgctggtaagcatggcctcatggatctatcaccaacagcacccagtcacttggggaggccgagtggcagggctggggcatccatcagggtttgattttgcttatgtggaccggcaggtgcagcacagctgcattttagtgcagggcttcctgatcctgctgcacagctaacaccgttcttcccgaaggcagcagctcccccacggggctgtttccccagttctgggcatcagtcccagaggcaaagacgggagccatccactctgactctgccaacaattctgtgagcacccagttctctgtatgaaattcctttctgctttagataattaaaataacttttcttcccctgcaactgaactgagtgataagcatgggaattattattttgattcataaatgaggcaactggggctcagtaaggttaagagcaaatgatgactaagagtcagaggatgggcggggtgtggtggctcacgcctgtaatcccagcgctttgggaggccaaggcgggcagatcacgaggtcaggagatagagacaatcctggctaacgcggtgaaaccctgtctctaccaaaaacacaaaaaaattaggaagcagaacaggagcaccatactggttgggagagaagttttgatatacatttaatatgagttccagaggtgaaagtaaaaagagaggatgataatgtttgaagaagtgagagttatccttcttccagaattcattaaagatattgttccttattcaggaagtactagtactgagaaggactcatttgtaaactaaaacgcaccaaggtatcgatcaccaaagacaaagaaccgaacctaaagcaggttactttaaaatagaagaaacaattagactcacagcaggcttctcaacttgaactgtagagctgggatcagcaaactacaacccatggtctggatggctgcctgtgcaaatacagttttattggcacagatacgcccacttatgcacatgtctttatggccacctccactcttcaatagcattgttgagtacctgtgatggaaaccacatggtctgcatgtggttgattcttaaacaagccctctgtttcagaaaatgtttgctgacccctggtatggagaacagaattcagtgaaataatatatttaaaacactgagagaaaattgctgacacctagaattctatacatacttgaacttttttttttttttcagaggaggaggtaaaataaaaatatttcaaaaaacaaaaaatttagaaagtttaccttcctttttttttttttttttgaaataagggttaaactatttacttcagtggaggaaataaaacccaaatcaaaggcaggtactacaacaagaagggagcaaaatttgctaaatttataggtaaatctgaaaaaaagacatttgtcttaaagaatattagtaatgataaaaatgaccaatattgaggtcataaataaagatgaaacaaaaatgctaagtgacaataacacgtaagcttgtgagggtaagtggcgatcagagcttggaattcaaaaccacttttttattttattgggaggagggtggagacaatggctaactttatactttgttgtatgaactgtgtgcatgtttccattttaagagtagcctctaacacaataaaaatagaattgtgtattggagaggtaaggctgagtgacagtcaaatccacaatctctagcctccatgtgcactttattcattattcacataaattccactgtagattgggcaattccccaaggcagctgccctgcctgctgtgccccagccaatcctgggggctttgatggattgcgcacacaggccatgttgacatggcttccccactctacaccaagagggagggccaggcatgggagctcacagccactcttctaccttagcctgagaaatgacatccaatggataacctccctgcagggactcacagtgcagtctaggggtacatggaaaacgtttggtgaaaattccatcactgttgcaacccatttttatggctgccaaatacccctttgttcccatatatatcccaaggaagatagctcacaagtcctctcgagttttcatgttcagttcagagttcaagatctcttgaccctataaattccactataggaggatcgttagtcctttaggtgctgaatcagctcagcttccttgactgtttggaaactgtggatcttccaactcaacacacattgtccaattcacacacaaagtggagaattcacactggccagaagtagtcacctggccttacccagcaacaaaagggctgagaagtgcagggaagcaccagaaaatgaataacttcaaatcaatgaagagaacaggaatgaaaaaataatctacttgatctctgggaaggtgtgtggttgattagaaatgatgacaattttttgaccattgggacatggcagtcaaattctgggatgaacttagaaacttgtttgacccataaattgccgtggaagtgaagctatgtgacttacgaggctaggtttctaacagcctgcaacttctgcctcagtctttggaaacactttctcctggagccctgagtcatcatctaagatatctaactaccctaagtccaagctggccgcatggagaagccacatggagagcaaacaccggatgtcccacccctccaagctctgacttcaggcatgtacccggagccatctcagactccccaaactagcccagccactagcaaacatcaccaggtgaacccagtctacctctcacgaaacagaagattcacccagctggtccttgacccatttcctgaaccacagagttattcactataatgaaatggttgatgtaaggcactaaatgttgcaatagttggttatgcagcagtagacagccatggtaactgtctacagacagccacagaaaagaataacacggacacaaaggcagaggctgggaaaccttgacccggtgcccgcacatctgcaaatgacaggaaattttcccaaatgaaagtttaagtccatttttagtctgtgctgatataaataagatgatcttaacatactttgaaaaaatatgtacaaacataaacatatgttttttaaaaaggagccctcaaacgaggaagatatgatccaaagagacagctattggctttaaaatattagttagtcagccttggctagacagctgctgctgctcctgagagctaagtcccactgtgtgaggttaccagttagaaatgggattttaaatcaaatattgggcagtttgtctgtgaacaccaaaatggcatgatattcctgaccaccatcatgatttagcaaatggcaagaccttcataagcacatgctaaaagccaccagagcttacgacggcaatgtcttatcttgccacaaaaggcactgcattttttctcaaggagtcaatcccacgctgagccctggcaatccctgatagactgttatgcaggtcctcactggggatcaataagccataaggcactcaacgtcatgagtgttcaataacaatgataattcagaaaactgaaataaggggccccaggagatccatctgaaactgattaaaaaatatatatatccctcatagccaggcacggtggctcaagcctgtaatcccagcactttgggagaccaaggtgaggggatcacttgaggccaggaattcaagaccagcctggccatcatggtgaaaacccgtctctattaaaaatataaaaattagccaggcatggtggtaggcacctgtagtctcagctacttgggaagctgtggcaggcagatcacttgagcacatgcgtttgagaccagcctgggcaacatggtaaaacccgtttctaccaaaacaaacaaacccaaaaaattagctaggtgtggtggcacgagcctatagtcccagcaactttagaggctgaggtgggaggatggcttgagccggggagggcaaggctgcagtgaatgagattgtgccactactacattccagcctgggtgacagagtcagcccctatcagaaaaaaaacaaacaaaaaaatcccctcttaacgacatcctgcaaaggactgagagagaaggacagtgtgagagagaagagatcattaaggcttgtcaccagatgccatttcaatgacaatgcacagccctcatgggcaaatacctgtattaaaaaaaaaaaaacaggttgatttatttctgtggaaaatagcaatcattgcttttagcaaacgttgtttaaaaccaagactgtcttctttgaaaatatggaaagaacatttttctttaacatgtacaatgtcgcaaacccctcctgagttcaccaatttatgtaaataatgttaatgtaactcactttgttcatttgttctagagaaggtatggcatttttttttttctttttttactttaaaattaacatccaaatacagcagcgggggatatataccaaatgcatcgttagagtttattttacacactacagcatggactgttgcctgagtttatcgtaaacaagaaaactgtgataggaatttagtgctaatcacatctttgagaagatttgagagacagaacaacctacaaagctctcaaataatttttgttataagttcaggatctgatttttcactttgattttgtttactgtgttttggagatccaaatatttcccctaagacaaacaaaagcacaatcaatatcatattagccctcaaatccaaaaatttaaatttcaagggtctttggtagagagtgggagaagcaggcatgcaaaagacacaaaaatcagaatgaatgttttcagatatccagatttcttttttttttttttttttttttgagatgaaacctcactctgttgcccaggctagagtgcagtggcgtgatcttggctcactgcaacctccacctcccgggttcaggtgattctcgtgtctcagcctcccgattagctgggattacaggtgcccgccaccacacctggctaatttttgtattttttagtagagatgggtttcaccacattggccagaatgtggcctgtggtgtgtagtgcttcctgaccacacggactccatatccatcagcacatcagaaagctgtgtgctatttctttgttgcaagtcactaaggcattctgaaactcagtctattgatcttcaaaataagattaatatgcttggcaaaagtgtgtgaatcatagtcagaccaaataattatttggttctacatgtattaaaatgaatttttgaagttactgaattaattgttttcattgaatagtcaattaagtgaaaagattttattaatccctctggaagatgattatagaaaacatctctaggatcaagctaatgttctttgtataattccagataggaacttctttacatggctctgaaattaggactagacctttttgcaaactgcaaaacccaaaaaaagtcgagtggactgtttacactggagtctttccaaggagagtgaactcagtgttattttcaattgctttgcacatcatttagctcaaactgtccaagtgaatctaattgcagggcttatagctttttagtcaaatccaaaatctctatatgaataaccccaaatcatcatttcaggttgtcttgtggtagaggagattttgccttgcaattttacatacttatgctacgtggaaggctgggtggcgtgacttcaggtaaggcgacgaaggatctctcttgcaatttattgtcatttacaaaattcaactctgaacttttccctccctccctccctccctccccttcctttcttccttccttccttccttccttccttccttccttccttccctgtatttcactcaaatgcataatgtggtttctgcttagatttctggaacattagggctgggagagactttgggaccatgtggtttaacccacttctcattttatagacaagacatttcaccaagattatgttgtgaaatcacagtcttgctcttttctcttttatacctcttcctaacctatatcctatcctgttaaaaatgagaccaagaatgtgatgtggtggtttgaaacaagactataatatttctgtttctctaagtctgaagttttagtagctttggccttcagtgattatgttattttcatatgtacactatatcctaggttcattatcaaatatctattgctctttcttcaagtaatatatatttgatatgttttccacttcaaattacattttagaaaaatgtttcctcaggaaagagacacacagagagagagagaaagagagaaagagagaacccacctacctgtaagtcttgaatagtcatggggttcatgtaacctatataaaaataaagacttctaaccccttatctcccacaaaaaaccctccacagtgtttaatgtcagtgagatacagtaaaaatgaaatcattgcatgtaatatgtttggtattcagcgtgtcaagatttatgtgagcttatttcgtgtctagcacggtatcagtatagggattactatcctaaaatctaagagtctagagggtgggagggtgatagacagaaacaccatgctgtcccgtggtgggtggtaggggattagaatgcattggaatccacaggggatcagaataaagttaataaagaaggacagagcaacttactctgaaggtgtagagctagttttgctgtgaaagagacatttaagttagttttgtaagaaaaaataggaaagggggaagaacatttcagagggtagggagattgtggtcctgaaagggcatggaatatcaagaaatctacattcctcacatatcccttttcttgcctaggttttgcaaaagtctcatgaatcatcccttcctgtggtcctgctccctgagatcctttcaccgctcacagtgggctacttctaagagcgtgcctggcacagggtcactgagagcatagtcttaataaaacaatgatggatgcttgtctctctcactgggtgccatgcactttgatcagaagctttaagaatgttttcctccactgtctagtcacagccgtattaaattacacaaggcatgggaagaggcataatctgttgatgataaatcagaattaatgagagtttaacaagcctgctaaatactaagtcaatgtaaaaaatcaattgtaagcccatctatcagaaaaacactattagcaagcaaaatttacatttttactgcttaacatagcatcccaaatatcaagtacctagcaacaaatctaacgaaagatatgcaagacttatagagaaaacagcaacagcaacaactttgtttagatacattagcgaagatctcattacatggagacatacactatgctcatggactggaagactccatatggaagatgccaattcacatctcagaatctcagcaggtgttgcaaagaacctgaaaatttgttttaaaaattcatgtcaaaatgcaaaggtcctacaattgccaaagaaaaatagggagggaggaccacctgatatcagcggtgattataaaacaataataaatgtgataccttgccttaagtctggggatagacaaatagacgaggggcgcaggttggagaatccagaaactgacccatgaatacattgacacttgatatatgacagaaatggcccccaaagccatgggtgtctgggcatatagtatccatacagaaaaaatatgaactatcttcaataagagacataacactataaaagaaaatcattttaagaaaaaattgtacaactgaatgtgaaaaactaagctataaatcttttagaagacaatacaggagaacctatttttccaccttcattatgtggagacccatcttaataaaacaccaaaggcattaaacaaaataaatttgactacattaaaattaagaatttttgttaattaaaaaaacacctttaagagagtgaaaaggcaaggcataaagagagagagagactgagactttgcaacaaaggactgacatttgaaacatctagagaacatctacacatcaataagaaaaagactccttggaaacaaatgggccaaagacttcggagatatactccacaaatgaagaaactcaaagggccaataaacagaagaaagggggctctgatatttgcagcaagaaaagaaatgcaaattaaaaccacagtagggcaccattacatatacaagctcattggcaaaaacttaagtctggaaataccaagcgtgggtgagaaagtggagcagttggaactctctacaaagcttctgagagtgcaaaccagcactgctgctctggaaggcagctcagcatcatctgccaaggttgagggtgtgtatcccctatggcacagcagttcctccgtgacgtgtgtactcacagacacttccatatatgtacaccagcataacgtgtgcaagaatcttcggtggcatgtttgacataaccccaatccagaacccaagtatttactgcaagtaaaaacacataaataaattgtggcatattcatgggatccaatattacacatcaatggacataaataaaattctttcattctaaacagaataacaaggttgaatttccatatttagggagggaaacaaggcaaaaaatagcaagcaattccatccctgcagatcatatgtagttcccaaacaggcagaatgatgggatgatgtgtgtgaggatatatatgtgaaccccgaaaacctgagacaggtctcagttaattcagaaagtttattttgccaaggtaggggacacaccggtgacataacctcatgaggtcctgacgacatgtgcccgaggtggtcagagcacagtttgattttatacagtttagggaaacatgagacatcaatcaacatatgtaagatgagcattggttcagtcggaaaagccgggacaatgtgaagcaaaggcgggaaggcttgtggcggggcggggcttccaggtcataggtaaataagagaaaaaacggttgcattcttgtgagtttctggttagcctctccaaaggagccaatcagatattcatttatctcagtgaggaaagtaatgactgtgaatagtatgggaggcaggttggccctaagcagttcccgggttaatttttctctttagcctagtgatttgggagccccgagatttattttcctttcacacatacatagctggttaaattataaataaaagcatgctttgggaggccaaggtggggggatcacctgaggtcgggagtttgagaccagtctgaccaacatggagaaaccctgtctctactaaaaatacaaataaaattaactgggcatggtggcacatgcctgtaataccagttactcaggaggctgaggcaagagaagcgcttgaacccaggaggcggaggttgcagtgagccgagatcgtgccaccgcactccagcctgggagacagagcaagactccgtctcaaaataaataaataaataaaaataaaaataataaaaaataaaaataaataaaagcatggagaagtatttatcacaaaatcagtaatagtgacttgtagagggagggagaggatcataattatggagaggccaacaaaagacccctgaggctctggcaatgagctatctgtgtatgccataggggtgtgcgtgcatttctcgtatatatacacatccaggaaaggagtgggctggatgggctgtgagagctgaaaggcgggagctgtgatctagggaagagcatcagcacacacccagcccacagcaacctcccaaaggctatcagccctactacacaggcttgacttagggtctagtatctgccttttagaatagtgagtaaaatactcattctagagtccttaattctctttagaaataaactgacacatcaaatgacataaaataaatatgtcactgccttacatctgcagatcaaaatacacttactgataaccacatagaattagtcaatagcacatacattcttagcaaataataatttttttgttgttgttgagatggagtctcactctgttgcccaggctggagtgcagtggcgtgacctaagcccactgcaacctccgcctcctgggttcaagctattctcctcctgcttcagcctcccgagtagctgggattacaggcacatgccaccacgcccagctaatttttttgtatttttagtagagactgggtttctccatgttggccaggctgctctcaaactcctgacctcgggtgatctgcccgcctcggcctcccaaaagtggtgggattacaggcataagccaccattcctggccacaaataataat

SEQ ID NO: 404 - DNA, 35915 bp, Homo sapiens
aaataaaaaatttccagttttgtgtaaggttcagataaaacagccctttgtggttgttgctattggcctggatagttctctgatggatagagactttactgtgatcccaatatcccaacattaggaaggtaattttctaaaagaggtaaaaaagaatatcgagcaaaatgcacaaaagcagacttttaaaaataagatttgtcaagcttaagaacacttaactgtactccagccaaaatcagaaaatgctttgcttttttttcccaagtatccacagaatattcatcaaggtagaccacatcttgctccatgaaaatagtctaaacaaatttttaaaagctggaatgagagaggagagaaatcaataacagaatgacagcagggaaattttcaaatatttgggaatttaataacacacataataatccatgggtcaaaaacggagtcaatggaaatttaaaaatgcatatatctaaatgaaaatgaaaacccacgtatcacaatataggagattcaggtaatgcagttccgagaggaaaatgtatagcacaaaatattcacattaaaaatgaagaaaggtctcaaatcagtaacttaagttcctacctcaagaacctagaaagagatcaaaatgcactcaaagcaagaaggaaggaaataatgaagtgcagaaatcaattaaattgaaaatagaaaaacaacagggaagtccattgagacaaagagctggttcttttaaaaaaccaaaagttagtaaacttctaacacgactgacaaaaaaagagacaaatgcaaatcaccaataatagaaataaaatagggaatatcactacaaagtctgcagccactaagaagatattaaaggaatgtcataaagaggtttaaattcataaacttaacaacttacaagaaattaatcaccttctgataaaactaccaaacctcactcaatctgaatagctctgtatccattaaagtaattggatttataattataagccttctgacaaagacagtttcaggctctgatagtttcattaaataattctatcaacatttagaggtaagttgatatgaattatatacaatctttaccagaaattagaagaaggaacacttcccaactaatttctgagattggtgttaccctgatatcaaaaccacacaatggtaccagaaaagaacttaaatgcaaaaatcctccaaaaaatattagcatactgaatccagctgcataggaatacaattatattttatgaccaaaaaggaatttactccagatctgcaagatagttcaacattcaaattcaattaatgtaatccaccatagcaacatgctagtagtatagtaagaaatcatacaaccctactgatggactcagaaaaagcgtctgacaaaatccaacatccatccatttaaaaatacatacatatatacattggcaagttagtaatagtgggaaattacttccagttttatataaaaccatctacaaaaaatcctacagctagcatcgtacttaatgatgaaacacttaatgctttcctccttcaatcataaatacagcaaggatttatacctttatcagtcttattcaacataatgctggaggctctagacactgaaacaaggcaagaaacaataaaattcatacatattgcaaaggaggaagtactctatttgtagataacatgatttctatgtatttaaaaaaagaaatcattttttaaaaagtgcctatcaccaataagtgagtgagttactgtggctgcaggatacaagattaacacacagaaatcacttttatttctatgtactaacaagaagcatgaagaaatctaacttaaaaatacaatatcttttaaaatcactccaaagaaagaaaagtacttaggcaaaaaattaacaaaataggtacaggatctgtatgttgaaaaataccaaatattcgttaaagaaataaaatacataaataagtagagaaacttttctgttcatggattggaagactcaacatagtaaagattgcattccagagaattatgttgagtgaaaaaacccagtgccaaaaggttacatactgtatgattttacttatgtaatgctattgtttattgcttatataatgtatttacttatatatcatatataagtaaattacttacatagcatattttacttatataacattattgaaatggcaaaattttagatatgtagattagtggttcccatgggccatgaacaggggaaatgggaatgtttgtgtggttataagatggagtatgaaggatgcctgtaatgctgggactgtttcttatctccactgtgctgttggatacctaaacctacaaaggcaataacactgtatagaacttaaatgagttcaagaaaaattggggaaacctgaataagatttgcaagttgcatcagtatcattatcttggatgagatatttactaaaagttttatatgatgttaccattgggaaaacatatgggagggatgtctcagaattatttcttaaaattgcatgtagagctataattatcttaagaaaatttcaattaaaaatgcttactgtctaagtgtaaaaataagacaaaaaaatcaatttttctccttgcattgatgctttctatttttcacactttccggttagattttaaggatacttatattctgggaatttaacttcgccagtgtgcaatacaaaagagctaccaaatcgatttttccttttcttggtatgcatagtgttttctagggtttgctaggtatcgtcttctggaagtttcttccagtttccttcttgctttctctcaaaggcaacccacctgtgtgcttaagcgccagttctttgttgtgccagctgcttcttaattcctgttctctggcctctaatacagcaactcttgaccctggagatggtggttggccattttcattttttccaggtcatgtggttttcatttagcctctgagcttccctctgagtggccatggaattcaagccaggtgccctctcaagaggcttgctggtgcttctctcagggggagtttaaactttccattcctgtgggaagggaagggcttttatacacatttttttggctcaggttatttatcaagattgataatttggatatctcagtcataaaatggcagaaaatccaggcagatgcatgacacccagaaaactggacttcaagacttattaatttatattttcccaccattttggtttagatattatggacatagtacctaatggttttacattgactagccaaaaggaggtgatataatccatgatatataataggcagaaaatatttagaactgaaaaatattcggtataatcctattatgctcaagaacatccataccaaccaaatctgagaacatttgacagtcactgttgatctcactaactagtttattatccagctcttcagtattcacacacagctacacatgcacacacaaacacacacatatatatatatgtttatgtgtatgtgttgtatggtaaaagcatctctgcacccccacacagaacagggcacacatgccaatctccaagaccgttagcccccttgaggtcactttatggtcaccaggactactgggatctggtgacatcccttgagtggagaaacttgtgaaggtatctggaccaccacttttgagtagcttattatttccatccatgggaggttgtgggggtccaacccgcagaccttgacccagcaacagatgagagacatacactgacacaggtattttgcctgtcagtcctgataaggggctctgctctgagtttgcagcatcaccttgataagccagcaaagtttgcatttatttagtacagatttaatgacaaagactttgagtcaacacgcctgtgggtaattaatcttgttaccctcccctggagagagcagtcctatagatgatcaaaggtttgtcttaggaccacatgaataaacaagctatttagataaaccccctttacattcctttgttatttacccttgctattagctcaaagacgattaagctgctttcagccgtaatctttccccgaggcttttgcaaaaccttctggtcttctgagaaggtttgtgtctattttacaatttctcccaccatcctcactgcatccccacaggagactggggggttgtgcttttgttggtactttcctcttggccaacaggtgtgccttggtggaaccattcctggactggtctctcctggcttccttcgtgctttacggaaccagtgagttggtctttatattcccgatttatgctctctatatcattcccgcctctttaagaaaatttcaattaaaaaatgcttactgtctacgtgtaaaaataagacaaaacaaaaatatttggtgcttatcactacttggttcaaatttgaccttgaagttttctttactcagggtaagaacactcctcctcttggtcttctgacaggttcactaatcatcatgtctaactcaagggtcctctgcaataagaaccatttgagcttaaggtttgaacctggatagacaccaccatgtctttcaatgatgagacaataaatggaaaatccttggaatcataaatgtctaaaggtgtcaccaaaccatcactgaacaaagttcaagaacttactattgcttcctaaggaaaatgaaaccaaagtattatgttataatcaggttcctacaaatcaaaaatataaaatgatttataatgaaatgttctctgattatacagtctgagaaaaatagacatttatattttataatcttgaacagttcttgttattccttgaactggcatcaataatgtgctgtagcctctctggtatgaggaacaaataatagactttaataaatgcatgaaagtgtaaattaatttattgcatgcgtacaacagaatttgactttgacctttttaaaaacatttataaagatcaggcaatttatctgaatcaatttcaggtgcaactaatcaggtgttcaagataatattactttgaatgctcttcattaggaagctggtgctgatgaagcaaaacaggcactggcaggaaggacacaggaagatgtattatgaggctggctggtctgaatggcacagtggccctggtatcttcaaaaatgatttgtgcaagtttaaagacgagagagagtttcagagttgacaataattgctgtaaacagtagcaatttagtatctattagccatgcttgttcaagtagctgaaatggaatttctaagcattgcaaaccaactgctttggcaaaagcaaaaacatgtgatcctttggtcatgatctagcagcaggctgtgcctagcacagataagcccagggcaaagcaaatggtgtatggggatacggtcggcgtggaaaagcacataagaggaaatgtgtctaagccactgaatacttttctcagagacagagcagcctggataagaagcaagaagcttcaagaatccccagtcctaggcatgagggctgtcctgctctccttcgcaggatgtgctaactgagagagaagtcatctccactgaccagggatgcagggcccctggaacgctcacctgctgtggggaatgaagaacatccagggcagtggctgtggagactatggcccttttgtctgctggttgaggctgcagggagagagacatgccagccatgagctgcactcccagctctgcgatggtgactcagtcatccaggacaatcaccgtcttctcagccaggatggagtccaagagtggcaagaagacctgaaatgtaggcgaggaggctcatgcatctctgttcctcataagcaccatgaatcccttaacttagggctcccaacaaagtgctctcccagccctcagctcaatgcatatgcttgtgggaattccttaggaaagtgttatgctacgattccattacacttgccaatttaaaagggagttcagaaagtatcatcttggtccattttctttccttattggtaaaaatatatgataacaataacagtacattttctgagaacttcatttaattaagggacaataactcaaaacagcccatttagaaatactgaatgctcaaagaataacattttcccatcaactgggattaatgtttcaaaaattgcagaattgcaataaactgtttaaaggaatggtgttcatatctcttctgctcatagtccatccagcaggcaggtagatgtttactatgggacagtaatgatcattgtgtgggctgctgcaccatcacctttgttggcagaggccttctagtctgtacagaagcagcttcctgagcttatggtcctaaggttgccagaggaccccctccatccaccatcctgccctaatcaaaaatcactgctctctgagctaagctacttgtattactgctaagacatctgaaatgtgtctctcgtgttgcctatcttggtttctctcttccttcctcggggttccagcccttcctctcactctggcacatgctctactctgaccttcacctgtccagaacccaccctgaaacagcctctctggctctgcaactccagaaacttcccctcaagaagtagctgtcctgtgtccctttatgagaacactttgtttggttgccactgcctagtctgtgtgtttagtagctggggattgtggcaggggagaaagaggagtgactcatgggtcctgagtgagacctgttgggtgccctgctgcatgtgctcatgggagaaagagagctgacatcaacttccccagcagcacaggacagccatgcatgttcaacccacgtaagcttcacagaacttcaaagagtgtggttgaattatttctctgatattaccgataaggaaaccaaggcatggcagagagaggccacccatccagggccacacagctggtcatctgcagaagcagggtctgtgcccacgtagaccacctgttgtgacctcttcctttctatagctaaatccattcgtcttctcaacaggtatgaaatacatccttatttttgcatgaagaaaccaaggctcagagaggcttatgggtggcccagataattgtgaattagcacattgggatccagctccatttcacttttgaaacccaacttctttacaatatgctgttctgcctccctgtaaggtctgagaattacacttacctggaagggaagataccatgatcatgaaggtggttttcccagggcgaggcttgtctattgcacacttcgagaaccatttacttgtattactgctaaaacatctgaaatgtgtctttcctgttgccaatcatggcttctttcttccttccttagagctgcagctctaagtgataggaaaattttcgccagcatagtaagagcaatttgggtttcccaaagtgcaaggtgaatatttcaatgggtaaaacaaataattttcaatgaaaaaattataggtagcaggaacatagcatttaaaaacagaaggaaaagttatgagctcaatcctttccatgatattaggagaaattctctgttcagtgctggaatgtcttcaacagttctctgacccttgctgttcttcattagttaataaagacaaactcatagacataggcagaccatagtatctactcagatttttaatagtatcagtttattttttccaaattcatttttatttgactttttactacatggtggattgtactattttttgtgtgtcagtaagatgaagcaccctaatttaagtaaggattaaagagcttaacaggaacaataataaaggtggcatttgaaaaaggaagtatcttgaaagtggtacgtggataaatgaagttttagagctgccatataaatggaagtaaaacaggttggattagtctgttctgattctgctaataaagatatagccaagactgggtaatttataaagaaaagaggtttaatcgacacacagttccatggctgtgtggccagagagtcctcacaatcatggcagaaggtgaaggaagagcaaagtcacatctcacatggcagcaggcaagagatcttatgtaggggaactcccctttataaaaccagatctcatgagaccagatctcccctttataaaactaccagatctcatgagacttctccactatcatgagaacagcacaggaaagacccacccctatgattcaattacctcccactggatccctcccacaacacgtgggaattatgagagctacaattcaagatgagatttgggtagggacacagccaaatcatatcagaggtctattttaagacatattataccatattcaatatcatatctttgttttgtaccctaactctgtagacacctgtgaactctatgtcacttttattcacctttgcatctccaaggcctatagcactaggcggaaatacacttaaaaatatgtttaactattttaactatcttgcattgttgtgatatttttgcagtgtgacatccatcttaaaaagcaaaatgtgcacaatcttcctccaaatgtgccattctcagtggttcctttgcctttagaggcgaaagcttcattcgtacaaaccagacttccctctctgtttcattaatggacttagaggcttcctgttcagtaaccagcaatgaaaaattacttttaattacttcttctaacccaggaaaggcatgccatttttcagttaccaggtatagatggcaatagagagagatgagagatgtggagcaaaaactctcatacaacccattccccacctaccacggcccagcccagggaggaagcacagcttcagggctctggctgcaatgtacaggcaacaggaatatgaaaagaggtgcacggacacaggtggtcccaagagagggtgatggagacccgtgctgtcctcccagccccatatatgtgcagggcactcctggcgtctgtgggctgccacccggatccagcaaacattcttcttgaaggcccaaagaactttgcttcctcctctttatcatgaactgatcaatagatattttccatgagccctactgagtgccaggccaggttctatgctctggggaagcagtagtgagtgaaacagatttgtcctctgtgcctgggaagcttatattttagaaaacgggagggagatattacaaaaatattaaaacataataatagttataatttcatgtgtgtttaatgggttcctcacttctattctccccttttcttggaaggctgaatattggcaaactcactatttttaacctgaagagctgaccttgcaatgtggtttcctgcccattctattattaatagaatcttgaaccaaagcaagtagaatcacgtgtgtgaaaggcctgatctcctactcaaaaccatccaggaattaaacagcatggatgatatctcagttcaagttccttgcgtgtgaggggggattgaagaagctgccaacagagggaccatcagctacttgggtccttcctgtgatgtccctgagagcagaggcatggtggtggtgtggggaggttaggggagctttgtagttgcctctgccactggatgcagacacctcaggcatggtaggattcctctgagcctcaggctctgcatctggaatagagggtattcattctcagcttcacaaagctactatctaagcatcaaatcagagcaatttggaaacggtgaagggcggaccacatctcagtgacatgactgtgttttgctttgagtggggtaaagggaaagcaagcttttaacaggaaaagtggaataaaatgctcaggaacacctaaggaacaaacccaccctggaacacacagtggctgtgaaataatgaggttgctttctaggccgtggcatggaaagcctccgggatttactgtggaatgagaaaaccgaacaagagcagcatggtgtatacagcgtactccattcagtgcaagaatgaaaaaggaaaaggtataatagtgtgcattattattttattttattttatttaaaaaaaacaagaagaaaaatgaaaaaatactacagatagaattggaaggaaattgctggaagtagatagggtgaggataaacttttcaatgtatactttttatgttgtttgattttggactaagttattatgtttcttttttcaaaaaataaaataagttttaaacattgagcaatgtttttcttctctggtatccttccatcttgagcagtttctgcagtacttcagaaacagaacatagagagaatttaatttcctggactctttagatcaggaaacttaacttgactttcttcctattgaggatatcaagatatttgggtatgttaatctactgccatcttcagaagctttcccttcaaggagaaaatgcctttcagcttaagcaacaaaatatttgcttaggtgtattattaatataccactctggaagcaaagttttctgaataattcaaagattgttgagcagagaaaacctgtcatcctgtaatcagtgttttatcttatattttcaccagcccttgaaattactcttcagtgacgcttactggcacaatctgctacaagaaacagctagacgtttttgactgtacagcttagttttgggcttctgtcctctgcaagaaaaagaaaacatcactgaaacaaacactggtgatctggaaagaagccaaagcatgatataaataacctgcttgaggctgatcaggccccataaccctcaaatgccaccttcttctcagtggccgatgaagtctcaaaaggtctttaacgacaccatcagttagttcctcttctgtctcctcctctttctcctttcttctcattcccccttcttactctttcccttcctcctcctccatcttcatcatcttctttttcttctccttgttcttacccaagacaaggaagaggaagaatgattttggtggagaggtagctgttctgtcataggtatgatcatctatctataatttgagtgcttttttgtttattgtttgtttttaaatgggcctcctttgccaaatgtgctgccttgctttggcttacattccctagcaccccgtgcatgtagacatagtcacatgagacatgttaaccgatagaattggagaaatataaaaataattcatgtaattcctgctgcctctggaccaaaagattttaagaagtagttttgcctcctccatgctctctttaccagacccagacaacgataaagcccaagatgatggcagagcctgaggatggaaggctcttggggcctctggggctctgcagccattgaggagagttacctcatactcaggaatgcccactgtggactaccaagtaagctggaaaaaacctgtgctatgtttgatctataatacatcaggaatatatttgattcagtattttagcatacttgcaataatacaatagtaatttctagaaattttcaataattttttagtgcttactttttgccaggtatgattttaagtgcttcgcagatatatttcattgaattctctggacaactaggaagtataattctcatcctcaatttgtaggtgaggaaactgagaaacagaagttaaataacaagtctggagtcatgcaggtataagggtcagagccaggagtaacaccaggcagtctgactccagactccacaccctcacccaatgtactgaagtctatggactttggttggcatccacaaatagctgaaaatgaataacacaggaaagaacaatagggaaattagaataaaagtaactacagctgtcgtctaaaggcccggttttgtgctcagtgcttctaagtattgcattattttacttaaacttaataaccatcctatgagatagacacgattattcttcccattttaattttttcacatcaaagtgctagtaaatatgcaagtcagatccatctgaccaagcccagaccattgttaactattgtggattattctttcctagggtctgagccccggagagccagttttatcccatttataaagagttctaaaggttctgagtcccaggagcatcagatccacagtctcctctctggtttctcagcttctgttggaggccactaaaattctccagcccttgttgtagctcactccatgttccagatctcaatctgccaaaggagtctcggcgtccagatggtggcctcatactgagagggaaggtgctgcaggtgaaggtcaccatgtgcctcatttccttcccattcataaaatggattcacagttgctagaaacctttggggaggaggtagaaccttgagatacatcaacaggaaaagcaccagcaaaaattgaaaatagtgaaagttcatgagacacaatagttctgatttataagacaccaagacaaccagaagaacaggacttgtacaaaaggtaatttgtaggcactgattagtgacaaatactaaaaagtatttgtcttaccaagaaaactatttggtattacaaaatactgacaagtaaaaccatacatataatttcataaagtaacataagctttgttgccacatatgtgtttgcgtgtgtgtgtgtgtgtgtgtgtgtgttctttaacaggtctgctcaacctactgttaatcaaacaaaaattcttgtaccatattggaaaatatataaaaggtggccatgtgttaccaaaaaatcactttattcaacccataaaggggatcacttttttgttaatcatgagagctttgcactagattaaaatcttgataagaaaatattcacaaaatgcactggaaatatcaatgttttgcccccattaaactgtaatcttgtggaaaagaagtgagactgtggtatttcattacattctctttattcgggacttaggattagcctctttaacgtgcgtaagtaggcaggttaagtattagacaatttaagcctccatttcacttcacatcttccagataagctattaaaatattgctgaatttctctcctggaccatcaggaaaatgcatttatgtgtgtagaaggaaagaggaaggaggatgcaaaataagccatcaattcaccacagattcataaaactgtaaggggcccgcaatgtcattttacagatgaagaaactgaagccagcgaggtggcatagctggctcaagatcacacacatcgttgacgggtgcaacgtcagactggttgctggctgagttctccatctcagcaagtggtgccgccatgcagcctctttagcaagctgcaaactgggactgttcttgatgtttctcttcctcacccaagtgtctatttacagctcagacctcccttctgagctccagatgcatgtgcctcttgacatcatcagatgaaaggctcaatagtttcttagcggccaaacatacaaaatcaaactcacgatctcctatttcccccacagcacagtcttccatctcaataactaacattgccttttatccagcagaacaaattgaacatcacgatgtcttctttaattccacccatgttcttcaccaccgacatgcaacacttcaagttctcttggttttactcctaggtgtcttttgtgcctacgaatttctcttcgctgctattatactagcccagacctccatcacttcccacctggacatttgccacaacttcaaaactgctctcttcacatcccctcttcccacactgccctactcttccttgagagattgtgtatgcaaatatgatctaatcgtctcctgcttacagccctttgatggtttcccttggctttcaggatctctgactcagtctccgttattagccctatctatttccaaatctcctctcccaccttcttttggtcactcaatgatccagccccacggaggtacttttagtatctccaggggctgtgccataactattaacctcagggcctctggccatgtgattccctcttcctggaacagacacttccatgactgccttggttgttttattcgctcagcatttattctttctgcctatctaagcgcgagtcacttcctcggagaagcttcccaaatctgcctggacttgatgtgctctttgcatgtggtatgcagacctccatgaaaatagccgggcttgctacaaacaagaaggctgcaatggatgcattaggaagttcttcaccttctccattgttctggtggttgtcccctactacaaggacttcctgatcctatctcctgtagagaagacctctacattcctgcatttgtggaaaattttgatttgaccatatatactccctctcgctccccgccctcaccaccaattttacttcaaatcattttgaatcacatccgattgtcaggaacatatcgactttagaaatcttgaggccctttctgtacataagaaatgaaatcacattgcagtgaccctcggcattctttcagagcacatgcagacttaaatttgcctcagctttcaggaattgagagatagcccacatggaaaaataagtgaaaaatgaaactaagtgagaggctttggcaattctgcgtgactattatttgagttatttcttatgggatatgcattatcttaaaaaaaaaaaaagtgtttcttagtagccatgtgaccacacaccagccccctgcccaactcacacacacacacacacacacacactctcacactctcttttaatagtaataaggttttcttcagataaccctccattcaccatgtgcccctctaactcagtaattaaacccccatcctccttgccagtgattgatttatggggaaagcatgtgctattactctggccaatgagctgtgagaagtccacggcagggcttctgggaaaggcctacttggtcaaagagactcatgggaagtggtgcctcctcctcctacaggatgttgtcgcataggaaatgacgacaggaactgccccagagatcccagagccctgagggagcccaaaatgggccaggctgaccctgcgagttcagatggacagaaagacagaggaactcgggacttgatgacctagaggggctgctggaccagctgcctggaacctccccactatgagatgcccttcttgttggtaaagccatctggatctatgtggttttgttacttgccaccaaaaggattataaatgatacaggacctcatctcaaatgccactcctcagtatacattccttgagccatttctaatttaaacttggcaccctcctctggttactctttgtctccattacactattttcctgtatctaatttgctgtgtgtgctactgtgcacacttatatttacaacattgatgcattacttagactcttcgtattgcttatatcatgtcacttacactgtattaatcacaccagattgctctgttatatgatgaactccttcacagtaattaccactctcggaaccctcctggttgtttcttatctctcttccccacctgaaggtaatctgcttgagaccatgacctgtctcctcttccctactatctctgctaataggacagtgctgggcacacagaaggtgttcaataagtagatgctgagtgtgtgaatgaatatgtcacagctgtttcctctgggacccaatcatttctgtacaccaccaccagtagtgtgtgtatacgtaagaaggcaaagaaggtgactcacacaaggctatcatggtaatggcattaagaaaaatgaaagtgattttatatattatgagagaagacacagaccaggagaagaaacttaagaaccaaaggcaaaagaagtctggggtctaaaatctggtaaatatgagatcttggattcccagtggtgatttgacctctgtacacgatgtcacagagtgagggtgtgtgtgtgtgttggatgggggtgaggtatgggaggggatagaaagacacaccagggtaaagattacaatcaaacagccattctgataccttctatgctctcttgagctgtaagagaaaataggagaatcaactgctgcaaattctgttatgagaagagttaaggaaaacatgaacttggaaatggaaaacagacattttatgccattttaatttttaacgtttgcaagatggcctataaatatcatttatgaaaagttgtctttagagcataatattttcactaccaaactaacacttttgccaaacattactcttgggtaattgagtggggagaaaaagattcttagaatgaaaatgggtttcctctgaggatcccataagaaacttcccttgctttgttttctgtttaggagagaagaaaaaattgaatctgtctgtatagcacccactgagtttctcactgtattgatcaatctgtctgcatggatggaaacctaaccatgcattaaatttcaatcccatcaccctgcctttgacctaagaaatgtgctactaaggtagaagagagaaaagctacagaatcagatggtgtgtctcttacaaatatactaaaaaagcagactttctaatttaggaaaagggaaaaaagtatctatgtggcctaaaaagttgataattagttggtcatcaggatcaaatatttatcactaattacagagtttagcaaagtcctagtggtagtgaagcaggagcctaggagagccacagtgacaccattttaaaatcacctccaccttgagtccaacaggacgcactccttgccagtcaagacccatggtcataagatatttatagttgaggaaacagcctgaagatacctatgaggacacactcctacaacaatggagaatccagatgtcccaatacccataagaatgtatactttcaagataattatagttatgctttgatgtactcacacactaaaatgtcaaggatagttttctttaaatcaataagataataatttttgtcagtctatctgatcaccctcacataatcagaacttagcttagtctttacatagagaagatccctacataagaaaaacttaaagacaggccatccctctgcttgctttcaggggatgccttactctgtaattaagtagctttcaatactgcactctgtgactcaccttgaattcttttctgcacaagatcccagaaccctttctttgggtctggatcaagacctcttttttcagtaactctagcattgtgtcatgtgcagaggtactcaaaattattcttttttttttcctgagtttttacactttctagaaatatgataacaatcattattacaataatagctatcatgtattatatacttactatgtaccatgtattgtttattaaactttgcatagagttatacccattaaatcctgcaaacactgtgaatgttaattgctctgtctctgtattacggatggggagaccaaggccttggggaagacacttgtccagagatcagagctgctcaagggcagagcagtgatttgtacacaggtcttctgtgccagagggtttctcagcaccctgtgttataaccttagagcagcccactcaaggaaaagacatgaccatgcctgtagaggatgagaggctgaccatgaaagggcatgacttaaatgcacacatcgaggcttttgatcaacctcatttacgtataattgatgttccataaactgcatccagctaaatcgtacaatttcatgattttgacaatgtccaccgcagaaaccaccacacccttagacagaacattcctgtcacccccaaaagatgccatgcctgttttcagtacatagctctctctaactctggtcccaggtaaccttgatgtgctttctgccattaaacactaggcatggattagttagggatgagtttgacaatcagtcctcaagtctagggagatggaactggaagtggcagaaacctgagtccttatctcaacccatcccctccgcaggtgtgaataagtcagtctccaatgtctgggactcatattccacatctgtgaacctgagggtacccatattttccagctctcacattgttcttcctttcatttagaggatttagagaccaagcccagagtccaatacattttgagataatttaagctttctctgcctcagagaccttttctataaactaagaataaatcattcattcattaaataagtatttacttaatgtcagctcagacccaagaagtgttctaggccctggaaatagggcaatgaacaacataatccctgtccttatgaagctgatgatctaaaggtggagacagacaaactaaacacacatatagatatgaaatataatgtcaggcagtgagatgggtcagaaagaaaaaaatagaggaaggaaagggaatatacaatgacagaggttgctgttgtattagcatccatggctcagctaacacttcccaagtgtagggcttttctcgggttctcaatggattccttactttcttcttgaaaagatgaggtaattaaacccatcattaccaccattcacttgtctgcccactataatagtcatagtttctaatatatgtatctgtgaattatgtatatgtgaattaatattttatttagttatatatactatatattacatatatttaccatacatgatatatatcatatatgaattaatatatttaattatatatgaatttatatacatatatccatatattcatctcacatatgtgcatgaatttgggctcaaagcatacagttgaattttcaggagttaaattctgggtgcacagccccagtccatgtgcaccccaggatgacagtgaacacgactgcacatgtgactgttcgaatacagcagcacagtctggggtagtgtccatggtaaaagttgtttacatatcctttagagtactataaataatacatgtgcaaagtcaaataattatcacagagagtaaaaggtgaataagtccatggaccctggggcttgaggaaccttgagccgtttttgtatcttcatacgctaagactgattcattaacacttctctgccctttctggactgtaatgcatgtccttggaagacaagattgttgccttatctgactttctgaagtccagggtcatggatggggcctggaacattgtagacatgcaagaatggttcagagtaaatgagatgaagtaggttgtccaggatcatacagctggcaactggcaggccccgtgagcccctcccttccctcaccagcactggaagtcactctcagcccctacttccaaaagacctccctagcccagccttttgaggtgtgattgtgatgctttgcacttggctgtatttctttttatcaattcttattcacatatgttgatctggcctctgtggttggaccatggcttggatgtgccatttcttcatctctccatggtggtttggccagcactcatcctataactgacgaaacgtccaggcctcccagcaagtgtggacctcaggggcagggtgggcagaacggggaccactgcacagcttcccttcccatctcattcaacacacacctccatcatagaatcttaacgtcctggtgctgaatgagacctcagagatctgatctgtgcccactttgaagagacgtagccccgaaaggacaagtcaccattttaaagggcacagagtttacagagcctgaggctaaatctccaggcccggctcagggccagtgatgttctgtggtgggatctgggcaggactctggggacacagagggaatcagagagcttatgccctggaggaggcccaactgagtgaaggacacagaattgtgcaaaatgctgtaaaatacagtgattggtaggagagtacagttttcacagtgcttacaagatatcaggcctcagtggctgtgttctgtccacctgaactacaagaagagtctgctgctcaccttaatctgagtttcccaggacatctcctttctaacaggacacaattagattgcacaagtacagagcacaatctctcaaatctgcttgctgggcctcctatatgaagaaaacaaaaattctgattatttttccctttgagaagaagccttgtccaaatcacatgaaacaaggtttgattccacctttataaacaagtgctatgaaaatttttctccctatcaattgtacacctgcaacttaggcccaagattattacacagtacagcatctattagatgcttatttatgagctgttttcattttagcactttatctcatgacgttgggagatttaaaaagtgccaccaacacttgttagattaggaaaagatccaggcatttcatacgcatcaaaaggtgccgcagaagggattgggggttgtttatctggtaaaagcccagcatatggtgcagcccagctccctgctccagctctagctgcactctctgaacctgccgttaattaggtgccattggtacaggtgctggagtcacaagtttagctgctcaggatttgcacataaattagtcaaagaaaagataaacactttggcaggataagcatattctcagggtagaaagcagggtgtgtgttttccaaacttgttttaaaactacttatgaaaatttattttagaaaagaaacttttataaaaagaatgctgtgaattgtgaaatcaaagtgtaaaaatcagcagctgagtttttgtctttgagacgagaaaaggggaaaagcaaatacaaagacttccctatcacttgctccagaatcataacagaaaagagttctctttgttttcctccagtatatcagacttcctcatacatacctttgcctcattgacatcatgtttcaatccttattaaaaacttctgctggctgtgagaaggtctactagaaataggaaataagttcatctcactggccaaggcaagtcaatttatagttgtggctcaaaggagctctgcttgggagagaatctagggtttagcaggaaggagtgctggtattgattagtgatgtctgccatgggcacatgctaggattgagagccacgtatgtcttatctctgctgctctgactcattaacaagtcccaattccacaaagcagttcttctttatggtaaagagaattgatgttccctgcccaccatcaaagctgcatggcaggagtttaaagtgtgaaccaagccccaaaacatcaatgagagtcaccttctctcctaatatacacaaaacaaatatggctctgagaaacacaagactctagggccttgaggaaagagcagatgaaaggcttccaggggaggagggaaggaagcacatggccatgtttactgggcaggtggagctgggaggcatgcaggtttacactggctcattccaaggtttccctgaattatgcagaaacaattccagattgttagttcttaattagagatgccaaagacagaaattaacaaacaatctaattaatattggaatcatagtgaagctgacaggaacaaaaggttgagaatgcagcaatattttttcctggccaacaggaaaaacatggcacatatctaattagaatggaacaataaaattccaaattaccagcataaaggacaaaattaagcaataacatccaaactgcctgacaacttattcttagctgtctggctcctagtgatgagcaaaggaaagaaatctatgcacagaaatagaatgacagtgtttttttgtaggaatttttgccaatcattgctaaaggaaaaagaagaaatagcctgaaacttctttcgagtttttctatatgttcttccaaataaaattcaaatcagtcagagggtttctttggaagcccatagaagacaaggaccttttccagataagccagtgcaaagagtctgttctgaacccatttctttctcttcatcaatacctgtggattcctcagaaacactctcaattccacccttgcctgtggctgagcctctagcttctattttgtttacctgatcctacagtgcacaacttttggggtagatcagactgacagtccccaggcagaatgtattcataggccctttccaactaaaaaggtaaccagttctctatacattgccaaacacacaatgttattcaattgaatgagattttcaagtcaaaaatcttgcataaaatctacatttccagaaacatctgtttttaaatgagatagcagtaagaaggaactttttgtccatttttaggtactgtgaatttggacatgtaatagactaatgtttattattcaaaatatactgagtacacacacttaaaatcctttctgtgcttcagtttcctgagctgaaaaatgggataatacatctacttcatggaaggctgtacagattgaatgttgtaatgtatttttacaaagtagaacaagttctggcacagtaccactgggtgttgtaatgacggtgttgtccttgttgctattactgtatttgaatagaccatggggatagaaatatttacaaggcatggcacctacctccaaggggcacatgcatcaacatgcacaaagacatacaaagtgctgagtccctaatgtgtctgtacaggacaatggaaacacagaggtgagattccttggcagggagagcaacaggaaggtggctgcacagaacagggagcactttagccaagtctcagggtgactgggaggtatccaggtgaaggagtgggaacaggattcccagtgcagggaatagcatgagcatgggaaaaccatgaacaaaacctcatcttattttgagacctaagtaggtcctagtgttttgacagtacagggagcatctcatggaagatgaaaattttcctgtagaatcaatcctcactccttgaccatgtgcttcaagttaagccaatcccacctccagctgcagaggtgggtacatgacccaggcatggccaatccacctattttattatatggccacagttctaccagatcaaaaatggtcatgggcatgagacccagtgttctttaaacctggaaatattgttggaagcactagagaacagaatcttcctttttgtgaacctgaatgtgaaatgatgtaaacctcttagctgctgcgggtgactatatagaaataatccatctgagaataaagacaacatatggggatatcagaaataagagatggagagtaaccaaatcctaaggagcctttggatccaacttaaagtcattattacctcttctagttacttgcccactacactttccttcagtggctcaagcaagttatatttggatttctgttatttgcaaacaggcaaacagaatgcccacaaatagctagtgagggaattcaggttatccctgccagatctcactacctatcacacctgtcctactctgttccacctgaataatgattcctttagctcaatgaccgcagttcaaatgtgcctctctaaaggactaattcaaaaaaaatatatttccttccatattttaatctgaaaatttaaaaacttgaggaaacctcatcacagagcccttttgtagctgctgaaaattagctccggaaatgcagctgctctatcaaaactgctgatcttcaccagaggtgacattgggttctatttagtaaccagctttccacacactgccaaacaagcagcaggagaaccttagatttccttgagagctcatccatcagaagatattctgccttaaccactggaaggctaagtttgaaaacaagatgtctccctggggataggaaggcttttgcacactaatgtccttttactagccctctagaatctcctcattgctagtccagctgacgctggaagctgagaaactgaattactgcagggtaaaaaggagggcaccatctttgagaccagcatgattctatgtttttttttctttccaagaataaagatgctcatctcctgttgatgatgcatgatggacttctggggttctgggaaccatcattcattgacaaaaatacaattactaatccaataaaaacaggagcccacatattagaaagatagatccccaaagattacaagagaatcttactctaaaaaccacattttctgtccttcctgtgaagatgtacaaagaaacttgagaaagctaggaaaacatgtcttcctgctatttttttaacaaagtattttacaaatactttggaacaagtccactaccaactgattcctctgatggggaccatagggatggcattttgatactagctcataagaacctcccctaagtatgtcctgcacaactacaaggaataacagctcaataattctccatggttaagattacaggctctggagccagtcttttcagattgaatatatgattgctacactcactagctgagtggccttagatgactttaattaaaccatctacacctccatctacatctccttatctatggactgtgaaaggtggtattttctacctcaaaggactgttatgagaattaaatggatcaacacttgtagcagctggcacataataagtgttagctatcaatattcactgttcaatcagtgttagctatcaatattcattagagtgtaagctcccaacggcagaaaccatatccattccatctttgtgactcgcacaacattttatacactttcctatacattatatatgttcaatcagtatatctagattaaaatcactcagtaagatcaagggaagacttggttcacaggatcttagaactcaggtccaagtctccacccattgccaaatctgtttgacacataagcccttctgcctctttttgaagattttcagtgatgttaagtccgctcgggattgtccaacaaagattggacagccactcttagggtttatttcacctctggattcattcattcctatgttcaaagtactgattgagcaccatatatatatcaggcactgtgcaagcacagaggacacgtgattagtaaagggacatagcccagactccgtgggtcctacagtcaagtagaggttagaagatagaggtgaagatacgaatatggatgtaacatagatgtatatgtagtatttactgatgtagtggaggtcaagcactgtgtgacccttttacaaacatcatttcattctctcccaaatttcactggtattgcatcatacgacatttaaactagttaattataatttatttatcagtgctcagcctctctgtagatttccacctgacaacagtttattatcagaagacatgaaagagagaagaataaaatagagagggaaaaatttaacttaacttcattgtcttcctccaaatctttcttatctatgactccattcaatactgcctgtaaaaccagtgtatggtgaggaccatatactgccccataaaatttgcacatgggtcaaatacaagaagaaattaaagcaaagacaaaaaccaattggcctgggaacctctaaaagcctagatgttctccaaaacactttcaaagatttcttggatgagtgtcagttctgcttcatggactgtcattagaacagatctctagaaagggtagctccgcgcctcagcattgtcattcccattttacaaatgaggaaactgggcttggggaaatttaagtaatttttcccaagatcaaatacatagaagatagaaccaggattcggaccaacattatctgtctgaaagcttaaccaaagaattcagtggctctgcattctttttccttaaagtaagctaaaagtggttcctttttaacttcccctgttgaaatataaaaagcacaaacctactccatcttccacatgatggcccttgaaagacttaaaaagagctgtcagttctcactctgtatgttacccccaggctttttcttctcggcatcaggctatacactctcacttccttcaggcaattctactgtgatttgatttcaaaagccttcagcccatggacactcttcagcagaacacaatctgacttcccattgttctgtttatgacctagaaagaattctctgttggagtgacagagtgagggctatcatctgttgctcatttttgatggagaccagtgtaaaagaaatatctcacatcactctgaaatctactgtcagaaagccagtagcacaaatgtgacaagaaatgacaagagcccctcaccctcagtgtggaaggcgagagggagtggtggagattacagtgagttggagtggtggggagtggagagcctctgtagacaactggtccactccagatgatgatgaccggcaggagtatgggcgcaggacaacctgaccacatggtgtttcaagaggagctcggaatccagatgtgaaattaacaatgtttgcatgctggaaatggattcaaattttaaaaagtcaaacacacacacacaacccttctggaccagatttggcatgaagtacagcagcgttgcctgtgctgggaccatgctctgactaatgctgacgaagatcacatcagcctcatggcgacctcttcatttgattcattggctcttactatttataaagatgccaagattttttcacacagatgttgctgttatgctgcatattttgaaattaatgaaaactttcttaaactaagagtagaactttttatccttcttccacctgccagactaggttgaggttccagtctctgaaaattattttattctcccagattctggactctttaacaattgtgtcctctgtcttctccaaagtcataccaatcctgagatcaaaactgcaagccaaggcccagcgcggtggctcacacctataatcccagcactttgggagtccgaggtgggcagatcactagttcaagagatggagatgttaatgctgaagacctgaaatcaacagaaaggaatgtctgggttactatgataaggagtagagagtccaaagatttatcatacagatgaagcctgcaggtagcaagcttcagaaagaatatggccaacatggtgaaaccccgtctctattaaaaatacacgtggtggcatgtggccgtggtcccagctactcaggaggctgaggcaggagaaacacttgaacccaggaggcagaggttgcagtgagcccagatcgcaccactgcactccagcttggcaacagagcaagactctgtctcaaaaaaaaaaaaaaaaaaaaaagtgcaagccaaaaataaaatcctaaggccctgaaatcatctgaatggacccctctcctcagccaagggcatcccaaagttggttcaggccatagggaagcaggtcagacatgccttgtgataccctcctcccttttggaattcaggaaaagctgaccagcattaacatcaacacaaaccttaagtctgataagaaacatttataatctattattttcgaagcttgatacctgcaggcttcatcttcatgacaaatctttgactcctctattccttatcatagtaaccagacattcctttctgttgatttcaggttgccattgcttttggtgttttagatatgaagtctttgcccatgcctatgtcctgaatggtattgcctaggttttctttttttatggttttaggtctttaggatggccagggcaggcgagggagggcagggtgggaccagacggatgaacatggctgggcgcggtggttcacgcctgtaatcccagcactttgggaggccgaggcgggcagatcatgagatcaggagttcgagaccagcctggccaacagaccagcctgggcaatatggtgaaaccccgtctctactctttcaaacaattgccaattagaacattttaaatctacctataacttggcccccctcccttgacttcgagttgccattgccctgcctttccagatctaaccaatgtacatcttctaggtattgattgatgtattatgcctccctaaaaagcataaaagcaagccgtacctcgccaaccttaggcactgggagcatccctaactttggcaaaataaactttctaaattgattgagatctgtctcagatacttttgagttcacaaatgctgatattctcttcatatcaccacagttttcatttttccaaattcacactttctcccttccctatatcccaatccacagaatttcctcagtccacacttttcttgcagaagctccataagatccttgctatctgtggagtatcctccttggggattgctcggcatttcctgaactgacatgagtgaaaattccacagactggggagtgctccaaaaggtgctactgagggttcacactgtcctcaatgacctggcatatcacaaagtcaacgctaaggaaagcacatctttgaggatgagtccattcctcgaggagtcctggcaacatgcatcattaatatgggcagtacaccttggaaaactacaatacatctgatttattaagtcccctcaatttatacaggccaggagttgaacagaacctggacctagaatggtgatgaagcagcctccatgtttggtgatttgcaaactcagtatgttctcctggagatcaagcttcagttttctgtcaagaaattcccatattcaggtagctacaacagtgaccatgcagcacataactcctgttttccaaagtgacgtatctgtcaggttggggagagggtattcagtatgtttctgtagaatggagacaattaagtacagtgcataatggaatccaactctccaagagcttggatttgcctctcttagggtggaatctcgagggcaagagattgaggtctctaccttgtggggctccacaccaggctctctggagaggacctgcagaggcaagtcatttgtttggtccatagtagcatcagcctgcagatacagtctttctctaaacaccacaattcttggctcctttggtaataatgaatgctatggcaacgctaaataatgaatatcgtcagaggcaaccgaggaaaatgagtcatcaattttattttgttcctgagcagatgattgcctgtgacttggctcagaccgttttaaactccaaatatttaaggcccttgatttgtttaattaaacctgccaggagcctcagcacagggctgcataaagttgttaagctatttcgccttctatctcaggaaaaattaacttcccaagcccaggaaacagactgtataaaatttctgtttcctcaggattattatcattattattttaaaaattatacttcacagaaacagcattgtttctttatggaaaccatatctggcttaaggcacagcctccctggaagccttcaccaagctgtgatctaaaacatgaacaaatcaactgctctcagatctgctctaccatgggagaataccctaaaggcttttctgcctaccatgaagttcttaagactgaaaccaagtttcactgaacctctaaacaggagccagtggaatggcatgaaggacttagcttagcattattgtatttatctaaaatgaatgaatagattgaacctggaggttctcttagcaacttaaaggagaaaagatgattctaaaattttaaatcctttctccatgaggtctttgttagaaaaaaaagaaaataggtgggaacactaaattgggttgttcagacacctgcaaagaacaagaaaacaaaaatgggatgatttctggctgaatttaggaccataaatccagctaattggaataataataaaaaaaagcagcagaaatgtaccatggctcaatttcctcaattttgattaacctaatataaggattaaccagtggataatattatattaggttagttgtcacatggatgaatgttttttaatagtcattgagtttcatgcatatagggagtgagggaaggaaggaacatagaagggagggagggaattctttttgctggagattaaaggtcagggattcccctttcaagggagagggaagcagcatcgcctgctgcagccgcctgctgattccagggagtctctgcggtcagctgtttcctccttcatgaggtcattctggtttccagccctttagagcatgggatgctcagtcagaaccacaccttggagacaaaagaaggaacgacaaaaagctctgaacacttaggacttctgtagataaatctccccttaccttaatgacatcttcattggcagacttgcattccacagactcagacacatagaccacagaaccatcctcctggaccctcacgactttgacaggaactgaaacaggctttccagtgagaatggcagtgttcaaaacctcagtgtcctaaacaggagaggagagggctcagatcagcaaatgcgcacaccaccggggcaagagggagaggggtgtccaccaagctccctactgccttcattctcattctgtaatttagacagttgtccagagggatgaagccacgaagcacacacaaaatggaagtttccaaacaattggatggcattccatcccagactgagatatcaaacctgatggttggttggaatgtcttctcagtacccaggtgcagggtcattctccctctccctgacctcctctcccttactccaccccccgccgccctctgtctcacagactcacacatagcacacgagttcctttcagtattttcaaatcttggctcaaggatcatttgggaagtgactacctattttctggacttattaacatagtgaacatagacttcattgtgtttttaaattaggaaagacaacagcagaaacaacaaaagagcactagtcgaacattacaaatctctgcacacccaagctgactgccacaccccatctccttgacacctccagaacccccagagatctccctccaaacccaggtacttctacatacaaagtggttagtttatttcttcctctgatgatctcttcggggttctgtagtttttatcatgataatttatctcaaatctgtctacatccttcatccactctaccaactcccacattaagccataatctctcacgtggacaactgatttctctgtgtctccttacaaccaagatgttcttttaaatatttacatatatacatacatacatacatatatatacacacacatatatatacatatatatatataattcagattatttattttagctgaaaacaagttaaaagcattcagcttctcataaggtaaaatccaaacctgctgacatggagtgatgcatcctcagcccccctctctagctctgtcttgctcccttctctctgtccatcactgcagtcttcttagttcttccaacagcacaatctaaattctgtcttctgagccttcaaatgcagagccctccacctaaacacacctggctgtgctttcatccttcagatctctgcatgtatgtccactgctcaggaaaaggacgtgtctgtctgctcttggtgtgagttaagacactcttattactaggtttcaaggtatttccctgcatggttgttaccaaaattataattatataataacttttatgtttatgatatttaccatttagacacaatagactctacactccacaagggcatgagacatctctgtgctgaaaacccaggatgatatctggtgtgtgaaaagcagagcagtagacagggcacatgtatgggctctgggaatgagaacgcctggttttgaaatcagcctgccctctgtttcagtgaagattgtgtgtatgtgtgttgggggttgggggatgaacataagagattacattttggcctgtgttctctgcattcttgtgccctttgcttctcctgattctggtgaccctgttgatttacatgtccaagccctgacagtaaatcacaattataaaagcgttttctctaactccttctttgtgctttacaatgaccacttcagcaaagctctgcttaactacaactgttattttgttaccttaaataagtttacttatatggctaaattaaaatttaataaagcttcaagttgccacagaaccagcaagcaaatgacagctgttcaataaatttaaaacctaaacctgattagatggccacattgagagaaatactccagaggaaaagcatagaactattgaaactcaagtccacgttaatgccttatttaaacatgaataaactcttttgtggggttttgctgtgaattggctggtgccttggtgactgcagtgagcagtgagagtcttagctgtaggctccggctgcctcccagtcctttggtcaggccccatggatggacagatgaatggatggatggatagatggagacggagagaggcagagcagagcaagatggaaggaaaaccaaagcagaaaaacagatgaagaaggaggaaggtatcggggaacccacccccaatatttcaacgtaggttctttctattttccataagtgtcagccagctgagaaataaagagaaagagtacaaagagaggaattttgcagctgggccaccgggggtgacattgcatatcggtaggaccatgatgcccatccgagcctcaaaaccagcaggtttttattaaggatttcaaaaggggagagggtgtacaaacagagagtatgtcacaaagatcacatgcgtcaaagggcaaaaagcagaacaaagatcaagatcacatgcttctgaggaaataggacaaagggcaaaggcagactcctgataagggtctatgttcagtggtgcacatattgtcttgataaacatcttaacaaaaaacagggttcgagagcagagaaccggtctgaccaaaaatttaccaggatggagtttcccaatcctaataaggctgagggtactacaggagaccagggcgtatctcagtccttatctcaaccgcataagacagacacacccagagcggccgtttatagacctccctccaggagtgcattcctttcccagagtattaatattaattttccttgctaggaaaagaatttagcaatatcttccctacttgcacgtccatttataggctctctgcaagaagaaaaatatggctctttttgcctgaccccacaggcagtcagaccttatggttgccttcccttgttctctaaaaatcgctgttattctgttctttttcaaggtgcactgatttcatattgttcaaacacacatgttttacaatcaatttgtacagttaacacaattatagtggtcctgaggtgacatacatcttcagcttatgcagataacaggattaagaaattaaagtaggacaggcgtaagaaattataagagtattatttgggaagtggtaaatgtccatggaatcttcacaatttatgttcctctgctgcggctccagccagtccctccattcggggtccctgacttcccacaatagggaaggagaaggggtgagagagagaaagcagatatccgtataaagagaccatataagcttaaatgattcagaaatggacaatcagagagagagagagagagaaagagagagagagaacagctgggaaataaactgaggaaaagcataaggatagagacacttagtgagaaggaaatggagaaagtcagagagctacgcaggcagcgacagggaggcagccaggctgaaaatggcaggtggaaaatcagaggtagcaagcaaacaagaacaaagaaatggagagaaaggtcttgacatctcacaagtcagagacctcggtgctctgaaaaaattgaatagcctttggcttcatgaaaggaatgcaggtgcagtcaaagcctattgatgggtgtgttctgtgattgttcagctgaagctgaggtagctccggcccattactgaggctcctcttcataatgacaggacactgggaagagcaaccccccaaacgaggagcacctcagggatttgctacaatgtcatatccaccgagattttctgttggccacagactcagggggctaatctgtctcataaacatagatgcaaaagtcctcaacaaaatgttaaccaaatccacaaagtataaaaagaattatacatcacagccaaggggaattaatcctaggtatgcttgtctggttcaacattaaaaaatcaattaatgtaatacattacaataggttaaaaaagaaaaaatatcacatgcttatagcaacagatgcagaaaaggcatatgaaaaaattcaacactcgttcataatttgcatacaaacacaaaaatactgttggtatactaggaatagagggggatttcctcaactcaataaagaatatatacataaaacctatagctaacattatacttaatagtgagaaaccagaagctttccccctaagatcaggaacaaggcaaggatgcacaccctcaccactgcttttcagtttcatactggaatttctagctagcacagtacgaaaagaaaatgaaataaaggaaatcagattgggaaggaagaagttaaactttgtttacagatgacacaattatctatgtagaaaatctgaaagaatcaaccaaaagtgaacaaaaaagaatactggaactaataggcaattataataacgttgcaggatataaggttaatatacaagtttcagtaagtttcctacaaaccagcagtgaacaggtggaatgtgaaattaaaaacataatactatttgcattagcaccccaaaaaatgtaatacttgggtacaaatctaacaagatatgtatgagatctttatgaggaaaactgcaaaattttgatgaaaaaaagaactacatcaatggagagatatttcatgttcatgtacagaaagattcagtattgtcaggatgtcagttcttctcaacttgatttgtagatttaatgtaatcccaatcaaaatgccagcaagttattttgaggatatccacaaattgatgctaaagtttacatggagaggcaaaagacccaaaatagttaacacaatattgaaggaaaagaataaagttggagaactgacaatacttgacctcaagggttaatataaagctacagtaatcaagatagtgtggtattggcaaaataatagacaaatagatcaatagaacagatcagatacccaataaatggatacacatcaatatagtcaactgatctatgacaaacaagcaaaggaaataccattaaaaatgatagtcttttcaataaaagttgctcgaacaactgagcatccacatgcaaaaaatgaatccagacacagactttacaccctttttaaaattaactcaagatgaatcacagacctaaatataaaatccaaacgtataaagttcctagaaggtaacacagaagaaaatcaacataatgttgggtttgcctatgactttttatatataacaccaaaggaatgatccaagaaagaaaaagttaataaaatagactttattaaattttttttaaaaatctgttctgtgaaagacactgttacgggaataaaataataagccacagactgggagagaatatttgcaaaatgcctgtatgaaaaaatattattgcacaaattatacaaagaactattaaaactcaaggataagaaaacaacccaattagaaaatgggcccaatatcttaaaagacacctcaccagagaggatatacttatgtcaaataagcacatgaaaagattttccacatcacatgtcatcagggaaatgaaagcaaaagcaacaattagataccacttcacacctattagaatagcaaaaatccaaaacactggcaacaccaaatactggtgaggatgtggggcaataggaactctcatttattgctagtgggaatgaaaatggtacagccactttggaagagagttttgtggtttcttacaaagctaaacattttcttatcatataacccagcagttgtgcctcttggcatttacccaaaggagttgaaaatgtacgtcacagaaaaacctacagggatgtttatggcagcttaattcataattgc

SEQ ID NO: 405 - DNA, 60568 bp, Homo sapiens
atcttgagagaaaaaccacgtaggtaacatcaaacactagttggaatctttccaagaagtaattatctgtgtgctgtttgtggtggttgattatgggaacaaaccaaggtttagccaattcagcaaacatttatggagtgcctgcaatgtgcatgtcactgttttaaggcctgtgcctactgtaaaggtgacccacacatgatgcctgccttgcaggacttggagttcagcgataataagagatgcatacctgaaaagcctatttaagactcttccggttctacaaagaaggcttcttgaaagtggtagctttgattactctttggatttatttacatttatcctataatcagaaggtatacaaaacagactcacacatatataaaattaatagattagatagcatttaaacaaatatttcaggtaggtacttcaaatgcatttgacatttatcaaagaaatggtaagtgctgtcatccgtgggtggctggattaacatgtgggactacttatcaccaattttgttagggatcttagggaaattcctggatcttatattcacaagcaattgtataaatacttcccacagctcagagacctaataggatggggtcttagagaaacatcttttgagccacagacttctttgttaccagaaggaaaatgaaagaagaaatttaaataccacttgaagagaggtaaataaatgagaaatggggctgagagggcgggtatttttttaaaaattcattaaatggaaaaatccacaaatgttaattctggtagatttcttagaaattacatcagaggagcatgcttggtcttcccaccctcattaggcctcagtgacaggtacttgaacaactgagcccctaatgtgcatgctcccccacccctgaagccagtctctgccctcctcttccctcctcttgcccctggaagctgatcgccaccaactggcctctgggtggatttggccaatggaagcacctgtagagggaagagagtgaggttaggatatttcttcctgctgtctccgtgcttccctgcagagagtgtgaagaaatgaccctgaaaagcctctggcagaggattcttctttcaggatggtgtcgcctcctcagcagcccatcctcctcccctggactcaagctctcattccagtaacactccttcctccttctccatcttcagggggaggtttgccagtcggtgggttctaagcatatctcgctgattccccccaaccctgccgacacctctgtaggtcgtcccttcattaaaatctctccatttgaactatctgagtttaattccatttcctcctggtatctcagtgatacacggtatcagtacaaaaatctcgcttcaccttcagaaccaacagatttgagacattttatcctctgtggaaccattagttattttgtcattggttgtatcagaaaaaaaaatcaggaatgcaaatccttctttattacagattcagatttgcatattaccaatgttatatattttaaacaaaactattcatcataagttttaaaaattaactactggagtagttaatgaatctgaatgtaattatgtagctttcataatattaaagtaaaaatactaaaagaagtatttcttaaagaagcaaatgctcaatctccaagtaaattttattctatgctcttccggtataagaatatgttaatatcttgaaaaatatcatattattttgtgaactcataaagctattttgagtttttgtaaaatgaaaaccttaccaaaatgtattttattgttggaaagcttgaccgttactgctgtttaattttttgagcttgtaaactttatttgtgcatgttttcaacaaagaaggattttattgttattacataaaacaggtgatttctagattttaaaatcacaaattgaaagcaaggcacaataatatatatttcaagatataggtacttaggaggcatccttttagtcatctgttcaatgtagccatctattttacacctactgtctactattgtttgaggtccttgccaaagtattgcaggctagttaggaaacataaaacaattagaaagtaatctatgacaagtaagctatctataaatggcaatgaagggtagaacaaattcaatgaaaatatctatttaatcctagtgtttactggtctagaagaataggctgagtaaattagtatttctctggctgttgtggtaacacattgcatgctataacagttttaagtaattacaggtgcattgaaatttatctatggctttgtcatcatattctaaaatgtcatgagtacttttttctgacctcaattactatgaaattggtttccaatatttaattaaccaagaatatcaagtctatagggtattattaaggtgagacttctgtagccttttcaataaagaccagaattttggagtgccttgaaccttaatcattgatctttaattcttattaagtcaactgcccaccttttaaagactgaggcccaggaagagtaagtttctctgagacaatgcatacagtacagtgcttcttgggtattggctctaagaccagatgcaaagaaaggctaaaatcccatttcattgttcattaggtgagaaccctttgttaagctgtgtaacctctgtgcatagtttcctcatcagcaaagtcagaaaaagtatgtacctgaaggactgattgtaaggctgggatgagagaatccatgtgatcagccctcaccaacaggtgctgcccagttcatgagtgctgctgctgtcctgcccaagtacccagcttgcagagtgccagagttagagtcccaggggtgttctccacagctgcatgcttgatccaggcctatcaggtgagttggctcttggctagtggtttttcttctcttgctgtacaaaagtccagacagtaatgtctttttttcatttttatagatatattccattgaaagtcctcattctcaaatttaaaacaaagactttttgtgtacctcaatagcaatgcacacacagttggcttcacaaacatattgtacatttctttttttcatatttattcaacaaatgtatattgactacccaccgtgtgacaggtgttatttgttgacggaaccaggcatcatcagcaaacaaaactgacaaagcttcctgccctctgtggaaggcatctgaggaagagactggattttgtagcaacatgttattctcattataaactttatcattggaatactaaagccaaatcatcccccatctccttgatcaggatacccacttaatctaggcagctacacaattgtgagagcctttgtttttttctgctgaaacatccttaaaaagatacctcacaacccaagatttggcttttcttaaatacgatttttaatttttttcatttctatctagagatttaattggaaatggaaaatcatcaattttccaattaaatgtctgttccaatcaacattataccttttaggttgtcattgtcatttttaagtttaagcaactttaaggattttgaatctggctgcctgtaaattaaaggtgaaagtaatcattgtgttggattggaacattttgtcaattgagagtggtttccttgttcttagtgtatgaaaagtttatttttctaatgtagattaataaaggagataaagaaaaacaaaatgagtgatttatgtgtgtgagaaaagaaccatttcctcaaggattaaataaaattcataccttttgtttcttttgaaaagtttttaaaataaattttaatgaatgtgtcctttaaatattcctttaaaaatgtatcctattttaaaatggactctctgagagaaggaattgatacctgtgtttaaaatcaaaaatagcatgcatagagactgtttttctagttggttgaagcttttttccctctcctttacatcagtgaaccagcatcttgcccttcagaccctacagcacactcttgggctcatgaagtgtatgacacatcctccttgggggatcggccatgtcctcgctctcatgaccacatgaattcttctgtatgtcttttctcacagctgagtactctcttcctgacccccttgtggaatggggaaaggaggctgtgacattgtgcttgtgcaaacaataattgagagctttccgagtctcctgcatcttcataaatgattttttgttttatgctgggacagtagttctttaaatagaatattctcccatggaaatcgcccacaatgctgagagtacaccttgcaaaaggtaagtctagaatatagggtgcctcctcagcattgcccagaagctgaagttaggactctctagaataccaaaaacaaatttatagcagttcattaatgtaaggaattatgaaaactgtgtgccaccattatccatagatgaaacaagagccaccacgcaagcacagacacaaagccctgaagatgaagccattgacagggctctcatttattctgtagaaacccacttgcctgtttttgaaccagttttctttggagcatatgtctcactgtgcaaccaaagtggtgtttatatcctagtcacttggcaaaaattctgtcattgcttcagggagatccattttaggcctgaagcatggagctggtaatagatgggatttggtacttctgaagaaaagaccctactgcaaatttagagagttaattttttcttttgttccccataatattgttgctagatagaactaccttttttgactagaagttaaatatagaggcctaaatcaattaggtaactcccactcattctaaatgagaacatgtttgtttttctccaacgagatgagaaatatttgaggcgcttcctgatatctctatcacccactgcattttttcacttgatgtatatttccccatgtatttgggataattttcaaataattgccctttagaaatctacttgatattaaatgtaaaaaaaaagcaagatgcaaaattattataggatgcatttacagaaattacaaaatttctataaactatttatggaggaagacttatagagtatatgtcaacacattgctttattattgtccttggttatgagtatggtttttttgaaacctgctttgtactttgggtgttttctcaccattggtacaattgaggcatttttccctcttcttcaaccttgcaaatcacacgtgaggatgctcatagaagtgcctctcagacaggctgttgttttgctttcaccaataaatcatttataattagaagtagaaaactattctttccagtgcaaatacatccctttcaaaagcagttctctttttgtgaatgatgtctagtgtctaagaaacgagggtaacctttattatatgcattgctctaatcgaagcattgttttttgcggtgaactcaaggttacatgtttaagaaaagcatcgggttaattccattaggaaaagtgtcttattcataaacctttagccactggaaaaacaccattaggaggccacacaagtgtgtatagctggatagaatttgacaactggcaaaacaaaacaatagcctacaattgcagagtgctgtctgtttaaaaaccaacatatctttcaccaacaaatacatattcacctcaacacgagactttcatgtggttattaatatcaaatttttgaatgtccaaattttggagtgtagtctagcagaggtaaactgatttgcctaaggtccttcaactgtcagaggtagaattattttctctctcctggctctaaaacctgtccagattctcctgcaacactgtccttcaaaaacacacttccgctgactccagtgctggtgatgtcatgctttagctagtagttagaggtgacttaactttaaatatggaatctttttttcctattaagcaatgaggtttagtttgaaaattcttagagatgataaacccctctcctttttttcttccttctcctcttttgtcctgaacaatgttccatatatattactgccagaaacagattcttgacattcctgttatgcttttccacatcttgtaatcatttctacagctgttagcattgccaacaattatatttccacttttaaaaaattgttacaaagatgcagagagaaaagaggaaagccaaggaataaactacaggcaattatgggatatttttgtgatgtgacattttgggaactgaggcagcatcactgatactgcactactttttaatatctagattttaatcttttgtatgaagataaaattcacatgccttaaacctgaccacaacataatagggcatttatttttctaattttgataccatccacatttcttaactataagaagaatgcttatgttgtaccaggttatatgatgttgccaagaagtagatgtgtaccatttactaatacatccttttggaaaatgcgtattaataacatattaaggagtaaattgacgttgtgcaaagtgagcctgtgagtttaaatgtatggattgtacaccttgctcttcctaattgcagatttaacaggatttgatgacctaatgagtttatttctgaatgatttatatttctttgtcagttcaatgatttagtattttaaatttttttaaatcacattttattgagataatgctattagtgtttctttcccatcacttaacaaagttaagtcactcctctcccaccccacttttgtacctaccaatgtttttttcacagttacaggctgattggcttgacgtgtcttaggataccacccaaagagagcttcattttataaataccaagctcattttcctaaatattttcaaaaagatagatttatcctcatatagtaaattcagattaataattttggaaagggtcatgtgaccatggtattacatggctgtggaagaccctccaagatcttgttttgggatagaaggactcagacatccaaacttttaaattaatgaacttattaaattctaaaactttgtaacagtgttaatttgagaagtataatattttgcttaaggtctgttttgctttgcaaaatgcatctccttcattttcatattatgttggaagcttagcatgaaagaacgtgcctcagaggaaaccataggtaagcatactttaacaaaagttagtgtcatcatgtttgtgtctttgcctgtggttttttaaatgtataatgtttaacgttgatttggctatcaaattacattttcttttgttaaaaaattctgtaaattagaaatgtactgaatcatttatttagcagactgaaggtgggtaatgttggctgaacaggtttaagccacagtaatttgaaaatgtaaatacataaaataatgtcatttctcttccactcaatgtttcttcaccaaataaagtccagcctgctctgaatttgttgccagtaggaacaatgttacagtgaatcatggtttaatataccttgaaaatggcacatctgttctgtgatagcttaccaattttagcctctttataaaatacgaagagtttgtcaaccagaataatctagaacctggcaattcaaataccattcaaagcaaatgttttatctaataactggaactaaatgttaggcctcatgacagttcaatatttactaaataagtttaataacagggtaagccctcagtatccagagcagagacaagcacaccatatttacacatacaaattctgcctttagccatctgaaagggccccgaactattgcagcaagcaaagagtctttgcattgtcctaaaatccatacaatactttatattttacacattttaatagctagtttaacaaataacaagtaccatgcttaattctctgcatgcattatttcaactaattattggaataatcttataaagtgggtactttcgtctcagcttacaggtgagaaaacaaaagttaaatagatcgcccagggctctgctggaacgtgttaagcagggatttcagcctgtccagtcagaccccagaagttgtgttcttaaccattagcaacacatcatcccaggcaggccctacatgagcctcataaccaattttatgctggatagtattatccctatttcacagatggcaaaactgaggtccagagactttaagtgacctacccaaaattacagtcatgagcagaggcactggaatgtagggccttgacactctacctcacgtggtcctctttcctgttttgggtagttctccactaccactactcatttctgatgctggaaaggctgtgttttatacatttctgtttctggcttggaacgaaacactctgggtctctgcttgatcagtgtcccctctaaactgcacctcactacagtagggatggcataagatacttctttacacagcatctttttgttcccacctcacccccagagctgtaataggtagagccagccaaatgtcaaagggatgatttgtcttgtcaccactagtttcccttttctctgccttgtatgtaacaggaatattctttagttcctccttatgttctaaagcacctccccaacctaaaaatagaagaggagttgtgggtcatttacactttagtgtgaatttgcccttgtgactttgccaaggctgttgtgcctaaccctttcaatctaacagcagaatgagagtctctggactatcctggctccttccctgagaagaatgaactgggaattgttggtctagacatcaagactaccagagacctattgctcagagatgtttgggctgtacaatttctgtagatatggcatctggagcagccttttctaagcaatggcattatcattccaggctctctcgctctttccatctctccaccaggtggactcttgccctccaccccttccaatttgtcagtgattcagagaacattctccatccttccaatgattacattccttcatcttgctggggcgccaattcagtgatggagcggctcttgggagcagccttggcttatagtgcagctctctgctaccttcaacaggctggtattcggggtgcttagatgtgactggttgtacgcacgtgtgtgtatgtgcatgtgtgtacagcagtaagagctttcgaggtagatacttgaggaagcctcagacatctagccccattactggggcaatgtcttacttgggtttttccagaaacagacctggagaccaggattcaagtgccagtggtatatttgggatgtgaaccctgcaatgctggtaggagagtggagaagtgaggcaaggaaaggaaggccgtcaaggggcgtgttaggaggtcattcaccaccgcaggtagcccgctggggacctctgggagcaagtgtggcgcacaagcctcagcattactgccctgtgccttgaggagtaagggataaggattttccccaccagttccctgtagtccttggtgagagcttctggggtggaggttaaggtctttaggtcagagaaattttctttagtttcggaaaaatctttcaggccgaggtccagacactcactggaacacactgaagtggttaggtccaagggctgtaggcagagctcccatatccatctgcagaggtgtttcaggtggaaggagtggagacagccttctctgctccacactgtcttcagcaagggtttctgtatctgtgcattgaggattaaattattcacatggtcagagaagcccatcaccactgatagttattgtaggtatggaaaactaacgactaagaagggagaaaaatataccaagcagttggcttggctgaacacaagtaaagactcttacagtcactggtgtgaactgcttattatcaatgtctgattacagtgctgcatactaatgattatgcatgtcattaaatgtgtcagattaactttgttataaaatttatgacaacattaaattttattcacatgctcagccttcataatttattgcttatgtagcatggttttaacttcagaaaaacctccaagacagtgttgtcttgatgactacactgcttatccgtgagtctagttttcctgttcatttgaaatgttcacattacattcagctctgtctcaagcactgagacagagctggaatcagtgcccagcgattccacttgccgagtgattgaggctgggggattactcccctctctttgtgaattctcttgctgtgtgttattgattaattcaaccaactcttagttgaccctaaccatgcaacatgtattgtgccaggtggtgtggatttagaatatggattagaccctcattctgtcctcaaggagttcctggtctagtagagaatcacatcactttatagttgattgttcaagaaggaagcttgttcaaacatgaataaaagactgtgcatcttctgactttgtaggtgtggaataacaaagatctgttcctttattgggtttccagaaaacatctccaaagctataccagtcatcattttgtgctttcagaaatgagtaacattgtaggatagtacttattgcttgtacttagctttgtgtgctagctgagcatttgtaaatagaaggcattcacgggtaaaatgtgtttcctttagccaaatgcacaatggtagtgcctttctagaatccaagctaaagatgtcgtcacatgccacatccacacacttcttagcaaaaatccaactagaagaactttgctatttacaacaaaggcaaatgctgtcaagaagtaggcttagtaccacaggaagcggagccaaatgtgttcttgaaatttataagttgacctgaaaataatgttttgggaagccatggcttgccgttgtcagctgtcaaaattgagcttggcaggagaaatcagggtcaggaacagaatagagatagtcaaaaagagacagaacagagagagggctactgttgtttctggagtccagtgaccacccgggttctagtgtggtactggcagtggactaaataagtggatccaccctaaggtggagagaaggttcatatggagataatttaaagagctgacttttagcccttccaaagaattacatgttcctaactgccaacctaggaacatcctggattaacttgcaatttaaggctgtggtatacctgtttcaaataaaatagccctgtgaatagcatggaagtcaaatgatatcaactaggtttgaaacaacctccttctctcttttgaatggagcagtgattaaacgcaagacatcagcttagaaaatgcatgtattagcaaacgcctaagatgaggaaagatctgggcatgccctgaagccaatgcaatttttctttctccaccccaaacctgtgctacgtgatgaatttacagtattaaaaacattgctgccgcctacttcttccagctgggacttcaggaccatctttgaatcctcctcggctctccacacccagcagtgcagcaactcctcatctctctctctctttctctcttttttttttttttattttttttgagacagagtcttgctctgttgcctaggctagggtgcagtggcacaatctcggctcactgcaacctccgcctcccaggttcaagcgattctcctgcctcagcctcctgagtagctgggactacaggcacgtgccaccacacctgactaattttttgtattgttagtagagatggggttttaccatgttaggatggtcttgatctcctgacctcgtggatctgcccacctcggcctcccaaagtgctgggactacaggcatgagccactgtgcctgtcctacccctcacatctctttaaatatttttcaaatatctgccttccttttcaatctcatggacttggttgtggttatggcctcttgtgagagggtttcttgcttccatttttctccggcttcagtccatcttccaaacccatgtcagcggcttctcctgcttgcacagaaaatgaagttcagacagtttgcatttgagccttggctcactttcccagcctcacctccagtgacccccttctctgccctaccccagtccttcttagcccatctttcttctcaggacacaccaggcaacttcatgccaccattccttgcgtatgctcttctcttggcccagctcactacctctctgaaatgttccaaaacgcttccaggcagaattaatcattttgtgtctgtattccaaaaaccagggttccattctctgtttatcatggtgatgatagttatttacttgtcactcttagttagctttgtaacacctagcacagtaactgaaacagtagatgctcaaacatggatttatttttaacttaaaatgagatgggtattttaggatgccagaatctttgggtcaaaaagatgtggcttagttttcatgtcaggaacggctcttagttcaagcagtgaaacaaccctggctcattcaaacaggaagggaaaaaattcaaggctgttgagttgctcacaggctctgaggggttcatggaggcagatgctggtggcctcagcggaaggagcaatacacagactctccacagagaacccattctgccactgctgctgggtgcagagtctggttgcacctaccacgccccaagcctgatgccagattctgctgctccctctggaaactgatgtcgctcccagtgcagctgccaccccagcccaaatggattccctgcagcccctccttagcccatgtcatgccaagagtcagtgccatctgattggctgagcctggatcacatgcccaagccctagctgcaagagaggctgggaaagcaagcatctggcttctgtggagttgttggtctctgccccccatcaagactcatgaggtggctgggcacgggcatggtggctcacacctgtaatcccagcactttgcggggctgaaacaaggggatcacttgaggccaggagtttaagaccagcctgggcaacaaagtgagacccccatctctatagaaagaataaaaagaaaaaaaacttaggcatggtggtgtgcacctgtggtcccagctactggggaggctgaagcaggaggatcacttgagcccaggatgttgaggctgcagtgagctgtgatggtgccactgcactccagcctgggcaacagagtgagatcctgttcccaccccaccaataaattcatgcatacatacatatactcttgaggcgggaaatccccagattcagctcagatgctggggtgacagaaggtgcaaaaagagtgacagatgtccactagaactttctttcagaacaccagaaccctggttaagagcttcctttgatggtatgtccgagacttagcaggaaaagcatggcatgctcaaattgagtaacttgagaattgaataaagggaacatttacaaaggatgggcaggatgcagggaagccaccaggaacagctgcactccaaggccagtaacactggggagcttttaccaccccaggcctgaaggggcaaggagtggggcagttaccagacctggagacagacacagggttgtgtgtgtggagaggtccctggcaggagccaagactgcattagaaagacacagccagccctgggcaattcctcggtagggagtaagtgctccaattcccccttccttccctatggtcccctgctgaggcttcccacaagccccatgcggaagccagagggccagggagccccacttctcaaaatgagcagagtatgttgaagaagggcagagagtggatccggaggaacaagtagaagacaggctgcccatgaggcttcatcatatgtcaccaacatttttctattcattttattcaatatctactttggggatgtcacttcacattttaagtacctgagcccacaagatcgatgtgatcttaaagtgtccttctcctattgaatttaacaagctgctattttcccctcgtttgctattcagaatgctctatcatatggttcaacaatttgtactattaaaggttagcaaatgccagccaaaaattcatttttttccttcctgggcttgggaaaagaggatgtgacatgtgacctgcacaaacacaatgtcaagaatctccctttacaagtctccatgtagaaatcctctctaggatttgtgtcagcacacgagatctcctgctgctcatctctgcctcctcttcattaatatctagcctcctaaataacgcagatagaagaatggtcataaaattgagccctacacaattaccagtagctataggcctccccaaggattcaggcactgtaaccctgattctttcaaagcatctggtaacttgtgctagaataaccatttactttggaaaagcataccaaggagaaagcttcatcctttgtctttgcatagatggtgggttcctttacagaatatggaaactgattgttttcccataaacctcaactaggagaatgaggtaatcatgtgttatttagataaaagaatgttcacctttcttttttacaaaaattatggtaatagaattattttttaaatgcaaatgatggagaagtacacagcaaagggcaaaagtcaccctttctgtgtgcccacttcccttggtcccccctcaatattaacaatatgccagaaaaagcaagattgttctaaccacatgattacaagctgtgtcctcagggactgctgaggatgtggtcttggaacagtatgtactctacttctccttcaaggtccaggcagcccttgggtcttcaagcccaagacagaaagttcactttgtatctcactctgggagaacaacacccatttgcaaagctgtaaacttgggtggtgtatcatgacagccactcgcaggggactctagaggcacttctatctatttacttaagtgttaattgtacatttctgatttaccactgtcctaccaaaacaggaatttgctttcttattttttttaaaaaaaaggatggaggaatcaactaacaataaatatctgaaattcctaggtatgatttttggcatttgtagccatcaattgtttgccaggagcagaatgtgtatgcttttgttagagtgtcatgaaatgaatataactgatatttaatgtgaacataagaaatacttgtttccctggctaacacggtgaaaccccgtctctactaaaaatacaaaaaaattagccaggcgtggtggtgtgtgcctgtagtctcagctacttgggaggctgaggcaggagaatggcatgaactcaggaggcggagcttgcggtgaaccgagatcgcgccactggactccagcctgggcgacagagtgagactccatttcaaaaaaaaaaaaaaagaaatgcttgtttccagtattacaccaaacacatagagttttctatatggattttagggatgtgttgcaaggattttgaaagctgcctctctgtgctttgtccttcaggaagaaatccctgacctggctcaccctggctcttctcctctcttgactcctagatcacatggtgtcagtatccctcataatagcctgtactcatctgatcccaagtactgtaaatgagctggcttttgcgtaccaggctcatcttagcagattccaagttcctggagggcaaggaatttgttccaggatgacacatagccatttgactgagttcttccatccttcttttccatagctttcctacaagaccctaaacctttgtctccattacaactatggcaaatatccatgctggatgaatacaaatgcctacccttggcagctgtctccttcacccatagcctattcaccacagatgttacctccttaaaaaacacatgcacacacatacactatggaatgaatccatctacttctttatatcttcattgccacaactttatccaaccactgtcatctctcctaggtcactgtagtagccttccagttggtttcccatcatccattctgaagggcttccatcagttctttacacagcagagttacatttttaaaatgcaaacctgatcgtatcactccttacttaaaattgttcaatagcttcctatttaccattcaggaaagacaacacttttcctacagcatagaaggtcttgcatgggctgaccccacttgcctctccagctcgtcttatttataagctcccctttgtctctgacccccagtccaatcggccttcttccaattcttcgctactttcccctgtccctgagctcttgcacatgctaagtctctgcctggaaggctcttccaatccccttcacttagtagaatctcctattcatcattctctgttaaatcaacactttatgagtgaaaccttccttaaggtcccttgtgtgtggataactttgccatgcacctgtccttaagatttccacagttggtaattaagcaattattttttgagcatttgtttaatgtctatcctagaagactgaggtctgtgagggcatatgtcaaatccattgtattcagatccagtttttattcatcattatgtctgccgtaccacatctggcatatagtaaactctttcataaatactctcttaaaatacagaaagaggtcaggtgtggtggctcatgcctttaatcccagcactttgggaggccaaggcaggaggataacttgaggccagtagttcaggaccagcctaggcaaaatagcgagaccctgtttctacagaaaatacaaaaattagcctgtcgtggtcccagctacttgggaggctgaggcgggaggatcacttgaacccaggagtacttggctgcagggagctatgatcaagacactgcactccagcctgggtaacagagcgatacttcatctcttaaaaataaaatcataaataaaatataaaaaaataaaatacataaagaggggaaagaaggaaaggagggaacagaaagtaggaacagagtaaagaaggtgggaaggaagttgaaagattgttaaaacaccagttcaggtgcctacttttaaaactactcaagtgcttccacacttactacttaaaattgcttctttgttgttgccgttttgctgtggaatttgctaaaatcagtttcttttaatatcttcctttggactacatgctgtgtataaaaataaatgtttgtcatgtagatcctcttattcagcctgattcaaatacccagctgcctgctggatacctccacctggatttcccaccaaccaacatgtgcaatacttaactcattgtatccctttccctcaaaactctgatctccttctcattgcaatatcctcgttaatgacgttaatgactttacatcccaccaggagctagattccttgcttgctgactggacatccagtcaatcaccaaatcccactgatttgcccaacaaataccttgcctacctctgtattcctgctgccatcttgctagtgcagtcacttattttgtctcacctgaaggattgcagtaatctaattggcctctgagttccaaattcaggaacctccagcccaacctcccctgaattgcccccagagttctttcttgaatgtgcaaatcttatcatgtcagtttctatagataattcctcaatgactggctattgcccttggattaacagggaaacataacatggcattcaaggcattttgtccctcatcctgtgtcttgctctccagccttgtatctcattgcttcttgaactccagtcacatggagctgcttgccctctctgcaccaaccacatggtgctgatagacaccaccatgcatttatacatcatgctcgcctggcctggaatgcctccaccccagccgatctggcagacttctcatccttcaagttcaaatgaagttactctctttgtacttgctttgttccttgtgacaggaatggggcaggaagtctggttagaggttactgatacgatccagctgagactagggtagtagctggggaaagggagtggagaaggcctgagacatgctctaaatgtagagttttcaggacctgccgatggattggatgtgggggtgagaggaggggagggatccaggaggaatcctaatcagagtaggcagctaccacagcaggaacaaaattataaggaaaaagaattacatacccgttatccacttcaacagctatcaactcctgaatcaatttttttccctttataatcttacctgcctctttgccctgcccacctttacacacataatagattatttggaaacaaatcccagacatttcataatttcatctgtaaatattccaaccgcatctcagaaataaaaaggctctttcaaaaacataaccataggctgggcatggtggctcaagcctgtaattccagcactttgggaggccgaggcaggtggatcacctgaggtcaggagttcgaggccagcctgaccaacatggtgaaaccttgtctctactaaaaaatataaaatgttagctgggcatggtggtaggcgcctgtaatcccagctactcaggaggctgaggcaggaaaatcgcttgaacccgggaggcagaggttgtggtgagccaagatcgcaccactgcactccagcctgggagacaaagctagacactgactcaaaaaaaaaaaaaaaaaaaaccacacacacacacacacacacacacacaaaacaaaacatagcccaaacataaccatataatatcactcctaaaaacattaatgaagaaagaacaaatgaaaaattaatattaggacttcatatcaccaggtatacatttagtgtttacagtttcctgtttgtcttatttttttcaactattttatctctttgttgtttgtttgaattgggatctaaattgtccttgtatattgattcattgctgtgttccttaagtctcttttaacctcccatcatgtctctcttctctcccttcccttcccttcctgcccctcccttcctctccctgtttctcccctcccctcacctcccccttcccccctcccctcccctcccctcctctcctctcccctctcctccttcccttcccttcttttttctcccccactttttttcctattttgttgttttcattggcattgttgctgtgttaaagaaacctggatgtttgttttataaaatatcagaaattctctgattgcttctttatggtgctgtttaacctgtccctgtgtctcctctatttcctatgaattggctttataagacacaggggttttattgttttgttgcctttagaaggggacagcaagattgtttcattgattatgttttatacctccatcagcaagttcataatgtcttgtaatctctatttttgtggcattaacagctattgatgattattgcctatatctgttcatttattacaggttgcaaaaatggcaatctgtaataaatattctcattctattatttttctcttcatgtgtcaacttaaatattctgtaaagagaaaattttccccttcccccatttggctaccatggggtaaagtttatacggaataggtaggatatgtgctttattcttccctgtgcataccagttttcaaataatgaggtgtttcctggcatcttccaaaggtgtgcttgttactgttataattaatgttattaagagtttatgtgttaaatatgttttatatggtgattgcagttattgtattttacaatatttaaattgttcaatctttgaccagtggaagcctgatcaagtcagctctggactacttttgacatggccctaattgtctttgatagcttccttgctttctggtatgttccaggttcaacttatatatatcctaccctatacctggaatcagccatttctcttaggattcctggttccttttaatgggaaatattatttacagaccacattctgagcagtaagtgtgctcattgcttctgggctggttattatttacagtggacaaagatagaaaacacaagtttttaaacaaaaatgattaatccattctgatatgttcaattcaaattcaggacaatcatgtttttactttacttcatggacctcatacccacattctcccttctcctatgctgaaaatcccaattctaaataattccaatgtaattactaatttgctatatcccacacaacacacaatcagcctcagagtaattatacaaaaactgtgataacaatatggctaatgaaaacatttcaattttttttctctttgtccttcagatatatcccactaaggatgtacagtcaaattattgtgttatagaattacttggaatcattcctctgtgtgtacctatactaccaactgtttatatagttaggttcacttgctttattttgctttaaatttttaataattcatctttaaattaaatttaatttatcgttataaaaatatttgcatgattgcaaagtcaaaatgacaaaacaagagctattcaaagtccagcatcccctcatttccctctcttttcctataaataaccatttaaatatatgatttatcctttccctttttatataagaaaatgggttgacatatttttctccactgtgtcattcttacttggtatatcctgcccggtgatgacctcatggtgacaaatacaagtctctgtattgggcttctggctctaagtaccaaataaggacagccaacgagtgtttaataggaacctgcagattctcactcctctctctcatatgccacagctggtctgtcaggatataacttcaactccaaattctgaccccttcttaccacctcactgccaccatcatggcccagggacatcacctgctgctgggattatcacagtggcctcctcactgttgtccctgtgtcccccgctctgtgccctgtgttttgttctcaatacagcagccatcaggcccaggagaacaaggattttctcatggtgaccagagcattccttcttcctccaccatgtcccgatggctctggaagtaagagatgacaagggccatgtggtacttcctttcatcaggtagacagccgacagatataataagcgcttgcagtttatataatgtttattatgttaatataagctttgcatatatcaattaagtcctttaatccctacagcaacccagtgaggatggcttcacaattttcctattattagagacgaagccattgagacacagatggatttcaaaattgcttacaaccaggtagttcacaagtggtagggttgggatcaggatccagggagtctggctctagagtccatgctttaagccaatgctgtccaatagaactttcagtgatgaaggaaatattccatatctgtgctgtccaatctggtaatctctagccacaaatggctattgaggacttgacatgtggctagtttgactgaggaactgaggaacttttttttttgaaacagagttttgctctgttgcccaggctggagtgcagtggtgctatctcggctgactgcaacctctgcctcccgggctcaagtgattctcatgcctcagcctcccaagtagctgagattacaggtgtgcgccaccatccctggctacttttttattttattttattttattttattttattttattttattttattttattttattttttgtatttttagtagagacagggttgcaccctgttggccaggctggtcttgagctcccagcctcaagtttatctgcctgccttggcctcccaaagtgctgggattataggtgtgagccactgcacctgaccaggaactcagtttttaattgtatttagttttaattcatttttatttaaatgagaacacattgttacatgtattagacagctcagctctaaaccactatactattgtgctttttatatatgaccagaagagtggcacagagttatttaactcttatttgcaactgttatttaaaaccaaagatacaacatctttatgggattccagctgccacctgtgaatttgaagtcttctaaacaatgtcatccataatctatgaaacatatgcctctgtaatgtcaaagctctgttagaccaaaaacagttatccaaatacattatgttcctttttattgaaggaaatggaggaccaaagtgttctgactctcatttgtccttacttaagagcataattgtgtaagataaaaataaagaaaagctaatcacaagaggtagatcatgacattgcagatttagttgaaatttacaagttatatttctattgattttttcattgtatttttttattttggaaaattgaaaatgtataaaactattttaaaaaagaagaggaaagaaaaatccaagaaatcttcaccaacaggaattaatcactggcatatttgagtcagtcttttttcctatgtatataatatttttaaaactgtatggattaattcttccctttttctaaaagaaaaagcacattattgacttaaccctcccccaccttgtctatcacattaatcacagtaactctccttagtctccagaaatagacactgttctgaacttggtgtgtatgctttcagcccattttgtaaacttttacatgtatattcacatatccttagaaacacataatattgttgatgtgggaatttttaaaaaacatttatataaatgatatcacactgtatgttgttctgcaacttctttccactcgtcatttttgagctgtgcgcattttgataatttacatctagagtcattctataactattatatcctaggaacacaccacagattattcatttcttgctggtggatatttaggttttgtcagtttttcattatttcaaattatgttgcagtgaacgtccttgtacatatcccccagtgcatctgtgcaaatatttctctgtgcagataattttaagattatagaattcactcatcttcaatattactaggtccttccaaagtacctccaacttggctatgatgtagactcccaccagcagcatatgaaagcactcatttccccatacttacaccaacatctgataccgaccaacttaaacattttgcacatttgaagtaagtagcttattgtggttctattttgagtttctgtaattgctagtgacgttcaacatccttccatgttgattggccatttgaatttccttttctgtgaaatccttgaacctattatttatgcttctttgttttgagttgcttatcttactgacttgtaggagttgttcatcatttctggttaacagtcttctcttactaggcatgttgcaaatatttactccctatgtatagcttgtcttttaacctttttatgatgtattttgtcatgcagaagttttaagttttagatttaatgatggcttctaacaggcttctctcattcttgttgaactggttacaagccttgttaaatcttcatgtgttaaattctaggaaaagagaggagattcgtgtgtgacttgctgatttattggctgattgccatttctcagagaaaaatattttcttgtgcatatttatagcatttccttaaggagcaaagtccatttttatatcattgtgaatgttttgttttggtggtaatgattttttgatatctaataataaaatgttgacagtggtaaaatccttgtgatagcttataaagcaagaattgattttgctcttcattgcacactctttgaaagtgtatattcatggctctttttcctggatttttctagttattttgatctgctatctataattatactgaaaatgaatttcatatgtttaaaaattattttagatatcatctgtcttcaggcagaagtcatagcagactggaggcagtctaccagctttaaatcccagctctcccacctattatctggaaaccttaggcaaaccactttaattttttgcttctcagtttcttaatctgcaaaatggggtacctgtaaaataacagtgcaagtgtcatgggacttctgtgaagattaactgagtggtaacacttcagagggtcctggagcagtgcttggcatagagaaaacattctacagggcccagcagtcattgtccctcaactaccttaagattcatacaaatgaggagaaacactgtagatttagtgctctctggaaagtatattcaagtcaaagagcagctgacgtctctaattgtcatttcatatgccgttagtgacaccgaaaaatagaccaatacagacaatgacgagcacaactgatctatatgaaactatcatttatagattctccatcacacactttcagccacccaagctcagtgctttcttactccaaacacttaaaaaacaagttaaaaacagacaaaaaaactcacaaaagatatgtccttgaaccacagctccaaaagtctggcccatcacaagtgtgatggtagagttatcagggtcagaatgtgtttggccccacctgccccaggagtccgcgaagctccgtgaaggcaaaggccatgtccatgccaaccacatgttggtggaattcagtcatttctaggtgcttagcgtcaggtgggtgccgccttcattctttgttttaactgacaaataattgtgtatttgtggggcacaatgtgatgttttgatgtatgtgtgcaatgtggaatgattgatcaaatcatgctaacaaatccatcacctcacatacttatctttttttgtggtgacaacacttgaagtctccccttttaacaatttggaaatatacaatgcattattacttattctagtcaccattctgtgcaatagctcagtaaagtttattcctcctgtctaactaaaattttgcaccctcatctctcacctttttccctccaaccccctttcccagcctctgggaaccaccattgtaccctctgcttctgtgagcttgatgtttcagattccacatgtgagaatcacaagttagatcatgtggcatttgtcctgtgccaggcttatttcatttagtgtaatgtcctccaagttcatctctgttgtcaaaaataacagaatttccttctttttaaaggctgaatagtactccgtcttgtacacgcacgttttctttatacattcatccaatgacgaacacctcggttgcttccataactcagcactgtgaattctgcagtgaacacggaagtgcaaatatctctgtggcacactgagttcagctcctttggatctctacccagaagtgggattgctgggccccatggtagttctatttttagttttctgagaaacttccatgttgttttccatcacggctgtgctaatttaccttcctaccaacagtgcacaagggttcccttttctccacagccatgctaacacttgtcttccatctttttttataatagccattttaacaggtatgaaagaaaggggcccctttgttctttccaaacgtttttcatgtgctctgtccccagcccctggctggctggatgccgggatcagggtgtgtgaatgcccttccacagcttcccaggagtgctgggctcagggtgggaagagctgagtttgaggcccggtcccttactaacgaacaataattaatataacctctctggctttagggagtctaggggacatgtggtcatcaaagattgagtgaaattaacatgtgaaatgatgtaacaatgtgggactttaaatagtgaaagcggaatttcaccagaaattactttgatggccacaactagatgttaaaatgaaagctgacgcatacttatgacagaacatgagccacattattttatttctgcatttctgcactctctccttactttggtaaatcattttgaaacaagcaccccccaccctgcagctcttccattcatgaatgatgcaatattgagctgtgatattttcagaagtgtttgctaagcattggcagcttaactaaaagcatcctctctattttgctcttggatcactgctctcacctgttaacccccagcagaaaatctgcctgctgaacaatagcttgcaaacgcagcgtggcactcggtgccggtgccggcataaaggagtcagcgagcagggcgttgggtcagcttgctgttgagggcaggctgtttttgttggcacatcccttttgtgaaggatgtagtccttgttctaccatctgtaccaggctgcacaccatctatttatttgctatccttgaactaacggggtattttcccccagccataaatgggttggtgtgagagaagcttctcctgctgagggactcacttctgcaccgcatcctctttgttaatcttctgcaaaataaggcagttttctgttgaagagaaagcaatcatcaatttttcataagagcagcaaagttgtgaatatcagaggacctcttgaataaagagcttagaggttccagtgagagacgaataacaaagccctggggggaagaaaaaagtatatccttttttatactatttatcatcaactcccccctccacgcccctgcccccccatcatccgcagttaggaaggaagaagccatttatgcaagctaacagtccttcaaacctcatgaaccttaattttaatccttatcagtgcctttttaaatgaataatacagtgaccttcagctttgtcctatattatgtgaggttgattcgtaaagactgctttagttttttaaattaaggcagaagctatatgtattctactcaattctagcattagtgctgtcccaagagtggcatttatgttcttttgcttctttggtataaataaatatcaaagtaggaagaccagtgtgaattctacaaggaataataaactaaaataatatggcattgattttgttcaggatgtctaagtgtgtttttatgattgtgtatttttatagctttttcacacaagtgacatgaattctgggcaattaaaaaggacatgaatttcaaggcatttaggaagagaatctgttttctaatagctgtgtcttttaccaagttgtggtttttgagaaaagcattgtcgatttcagacctccaccttcagaaactggccagttattgccattttgtattgttttacaatattattgccatgagactacattagagaactttgttttggctgctaaagtgcaatatgtggatataacaatctaataaagaagcagagaaagattcctttacactgcatgtgtattatctttttgagtttcttctgaccaagggttcttagactgtagctttgagtcttattagtgaggtctcaacccttcctactgttgagggaggcatgggccccaggagcgtgtgagccttggacagtcacagagacaattcgtttacaaatgggaggggagcccaacgtggatggctttccacatgatgaatttatgacaactcatgttgtcacaaatttcagtaaactaacagtagcagatcctatgctgctgggctaacttctctatccccttctctcagtccttcttagatcattagtgttatttttttatcaactttttgttgcattatataaattactcaagtattacttaaattactcaagtaatacataaatatcagcaacttgaaaaaattaaaacattatagataagttaaaaatcaccttggacctctaccaccatacaagttcctattccccctcctctcctcaataccctccaccttcccagtaacaattaccagtttagtctgaatcctctgaaatattttttgtatatttaagcacagtgctgtgaatctatagcactaagcaactagatagcattgttttttaaaggctttttcccctatataggcataacattgaatgtgtctgcagctggctttttactaatatttctttaagatctttccatgttaattcatatagatctacctcattgtttcataatatttcatgttgtgcctatgctgtaatttatgtagcttttctcctattcaggggcatttgtgttccaatttttctctattaaaaatgccactgtggtgcgtgacttcttatgcacatgagtgcctctctaggtttatacctacagatggaatttctgggttacagaatgtgcacattttagatagggtcaaatcgctctccaaaatggagttaatgtacatttctcttattactaatgagatcgaaccacttgtcatatgtttattggctattggtatttcctccctattatttgcttattcaaacactttgaccatttttctattgggttattaatttgtctaattactttgtaggagttatgtgtgtatgcatgtgtatatatacatacacacatatatatatacacatatacacactgtattgtgatcctgtatctgttacatatgtcagtctcccagactttggcctgtcttttcaatttgtttatggtgtcttttgtcaccattgtttttgacctagatttatatttttcaatcttattctttttttctccgaatttccttgtaaatatgctgtaattatcattgtaaacttattatacattgcttattagagaaataaccagattcatttggggtttgaagctgagactctgtgctgactccttgctgtccatccctcagttgtaggggagcctcatgtggggagggtgtggtcatagctactgaaatccatttccagcaaactaggatgataaagcagctttggtgtgaatgttttctttcacaaatgtatgtggattgaaggtttgaagtttgaggcaacatatatgtggagagggtgagcgcattcattatatgtgggagggttttttcatttttattttttgggtttttttttttttctggtgtaattgggaaggaaaagaaacagctcagcactttccctgccatctacttttcagaaactatgggcccacaactcccaaggctgtattctaggttttattgtatacttcaaattgggatatatctcaaaacagttgcatttaattgggagattattaaaaagcatgagcaaattcagagtttcttgcccagaaaatgctgccaatgtccaacctaaatgaggacattcttcccttcctgtttcacagtcctgccaggagccatatgaagaaggcaagccagtacagatgatgggtacaccggggctcagacttcaccactatgcaatatacacacataagcaatctgcacttgcaccccctaaatatacacatataaaataaataaaaacaaattttgataaaggtaaaccaggtcagggcttttaccagactgctgttccccaaacttcagttatttgcaaaccatcttgacaaatgttgccataacaactttcctcctattaatatgcttaatattcttctaatattaatatcctcctaagaatatgcttaatattcttcttaaactacctacttattgtttgtaaatttatttaaaaggataaatttaacctttgtcactggccacagatggaaaaccagtttcacttttcatatataaaatagacagtaaccatgaaaacaaacacaaatacaacaatcaaatattagtgaaatactctgagccggaggtctgagaatgaaatcttttaacaagagttcttgtttaaaaggctaccaaaccaacatttttctccttgacataaataggattgaaagagaattgaaaaaggaacaacttttcccacgagacttggggtcataccgattaaaatcttgcatcaacttagaatgaatcaatcatacagaattttgggtgtctgcatgttcttgttggtgtgaggtcatcatctgtgtatccagagcacatactttgcccgactaccttgtccccacaccatttggcttcacacataagcattgttccgtcagagtcaaagagcaacaaggctctttgtcaccatgagagacagagagagacagggcgaggtggggggcaggagggagagagcacaataaattcagtcgaattgaagcttatattgggaagaaaacagccggctactagctgtaatatagacgttcatggccatatgtaaagtgcagccatgttactcaaggatccatttaatttgttctgggctctgatgtcaccatgcacccactgaggtgtttttaaaacacattgagatcatacatatagttaaaaacaatcaagtaataccaatagggttattaaatgattccctattaaatttatttcctaccccatctttttcttctctcatcgtacttccaaaggcagccagttttaacccattctattgataggccttctggtggttagctccacatttataaataatatgcttacacctttatttagtagtttgccaccttaaaccaatatctatcaaatttttgctatgtcagatgagaatttaattaatattattatcctaaccttttcctctaacttcattatgttttgaccattgagaaggctcttgtcagtctgattcttagttctttataggtgatctgtttactcccgtggaaattttcaggatttttatttttgtgcttctgaaatttcacaataatacataagattttatgcccaagtattttggatttctaaaaagatgccaactcagttattttctgtagtttcttagtatttcatatattttgatactgttgtaaatggtatcttttttcaaatatcattttctgattattcattttagcatagagaaatgcaactcatctttgtagaacgatcttgtattctacaccttgatcaactcacttattacagcatttttgtacacttcattggattttctagttgacaatcatgtcatatgtaaataaacaaaactttacttcttcttttacaatctggtcttttatttattttacttaacttattccactggctaggaattctggtgcaatattgaatagaagtggtgagagcagacatccttgtcttatttctgtcttattctagggagggaaattcaggtttaagtaataaatattcagtcttgaatattacaccattaagtgtgatattagctgtatggttttttgtatatgccctttataatattgaggatgttccctttaattcctactttattgagagcctttccaggaagatatgttagattttttctgatgccttttctgcatctattaagatgatcatatggtttttctttatagtttagcaatatagtggattatattgatcattgattgatttttgagtgttaaacctattttgcattcctgagataaactctgctttaccatgatattctttttggcgtattgctggattcaatttgctaaaattttgtttagaatttttctaggttcatgaggatattggtctgtcttctttgcttgtaatgtctttgtccagttttagtattaaggcattgctgacctcatagaataaattggaaaatatttcttcctttccaatttcatggaagagttgtgtagagttggtattatttcttctttaatacttgatataattcacctctgaagccatttggcccagagttttctttgtgaaagagttttttttaaattacaaattcaatttcttttatagataaagggctacaaggttatctaattcttcttgagtaagctttggtaatttatgtctttcaaggaatttgttcatttgagttgttgaatttgtcggcataaagttcttcacaacatcctcgtttttatattttcagcatctggggactgaacagtcatgccacttctctcaattctcctgtcagcaatttccgtcttctttttttttcctaataagtctggctaaaggtttatcagttttattgatcttctcaaagaaccagctttttgtttcattaacttttttctattgtttttcttttttctatgtcattgttttctgttcctttgttatttccttctacttaaagtttgatttgctctttttttttttttagttttttaagggaaaaactaatactttttttcttttctaatataagctggtactataaaattttccctaaaaactgttttaatggcatcctccaaattctgatatattgtattttaattttcattcagttaaaaatactttctaaattcccttttgagttcatctttgacccatgagttatctaaaagtatgttgttttgtttccaaatatttgaagatttcccagagatctttctgttgccatttttttatttaattccactgtggtcagataatgtactttgtgtgactttaattattttcagtttaataagacttatggaccactgtatgatctattgttatagctgtccatgtgttattgaaaagaatgtgtattctgctgttttgggagtgaaatgttctataaatgttcattttaaaagttacttgataatgttggtcagatcttctattttcttatggattttcattctgtttgttctatatattattgagacagaagtattaaaatgtctgactatatttttggatttgcatgtttcttcttgcagttataccagtttctatttcgtgtctactgaagctttgttagtaggtgcatagacatgatttgtgattatttatgtctttttgatgaaatgactccttatcattatgaaatgacatttttcatcccaggtaatactctttgatctgaaacatcttttgcttgatattactgtagctttccttgattggtgtcacacatgatatttttttttatccttttacttttaacctgtttgtgccatcacacttgaaatgtgtttcgtgtaggcaacgtgtggttgggtcttcttttttaatctaatttgacaatctcttctttttaattggggcatttagaccatttatatttaatgtgatatgtgatgtgataaggtttatatgctaattttgtgggagggttttgtcccatctcttctttttttttttctcttttcctgcctgattttagattaaatgaataatttttacaatttctttttgtgtcctttgttggcttataagttataatttttgttttgttattttaattgttactttaggacttatagtacatacatttagtttatcacagtttaccttcaagtgattttatgctcacatatagtgtaataatcttggaatagtatattttgatttttcccctcccaatcttttttgaaattattggaaaacatttaacctctacagattttataaactctacattatgttattatttttatttaaatagttaattgtgttttaaagagatttttaagttagaagtaaaacatgcacacacatatgtgtatatatatatgtatatgtgtatacatacacataagtacacacacacccatttccaatactcttcatcctttgtagagattcctgttaccatctggtgttattttcataacccttaaaggactttttttaaattttgtggtgaaatctgccagtgatgaattcttctaagttttgtgtgtctgaaaaagtctttgtttcctcttcacttttaaaagctattttactaaatataaaattctagtttgacagtttttttccttttagtactttaaaaatgttgcatcactatcttctcacatgcattatttctgtctagaaatatattatacaataatccctgccttgattctctccatataacgtgccttcttatctgaagctgcttttaagattttttgttcgtcacttcttttgagaaagttgattatgatgtaccttgctgtaattttcttcgtatttctttcgcttggggtttattgaatttcatggatctctggttttattttttctatcacatttggacattttatatccattatatcttctaatttttttctatcctgtcctctttttatttcagggactccagtttcttaagtacaggctacttgaagttagcccacaactcactgatgctctactcattttataaattatcttttcctttgtcttccattttaaatatttttgtagctatgtcttcaagttcactaatcttttcttctgcagtctctaattttccattattcccatccaatgtaattcttatcttagacattgttttttatctgtagaaatttgattttggcctttaaaaaatatcttccatgtatctacttaactttttaagcatttgaaatgcagttatagcaaccgctaattctgtgttaatttggggtctattttgattgattgatttgatatcctcttatggtcctattttcctgctttttgtgtgctggttaattgttgactgggtaccagatattgtatattttactgtattggtactggacatttttttattcctatcaatattcttaagctttaatctgagacacagtttcattgcttagaagcagttttatcctttgtcctcacttttaaggtttgttaggtgataccaaagcagtggttggtttaggtgttgctattccctacaatagaggcaaactgctctatgtcagagaatcttaaggtttcccagtctgactagcaggaatagactctatttccaggtctgtgtaagtagcgggcactgttcttcaatctttttgtgtggatttccacctaaccttaggtagtttcctcacatgcatacacttctcagcagtcagctgaatactcaagaaggactatccttatttttttaaattgttatttatttatttatttatttatttattttgagatggagtctcactctgtcacccaggctggagtgcagtggtatgatctcaactcactgcaacctcctcctcccaggttcaagcaattcttctgcctcagcctcccaagtagctgggctataggtgcaagccaccatgcctagctaatttttggtattttttaaatagaggtttctccatgttggcccaggctgatcttgaactcctgacctcaagtgatccacctgcctcggcctcccaaagtgctgagattacagttgtgagccaccatgcccagccagaaggactatctttagatctttggcattttctctatgtgaagccttctctccagtactcttctctgtaaactctagctgcctaggtgtcctcagactcagcttcatctactcaatgtgaggagcccaccaggctctgcctggatttgccctctcatgctgtagcctggaacttctctccaggcagtaagcttaaaaatcactgggcccgtgtcatttgcttcccttctctcaaggatcactgattgttggctgaagtccagtgtcttgcatattatttaatatattttgtactgggatggggggagtgaggttaggtgggaggataaagcaagttcctattactccattttggctagaagtggaaatttgggatttactctcattttagtggggttttagttaggacaagaaataatgcatgtgcttattccaccatattgagccaggagcacattgcacatttttaaaaagatcttgctgcttgtgttattggagcctctataacacttagctcatggttttgttaattaattgtccaagttcatattctctaaatggacttgttgagaagtggaaactgtgtctcattcactttgggatagtctcagtgctaaattggagctccataaatgcttgttgaatgaattagtgaattaatactgttgtcttattggtaaaattgcaagtttaaagagtcaggactgaaggtaagagtgctttttaattaaaacctttgtagggaaatgcaatttacctttcaggacattattcttttcaggctacagctttttaagagctgttaacattagcacccacttctgcctttgtggcaggaaacacttcttaaaaatgttgtcacatattttctggtagaatgtatacgcaacacttgggggaattttattcttggccatttatcctggtcattttctaatctgatctcaatgtaaaagttattgtggaataacagaaaaatacatctttccaatccatctagtctcttttgtgtgtgtttgtatgaaataccaatttactcttttaaagaattcttaaggttccatgtataattttaaagacaaatggatatattttaagatcaaatttcctcaaattttttcctgttctaaagagtgtagaattgtattatatattcacttaatctttcaaaggttcagaagctaagaaattagagcaagatcatcaaaatatgtcactttttaattcctctgcttgtaaaggcaacatagcttagtgattgcaagtactgtagagcccggtggcctgtgtacagctccacctttttttttttttaaatgcagagtctcgctctgtcacccaggctggagtgcagaggtgtaatctcgactcactgcaagctccccctcccgggttcaagcgattctcctgcctcagcctcctgtgtagctgggattcaggcatctgccaccacacctggctaatttttgtatttttagtacagacggggtttcaccatattggccagactggtctcaaactcctgaccttgtgatccacccacctcggcatcccaaagtgctgggattacaggcgtgagctaccgcacacggccacagctccaccttttactagctgtgtggccttgggcaagtcactgaatctctccaagcctgttttctcacgtgtaaaagggtttaataatagtacattctagggttgttaagaagattaaatcggttaatgtttacaaagtattttaaatggtgcctgatatacacagtaagtgtaatataagcattagtttaagcaaaataaaatagtgaaattaaagtaaaaataaaactttattttataaatatttctgcattttattcttctgactttcccaagaagtaaaaattaccctcttttatgaagttatgtcatactttaatagcttgcatttttggaaatcagttgaatattgaggggacaaagaacccttctaattttccttcaacatcttctatataacagtgatgcctatctccctatttatctcacagtgttgtatttagcaaggttttgcgcttggtacctctgtttttcttttagtctaaaccttcggttgtccatgattcaactttaaattatatctctgaacggccccctcctcaccacgaagttgattctagagattttcccatcataatatttaagatctcctttttttttttttttttttttttttttttttttgagacagagtcttgctctgtcacccaggctgggctgcagcggtgcgatctcggctcactgcaacctccacctcccaggttcaaatgattctcctgcctcaacctcccaagtagatgggattacaggcacccaccaccatgcccagctaatttttgtatttttttagtagagacgtgatttgtccatgttggccaggctggtcacgaactcctgagcgcaggtgatccacctgcctcggcctcccaaagtgctgggattacaggcacgagccaccatgcccagcccaagatctcctcttctctctgttatgttgctattacccgggacactttaataccataaatatgttttctaaccttactgagttatttgctaatttaacatccttattttatttagtgttccaattatgagcatctgtggcttgcagaattgtgtcaacttgctagagacagacttttgatttagcattcgtttccatttttatgcttatctgtcttttttatttgtgtttgcagaattttcaatttctcatcaatctctctgggtcattattattgtcttagcatctcattgtccagattttcaagaagttaagaaagcttagtcagatggttgactatattttgtaaatatatgactcagctaatggctctttgaaatttacatggactttttttacttagtagtcttagtctgtgtaatgccatctttgagggacttccatgcacaatctcatatcatctccgtatatttgtttctagctgggtatttgaggctagatagactcacaagatgtttacagaaacaaagatgagtcaaaaatccaaatctcctaattagtgtaattttcaatatagcccagtcctgtccagcatcaggagacttgacagcccccaaaccaaaagggcatctgaaatacatattgctcatccctccgcctgcctcccccatgccgagacaggagctgtggtgagcgtgtggatggcacaggctctgcgggtgtctgactagagagcctcagttacgcgctctccacctcatcacacagcagccccgtgtaatagaaatcgcttattatgagggttggctaaataaaggcacattgtgaccagtcacaatttctaaatgaatcctcctgactgatctggtcctgacactttcaaagctgccgttattactgaacctgaacatgtggaaaggacaagtcaagacagaatgataaaattcttgaatgcttttgcttaaaattattcattctcttgtgtgtgtgtaaatggggacacacacacacacatacacacactccatagacactctcgcatacttaaacggttccctaggtgcacttttatcattttatctcatctcactttggtagtttccattgtagtccttctgtagactaattctctaaatatttagaaaaataagagggtcttttatctgtgtgtagtcgtggattttgctgcctcttaaagcattatcttttctaagtccttaagtgttagaagtgggaaaaccatctttcttttaaatttagcaaatggcacttatgtgcatatgtactgatgccatatacacacttacactgtaatagaaacatcgtggaaaagcaaaccataggcttttatcataggcatgagctttttccctctcatctccgcctggaaagatggttaggagaatgagaggcctctctggatctgtatttataagccttactggaaaaaaaaagtcaattattttttagactcagctcacaccataataaatgtgaatctaaacaatcgctcaagtgctttctaagcaatggttctatctatgatcactcagacttccttcttttatttagtaaaaaggtaacaaataagaatggagtgccatttgcatgtttcttatttttactcaatatggagtccagtggttgagtaggctcatccagtagcaaagagaagcaaacaaaattgatttcctgtagcccacagtgattttccctagatttagagagcatgtgattccaagatgggtgtggggtaaaactctcaaggctttcctggcgagagacccgggcatgctggtggagaaaccagacatcatgcttgggaggttggggcctctctcctccttgaatgagctctgttttaggatgttgttcatgtgaaagtattgcacttacctcagcataaaatgtcaagccatcacatccttgggatagaaacaattaaggaaggatttatgtttgtaaaaacatgtgcctattaaggtaagtaattagggcacatgaaagaaagataatatggagatgtaaaaattgggggttctgcagtcagaccccctggatttaaatcctagctccacttgctgagtgaccttgggctagtcattgaacctctctgagcctcagcttctttccctgtgaaatggggaaactaatgggtttattgtgagtattaaatgagttaatacatgcaaaacaattcacacatagtaagcatgaaataaatactaattattatcattgttacgcactaagaaaggatttttgcaactaaagtgtcaaaagaaatggagatgctaaagaattatttggctttaaaagatgaattccagtacaaaatgaggctgtttaacaaccagattccatattacaatcagaaagttccagcagagtacctcaggcttcatctggggaacatgtttaaaggtaccaataatttttgggtttttttttccaattttaataaatgaaattctcattcctttctgtctgtctctctgttagcgctattgctttatcttactctgtagtctgtatttctcttcctagtttcttttttttttagaactagttgtgaattctttattctctcacatagacatatgacagtggggaaggagggcatgtgtgtttcctaaatgttagcaagaagtctgtcttgccatctccatagagtggaaaattcagcaagtagagtctgttaatgtcattccccttcaaatcacattcaaaagtgtgcttaatgcactgtgtacattaatcagacattttgatcatgagtaatggtgatgccttcagaagtttggggtgggggtgtgggttttgtatatcttggaaggaatcctaagtccttgggtgacttcgaagcagtctgtatgggcgctcctcccacatccattgcatctttgtcagacacatggcccctaggctccactttgtccataggcatggaaaggtgaaagtgcctgggaattaatatctctggggacactctgaagcaatgactgctggttatatgggtataaatactccagctccctcaccccttggctaaagtaattccaaggcacgtactttgcagttttccagagttaccctgtgagattcaactgccatcacccactgtggtagctgacttaataatgcatcctatattgtgtggccgccttcccttccctgtctaacttctccctcactacccagactctctgtatctcccaatacaccactcacttgttcggggtcacttctggagtttccaaccccagatgatgtgcacactttcagaggtagaagtgaatctactaagcctagactaggtatcatcaaaaccactctgggctgcaaactggcagggtgcaggccgcaaatttggcagagctctgctttccctgggtttggaattccactgactcagagcctgaataatcgtggaggcagacctgtcaaggtgttatctgaagagctgttggggaagtggaccaagaccacagctgcccattctctcaccccaccttctttctgcagagtggcccatttgtgattcaggagaaagagtgcaggagcagtggtcagcatgctgtgatcgatgatttctgagcgtgggtgggccttgacaaatgctcctatccacttcattccctcttaatagacccatcagacaggtgcttgttgttttccagtgccaacctgggtaaaccagtcatcatgtgccccagtgtgtcaaagaaaatgcctgcttcccagaaggtttcccactaatggggaaaagaaggttgattcacacagccttttattgcaaaccaattcattctttggcaatctgaaaccaaaactgcacatttagccaggcaggtcttttaaaagcatgtcctttaccgtactgtccattgcagactcccatccatatcttctttcttgttttgtgttatcatttttgtgatgctttaatactcaatacatgaactgaagctatgtggcttctgtatcgcagtgtattaggattccagaaagacatgcaatccctgagcagacaataaatttgattttgcacaagtggcatcctttatactttgctcataaggcgatctctcaagtgtatttttttttctgaaacacaacacaaatagtctgatgaagtaaaaatgggttgcatgatgggttttgtgctcagcaaaaagaacttggacaaagcagccatgctgatgttcttatttacaaaggttgccgtctgggaaattaatctctgctgttgctcagtaattaggaaaatttaggacccctagtgctccagcatcttgcattaaaggttgtatgtcattggtgttttcatgagagtttgctggatttctgtcattaataacaggcataagcccagcaagcagtagaatatgcattgcatttaatcaatttgctatttgtattcattatgcatgtcatccgttttgagtcatgaaaaattgaaaggccattacgaatagaaagagcatcatggattacaaatgatgtaacaagagcataagcgctattaattggtcaattgtgcttgtcggtacatttaaagtgattaaggcagaaagattagaaaggacacgaatgtgcttgggaaacagaagcatagcaacacaagggctctcccaagtcctttgtgcccaaataaatgcagcaaaatccaatggcatttattccaactaattcattaaacagatattagttgagcacttaccatgtgctgagtacaaggattgtactgagtacagcagaaaacaaaataagtgaagcccttgacctcagggatttaccttccagaggggagggggaagtatgaaatgaacaaatagatatacaatataatatattgtagtagcagagaccatgaagaccaccagaagcagagaggaagccctctttggggaaatgacatttgaacagaggtttaaatgaagaaaataaaaagacagggggtccgagcacagtggctcatgcctgtaatcccagcactttgggaggctgaggtgggaaaatcacttgagcccaggagtttgagacctgggcaacatggtgaaactatctctacaaaaatacaaaaattagccaggcgtggcagtgcacacctgtagtcccagctactcaggagactgaggtgggaggatcgcttgagtccaggaagtcgaggctgcagtgagtccagatcacgccactgcactccagcctaggtgatagagcgaaaccctgtctaataaaagaaaaataaaattaaaaggctacatggatatctgggggaagaatagactcaatatcccccactcccattccaacactcaagaagaaaagaaaattcttgcaattatttttttactcaagtgattttgtgaggcttgacccaataatggaatggctttgccaaggctagagaactcactcagccggttttcccattacagacctcttgggtgatagcaattctgttaaagtggaaactgatggcatcatttgccatttttactgtccccatacatagtccttaccatggcatgcagacccctacgctatccagctcctgcctcccatttcataccactcctccttctcctgccaagttctagcccctggactttctgttgctcacatttccagttcgttcctgcctctgcacccatgcatttgctgtctcctgccctcagaaatccagacctgagctcccaggccacatcctcagagacaccctccatgaccaccagggttgcacctgctccctggcccctgtgatttgatcccactacactcattactgcctgagttctgtgctatctgcttactcgtttcttacctacctcccatgtttgatataagttccatgagactaggcccaggtcacttgagttcactgcggtatcccatcacctggaacagtgcccggtacaaagaggctcagtacgcccaaatcaaatgaatgaatgagtggatcaatcaatcagccaaccagccaaaaataaaatgaaaaattgacagttgggtttctgcttttgtattcggtaactattttaaaattttgtatttaggtagctatttttttaaaccacatgaaagaaagggatgtttgttctgcacagcattctctggagtgattaggtagcattggtatttgtgcttcatgtgtctacaatctattgccatgcatttctaataacataatattccttttcaatatactgacttgtttttctttttcttttcttttttgtttttactggctaaatgctatagcattgtctttgaatattagcaaataatggaacatgggccaagggtgaaccatgacgaatttgtgttccagcagccctgcttctttagaattgacagtctggcttcgtggttaattcacagcatctgaggaatacatccaaagagggtgatactgtggcatgatggtaccaggattccaagttcattccaggtacagtcgatgcatcattcacagcagactcgtgagtgtccatcctgtgccagactccatcgcaggtgctggggataccaggcagaggatgcagtgttgccagctatcaggaagacctgacggtcaacaatcgtgcttccaaagccacctgcatattatactcccttgggggtcagctgtaatatacctgtgcctaggccccatcctaggccaatggaatcagaatctctgggcctagggctggcacacccatcttttttaagcctcaagtgctgttcatgggcagtcagggctgagaccccctgctggagtagaaggatggtgcataggtagcaaaaccacaaagcaatgggcaaaggccaagtcgcagatggcagttgcgtaagctggaagtggtgacatttctcttcagtgcataaccacagctcagaatgaatatttgtatggatcaggaggccaagtgacctggtattgagcagtagataaacgttgcatctatttatcaccacccccaaaaaacctttttaaaatggcaaataccattcattaaatgtttatttttcctgcatgaggtcaaacaaataatctcaattttctgggtgttggggattcaaacaacacccaaaatgggatgttgtatactaagtcaaataaagaattttaatagagacataatgtctttcctaaccagcaggtatgagagaagggaaaataagagaatctgcctggtaaccatcagggggaatgaattaacatgttctctaagactatgttagaaggtcagagcccagcacagtggtacatgctgtaatcctagcactttgggaggctgaggcaggaggatcacttgagcccaggagatcaaggctgcagtgagacatgatcacgccactgtactccagcctgagcaacagagcgagaccctttctgaaaaataaataaaaaataaataaataaaaggtcagaatttcatgaagtgggatggtaaagttgttgtgaaattctctccctcagataccctctgcctttgatggtgggcattaaaatgcttagactggaaaaaaaaaaagcaaatctttctgggtaattaagtaaagtttatgttattcatttgaagatcaagctttgcttctccccttgaacacaggtgaaaataacaggaaaatgataataactttataagggccaaattaccactcacagtggtacttctgagtgtgtgttggaaaattacatcttttgtcaagtgataaactctgattttttttaaaaaaaaagcaatgttcgtgatctagtaagcactttacaaaagctaacatgctttatgaaggtgtgtacacagactgcctaacctcacactgcagcctcacttactctaacacactctatggccctccatggaggagcagaagcttccacccacgggatgacttcagatgaacgcttttgatgctgggagcagcagccacccatgtctccagatacctgttcctctgactctgcctccttggattttacagttaccaacagttcatgatgatcttcagaaatgttcacagtttcagaggagccacatatttgaatgtttaaagaaagcaatattttgcaaaacgcaaggatgatccaagagagccacaggaggatctagcagccctttgtcgggaaatgaaagtaaccaacaagatcaggcctggaaagaccttcctggatcccccaggacatgctcccttctgtgaagcagcggttctcagcccttgctgctcattgaagtcaactggggtgctagaataatactgatgcctgatgtgcccaggctggagtacagtggtgtggtcatggctcactgcagccttgatctcctgggctcaagtgatccttctgcttcagcctccaaagcgctaggattacaagcatgcaccactgtggtgggctctgaccttttaacatagttttagataatatgttaattccttgcctctgatggttaccaggcagattctcttattttcctttctctcatacctgccaggatctcatacctgtgccagagattcctgaggaaggaggggcagtgtattttggaaaagctcccaggtgaatctgaagtgcagcctgggttgggaaccactgatgtagtcccagattagtgactgaaatgggtaataagggaagcagtgttggcagcacattctaccaagctcaaagtcttgacatgtcctggagccagcagagggcaaagacttcattgctaagagagaagctttagtgggagaagataaataagtctgtttccaggcaaatgtcccctttctgctgtcagcttcctggctatttctgccctgcctgagcctgaggatttagacatcactttcacgtaaatgccataaatgccagcttccaggtctctccacacattaatgacattgtggtgagaaaagccacttgcaaatgaagtaaatccttgaaagagtcagacaatagtgggctttgtaagctctgccttacaggagagcctgcagggggattttcggtgatctatgcagggatcaagctgccatggccaaggctctcaggacaaaggcctcatggagtcttttgtttgccaccgcatgtgactttactcctgcatctcctgcagagctctcccaggacagttgagtaagagtggagaagcaattggggtgaaccccaagactcagcctgatccgttgaggggctttgcagcataaattacacctcagagcctggggcaaaggagctgtgaggcatttttctctacatgggttagtcattggctacctgggctctcggtaagagtgatgtggctccagagcccaagaaaagcggcccctgcggtcctggggtggggagctcttagcagcacagcactcagaagctgcgagatgggtgcgcagagctgtgctagggatcctggagtctgggcaaacagcactgcatgtgctccacaggtgaagccttgcctcctccatccgtcagctcagcaccctgtatggaaatgcaaactgtgacgtgtgcttctgcgtttcccacctctgatatgatagatggcaccgcaatgcttttctcttcctcagggcccatttccaggctggactgcagtggtgtgatctcccctcactgcagcctccacctaaagtaatcctcccaggctaaagcgatcctcccacttcccacctcagcctcccaagtagctaggactacaggtgcatgccaccacactggctaatttttatattttttgtagacagttttgacatgttgcgcaggctggtcttgaactcctggactcaagcgatccgatctgcccgccttggcctcccaaagtgctggtattacaggcatgtgccaccatgtctggctcccatttccttgtcttcattgttgttggtttttttcttgttactatcacagtagaaaatctagcatgttggggaaagggtgtgactaagggaaaagagaccgggaggtcacttcgactatgacctgtgcatcagttaagatgttagtggcagcaagagacaagatgcccaaccacaagggaaccccaacactggagactttttctcatgtgttgggaagtctggcagcaggtggtccagactgtgttgctcaacaatgtcagggctcttggtggctgctctgccatcctcttggtggcagggtggctgccgcagctcctggcatcatatcctcacacaataatatccaaaatcagggaaggagggacagcttcttgtcactcattgttctctagttagaaaggaaaagacttcccagctccagccacagactttactttgcaggagaaagttcggccaggtttgcatctggaggctgggaaaatgattatctggcatttgagcttctgtctgccatgccctgcaaaagaagaggtgctggtttttctccagtcatccctttgggtccattctctgtcccactctatcctcttcctggctccgtgcccttggaggccaatcctggatttcatcactaggctctgcccttggacttatcatttacttcagcctaaggaaggcaccaggaggagataggaaagccagggagagaggctgggtgtttcctccctaccaaatgccacctttacccaaggccatgaagatactgccctttgtcaccttctgaggcattgttttccctccctatttacacctgctgtccacctggaaatgatttcccctctgatttttattatgaaagttttcaagtctaccgaaacattaaaaatagcttaatgaacactaatatccttccactaaattcaccaatagttaatgttttgccacattttttcaaaatatagatgtaaataggtagacagatcgtacattgagctgtacaattttgttttattccgaaccatgtgaatgttttaaacattttgacatttccctcctaaatatttcagtgtgcttctcctaaggataaagacattatcctaacaatgcaaaataacatcaattcaataatatcacccaattacacttttttgcttaaaatatactttcttaataatctccaatatttgatatttctttgcagctgacaaagcactttctctatcattatttccttttatttccacagtagcctctgaagcaactgtgatcagctcccttttctagatgaggaaaagaatcagagaggctaagtgaccagccaaggtcacacagctaatgtatagcagtctgggattcaaaggcaggccttccaaatccaaatgccacacactttctgtggcattatagccccttctcacaagtgtgttagttttcctagaacttagacccctaagcaattcttatatttgctccccaccaaccttcccatccaccaaaattgaggatcccctttccagcttcaaataacaatactctagtgatgctggtgattcacctgggcctctgtttgatgtgggaaaatgctaggcaatgcgtttggacattgcattttatttaagctagtgtgattgattacatagtatttcttaactgcattatgcctgattctcctctcattctctgggctcagagtgaaagaaagcgtccctctgcaaacccttgggtttatcctccttgatggggaggacctggtttatacttttcagtaagcaggtgagaacgagtgtccttgaagccaacaagggcaggatctctgactctccttcgcttaccagatctgcctcccagcatctctcgaatcagcccatgcctctccttcaccgttgccgctgcaccagttcaagccaccttgactcttgctgggaaaacacagcagcccctcacctggtcccacgtggctgagcatctcctccaattgacagctgaatctcatcaggctgccattccacccagatcccttctgtggggcccactacatgtagtaaattacagtgccaggtgtgatgtgtgcacctgtgtagtcccagcacctcgggaggcagaggtgagaggatcactggaacccaggagttcaaggctgcagtgagctaggatcgtgccactgcacttcagcctgcgtaacagagcaagaccttatctaaaacataaaataaaataataaaataaattaaattaaatataagaaaataaaacacacagtagaaggtgtgctgtggcctccgcagcctccttggtctggcctcagctggcctcactgcctcctctcataccatgcccccctccttaccccaagcttaggcctcattttcctcaaagaagcctgggtcctgtctcagagcctcggggcatgctttcttccctgcccctcgtttccaccccagtcacctcctgatccctgtgcatccttcagatctcagcttgagcaccaaccctgaagcctgcagctggatcccataagtatttccacaacaccctgtacttttcctacatgcaccccagcatcttcatacaataggtgcttaataaattgtccaatgactgaatcctcacaatatctctagagaagatggcaagatgcagagaggaggagtcacgcctgaagccacacagctgacatcagagccaaagcatgagcctcagtctctctgacccagagctaccacccttgctgccttgggaagaaggaagccccctcctattctatccttgagctgccttggcaaggaggggccccttgctgccgccatcctcacaggacaccatccacatgaggggatggtgagctccacttccaccttttctacatgtctgctctttaaactgcacacgttgattcattcattcattcattcattcattcccttgatattaccattcatttattcatcaagtatttattgagcatatttatctgcatggcattgtgctaatcgtaatcatcatattcaccactgctgagcagaacagtcagggtgctgccctcagggagttaccatgtagtaaaggagacagatggaatcacacagaggaatgcacgtctgattgtagcctgactggagtgccatgaaggagaccaagagggcagggtgatggagaaagcacaggatgaagttctcgtcttccttccaacagaatctcagttgcactcagttgttgcccccctcgaacctcccttgagcctcaggagaaaccaccctgattcagaggtccagagaagacctgactagcccaaggtaattccgtccccttgccagagtggcttgggcagggacacgggacctatttcaatgaggccaatgagacaaaggtatttctgctggggaggcaggggcttcaagcaaagggtcttgcttgaaagagccaccggaagagggctctctccttccttagggtgtcaccgtgtctggatgcgatgcctggaagtgctacagccactcgcgcccagcctgaagatgaaaccaaccccaaacacagccaagcagagagatggaaagaactaggaccctaattacaccactgagcagctatagcaaccagttccagagccctctgacttcccgccaaagtgagatgataagatactgtttaatttctctcttttatagccaaacacaccaaaattgacacagagatgtgagccatacctactactgttactgctccatccctagctccaaccacagtgcatggtacatggtagagagccaacaaacacttgaagaatgaatggtgcatattgagtgggattttccagaggcagacctggagacaaggcttcaagtgcgtgtgttgtattaaggaaatgctcccaggggacaatagcagagtggcagaaatgggacaagggggccagggagccaagaacagagaatcaatcgtctaaacagagccccctgttttttgtttcacctgggagtagcttctacctgatccccaggggaactctgggatgtcagtgacggctcagcattgcccctgaggcaagggagctgggctttcctaatcccccactcctcagtctctggctaagcgctgtccccaggggacttaatcacccaaacacttccccaagagtggcatctgctgaccactggaggcactggtacagtgaagcgacagaagggatcagagagggtccaggtggagcacagcaatgtggctgaataataactatattaattcatatagttaattctcaagcaatggcaaagtgtaggcagcttcttgtctgcaaacgtttccatgatatctctcctgcagccagacgggtcttttcctgccgcctacacagaatggccatggagcatccccaactcttattaaaatggaaaaaaaaaaagcctttgcatttcaatctattattgcactttatgactcatcttcaggttctctctgcaaaacattgaaagccagatcataatttgatgatgaaatattgattatgcatttgtatgcagaggtctatactatatagatagaattcccaccctgtagtatcttctattttaagtcagtatgaagatggatgttccccccaggcaaattttgataagatacttgtgtcaatacaaaaagagattaatgccaatgtgaatcaatacccgcttattggtttgggttgcttcttctccacgcagcagctggcaccaagaggggtttccaaacaccagcggctcccagccaatctgcatatttctttatttaaatcatgagagtgggaagtggcaagggaatggtgggttggcagggggctgcccacgcccactcccaaattgagaagggaatgaaaataaaacaaacgcaacttgtcaacaaatctgggagaagctttattaccatcattagcagtgtgcttgtcctctgctgcttccaaaaagaataaacttcaaatgacagaagaagagcggtctccatccttgctgggttctcagcgtacagcagggactgggcttatcttgactgtgcatctgctgtgtttcctgcccagcccccactgccacctgcaatgccctatatttagtgcttctttaaaatctcatttatcatctcccatccccaccaaaaagtaaggtccaaaaccacggaggattttttttttttgcgggggcgggggtggtattttttgttcactgctgaatttccaatgtctggatgttgaattaatttctttctgcttcattcattcatctaacaaattgagcgactactatgtgacagggccctccaggttcttgggatatatcagtgaacacaacagacattctagtgggtgatagggcaatagagataattaataagtgccgtatggaaaacattagaaggcaataattgcggctgggtgcggtggctcatgcctgtaatcccagcactttgggaggctgaggtggccggatcacctgaggttaggagttcgagaccagcctgacaacacggtgaaacaccgtctctactaaaaatacaaaaaattagccaggcgtagcccagctactcgggaggctgaagcaggagaatcactcgcaccattgcactccaacttgggcaataagagcgagactccgtctcaaagaaaaaaatgccagtaattgctatgagggagtggaaagcgatcatggtaagaaggattgggtgggctgaggagaggagttctaattttaaataggggggtcaggatcagcctcactgagaaggtaagtgtgagcaaagctgtgcaggaggtcagggaatgaggtatgtagctatgcaggggtgggcgctaggaatttccagacacatagactggctagtgcaaacatcctaaggtaggagtgtgcctgctttatttgaggaccagaaataaaaggaatggctggaggccgggtgcggcggctcacgcctgtaaccccagccctttgggaggtcgaggtggacagatcatctgaggtcaggagttcaagaccaacctggccaacatggcaaaaccccgtatctaccaaaaatacaaaaattagctgggcgtgctggtacatgcctgtagtcccagctacttgggaggctgaggcaggagaatcgcttgaacccaggaggtggaggtcgcagtgagccaagatcacaccactgcactccagcctgggtgacagagtgagactccatctcgggggaaaaaaaaaaaaaaaaggaatgactggaatggaatgagtggatgatgattggacaattaaattaaacaagtgagtctgaggcttccaggggccatcttgccccccaacctgcctctccccataagaagaataaactaagtacagacagatccagtctcttgctctgatccagctatgcctcaagcaacttctacccaacattttttcagtgcttaaggtaatataatccctttttaaaaccacttgtaactgaaataatcctgataaaacactgagactcgagtgcctaggacacctgagcttctgtgcccactgtgggatcttaacaatgtctgctggctggtcctgggcagcgggacgctcagcctcggagggtgaggcctggaatccatctgttcggggaggcctggacagctgacaagtgagaaggaacctttcaaatttgcaattttcaagtgtcagaaggatattatgccgctcctctgacacctggcatcttaggcagatgtgccccgttttctatcaacacgtctgctgtgtaaggtgtggcctttgcactcacaggatccggaacccacacctgagaatgagaactccaggtgttagcttctccaacaagtcacattggaaggaccaggcagacccctttccttcaattaccaaagttggtgacacaacagtttcaaaggattctattcaattcaacaagcgctttaagcagtggctcaagatgctagagggttggagaaacacatgatttggtctgtccccttaaaaagaagataagccagtgggcaagtgacttaattcatttcattcactatgtgttccatgctagaggcaagatactaggggctaggatggagactccccaaacaggcgaaagagatttgcatgtgagtactttgtgtgtgaccacttgttattcattgagcaaacatgaagaacttcctaaatgccctgcactctttgagactctaaggacacagcagccagcaagatgggcaagatcccagtccatgtagagcttatgtcctgctggaggataaaggtaataggccaggtaaggtggctcacgcctataatcctagcactttgggaggccaaggcaggaggatctcttgagctcagaagttcgaggcgagcctgggcctcctgagcccaggagttcgaggccagcctgggcaacatagcaagacctgtctctacacacacatacaaaaaaattagaaataaattagccaggcgtggtgatgtgcacctatagtcccagctattctggaggctgaggtgggaggacaacttgaacccagaaactggaggatgcagtgagctatgatcatgccactgcacttagcctgggagaaagaatgagaccctatctctaaaggaaaaaaaaagataataaagtgaaactcatttttgaaggagtgatttctgaaattgtttagtgcagtgaggaaaagacagtgggatattacaatggagagacgctgggcattgtgcagcaagacggagaagtcagggagggctgagctggatggaagtggtgggaaggagccagcctgcagagaagcagagcgtgtgctctggcagagggagtggcagggcaaaggccctgggcaggagcagggtcagggtcacagctgtgtggctggagttcagtgggccagggggagagtgatggaaggcaaggtcaaggtgggctggggccaaaccctgcagtgctttgtcagccatggcaaggatttggggttttattctaagtgcatctcagagtgccggcatctttatcttggggtgatgttggcatattcccaccaggataaattaacattctcaccttaacagatcattgggtagagactagaaatgtaccgagcagtgcgcaaagaagatgaggagggttctacagtttctccagatacataccatgacaatttgtttttttaaaaaagaagaaagcctgcaggtaagtacagccgaaagtaaagagggccacagtagaggagggaacaatgccacacaacatgaacagcaaggagggagcattccattctgagcagagggacgcgaggaggtggggcctgaaaggacacaggaggcactgaccccccgaggcaagggagatgtgccttctctgggagacagcggcttgggatggtggtggggcaggttccccggggaagacctggaccaggggctgggggtgggagttggagaggagagtgcagtcttgggagcagatttaaagttaagtggcctccatggaccccacatggcccagtcagtttggaccctcctgggagatcctgagttctgagcctaggcggtcttgtcctgcctctgctgagcacccgggccatggcagccatcaggatgcaggaaggtggggtcccctcccagcagctgggaaagcatgaaggaagttcatttctctgcagcagctatagtgatcgtgaggagaagtaactgaaaaggtcagacacacacttcacttacacagctcataagtcagtaaagaagcaaagcctgagacttcctcaggaggtgagtaaatcctctgccttgccaaggcctgcaaagctaggcttggggccggccagcctaggggagtggcttctcctgctctagctcccagtgccctctggcttggctttctgaagagagggctagaggagctgtgcctctagagttcaaaagaaaagtaccttagggagggagtatagggttgcagtcaaaagaatgggctctggactcataaaaacatcagttcaaattcagactcataccacttatttgctgtgtgattttgggccactcacacaacctctctgagctgtcgtttcccctccatactgtagggctgataatagtacccaaaccataagtcattgagaggattcaatgaagatcatacaagtaaaagagttagatcaatgcctaggttcccactgcatattggctgtggttgttatctttatcatttaaatcatttattattattaacactttaattgtacagcctccaaaatgacccctgtgatcccttccccctggtattcatgcctgctatttaaccagaatagggttgatctgtgtactaataggagattgtggggacagcagaatgtgacttccaaggctaggtcctgaaagatgctgtgactttcgcctgagtctcttggatcactcgctctgggggaggactgctgtcatgtcatgaggacactcaggcatccccatggaaaagtctgcatggtgagcacccgagacctcctacccacagccagcattaacttacctgctctgtgagtgaggcagcttggaggaagatccccccaccccagataacccctaaatgacagcagctcccaccaacatcttctctccaagctcatgagggagtgtgagtcagaaccacctagctaagctcgtgaattcctgacctgcaaaaaccgtgcgagatcacaaatgttcattttttttattgaagccattaagttttggggtgatttgtaatgcataaataattaatacaattattatactgaaaatttctcactaggaagtggccactcattaggcagccccagccttcaggctctgtccagcccagtaaaagtcagtcatttttgtgccaaagatccctgaaagagacagcatcatgtttgggtatcacctcctccagagagccttcttggccaagtcaagagcttttctccatgtgcccacagaaaggctctttgtaatcctctaccacactgcattgtcattctgggaccaatcatgttttcatctaggctttggctactaggaggctcagacccaaattttcaggccactgcgaagactctcaatttattcttgccctagtttactcatctatttgctttgtcctgttttgtgtgtcccttgtgtaaattatcacacatcctttgtgaaatgaggcggcatgaagcaagtccttgctgaaggtccagggcatggcaagagaacctgagtttaagaagcagacatcacctgctggcagcaggcagtatcctctcagtcagccttgatgtccccttccctggatcctcacttctcatggcaatctccccgtctcctcaggtggggatgggatgaacaggtttgattagcccttcactgtaaatgcctgtcctctgtcactgcaccaggactgatatggtttagttgtccatggctatcatccaaacttgaaggtggcacttgtaaggaaaaaacaaaccaacaagctatcctaaaaggaggctggcagcatgaggaaggggcttgccatcccctgtgccagtgcgggaagaccagcccaagtgcccaccccactgcgggagcagactcagctgtccccaaacctgaatgcaggtaacaagggcagcagcctgagcatctcagagcccagaggcagagcgttagccgattgcttccagcatcatctggggcacagtggggtcttggttcctcaatgggcctgagtggatctaactctgcgaagttagatcccaacagccatcacagtttgcagacaatgtcattaagaccatccagataacttcctaactccagttttgtgcccaccaagcatccttctgatttcaaattggcctcgcatgccatgtgcaactgggagagagtgtgtggacagaaatggggccaattgactatttcccttggctgtcatatttttcattaataaactaactctccagccacaaatacacactcagaatgcctcttgctactccagatcctccattcactgtgaaggcaatcatggggattatgaattccatctcccaggtgtggattaaactgcatgccaggggaggtttctgtggttccaatctaccccgcttagtacatcagagctcaacaggatcaggtcaaagctggaaggatcctgagagcccacagaaataatgactcctgtgctgaggttcacaggagtagcactggggtctgtgaattcttggcaaaaattcagaaaacctaagggaatccatgcattagctgataatgaggccatacagactaactaaagcatcagccacctcattaaactgggaagcttaatactgtttttattgcacaatcatttctaaatgtcttttattaataaaattggggaaatgaatttgttattctttaataagtgcagtgtgtttagctgacaaaatttttacaaagatggggatcaatgggttgcaagaatactaaaagatgttcttgttctgcagggttggaagcccctaagccaccatgcactacccatcattttacaaaagaaggagaaactgaggaacaaagaaacacatattttccctcaagcttcagattccctttaaactcttaggatatcccataaccccctgtagcttatggcagctagattcatgacagacaatctctctagagtcaatttggtttttctcttaactcactcaagcctctgggaatgaaaggtctagcccttgaaggctacttttggtagaagacgaggttcagtattaaaaaggaggacagaggatggaaaagaacacaactacatcaatagtttctccacattatttgatgttcagaacagtcccatgaagaagatataatattccctttctacagaccaaaaaattaatatttggagaggtagaaagaccacccaagggaacacatatttagacggaaagcccagttctgtctagtgtttaagtcctggcccattcagctactctgctctgtaactatcacccatttcagcaccgcggacagaggcagagccctcagtcttccctgtaggtgggatggaggcagagggtggtaagatgggtgctaagtcccagggaagatatgtatccaccaaagtgcctgaatgatgagagggaagtcagagctaaggaaggacacatcatggacatctctttacatgtgtatcaaattgcgttctgtttagaaccattttctagcctcccaccaaggacgtaaacaggacaagcactgtcatctgtaaagtgccactcccagactgccacccagagttcataaaaggctcagatgaatcaataggtgggaaagttatctggaatttataaaaattcactgttaaggagacgactatcacagacaaaccccaaaatcagcggtttaacacaatagacattttttctgacttgtgtaaagccccagacagggattgctgcctgtcaaaaggcctgactggcacttgtcttgaggcacactctggtgcccaggccccttgctccttgttgctctgccacctctgaagtggcttctaaggtcactgtatttatctgtgtcaagacagaggaaaaaatcatgaataaataaacccagggagatttgtatgagccaagcctgaaattggcacacatcactttggctcatacgtggaggactgggagtgcagaaagatgaggaaatgggtcttactgaacacagaaccacagaactctgtctccctcctctccaaagctgagaaattgccacaatcagaaagtgtgattcccatctgagagtttaagagcaggaatagattaaagacaaatcatgtaaaataccttgactcctagacttgccgaagcattcagcctgagccatctttacatgtggataatcttggatttcccaactgggcttcttgcacactccatggtagaacgtcagaggaaatttttttcaagcaagagctgttagatcatgagattccccagaaagatacagatacaggtatatgtcatattactggagattctaattcagctaccttcacaggcctgggaatgtgtttttgacacaggggcattaggattgtttcagctgcaagtgacagaagtctagctcacacggtcttaagcaagaaaggaaatgtattgattcctataagtgcaccaggatctagatacactgtcaggcacagctggatgcagactccaacagtctcattgggatacccaccctctcctcccatctctgaccatcccaggtggctcccttcatgggtcaaagtggccaccagaagctccagatacatctttttatcaacagccccaggagaacttctctttctcagtaaa

SEQ ID NO: 406 - DNA, 33780 bp, Homo sapiens
tttcacagtatgaccatctcgctgcactgagtgtaattcataatacagtgtaaaattgtatttagcatattaaattattatatgctaaacattaccgaatatattatacatttataaatatatttaggtatattaattttttgttttgttttgatttgtttttttgtaccaggacatcagtgagtacaggcttaaactcagaagttgcaataggctttgctactgttatcaatttagctgaaggacaaatagaggaaatgtacctagcacaccatcttaagctaagtgggaggctaggcaaccacctaaatacacatctttttttgtcccctcatctattcaggacaagtatagctactgcacatgagtaccaatgtgagttcaccatctttatatggagaacctgcagcctcagtttgctgccagtctttagcctttctggtctcatgagtcatccccaaactcattgttgtccctttccaggaatagtgtcacagatgggagttaaacagcacacaggtagacataccaactctgtagtttcaaagagctggtactgtaagaagacctggtagcttttgactcagttctatctctatctctatttttatctatctctatttatctctaaatctatctatcatctatctatctatcatctatctatctatctatcatctatctatctatcatctctatcatttatctatctatgaagagagatattaccaagcaagtaggctgtgaatacctctgtatttgcaatattttgaagagtactagctgctgtgaaacctaatctctaagggagttgcaattttgcaattaaaattaaaaatttaattctgccagttagttctactgagattctatcagtaaatttagccttcagcctggccgacgagaggttctgatttaattgggcaatagcaagataatttaaagatgcatgaagcactgtaatgcttctctggggagcacatgcgattgcttacttctttgtgcccattacacagaggcattcggaaaagaccggtcagagtttaagagaaaggtggtgctgcagcagattaagcactaccagcaccgacctgactaggggctttgctggccctgtcattaaggagcaagacctacacctgggctcctgaggcttcctggccaggaagattcctaagactcctgccctgggttttgaaggccccagccagccctaggttcttacttgtcaaagggcacacataaggatctcagtccttcacacttggcggttactgtggctgtgtgtctcgaagatggtccctgctcgccgctgggcaagaggcccttcctaaacgtcagttgtcaacatgaaaccagttttgttatgggcaaaatggtgtttccttctcccagtaccagcactttgctaaaccatatgtccacaggccacacaagtcttatttatttatttgtttatctttccagaaatgaactcaatggttctgctgagactcaaaggccaaaaaaaaaaaaaaaaaaaaaaaaattataaaagctgtagagtacaaatagtcctgttttaaaagcaggggggtggggccccgcctggagaacaaagccctactttgaagacttagcgattctaatttggagccatttcccactcccaattccaaatctgcatcattaaaccatgaaagagtgaagagtaataattgtgagcacgctgagtatttcttaatgattttctgtcttatacccaaagcaaataagccaaatgcttactcaaagcctagagggggagtagggtgggacttggttttgcaatttctttttttttttctatagtctttcttcttccactgaaagtgtctataaaatttttaaaggaaagtaggttgctaaaatgtacttaatttgccatgatagattgagtccatgcttcagtgactgtaattgaatctgtgacctatttctttagtaaagtagaaatagtctctggggtttttgtcactaccatcttttaatgaaattcaaaaagactgtcaaaatgtctacactttttctactggttgttaatgttattactttacaatttgttactttttaattaatcttaataaatgtgtacacactctacctggtcattggaaatgctagacattgattcttcactcttttaaagccaagcaaaattaacaggacagaaaaggcccggcagccaggaaaggtcttcatatatatttggttgcgcttttaaaaatattttgaggcatcagtttaaggatctgcctccaagaagagggggttgtggagagtcaacagcaaaaggctgaggggctctgcctgtggctgtcctcttgatgccaccactaactgctcccactttgcttaagggctgcatatgtggcaagccgacagcctgggggagcaatattttattgacaaaatgtaagagaaaatatgttcggctgcttttaagcagtggtgtaggagggtgttacagaaccagatggtctaagttagtctttcatttgccaggatgatgggaaagcactgccttgctctgcaactgaaatggtggtggccgctttgccaatggacggttggctgtgatttccagggacagttgttcttccagaagcaaagtgcccaaggctctgggtgagctctgaaattcatctcctacggtgtctggggtgggagtggggagaatgccttcaggtctttgccatgatggtgttaaaagggaagttttgcagcagttctcaaacgtggccccagatcacagcatcacttaaactattaaatctgaaatctggggatggggcccagcaatcggtggcccagcaatagttctgttgatgactcttttgtgaaccattagattagagaaaggaattaaggtggctggagcctggaagtgggggtaatggatggaagatgagtcacattagggtcagattgtgaactatcaggagtgctcatgttacctaactatactcaggactttgctatctctttgcctgtgatattcctttggctagaaagcatcatctcccacttcctgtttacctcttccctatctctatttttcaaaatgttagccattttccagtggcatttggagtgtctcttaccctgtagacttttctgactacttcaagagcatttgggctgtctcttcactgaaaccccaaggctgtgacttttcttgcagcacctagattttgctttgtttctctagaaaacaaatcttttgagggcaggtggtctgcctggtcattagtggatgctcataatgcctattatgatgcaagcaacacaagagatgttaaaatgacttttgaaacatagagatttttattcagttgaatatgtagacaaccaccagctaatctctattggcttggtaagtactccagttctcccctttgtctggtaatcaaagtagacttccactcatgaaccaatgaatggatcacatggtcagaaggttctagaaacacaatggttcagtttgacacacacttactgagtaggctgccaagtctagtgctaagtgcttggagataaacaaaatacagtccttgtctttgtaaagcacacatttctaatggaaaaagaacacataatcagatcatttcaatgtcctatgataagcagagagctacgcacaaagactgatgtgagcacaaagcatgacctccctcagataccactctggaattacaaacaaaggtttactgtaaaaaaaaaaagtatgagttaaatcttgaagaatgaggaagaatagcaaggaaaagagagtatagaaggaagttctaataaagagaacagcacaaaggcatggaggtgtaaacagtgtctttgtaagagggggagggccttatgaatggtgtgtactctggcattggtagaccataaatttctagttggagactagcagaaggctatgttgcagagcagggaaccagtcatagagggtgttgtagtccatgctaggaaatttggaatttattctggaagacttagagaataacaggagtagtggttagatttgcattttaaatagatcattctggctccagagggaggaagggttcaaggggatgaggctggatggtgacaagagaggacaagatgagccctgggcatttgcagatttccccagggacacaaagtagcattcactctcaaatcaatgacaacaatgagttctttctcattaggaggaaaacctaaacagagtacaagtctgagtgagacgcggcaggccttgctcctggtaaatagaaggatagccaggctggtttggataagaataagctcatcttgtatgagtggccactctgccccacctcatttgattaacaagaatttccagcctgtggacttgaacctaacagaccatgatggcttgaacaggcattcatcaatcactatatctccccaaacctccagacagactgacttggagtgataacaattccctctctcattcttgccatctacacatttataatttcctagtacatttcacttgatcagccaaatagccatttttttacatactttcctatagcaaatgctggaaagaaaaagaggtgttttcacctgcctgttcttcataactacatgcaataataatcacagcactggcattgctgctgagtaatttaaagtcccaaaggcagtttgttcccataatcaggcccctgaggtcctaggtgtgtggagagagaaaagaaaaatcctgaagaatctcatcactcaatggaaaactaacatttaaaatgtttcttataggattttgtggtttagaaaatactcatcacctgcattgtcctaatgatttatgatgagtgggatcataatttgtgagtgctggtgtcctctgcaggaacacaggcttaacatcttgttcaagggtaccagttggtaagctccagaatttaaacctaggacatggattctactgccttactctgctcttcacgtcacactggagcagaataacttgactcaggatggttggagaaagagaggtggaagaaggctgagaaaaatagtgaagatggaagactttgttttgggatctttcagaatctctactctcaagtggtccattttcttggactactatccagagataagatgagaataaagagacaaaaaaattgacttcctatttaatcagtgagaaaccccactacctattcaaattctagtttagcttcaagacctagcacagactcgtaaaccttctttcactattagagctttcagtcacttacttttccttagaacctatggaaagagatggcagacaatccagcatttaatgacatcctgccacttgctgtttactgttagctgtgcttcatcaacaatactaaaacctctgctatacagaaaaataaatccaccagagtggttgagtcttccagataactgatggttttctttcttaggcccgagcatttttaaaagtgcaaatattttggcaggaagcacatttatggtatatcttatacgtctctgtctttttaaacatgttatgctaagcatgtttttgccatccattattgcactgtgccttattactgggtatccctgtacttaatgccctgatagtctgaagtgtattgtcttttatctatttgtttttcaaatctcctcttactggggaggctttcagccattactgtgcctccaatgggaatcttattttttttttccttcactctgacacgatctcagctcactgcaaactctgcctcctgtattcaagtgactctcctgcctcagcctcctgaatagatgggattacaggagcatgccaccatgccgggctaattttgtatttttagtagaaatggggtttcaccatgttggccaggctggtctcaaacgcctaagcccaagtgatccaccttcctaggccttccaaagttttgggattacaagtgtgagccttcgtgcccagcctctaatgggaaccttctctcaccttccaactcactgctcctaaagcatcatgaactgggaaatcggaaagtcatgattgttaaacacatgggcaaagtatgagtaaacaggtctccagtcagggccagaggaacaatttccattatttgggatgatcaaaggtttgatcaaagattcatatctcttaactatttttagttggagaaatttcctgaatagctgagctctgaataggggaaatgtttctggcggtaaaattcatcaggtaatgtttttacagtatccaactcagtgccgagggcacagcagacactaaacaagggcacagcagacactgaacaagttacttggtgactacagtgtcctcaactgcaaaaagtgtccaataatgaccaatagagtatttgcatcacctgctattttgattgccctcaagatttcaggcagcatcattttgatatggtatctttgtaagcaaacttaaattctctttggaacatgagtacgtgtaagcaaaatgatgtggtccaactaactttgaataaatagtgctgcaacatccaaagacacaatggattgagtaacctctaaatcaactgcccttataaatgaagatagtcagtgttaaacttaaaaaaatctgaatgaatatgcatattatacttaagattgttctggttaatgtaaagaacaactgaggaaaagaatgaaactgaaaaaagaaaatgacatccaaacctttcttcagacagacaacctctgtgtcagttttcagggttcgtcatactgtttaatttcaaatctttatggagaggatatggggggaatatcaataaatggctcaagaataatttttcttgttctgttttactttattacatcattgtatcaagcgtagggtatcagtgagttttggaaattatgccacccagacaaaccagtgcagtgatgacgatggagatttctggctcctgtagtctttgcccaccctcctctgaacctgctttttagaattttagaagaattgagaggaactctagaaactacagctttgaccattcaaaggctatcatctgggaagttttaatggctacatggctagactatcatatttttgccccaagctactaattgagtctcaaaggtagcattcagcatcctttcctaccgagatctcattatgcacgtgtaatgtgagtaaacaatgagattctattaaattactttcctccccttaaattagccttaatacagaaagggaggagacagtgtgcttattcttacagagatcaagtaattaattttgtaggttctatgaaatattgaaggaaatcatgcaaatgaatttgcaaacaattagagcagaaactactcaaatatgtgtatttatggaaaaaagatataaagtgaatacagatcagttcattagtctcatggagtttcttcatcatggtaagagtgttgtacatgtgactaaagtgctaaataaaattttagatagatgtttattaattgctagatgttgacttttacttttaaaatcactttcagaaattctaacattgtgttcggttaccattttagtccaatctcatacctagaagaaattgtgttcataaccataatacgctcccctcctttatttatatagaatttcagggttttcaacttacttcataatccagggacattacaagcacctcagttagaaatgctatatttttgcaaagcaaagcttgaaacaaaaatattttgtggttaaacattcattaactagaaaatgtaacccacacaaaaagcacaaacccagagcatatcagataatcaaggtttaatcaaggtttattgtagtatctattatttaaaactagaagctaaatacataagagcatctctctggttttgtgcttcaaatatttatacacgtgtttccaaatgctccagcattagcattagggaaatataatttacagaaggaaatatctacatattgctcctgtcaacttctgggtattttccccacaatcgtttgaaatcacttgaaattagtcttgtcagcatccaaccttgaccctaggacagggtttcttctccttagcactatggacattgtggactgcataattctttgttgtggcagtggctgtcctgggcattgtaggatatttagcagcatctttagcctctacccataataagtcactagcatttctataggtgccagtagcatgtctctagatattgccagatgtccccggaagaacaaaaatttctgacacaaaataatgactaaagacatgacatcagagatctatggcacaataaagagagctccaacatgtatagtgactggtagcttatggcgtggggagggatgacagaaaaagaaattaaaatacatgattagaagattcctgaattaaaggaaagaaacacttaattgagaatagaaaggcctgttcacatcctgaagaaacaccaagatgtagtttggtaataaacttcaaggattaaaacaaaacaaaacaaagatacaaaggagaaaaatattctgcctcagacttaaccaaataaatgcgataagattatcaaaaaaaatttctgtttatttgggtgagttaccaaaatgaggcattcttctttgcttaagaagtggggcccatgacacagggggagactctactttgttagatcgctgctcaaattctggaccacaaacttgggcattggtggtcgttttctattcctagtggatacccccagtggattcactcattagaggttgtctgaatgcgtattatttcccaggagcatgtcaattaccccactctcttaccaacaatgcttttatatatggccggaagtgtccatttttatcttcaataaattttaatatttactaagcttgtatcttcactcgttaggaaagagcaggcttttgttgattaattgcgcattccttcttcttatatattgcctcagtgcatgttgcccattttcctaccattttctttattttttaagttggactgcagttgctctttgtgaactgtcagatgcgttgagagaatgggcttctccggagtgtattttatcttttgaatttgtttctggtgttttgctgaaccaaaggttttcatttgaacgcgttcaaatccttcagacttctccttcacagcctccgggtatctcatcttccttggaaaggtctttatatcactctgggattatgatattcttatactttcagtattaacatggctgaaccgcaaccgatgacaggaaatcggatgcttctgacccagtgagcagaagaaccctgggaaaaggatgacatttttttcaaagggctaaaaatataaaacatacagaccaaacagcagaaaactgaaaatccaaggtctaaggcagcgcttcttgcctacttgtaatttgtgaactgatagaaaggacacagaaacataccttaaggtccactatcagttatgctgccttatggtatattatgcatgcgtgtctgcacatgtatatacacaaagttggcaagttaatgatgtaaataggctcttctacatgcctagaaagagaagaaactctgactaagcccataattctttccaatttggcattcttctaagtacccaataccaacatcccatggtattcatcatcaactgggactctcagattaaacttttttgattctgaaattttataaccatctactctattcccccttctttccccaatagtctagtaaaagcccaaaatagagacttttctaaactactgctcctgatctcaaccccctaccctacctccctggattaagttcctcttgattgatggagtttggttgtctggattctgcaagctcagctgtcccaatttatagtctggctccaagccccacccactgctgaatgaccaggggcagtgtgatgttgaacctaaaggtctctattgtgacatacgtagctggtacaaaagaatgtttgcttgccctcttgaaggtcttgaacactgctggaagcctactagatatttaatgtaatcaccatgataatggctaagatttattaagcatctgctatgtgctttatggtgctaagaacttctcatgtatttactcattgaatcttcacaaaaaccttatgaagtaggtaaaattattatattatcattccccaatttagagtataagttaatgaaagtcccaaataaaaataactcaaaaagccttttccaaaaaaagggagaggatccatttgatccattgtaagaaattctgtgatagttatttatgttaaacttggctaccccaagcaatgaatgacacagtgataaaacagactcttgtctggagcttttcaaactgtaaatgattaataatgttcatttcttactaaatgccttgaagaaagcagtgccccttcatgagggagataaggtatacatagaaaggagcagagagtggaataaaaggcagggtaaatcactttaacacttgcaaataagagaattcaccaaggagggcttggaggctgttaagatttcctctaagacaagtctcaccttacatcaccactgggtatttcctaaggcagggatttcacccattccatctttggactagcagtgtctgtctcaggggaatgaagaagagtgggagggatgatcccatctctagtcttcacatggactagaaataagtgttgtgacataagagcttgtgaaatttctttaattcccccaatattatcactgtttggttcatgttcttatactatgctaattttcctataggaaaaaacagtaagacactcaaaagaaaccatttgctggttttgagaggcaatagaaagggtcaggtagataattctgtatctagtgccttcattttctgttactacataatgaatgactacaaacttagtggtttaacaccataaattcattatctcacaggttttgtgggtcaggagcctgacatgttttagctgggtacccacaaagctgaaaacaagatgttggtcatttacataatcatctggagaccaaccagataaatgtccaccaccaagctcccccagattgttggaataatttattttcttgtgactgtatgactgaggtttccattttcttgctagttgttggccagggacttctctcagcagctagaggttgctctcaggctcttgtcacttggccctttgcacaggtagtttagcatgtgactgtttaatccttcaagacaagcagaatttctgtttctttctttataaatgtcctggcctttgaagaactcatttgattagatgagacccatccatgataatctttcttgtgattaactcaaaatcaacttctctgggaccttaattacgtccacagaatcccttcacctttatcatagtatgcaacctaatcatgagagtaaacagcgcgaacactaggggggcaagaattgtgagaggcatctcaaaattctgcctaccatggctgtggacccagaactttattagggattagaggatgcaccatgagaaagcaactcaaatccttgaggaatgcagagagaaggcataaggacataagggaggtggtggcctggaatgagacagacaaaactgtgtttgcctgccaaaggtgtccctgctgtatctggaatgcttcactagaagcagaaggaggagggagctgcaggaaaagttgaatatttataactttcagactaaggttttcttctatatctggccactcatcctaagaagaggaaccacatcactggctgagcccagacctaggagggcaggttatcttatcttgcattgcaactctgatcaactgatagagtctgcatgcagtgtcaccttgagaaatattctgagactgtgttgtggttcagcaggaaagagtgttgtgcttgattagctatgtctttcatgaactctggatggtgaatggaagtatgttgaacaagtactggttattcatgacttagactgtacacatcacccgaagacatctcaacaaatattaaaacaaaatacaaatgcttaggaatatacactgtatagaaaagagatgacctttataagattgttttgaggactaagctctgatttttattttatcttgcccaaattcctatctaaggggtctggggagtcatgccctacaaaccatgaattctcatcagatgggttttatttaaccctgtatattgtaatttactttccaatctgactctggcataacaaggaagaaaatcaaaatgttttaccccagaatatatttccttgccataccttgaaattgtcctgcaaagtctctcgtaagaaaaatccacattctctagagaatcccttttcccctttgttttttttccccttcctttccagatccaggagacaatcaactaagagctaggcacccttttaggtccgataagaaacattttacaacctgccctctctgaagtctgctatctgagagcttcctcctcacaataaaacttggtttccacagtcctttatcttaacctgaacatttcctttgattccagatcttcagataaactcaaccaattgtcaaccagaaaatgtttaaatttacctatagcctagaagcctccacattttttcccacctttctgaacaaaaccaatgtatttcttaaatgtatttgatgtctcatgcctccctaaaatatataaaaccaagctttacaacgaacaccttgggcacatgttctcaggacctcctgaggactgtgtcacgggccatgagcatatttggctcatatttggctcagaataaatctctaaaaatatttgacagagtttgactcttttcatcaacagtttctttgcttctcatcccccaaacggtcattttttctacttaaagtctcccattgggaggttgtttacttatagacccaacccatacacgatttcttgggaaataccaggtaaatgtaaaaatgtacagacctcaaagagtgatgaagtcataaaacagaaacccttcaatgtttgaaaatagttttataagagtgaacagtctatcgactcaccattatgccaccaaagcaatatgtaaatgtgtatcttatttcccagtgctgcttagaagccacagaaagaaggaggtgcccatattaaagaaaggattcattgaatgacttcctgaagagtcggatgagccacatcccatttagcagatagagaaattcagggtcatgtctgagtctgtaggcctccactagatcttctcatttgatcagatcaagtctcctgagcattttaatattgagaacatttgcagtcctcgttggagtaatttctgctttcccattccttggggcttggcaagaagaagtcacctgatttttacaacttcgtggcattttcccaatcatgaaaatgccctcatgtttctcactcatacaacaaacaaaggcaagaaagcaaatccatctgcagaatagtgccatatgaagctagattaaaatgctaacgggtgagcatgcacagagaaaacagcacactgccgagggttaaagaaacatggatttcatccagaaaggccctttgcaccacagtctctactacccagctctgtctgaggggctggagacaaagaaagtaagatagaagtggataccaaacttttatgcctcctagtcccagttatagctcctttcaacactttggtttgttttttcttggaatgaggctatgtaaaccctgaagaaacagcgcctggcaatgctttctcacagaaatttcgccccttatatttcttccccctccaaccctttatgtaatagaactactttggtatagacaataggttgcaattatccttcggaactgagcaaggaaagaatgcaccaagatgggcacgggagcaaaactaaacacatacccttaaaatactaagcagaatgcatgcctctgatattctcatcactcctgagccaaattatttagtttatagctattagatgcatcaggacagttcttctgatccctgtgctattccttgggtatcgaatttagcaacaacatattggtgaattaatttcaaagatctttgggagaaaacagaattgaatccagtgaactcagggatgaataatatccctgaatttggaaatgaaatgtgtttccattaagaaattgcttcagaaatgaagtagaacaagatacataaattccaagtatctctcttaacagaaagacttgagaaatgtgtttaaagaaacatattaattatctgtagctattctaaatgcttctaaaaacaaacaaacaaaatgtctatgcattgtgccattgtgtgtttattgagtaagcccaagctcttacttagtgtgcattgattctttggttgccatggcagagggaatggtttctgtgatatgacagcagttgccatatgttcagcttcaagccaactgattccatcacaaaaagaaaagagaaaagaaggagatgtgcagcctcacctattccaagggtcctaataggaccaagttgtcatataagcttctgttccgggcctgacagtgaatacatgccatagccatgtcctttatgcaacatatttgcaaaagatttttacatggaagccactactccagtatcccaatcagcatctaactcagatacagtcttctataagttaaaacatggcctatgaagcgattttttaaaagatttgtagtcaagaagagacacattctttgggggaggatgaggcaactggagtcgccaatgaccttagagagctggaacttgagacacacagagggaatgtgtgaattctaggatcaccaatggaatcaataagcttttacctgtaggggataaatcctggaagaattctagagtttgaaactgtctggaccatttgaagcagcatctcagagggtgagttgggcatattcttgcccaactctctctctccataaataattccaggctgagtgtttcatggtctgactcattgtgactatcatgtatgtggttatgttgccaattaggatgccaatattcccactgtcagagcactaatgagtgtttttagtattcaagagattactttttggtattcttccaaggtcctgtgagtaagttggctattcactgatagagaaatttatttttttctggaactttatggtatgcattattaaatccttgctacaacaatctaaatgatccttgagggagtcagagcccttccaactgcaagcaaaggacttttgatgttgagatatggccccaatggtgctcttcagtaattcctattttctttactatggaaacctgtaagaatatccaaactagcagacttaagctaggcaatctacactaataatggttttgtctttaccatggttaaattgtgtaaaagttgcagatggcaacgctgagcactttgtacatatacacaataacagggctgttattcttttatcaggtcaccaaatcaaccagacagcccactccacatatgggcaaatggcttgaagagacacattaccaaagaattcccaacagtcaaaatgtgtttaatcttatccacatacatatctcaacatatcttaatatccatatccatatctcaataaatcaaaaatgtgtttaatcttatccatatccagagaaatgcaaattaaaactatagaaggataccactatgcacccaccagtttggctcaaatttaaaagttcagcaacatcaagtattactaaagatgtggggaattcagagctctcatatgctgctggtaggaataaaagttgctgccgacactttggaaaacagttgcacattatccaataaaattaaagaaatgcaaaaattcttacctaacaattataccctaaggtgtgtgtacaactgtctatttacaccaatgaggatgctcccagcaccatagcttgtaatagccccaaacagaaatttcccaaatgcctatcagtattattgacaattggcccaaaaatccatttatcatcattgaaaatgaacaaactccagttacacttaaggacatagtaaacttgatagggtggggggagagagttgctatcaagaagagtaggcagttggtggccacacagatttttatttgttatgtgtacgtataagtttatatctggatttcattttgtttggtctggcgacagtatttgtattgtctgccatagtgaatgaagtattggacatctaactgttcttatcaaccagatcgtaagctcttgaagaagaaatatatatgtgtgtgtgtgtgtgtgtgtgtgtgtgtgtgtgtgtgtgtatgtatatatgtatatatatatacacatatacatatttcaatttactctccagtaagttatattttccagtttaaaagaaaaatcagtatccaacagggaccatatgttcagcttcaagtcaactgattccatagcaaaaagagaagagagcagaagttgctgtgcagccctacctattccaagggtcgtattagcaccaaattgtcatatgggcctctgttatggacctgatagtgaatacttcttgtgatagttttcacttcttgtgaaaactttaactaaaaatttggaatgtaattcaaataaatctcagtagacacataggaatgtagttttcatttatctattccaacccttattggatctgcttgtttgtgtacctaacaattctttggggtaatgagtgtcacagagacacatgtaaagaaaaattgaccaaaagacagttccgagagctagggttctttagagaggtaaagaagaagagaaatgttattgcatccttcttctgtgaggtggcagtaactcgagagtagaggatcctcgtcaaaccatgtgtttcctctgatgaagtcttgttatgataattattatcactccagagatgttgataattatatttagacagtttttaaagcaatattgtataatatttttccccatttaacaccagcatcagagctgatgaatactcagtcagaagaaatgcaggcctgcaggtttgtccacaaagtgttcccatcaaccgtgtaagtgagtttgataatttatacattatattaggggggaaacacactcttttgcaaaggactggttcttggcgcataatcagttcccattgaatttaaatgacttttggtcctacaccaatgctgataaaatactttcaaatgtacagaatattaaccaaatgtttatattaaacaactcctttcaggtgaaaatgcgctcggcgaagcatagctccctggagcaagttagtgaatattaatgtttagcacattataaggctctacaagtactctgatgttggaggccaagggggagataaacgagcaaggttggtgcgtgggccctgccaggggaaggtacaatcacattggacataacctcaccgagatggaaatggaggttgaaatacatgcaataggggctgctaggaactaggaggcagatatggactgagaaggagagtaccaggctctcctgcgtgttccccactcaattcccccgaagacctagtctggtttcagacctgcccagggtcccatcagcagagagatttatggggcatgcctcataattaataccagccaatttccagttaatcatggccctcgatttcaggtaagtgaaggctgcttatcatgagaagcattcggacttagttaagtgctacagtatttcaaatctgccaaagcacaccggccatttccaatgatcattgtttatctgcaggtttcaggaaatcatataaatatgcaactcacagtgcatatacacatatttcaggggggaagacagctgttatcaaccaggctgaaggtcaaaacgaaaattcttttgcatatctcttggtgggtaaaaggccagactggggaccttgagacccagggacaatgcccagctctgaataggacatcggtggtatttcagtgagctagctcacatcttcacttctgttcctccatccataaaatgaggatatgaatatttcaggtaaccaaggtgaagtgctttaaacagcttggaagaccaatgctaaataagcatatggtattattttttagtcttgtgttaataatactttagaattcaatgcatgttcaacattttgttgttgtggttatagtttaattttatattttagtagctacttttaaaattagtaaggctaaatcttctcagatttattgaagttccaaatgaataatgataaagggaaaccaaagttattattcccattttacagataaaataatatcaggcctgaaaaatctctctctagaagatgttgtatgcatcttatagcctctggaatggctctcatataaatcatcctaaaatattggttctaattttcaaacactattttcagaaaagcagagtacagaattttccataaaattcaattctaacctctctacctgtatccatatctttttttttttttttttttttttgagactgagtctcactctgttgcccaggctggagtgcaatggtacgatcttggctcactgcaacctccatctcccagattcaagtgattctccctgcctcagccttctgagtagctgagattacaagcacccaccaccacacccagctaatttttgtatttttactagagacatgaattcgccatgttgaccaggctggtctcgaactcctgacctagggtgatccgcacaggcgtgagccaccgcacctggcctcatatctattgaagacttgtaaacttgcagatcctgacaccatagaacctggtcacacagtagccatgcttggcacatgaaataaatgttagggcctagagagggtaagtgaccagctcaaaatcaacacagctaggacctgagccaggattacaacccccattcgagtgtcttccttactatgttaaaccccgtagagtttgttctcaatcaagaatccaccatggcttcatgctttgcttgattgcaaggcagacacaggacaaccttcagcaaattctgattgagtagcaatgtgaaagctggagtagaaaaacaaataagtataagatattctcccttcttcttaaagagtttacaacttggttgagaaaaatgttaggtgttcaatacttcattcactatgggagacattacaaatactgtcaccaggccaaacaaaatgaaatccaaacatgtgggagtagactagtgatttccaatgtatgttttgaaaaatagtcccacaagattggccatgcctaagtaagtaagtaaataaaagtataaataccttttatgattaaataagtttgaggcatcacacacattgtagagtcacaagacgcaaatggattcaagtgctctgagatgtcccacagtaaaggaacctattgaataatttccagttttgtgtttctcagactcataaagccttttcaaagctttcaattgacttggccttttcttacttcatctatggaattctaacctctaactgaaagtgtaactataattttatgtgcttcatgtcctggtcatcttttaatcattggctcttaatacaatgtctagcatgtggtcccttgcatctatttgttgaatgaatacatagcctgcttggtgctgtgatggagaacaggatcactaagtcatgttctttgtcctctaggacggctctctcaaatgttactgtctatatgaatccaccttgggatattagtaaaatgagtttctgatacagaagatctagaaagcgcctgaaatgctgatattctgtctcccaggtaaatccaatattcccagccccagggtcactctttaaggccatagtagatatgagctctcactctagcaagagatgtatgccatgaaaagatgtgacacttgtcaccatagttcaagagcagttctggccaggcacggtggctcacgcctgcaatcccagcactttgggaggctgagatgggcggatcacgaggtcaggagatcgagaccatcctggccctcatagtgaaaccccatctctactaaaatacaaaaaaaaaaaaaaaaagaaagaaagaaaatgagccaggcatggtggcacgtgcctgtagtcccagctactcaggaggctgaggcaggggaatcgcttgaacccaggaggcggaggttgcagtgagccaagatagcatctctgcactccagcctggcaatagagtgagattccatctcaaaaaaaaaaaaaaaggaaaaaaaaagtacagttctatgggaagaccagggtagacatgatttattctgcctaggcgggtagggagacagtggaggaggatcttgtgaatgtcatgggaggggtgctttgagatgagctttaaagagtgactggcattttgccaggcagaggaaggaaggacatacaggttagtcaacagcatgaactaagtggcagagcaaagtactgtgtcctacacgttcaggaagcagtgaggtaggagcacgtagtactgagggagtcaagagataaattgtagaagggacattgaactgaattgtgttatggtttggatatttgtcccctccaaatatcacattgaaatttgatccccagtgttagagatgggacataatgggaggtgtttgggccatgggggtggatccctcattaatgacttggtgtggtccctgtggtaatgagggaatccttacttctttagttcatgagagagctgagtgtttataagagcatggcatccctttcctctctctcttgctccctctctcaccatgctacacaccggctcctcttcctcctctaccatgattggaagcttcctaaggtcctcaccagaagcagatgctggtgccttgcttctaatacagccatacagaaccatttttctttataaattacccagcctcaggtattccttcatagcaacacaaaatgaactaagacagcattgcattttaaaagtccaaatgttgaatagtagaattccagaaataataaactggcaggaaagaaactttgataagtgggtagaaatcttcttgctgccctttcatgaagccatgtggcctgcatggacactatctgctcctggatttagccctgctttcaaattttaatgggatgtcagtgaggttttcaaaatgattgataagacataatcaacccctttcactggttgaagattatgctgtttttaaaaagcacttagcatttcaagggttgttttataggcatctgcacaaacctatgaagcaacaaactttatttagcagttatcgacagactactactgcttacagggttgtattcttccattctgtttcagattttagcccagctgttctgggatcttttatttcaaaaactggaaaaccagggctattaatagagtcaggcagctaatttaaatctgataatgtgctgacacttggctgcatacttcagcacagatgcccatgtgtgcaatgtgtatttatttctgtacaaatgtgtacatgcatatgtataaataacagcaaatactatgaagtcaacacttattatttaacaggaccacctgggagttatcctgtgcctcataaatagaacactatttgacatgtaaaaatcttctacaaggtgattgaagcctgcaggtttaagggtcagagttattataagtgggagcattacagacacacacagtacttcttctggatggaagagagacccatagaagaccagaacattttagctaaactttactttcctcatatgccttatactgtaaccaaattacttactattgtccatacatagtatatagttttcttcatcttgcttatgttattttctctgtgaattagataagaatctgggctttaaaattagctttgggttcaagtttcagctttgccaaattctagctatgcgatttggagcaaattacttactaaaccaagtctggcctctcatctgtacaatggagccattcattttatttacattgaagggcttttatgaggatcaaatgagataatgcaagtaaacactcagcacaatgtacaaatctgattcatggtgacagaaatcagagtgtttttctggagtgaagggtcatgaggtttcacttggatagggacataaggaaactaaagcaataaatatcttgtatcttaatgggggtggtggttacacagatatattttccccatctaatatataggtgtgatgatgatggtggtggttattattattattctcccatctccatatctaaatgctatttatttttcaaagtttagctcaggaaccattttttttttcatgtagttttcacagtctccgtaattggaagagatctcttttactttgaacttattctttgcatttctaagatacagtcttcctggtgttaagatttagctctttgtatgtgtctcttacctccactagcttgcctgtccttggtaaggtgtctctggatggtcttggaatcctgcatagtatctagtagagatctatttactctttatcctcccattaaatcattgtgcaaagggtgaattcagtgtaaccctacatagaactgccttgaacttcattctagtacctcaatacatccaaagccttctccagggtttccacaagcaaagtttcctcctggctttggctataatttccatgtatgttgactctgttaccttcatccagtcataaaattctatgctactttttataatttacacaagcacatatattcaccttaggcacgtacgtgcgaaacaaactttactgaagaggtggagagtagggttgcaaagatgtgggactcatgccacagcagtgccaagagcaatgagcaaagccagcctgttctcacacatctcccagcctctctgccaccagaggctttatgtagctcttcagccttgtgctgcacccagatttccaccatcaccctgtctcttctctgttcctctttgtcttttctccttcctctcaggaacagaaacaaattcctttctttgttgcaggtggaggagttcagctattaccttgactttgccgaagtcctaggcactcccatgccctcagagtctcattttgaatccaggcacttagggatgctatttttccacatcaaacagcttcctcccagccaaagaattctggtgacagtagtgaagataattttcactcctgcttacagaatgacaaagcaaaagcaaagaggagaagaatgaagtaaagacaaccaaaggaaaagactgatggctccttaagaatgatcttgataaaggaatggtggctgaggggtccatctcctaaaccacccaccttactgactccctagagcaatgccatacagaaagctgcaccttgaggggaagacacaagaatcctggagtggaaaaaaattgggtaatgatgacagccttcgaggtcttgagagtaaagcagaagcaaaaaaaaagtgttatttttatcttttgaagatggttccctcttaagacttttgcgaatgattaagatttcaattatgttccaggaaaaaaataagatttttgcttgacaaaaaaaatttttgtctagaacaggtgggaaggaagagatagtttagccacatccaagagacctgtaaattgggtacagtgaagtgaatggtgtaccagtcataaaagaatgttaactggagaagtctctgctgtcttcctgtaactgaggggggtgtaaccatccttgtggaagcgtccacttttattgaagattggctaaataaatctgtgcctactgaaactcaagccatttcaaattggtctgtacttatttaatttattaaatctttaatacataatattgagcacatattatgttattgacactgagtacaatagagaatgcagtcaggaaatgaagcaaccttaaagaccagaggctgtcaaccttgacagcatattagaatcacctggagaaattttatgaccttgattcctaaatcacacttaagttcaattagtcagaagctaggggtggtacctagccataagtagttttttttgtatgtgttttttgttgctgttgtttttaattgcaactcagtattgagaaaaaaaaaacatggagataagagatgactacatagccgttcactgtcatgatggaagattgtctaacaagcctacccaaagactatctaattctttaggggaatgtaccttcatttattttactatttagtaggatatttacttaggatattacacaactctgtaaaagcagatgttgccttgcagaacaaacagaggcccaagcttattcaaatagaatagagcttgtgtttgtgtaattctaacaagttcttgggtgatgctgacacgtgctgaagtttgacaactattggaaaagtctgatagcaatgcaatagattctggtacaataacaatgcaaatacttttttcactagtagagctgcaaataatttctgtctaattccaagattacagggtttttgctccatagaacattaaccagttttgtatctcacctagcaatcttatttcagcattctttcaggacctatgtctacttggtctttctagttctctttgaaccagttgaaacttatcctgctggctccctccttaaatgaattaaataactttttggcaagtagtcattgtacatttgtatgagattcaagctttcaacttttgaaaattatactttgacaccaggtgataccaatgtgcatccaagattgagattcactgctctagagagaagccaaaatcctggaaggcatccaaagagaaaccactgttttctctatcccaagcagaatcatataattattcttgaaaacttttatgagtcccacctgataacaataaaaattaatatttactgagtgcttactagtgccaagcacgctattctaagacctttacacccatgattaagtcctttaatcattacacaagcttataagagaggttctctcatctgcataccaatttcatagatgagagaactgaggcacaaaagtttaagccacttgtgtatactgacactgttgctaagtgacagagcttgagttcatacctaggaagtactgcctgtgcccttcagggctaagacataccgtacttcagggattgaggagatctacctttagagttatttatccagattcatagacacccacaactggatacctgaattactgaaacaatcaaagccagccaaaaatgcatactcttttttgtcttttttttaacttagatttttaaatttttcatttttatggatacatagtagatgtatatatttatggagtacatgacatattttgatacaggcatacaatatgtaatgatcatatcagggtaaatggcatatccatcacctcaaccatttatcatttgtttgggttaaaattttttaagttataatctttctgttatgttaaaatatacaataaattattgttgactgtagtcaccctgttgtgctatccaaatactaggtcttactgattctatctatgtttttgcacccactagccattcctactttttcctcctctccctgctccccttcccagcctctggtaaccatcattctaccctctgtctccatgggttcaattaacatttgttttaacaaaaatttacactcaaagttggtttctttggcagggctatcacgtatccacttattctttatcaaaccctcatattaggaatcatcttcattagggcaggtgactaacatctccgcatgagagtatataagtaaattaggatgtagattcaatagaaaccctgatttggtatccaagaagagacattcaacacggttagaaatttgaaactcttgtcatgtagttctctggattcccaaagtgcaaaaataaaaacagataaataaaagggagaaatattttaaatttcttcctaatttaaactcatacccaaatcgacatttgggcaggtccatcaaaaagcacttggggagaaatcatctgtgcactaagtgctttttataccatgagcaaaagtctgaattgtaagtaatattggcaagaacaagctataagttaagatgcaaatccaaatcgagtgtgcggtgttctggcttcaagcctggtaattgaatttccagtttattatccttaatgttttttaatgtgagtttgcaattcaaggcaaaatggaaagctgctcctccaaagctttcccctgaagcacttccaggaacaatttcttttcagagtcaagaaatggttttgggtcaggagtgcactttaactttttcaaactctagaaaactctattccggggagacactaaaccatgggtccactgaaggatactcatctggagactagggattctggagtccgaacctggcactggagcttattataaaaaatggaaaagctgggctgggcgaggtggctcacgcctataatcccagcactttgggaggccgaggccggcggatcacgaggtcaggagatagagaccatcctggctaacacggtgaaaccccgtctctactaaaaatacaaaaaattatcagggcgtggtggcgggctcctgtagtcacagctactcgggaggctgaggcaggagaatggcgtgaacccaggaggcaaaacttgcagtgagccgagatcgcgccactgcactccagcctgggcgacatagtgagactacgcctcaaaaaaaaaaaaaaattgaaaagctaaatgctgtgagctgcttaagaagccctgtcacagcggagagttccacacaacatgggctgacactcggtgccatagaaagtagatggggaatgtttcacatgaaatctgctgcttcagtatgtgtacttggttattcttcaaccgcctgagccttttggctataacagctaagccatacttggcgcacactctcacatttttttttccctaaaactagccctgaacaaggctgagggactcaatccccttgaaatagccttcttaatgaagaaagagctttaaaggtgttagctagcttattgtaataataatgatgataataataacaaaaacaataactataaacataatgaaggtctgccattttgcaagctgtatgcagctttatgcattatttattacgcattattgttattcattatttattacgtaatttatctctcataataggcttaaaaggtagattattgccctcaattttatatagggaaactgaagttcggagaattcaagtaattttccccaggtgatagaactagaatggcggcgtggccaggatgcaaacccaaatttgtctgctctgaagcttgaaccctttattactaggctaagggcacaagctcctccagtatcttctattggaccatatacttctgtctttctttaaacattatttaaatatttgtgtgtatgtgtgtgtgtgtgttgaatgtgtgtgtagagaagaatataaagaaaaagggcaaacgtaccattagcccattacccatccatgtacatggcatgaaaatccaagagtagattagtataagttgaaaattaaaaactttccccaagctctgtcaccagaggtaaccacttgtatatttcttatatatcctaccaagaaaaagtattctgtttctcatatatacatctgtatatctgatttttaacaatcatttaatatttcattaatttatttaactagttctcacatatgttcatttaaattacgtctttttggcatttaaaatctcgagtacaataaacactcatatatatagtttggtgaaggaacatacattatttttaaacttctgtagatattccctctaaaggcattgtgttaattcactatcccactttcagaccatgagtagtcctctttactgtatccatttactttcatccccatgccacttgattctcccaccaagtttataaagtaagtagagtagggatgttgatatggtttggatttgtgtcctcacccagatctcatgccaaattgtaatccccaataatagaggaggggcctggtgggaggtgattggatcacgagggtggatttcccccttgccatttttgtgacaatgagtgagttctcatgagatctggttgcttaaaagtgagtagcacctcccccttctctctcttcctcttgctctggccatgagaaaacatgctttcttcctcttcacattctgccatgattgtaagtttcttaaggcctccccaggcatgcttcctgtacagcctgtggaaccataagctaattaaacctcttttctttataaattatccagtctcaggtagttctttataacagtgtatgaacagactaatacagatataatccttgtttctagcataagtcaaggctagaaccgagatgttctaagtacagaaacttttccttgaacaaattatactttaaagcttcaaagataaataaaagatcaataccctctgtttttacctctgacagatgaagagaacaaatataactgggctttgtggtttagagctctgggataagaactttaaccatgtttaaaacccactaaaataccacttatttagagttgggatagatccatgactttctattgttcaaaggcattttcctttgtaataattccatggaaagaaaaatgacttgaaagccacatttattaaaaagcccaaaggcatttgaacatcaatttacatttttcttttttataggaaaaaaagtagttaagtgtaaatgaatgtcaaacatgtggtttacattttctttaagatgcatgtgggctttaaaacctaatgaaaatactttagaaagaacatattccacaatatggtaagtgtaagataggtaggaaatgtggagcacgtcaacattcaggttgggtcttgcataagtcctgcagataaaacaggaggagatctttggtcctctcacatgagatttcaaagaggggggtgtcaggtctctggacctaggtttcaccccagcgtaggcctatgatttgaggggctgggagacattccatagttaaggaagcttttacaattattcctcacccatttaatgaacacctattctgtgctgaaaattagagatgtgaagacaaatgaaagacaaacttgttttcaagaccttgaattcctagtaaggaaaccagatatggaaagagacaaacaacaataaatgtgattagtgaagtataacatagtgtcagggcagtacaaacaggggcattcacacttgcgggggtcatgagggaagatgtcctgaagaaggagacctggaggatgagtaggagtagctgagcagagtttgtcaaggacattgcagcacagagactagcacgcacagagcagaggcatgggaagcttggcgctgcagggaatgctggtacagccgtcctcatctatgagtttaccctcagtgatgtcagttacctggggtcaactgcggtccgaaaatgctaaacggaaaaatccagaaataagcaattcataaattttgaattttgcaccattctgggtagcatgatgaaatctcacaccatcccattttgttcccattccaaacataaatcattcctttgttcagcatatccactttatatactctaactgcccattattgtataagggaaaatgtagtgctctagataggattctggactattggtggtttcaggcatccactgggggtcttcgaacatatcctctccggccgggtaagggggaacttctgtagttccatttgattacaatggaagatggactgtggagggaagaatagttagcaagaaggctaaagaggcaagccaggtcaggttaaagtgtttgaactccattgggaagagacattaaatggttttaaaaataacttttttgagttttatttatttatttatttatttatttatttatttatttatttattattatttttgagatggagtcttgctctattgcccaggctggagtgcaatggcgtgatctcagctcactgcaacctccacctcccaggttcaagtgattctcatgcctcagcctctcaagtagctgggattacaggcacatgtcaccacacccagctaatttttgtttagtagagactggatttcaccatgttgtccaggctggtctcaaactcctgacctcaagtaatccacctgcctcagcctctcaaagtgctgggaatacaggcgtgagccactatgcccggaccttttttgtgttttagaaagactaatctggactatgggtggaaaacagatgagagacaggtagtactgaggacaagaaaatcagttagtatgttgttgctaaaattccatgagaaattatgtactcaaaccaagggtttagcagtggaggtaaagagaagtggatggaaccaaaaggttaatgctgtggtgtctaagtgtggccaaaggcagaagaagagttacggtgacctctgaatttttgacatgagcttgaaagttcaacctcaggaatgaacacttagatggcagttagattaagaggcaatgcagtttgttgaaaaagacactgactttaattcatttaattttcttctaaacatgaatagaaggcaatagaaacgagacatattaatgactatccacataacgttttaaaggaatctgataatcttttaagattaagtgttaaggactcccagaagactctgcaatataaaagaaggaatttttcacaacaattacatttggcaatatcatgctctggagaagatgtaaggttataaaaattcatattcactgttggtaatgtatgttggtataacccagagatttgacttttctctgtaagccctagagaaagtccagtgtatcacacatgtacaagaatgtttgttgaatcactatagtaaagaaaaaaccagatatgatttaaatgtttatcaaaaaatgagtggataaataaattgtggtgtattcatataataaatattcttctgatatttaaacgagtaaactaggcttaaatttataaaaatggatatttttgaaacaaatgtttttaaaacataactcttaaaaacctaattttaattaaaaaatgagtcagggaatgatatgtacagatgatattaaaacgatccattgtattatttataggcatttatgttaatagtaaatacattagtagtatacacataaagcatgcccaaggttgcctgctttagggagaagagaaaaatgaaggatgaatataaaagggcttgaaaaatgtctggttttctaaactctttatttagtttctcaacctttgtaccactgacattttggaccaaataatttttgtcatggaggaaagccttgtgcatggcaggatacttagcaacatccccagcctctacccactggatgccaagcagcacctccccatgtcatgaccattgaaactatctctatacattgccaaaatatcctctggaggtggaggtggacagaatcaccttggttaagaaccactgattttgtagattggcatttctcatgtttttttttccatatacttgtctcttttttgaaatactttataatataagggcagagggttgaagagaagaacattccttttgctactattttaatcagctatagaatgtcttggtgttcagacatcaagacacaaaataggcccttgtccccaagaactccatggtaaggcaatgtaggatggaggcaaagaggccttggagtgggacaaatctaaggacagatttaaggcagatttaagaacagatgtaagacaaatccaggactgatctaaggatagatcctgactctgccatgcattaactttgagagcctcagtctcctcatgcctaaaataaagatttttcttcaagtaaggtatgcaagattttaccttctggaagtctttctgaaacacagtaaacatgcaacaaggagcagttattataccatttgttttcattatatgtacacacttaataaatcatataagatagtattgacaatatcctccctattcccccactccctgggtctgccttctcattggtgactccaaggaacaggagagcagtttgtctctgtctacaatctctgttcagctcataagcacttgcattttgcattctcagaaatatctctcacagagatgcagagcgggagagagggagagggccaagcaacatgaaacagctcacaggctcatgaagaagatggtatccgagacattttcaaacactcactgaaaccttcatagtccttatgaagccaaactctctctcttctgttttccatttttaagttttaagttacctagattttccttggcctatttgtaggccccatagggtggtatttcaccacactattcccgtgggttctgtaaggaagcccagtgagcccagtttgctggagtgaaaacgtagcaacatggagccatgtcctcatattatggaacatgttttggcctcttggacaaccttgtttagcatttgagcaggcttccttggtgatagtcctataccaactgattttcttcaaaatttatgctagctgtattgtatttttgttatagaatctttgcaagaaccagaaatttcatttccattatatcctgtttgctatccttaacaagctagttttggttcagattgctaaattcagtaatgaaaatactgattattatcagctatgtgccacgtcattacacatgccaaattgctacaaaggatttcaagagagttgaggaaaaagacaggtattacccctgaaccaaccaaaacacctagaacagaaggaagcctctgaaatgaaccaaaatgagtgaatgaactacaatgaatgactatgtcttggttaagcagaaacaaaacatgtttgtaaaagaacaagcatgaattaagacaaagtactggaaaatagggcaatagagtgaagacctgtgattttggtttgatctaaaatatcagattcagagcaccacataattacttaatgcttattcactcaattcataaaacaatcaattgcacctaaattgtatccagcacctggctaactatcatgatgtatatacaacctgcacctttccatacaccaaaaaacaaatcactaattatgggcctgccatgatcagttattggtgatagggagaatgcttacattctagaaatggagtaaaatctatctctataatgtcacatagtgttagtagtaatgtatattgatatatcattgaaaatattatctcatattcagctctgtcctctcacatatgaagttacacatcatccttgctttctatcactttggaaagaatgcaacccaagagataccttcaccaatctccctttccaccataattcatggttcccaaggtctgtctctgtcctaatggatgaattctattcacagaaattcattgtttccagagttcttttcatctcttgaaatatagagtatcacaatggaccgagggagacggctatgagaacaatcttcattgctgttaaatagtcacattcactaggctttatctgggctccacatgcctttaatctgctttgtagaacatcaaagctcttttaatatacttctaaaactgaataaggcaatagaaaaggaacacattaatgactattcacataaactgctacaattttaacctgatttattatttagtgtactataaatcaaaattaattacaaatattgatgctgaccacatgtgcatagtttttaatctttactgcattaacacagtt

SEQ ID NO: 407 - DNA, 349518 bp, Homo sapiens
ggacaaaaaatcattacaatctgaaacaccagatatgccctctcttcccactcccagtttggatgttaaggaacgcatgaccgttacagatcagaaaaacagcctctatccttctctcccactccctcttaccccattctcagctcttaggcagaaatcttactgctcccatctccctgatagaagtgtccctggcattggtatttctgcatcaaatagggcaagaaatgatttctctgttagtcccaagcctgcaaaagttgacccatatggcccagaaagaaactgggagactggcagtactggaaggggcagaagaattctggtatattagaaagaaccggagattcagaatcagatgaaactgagtacaaatttctcctcaatcactgactagctgtggaatcttgctcagatacctcacctccccaagcccctgtttcttcatttgcaaaatgaggagattgataggtagcccacaggggtgtcgtgagaattaagtaagatcatatatgcaaagtgcatggcacacagtagtcatttaatacacggtagttttaaaagcattttcctcagagaatggggacaagagctagtactgtcctgttacaagatacattagaaatctttaatagctccagaataaaagatatcaaaggcactttaccttagtggtgagcagagagggaaccaagttctctggaggaacattagtccttttgttaaaattttatctggcctttaattggtctagtctttattttatatacagttggccagaaccccagctagcatttgtttaacccattgtaagtagattgacaataaagattagcaatgataatggccataatgataacgattgctgataaccctcagctctcactttctaccctaaaaacctttctgcagccgggctcagactccctggttttccgtttattgccccagctgtggttgcatggaacaaaccagggactaggagcaaactaaagatttattcatggcggaagtcacaggatgaactagaaagggctccgagcatcctggggctaactcaatctttgaatcttctctgaaatattgtttataaacaagggcccagtccaagagaagtacagcgagagcacagaccaaatattctaaactggaattgggaagggaaactgagcatactttgcaggaccggtattcctgccccagtgatcccttgagttcttcatgcaccagtgactatgggaatcagtgagctcttacacttcaaacaagcaccttttaaagaaatagtgatggtgggaggagaaactgagactcgattgtccttaatcagaggaaatctttgtcacaaaaaagcttgcttttgggtaagtggcagagaagagtcttaacctccttacccttagttcacagggactaactgaaacagttgctattggcctttctttattgtaagagagaacacctataagtcctcccaaacctgtaaacacagcaaggcacacatgtgcacatcgtttccatgaagtaataatattcagaatggaagatgaagttggtgaacttggtggtcacttagcaaatattagttgaacaagataaaattcaaaggcacacaaaatacctgaggatacacacagacccatggatgcacactccctgaacacacctgtgaatatgcatctaagaaaaacactggcacagggaataagcccactaggctctctcgcttttctcttttctcctttctctctctctctcactctctctgtctctttgcacgtatacacatatgtacccgccctctccacccacctcctccccatatagggaaggagggggtcctttgaaatggaggtggtcccagctggaaaaccccggagctcatttagatcacatcacttcaggcttttgtctctgctcctgaataacctaggctgctacaacaaaaggataaggcatctacatggagttttcattggcaaagatgcatctcaaagatgctgctataataatgaataacaaggcaagatgcttgccttttctgattgacactcctaaagaagggagaggagaaaaaaggagaagggaagagggagaaagtggagtaggaaattggattggggaagatgaaaccacagcaagtatttggttgcatttctgcaaaagagtctttaatcatacaaagactccaactaccactaagtatgagacatgaggcctagggcttattttattttacaactggctattttgtttcaaacaaccagtttaagaagtaaataaaactgaggatgcagagagggtgtggagagcaggaccctttaaagcttggggaggggaagcaaaggagtgggagtagggggaggggttgtagattgtagttgacatgtcacgagagagatgtacatttaccatctccccagctgacactggtggaaggaacattggattttatttcctaaggaaataaaggctttctttttccctttcctactgttttctctatcttaccctcccccatcattcaactcatctgaaaaatttctacttttccatcaagcttgatcccattacctaatgcactattaaactatcttgtgttctctgactgcccaataagcataatgccttctgcttctctcctgcctgcacactttaactcagtggtagcaaaagataaaattagatgttagcaaaataaatcccagggaagagggtgatagaaatctgagtcattgatttttttttttttcttgaaaatacagcaaccagtcaatatgcagagagaatgttgggagacattttctattttggtgtatttaaaagttattttttaagcaaaaaaaaattaaaaaaaaaggctttctgtcatggagcttaaggggttccaagtgaaagtgcagctaaacagaccaaagacaataccatcccaaacttcttcaagacacattatgatatcatcagcaaactcttaatgttggcaaataattaaattttctatcttttagaactgtgtaaccttgggtgtcttagaaacaaattgtacaaacaaaccatggagatgagcactgagggtttcagaagagatataatgaaccaactttaattactaacttgaaattaaaaatgtaatatacagatttaaatttattttcacctaaattgtgtataaaattatatggcttttgcaggctaagaaatgctttgtaaccagccatgctactaaaaagtctgaagtagtttccaaaactgagttcccagactcacacagtaataatgatacatttatcattactgatgaccacctactgggtaattattgctttgttactactattacaatcaagagatttctttatttactgttaacattcacttaaaactgaatgttaatgactgttctgaattcaccaaagagagttttctgttatatttcagaagtacttacgtcctggttcagaaatggaaaaccatatcataacagagtggaaggctgggtgagcacttggttctcaccctctcttgagaatgaaaacagtattctgaggatttctggagcaaaattttccagctcagagttgcaaaaggttaacataatgcagccacttgacttgtgctaattatgtaagtattttattacaggagattcattcattattgatgcttgtttgcagtaacttcctgcttgggggagttatattttatatgagaagtaaacaacctatggctccagggctagcctcctcctcatctgatttcctcctacccctttgtctagtttcacaacaatcctcctgggttggtatgtccctactgaggcagagagacaattccctaagaatttcctcttctccctccattttcttttcccattcagaacttccttgttcttaaaaggtagagttcagagtatggaagtgttgaggtggggaggaggtaggcgagaaaataaaactgtttggccacaaatttttctctttggaagctactctcagctcttagcccagaaatatcagaagtcagtctggcctttggtatacccagaggttaggagatggtcattttggaagtggacatggtggatgctgttgaccaatggtcaagctcagaaagaggctccttcctatcccctaagtcagaacctcatctcagagctattggtggttggtgcagtctacaatatcttcttccctgggccaatgccctgggaagatacggccctatgcccagttgcactaggaaaagacatcgctttgctgtgggatggcctccatgagcccctgtgaaggactgtgttggctgcttggccaaggggctctcaggagtttcactctaaaaacatgtactggccatctgaggcggtctatttggtgggaggccagtgtttcctagagaagccaaaaggccctggcataggcctgcagcctaggaggaagggtttcttcttgggctttcttccaagttctgagatccctgctcacgagtcccagttcagagctgggatggatataagatgtgagttcagcatgctccagacccttagacgaagttagaaattggagatggtagaagggcagtgggagagggtgaagcagtttgggggggtggtgggggacactgtaaagactgtgttcttgaaggttctgatgtgagcaggtgggaatgaatacgatggaaactgaagtctcaaggcgttggaccagtgtgaaaagaatgaaatggtatggtctgagatggggtgaggagagctttggggaggtgcatgcaaattagttggaattgggcaagtcttgccacagtcctaagcagcaccgtcagagctcaaaacccagattcagccctgggcctctactatctagcctagaacttctgcactttgggggtagacatggggatggggtgatgacccaaggtcccagggggctctgggaagagccctgggttggtgtgagaggatggtgagagtacaagattgggtccagaaaggctgccctgggcttggtcagcacaatcttcgctctcctgggcgcatcgcttctctgcttttacccctcgccagggtggaaccgctctgggtgatctgggaggaatgccgttcccagcaagccgtccttaatggtcctttaacaaactcttcgatctctctttggccgctctggctctcgctcgcctcctccctcttcccttctccactgcctctatcagttatttatgagcagcgttaattattcacgaaaagagaaaactccagctttgggaacttttctaggagacgtttggggggtttctctctttcccacccctatggcggtttgagaattggggtcttcggggagtctatttggccggatcctgctttgaagcagtggggaaagggaagcccagtggttgggccggagacggggctaggggtgcacccttcgtcccggtcagctcttgcggctgcctacgttccttcacctgccaggaccgggaagttactaggctcgcccgcgggagtcgctgtccgagcttggcagtgctgaaaccgccggcgtgagctagggagctgcgggctgcggaggttcaggggcaaaaatctggatgctgtcctaagctagggagccgctttccacagcgtctccaaaaagtctagtttgccttctctccctagctctcttcatatcccccccaaccccccgcccacaagtgacaccagaacgttgtaaccaaaaattaattgccttaatcaaatcgacccaccttctgcaattaatcttttagcaacaaattagagacaatttacctcaacctcccgggtcaggcggagataggtgggatggggtgggggatggtcagggtgggagactctgacaaaatttacaaatggtgcggaatggggacttcggaatgggtgtgcgtttgaagtggaggggagggaggaggtcgaggtcagctgctgggctgtgccgggggctagaaattcctggagtccctttggtccccgtattctccaaaggaagggaggccgagggcggaggacgaagccacttacctgtccgcgccgcccgcgcggtctccggccccctgcgcgaggtcctccctcctgcctcgcgctccacggctcctccgcgctctgcctcccgcggcgcctgccgcctcccctgcgcggatcagccgccgccgcccgccgcccgccgtcctctgcgttcctgctcgcgatccggcccttcgccgcgaccctgtcctgtcccacccctccccttctcggcggttcctgcagcggctcagctcttcctactctcctcctgggcaagtttgtaagtttagggtgagggtcggtctctcctcgcgccctgcttctcggcttagcttgctcagatccgcacccccccactccccacctcagacctctctgacgccgcctgttggtcaggcagggcagggcgaggagcgcagcgccagccccagccccatcaccccacccttcacccctccatgcccagtggtcgaaggaggacagatatgaggcgagggctggaggcctagtaattgaagtaggaccaggggcaggagggagcaatccgccctgggggcgcgcagcctgggccggcagcttgaactcccttgccagaagggttgtcccaggacgcgcaggtgcgcttctcctgtgccgccctagggcagtccactaggagggggcaccatttccacactttcccggggaacgaccacctgaggtgagatgagaacctattgtgcgtctccaggaggggagctgggaagattggatacggaagactgagcccttctcagcatctccaggaaggaaagctttagggccaaacataggctgctttaaaaaaaaaaaaaaaaaaaaaaagttagtcgaatccgtctcataacgaagtgtcagactgcgtgtcagggagaccgcgggccaggggttccagttggagcccagcgttccaggaggggatgaagaccgagttcggtaaaacagcgtggtattacaaagtttgcctttcaggctccggcctagctccttccttggcaactttgcaagtgccggcaaccctcactggatcatcctacccttggaacttcttgggaagcctcggtttagccttgggtccaccaagacttcggcgaaatggaggcgttccatccccctccccatcctcgtcctgtctttttcattgaaagaactgatggactgtttctgccctgctccctccttctctcataaacgcttcccatagattattcgacacagagaaggaaggcggctgcttaaaaaacaaaaagccatagccctaatgagttcaattacaatgtggtaaacacattgcctctacgctttaattaagcctgctgcccaattttaactcattagtaattcattaagagaacagccccgtgctggctggtggaaggcaccgcagaccgactgtgcacgaagtccacacgcgcgcagaccgccgccggccctcgccttgcgcgtgagcgagtcaggtttgcgacccagtgacgttgttctagtccaacaagactagaacccccgctctgccagacacactgggctttgcaggtccaagctcccgggataacctttcccggcttgagtccctcgggcttgaaacgtggtttagcaaacctgttgggtggggtggcggtggtgtggggccgggccacagttgagaagcaaatccccgggttaaaagagcttctcttgcctaaggccagatccagtcgcccggtgtggcacgtatccaccctccttccctggttcttctttcattttgcgacagtctcatgaaaaatctaagttcggccttagctctcagctccggctaccctctgcacgctccccgaccctgtacccgggagaagcttctgttcaaatgagactgattttttgcgtggtggggaggtgaggggagaagaaaactgttggctagagaggtgaatatctgaagggagagcacagacctctgcttttccctctttctcactcttctcctctgcttgggagcggggctggggttaaggccacatctgtaactatgtcagttgagaccagccctctgtcaggaaaagaaatggagacagcgttgcagagcgaatcactcatggtctttccatttcataatcgagggagacagcgcaagcaggtcagactcgaccggttcgcttcctcccacccctaacttggcgggatctgagaagaaagttcccgcatgtttgagcgtcctagggcttggataggacagacctcgtaggtccccaagctccagcttggagttcccaaggagaagggaagcgctagtgctatggagcgaggttttggtgaagaaaagggcctcgcgcccccttagtgccgtcgctctggggaatcttctttcgctgggaggatgaatggggcgctcgccgcggctcatggcgccccctaggagcggcaggaaacttctcctgcagggcagcgcgggccgggctccgcctccggaaggcgggcggggagggtagttgctgggggtccctaggccgggccccaggacatctaggacatgccgggggctgtttgctacggcttcatcccggagctcctgctcggggttgccggctgcctctgctggcgtccctcttcccttcctttgcgtaagcggcaactcctccaggaagccaggggaaggacgggatttcctctccacgtagggtagtagatcgcatagcccagccggatcgcccagcaggagtgcagggcgcgcgtcggggtgtctccggcttgtgggtgtgcggttcgaaaccttagctggggtgggggaagggatgtctttaaccttctgtctaccgtccccctcttccctctctcagcctagaggcaggggatgctgcggaatcagactgggtgcaccaaggcggagggccatgccgggcttcgcccttcctgggtgtcccggagtccgttccggagaaaccctggcattgccagaactgggtccccgcactcactcctccataattcgcggcggatcagcgggaggagggcagagggcgggggcgaggcagcttcctggcgggtgtggcgcaaagtgtgcggggtgtggcgcaaagtgcgcggacccgggtcctggaccgaagatttagcccagggtttcgtgtgtgttgctccctgttgctttctacggggtctgcgctggcctcctcctcgggcgactgggccctgaggcaacagcgccttctcgagccccgaggattgaccgccccgagcctgcttggagcagggcctctctccagcgcggtgtgatgaaagtaagaaaatcgggcccctgccccaggcaataggggaggcctaaaatgaagggggcagcgatggggtcggaaatgcgtgcaagttgagagtctcgcagggaactcatctcttgctcagggtttccgtgtttggaatccagttagatgtctgcgggggatctccaaggctctcattccatgaaggcatttttatccactctgggggagatgttgccagggcagacatttcggaaaggtccctcgggcccgatgttaattacaactgaaatagattgtcttccttcactttttttctcctaatgcaaggacagggaggtagaatataatttattcctgttgacagtaggataaataaatacatttttggattactaagagttgactgctaggggaagatagcttccccacagtatcagatggaacctttagaattggccctgggacaaggaagtggccttgtttgtcaggagctttaatccaagcttcaccccaaatagccactatgcccttctttcctggcatgggatattgagaacagggctgaacgaggtcgattttggggggtacagctgccagggatttcccagggtcagcttaagccaatcttttggtttcctgcaacttgccttccttttatttctttttcaaccctccatagcaccagctgctgtgaagatatacccttagaaacgaaccgtctgttaatatggtaaaaatatttttcgctttcttgaatagtgactatggggatagggctattaccccatagtttaggattctaaattgagcgatgtggggtgggggaaatagaagggaatcaaatatttggaaaggcacagaaagccaagatgccaatttattagtcccagataagcaagatagtaacagtttataagcctgtcttaacagggactggaagagcctgggcaattacttatgaaagacaaaactcaagactaagttgggaagttctgtaggaaaagcatcgtaagtctcacagtagtagtaaaacaggaagtgtactctgactcatgtttgaagtacttttctgggaaggggaaaaaatgtgttcatgactggaatacttaccttgtgccaagtatgtgttaagcatttttcatgtaacctttcatttaatccttgtgtgacttccatgagttaggtattactgtccacattttacagcttatgaaaacaggggctcagagaggatgtacttttctcaagaccacacagctggtaagtggcaaaatctggtttcaagttcagatctgtttggatcccaaatatgctcttaactgataaaccagactgtatactactttacatacactataccattttggtccttacaatagcctcattaagtagctatggcctatgttagttcatttgatggataacaaacacagagtctttagaccatggtcctcaaacatgaatgtgtccccacccttagagactttgattccatcagccagcttggcatgggacccagatctctggcaggtgattctgaaactggtatttggggagtgtattttgacaaacatcaccatagagaaaggtaacttgctccaggccattaggattgggccaaactcataccagaccccttgttttcctttcctttgcatcaagatctcagtgacttctttcattgattgattgattggttgattgagacagggtcttgctctgtcacccaggctggagtgcagtggcgcaaccatggctcactgtaactttgacttcctgggctccagtgatcctcccacctcagtctcctcagtagctgggaccacaggtgcgtgccaccatgcccagctaatttttgtatttttggtagagacagggtttcaccatgttgcccaggctggtctcaaacttttgaggtcaagggatcctcctgcctcagcttactaaagcgctagaattacaggcatgagccaccacatctggcctcagtgacttctttattgcaatcatataattagaacccagaggccggggtgggggtggggaaagtaggttctggctatggtagcagattgcatctccccttgacctcccagaagccactaacctaggcttcatggaagtcagcgtcctgaagtttcttaaaatcacacatacccagtttacctggggaagcagactcaggcacaccaaagagtgagggccaccctactgctgggactcagctacatggtccagaggaaatatagaatggagagcaatgaaccacagacatgtagttgtgttctcccttggaagagggtgggaagcaaggtcaaagaagacaaatgtccggacccaactgacacatacaatttaagtgaagctctaaatcaggtgctgctggaatgtgtatttgacttggtccatcctggaaggtctcacctttccctctaggtgtgtgtggggcttgaactgcacccagagctatatgcaaggaagaagacaggctctagccctgctgggcaccaataaacctgttgattgatggtttctatcaggttaaactctgtgaacattttaacagaagcctcccaggagcaattccactgtttatctctgtttttaggccaatgcaaatgtttatcatcaagattaaatcacatcactcttttaacccttgaaaaatgggatttactaaagcaaacagtaggagattcttacttgctaagccattccaggaaggttatggcagaaaccaaaatattttagagccctaattgagcttggcccttagacatttcaagactgtcctaactgtgatagatcatatgtttgcattatgcatgaaataatttgacatatgtagttttaatagcacattgttaactctaagtggagtacttttctgccctgctttttggatgacatacattctgtatttatctggctagtccagcagcagaaatgtatttaatatccagaaaaggccagatttgtgaacactctcctgttattatattgtatgatgtgaacttatttgaaagtcaagctagtccactgctgcaaggcactggaaggaagggctgctgccttagtttctatttcttttttctggtctgaagacaataaagatcccataaattgttttttaagcctgctatgagcaggaagtgggaagtaagaaattaattgatatataggattttgtataggcccaaaatgaaggacacaggatccagtagatattctggaatttcagaggctctagcaaggccctctgctcctcaaaagaatttccctaccatcttgctaatacttggaattcttctagtggtgatttgtgtctttgacatctctttaaactcaagcaatcatttatcatttagggtggattagtttatcacattttttcctaagattttattttgatgggcttgaaggtgtaaaaagtgtgcagatgccacgcttctgtgattaggaaggaaatggcaccatccactacgggcaaagagagcaaaagaaaaaggccctagagggagaactgctttaaaattttgccgagagttaacgctgcccagcgctgggtgaggtactataagggtgcacgcacagtgccagcaaggccccttacattctacttggggagacaagattaatagtgacataacagaacaaggtgcaataaagtctaacttgtgtgattcataataaaagcaatattggggcacagagaagacaagccttctttgtgttgaaggtctttgcgttgcagtgttactttgtgagagttggaggactcttgtggtgcctgtagaacacaggagatactaagaaacccccaaatcaaacaccaaaccaacattttatggattccacatttcctggttcagaaatctgttgaaatgagtcttctcacagtggcatagaaagaaatgagaaagaaatgtggagaagagtaatgcacaggcaaagtgaaaacattagcaatcatttcacctaccatcaagaactgctgaaatcagagactcctcagtccctttttgctgccggtcctgattcatctttcattggaaactccctgccgctctggttgcacttaatgatgtacggccccgttggtacttagtgctcaggagttcatctttatacttctctcttattaagaaacatgaatgccaatctaattggttggactttaggaagctgataggaccatatttgctagcagaagatgctgtattgtaacaggtcagtgctgggttggtgggcattgctttatctcttgtcattaggaatatagagtagtacgatttggcatttgtgtatggacactggcaaaggtagaactgagcaggaggcttcccagcttactttagttggaagcctgaccaatttaggacaaagagtgggtcacctggcctagactttttaatgttgggatttggtgtctatactgaggtagtggtaaattattactctgtgggacattttcttcttttcttctataattatgttctttgggaacctcatgggaaggtggctttgtccatgttctcatatattgtaaaagttttctgtctctaagaataatcttgtgttatcatttgaagttcagctctagtttctcctccttgaatatgtctatttcagtccttagtgatttttccttcctctaatctcttccagcactgggactttctaccacctgctttattatttacctactgctttgcttgctattttttcctatgccttaactgtatcttaaactgccaactgaagtacaaatatctcagcagccattgtctgcctcttggagaacagggaaagaccatagttatcttatgttggtctttgtttatttaaaaatgttttcctgttttcctgacctttgaggttattttatacttggcattcactacggcacatagcaaagagatgagcatgtaaagaatggtcagtgaaggcctgctgacagtttgacttatttcaagatatatatcctaacatttccccgtacctatgactatcagttgtctttgtatgtggaataggttggacttgatgaaaatttttatgattctagtgttagttttataaccagagaagaaatctttagatgacagtgggggacttggtgtgtatattgagcacagaagtggtctaacccctttgaaacttttcctaacaacttcgcctcttaagcatgggctctataatattccataactgtcaatatcagtgaaccttgttagcataacataaaatattctctgaaattttcttggaagctaattcttaacattgtatatcatccagatattttgtggtttcctcctctgtcctcactcaagtagttcacacttcagtaggatttctaataacactctctttttaggtacccttatagtcccagggctttataagacaggctttaccatgtaatttgctttggccaatgaattatgagcaaagagcacttctggctggaagctttaagggccagcacatgcttcatcatgatccctttgccatgacactaaaaatattttgagatccctttatcagcctgggttttggagtgaaaacaacatggagctgacctgcagtgaacacattgcatgactgagacataaatgggggttgactgcccatgccatgtccgcccttcccatcaacagatgtagtctatttcccactcccttgaacctgggcttggcctgtgatttactttgacatgattcacactatcataagattgtagtagaagagatgttgaatgagttctggagtctaggcctcaagatattttgcagtttccacttttactctcttgggacctagctgccaagtaaagaagcttgggttagataactgaaagatatgaaacttcatagaaacagaggttttagacttctagccttccctactacagtgaggcccgctttgtctttgcagctttcactgaagcagcaggcgaatgcaactgcaggagcatgtgcggaactgcccaaccaaaccacgacatgctgagcaacaataaattgttattttaagtcattaagatttaggtgttttatttgaagctttaaataactgaaacagagatctctgttgttgtaagcttctaagatttcgggatctttttttttttttttttttttttttgagacagggtctccctctgttttgcaggctggagtgcagtggcatgatcacagctcactgcagccttgatctctcaggttcaagtgatcgctcccacctcagcctccccagtaggtgggaccataggtgcgcactaccacatccggccaagttttgtattttcggtagagtcgggtctccctgtgttgcccaggctggtctcaaactcctgagttcaagcgatcctcccaccttggcctcccaaagtgctgggattatggacgtgggccaccatgcccggccctgggatcacttatttttaacctcagcataacttgccctatactaactgaaaaagttatcaatgtgtttttaaccatttattttgatttatagatatggatttattttcattagtgatacattttaatttatttctatcattttgttttgtgtcatttgttctgcttttcccttctttcttcccttctttcttttggatatttatttatttatttttttgagacagagtctcactcggtcgcctaggctaggagagtgcagtggcaaaatctcggctcactgcaacctctgcctcccaggttcaagtgattctcctgcctcagcttcctgagtagctgggattacaggcatgtgccaccatgcctggctaatttttttatttttagcagagatggggtttcaccatgttggtcaggctggtctcgaactcctgacctcaagtgaactgtctgtcttgacctcccaaagtgctaggaatgcaggcatgagccaccgggccggcctggattttttttttttttttaaactaatgttctcattttatttcacacttcttttttttttttttttttttttttttttgagacagagtctcgctctgtcgcccaggctggagtgcagtggtgcggtattggctcactgcaagctccgcctcccgggttcacaccattctcttacctcagcctcccgagtagctgggactacaggcgcccgccactacacccagctaattttttgtatttttagtggagatggggtttcaccgtgttagccaggatggtctcgatctcctgaccttgtgattcacccgcctctgcctcccaaagtgctgggataacaggcgtaagccactgcgcccggcctatttcacacttcttttagtttatcatttatatcctttatacttcttttatggttacctaggtcatttttaattgcccaattaacttaacacagcctaatattattatcctcctgaacactgcaatgattttacagtggtttaactctgatcacctcttgcccagcttatcagctatgttgctttatatttagttctgtggtattttagcctttttttttagtcatacaagttgtatattattaatattgtttatctagtaaatgcttatttatatttactcacacacttattcatacatttattttattttattgagacagggtctcgctctgccactgaggctggaatgcagtgttgtgatctcagctccctgcaacctctgcctccagggctcaagcaatcctccccgcccagcttcccaagatgctgggactacaggcatgcgccagtatacccagggaagtttttaattttttgtagagatggagccttactagattgctcaggatggtcatatagttatatttactcatacatatgtcaatatcttttgtctattagttattcacttatttatcaatattatttataattcctttttgtctttgggaattaatttatgtctgtttgaagtatattctttggaatttcctttagtgagaatttgttggtaatgtggtcaagctttttcttccttttccttactttgtctaaaaattattttagtttcacttaatttttgaaagattgtttttctggctaatagaatactacattgagtgttaccttctctcagcatattgatactattagtctgctgtgatctctcactgttgcactgagaaattgccatcattctaactgccactctttcttcttcctggctattttcaatatattctttttgtctttggtgttttccagttacaccatgaagtatctagattttaaaatcttggttaatattgctttgggttcctgatttttgaggactgatgcttttcaatggttgtgaaaattctcagtcattatcttttcaaatatgatttatttcatattctccttattgtctctttcagaaattctgattagtcatgtggaaggctgcttcaacctatcttacatatcttgtaaacttttttttctgccccaacttttcattaatttctttagctataccttccagttttctaattctgtcctcagctatatttaatttactatttagagcaatcaattaaaatttcaatttcagttattatatgtacattttatttctggaatatctctctgattcttctaaatatgctggttgtatttagaccctttagttgcttgcacatatttccaagtataccttttacttcatagttataattaatatagttagtaatgtagttattatttattttatgtgaactaattccattatttgaagcctttcctggactgatctgctgtctacatttctgctagttctcactcataatgtcttgatttcttgtgtgttttgtgattttttactgtgagctgctcattttatgtgtaagtttgtctatgggaattcttagtgaagttatattcctccggagaggacttgcattccttctgctagttacttttccagcaataacccaagaccagcttaaaaaacactgttattgaggtattctgcacatgccataaaacttacccattttaaacatacaattcaatgagttttggtaagtttacagtattgtgcaattattatcatccagttttaaacttaaaagacaaattctccaaagatccctttccctgtttacagttagtcagtattcttaccccttagcccaatgcaatagtctactttcttcctctatggatttgtcaattctgaatatttcacataaacaaaatcatacaatatgtagtcctttatatctggcctctttcacatagcacaatgttttgaagattcatccatgtttccaggatcattttaggttaaagtctaagcttgcaaatttattggaccacagaagtagcatgaattcaaccacagtcctgtgcaaaggccagtttacaggtagaatttttttcccacccgatgctaaggctgaaatagacaagttttcttattgactgtttctgagcagcagatttctttatcatttgctcttttacagagggtgtagctctttgtgacattacttttatgtcaaggttccctaatagaccccctaccttatctccaatgcagccccatagtagaacgtcagggccttcagatttcagaagagaccctcagggaaaagccagccttggcagtcattcagccccagaattcttgctttcactttatcttttgcctgtgtgtgtgtgtgtgtgtgtgtgtgtgtgtgtgtgtgttttaaataattgtgctagtttgacaatacttttataaatataaatttcattttttccccagtattttagatgttttcatggcaaggacccttcagggtgttttgtctgccatactcccggaaagagaaggctgacaagagccttttacaagagtcatttgctcacctgtttggatctcagataggtgaataataagggaaaaatattaacgttctgagtaagaggccatcccagtccctgcctgcggtctctcccaatcttagcttacctaaatcatctaatgaggagtcttatttttgagtctactttgtttagcagtagtctgcggtcacccctgcatactaattacctcgtacacttttttcacctctggtgggtcagtgaaagcagccatttctcggactgcattgggaattgctaaggtctctgttcagcttaaaccatgtcagttttttatagttgaagtggaaagggcagggattggaaatgaggaaactgagaccaggagaggcaaaacaactcgcctaataccacagagagctggaacttgaactcagacccactgacttacaatgttctttccatcacaacatcctgccccttgttgatgacagagaaaaatggagtgagagagtgcagcactggtgcattcattaaggtaaagttttagaaaagtctgaattttattttatcttggatttctctgtttccattgcccattgttaagtgagagtagtagttaaggaaaacaaacaaacaaacaagcaaacaaacttgctgtttaatgtttctgtttttgaacaatgtggatcattttgcccagaaatttctgacttctcagaatgttagagatggcccattggtttggccctttaactggaggaaaatgagggaggagcccagagtctttatcccagtatatcagcccctttttgatgagtttcttacctcattttgggggaaagataatgttattaatgccctttctagcaatttgaaaaaaaagacaaacatggcttagagtgaaatcctcggtgattgaaaatatcattagaaataagctcctggtgttcactctgtcatttccaagtgttctgatgagtttcatttgaatgctgcactatacggagttggctgaagcccacaactatgtgcgcgtgttggcgacgaggcctcttccttgttgaggaaggaggagggagaggcaggcagatgtcatttagtcacccgtatttgaaactgagatgagccccaaacagaatctgcagatttgcttctggtgcagttatcagtcactgcatccaaactgcctcaagctgtgcctgcatagtgcccaaacgatgcactcgtgagtgaaaaaacaaacaaacaaacaaacaaaaaaactagccagtatggtcatctgagtcatgaagacaaataatcactatagcaggaaaaattacaataaaaaagccagctgttgaactgaattcaatagttaaaaaaaaaggtggggggagggcaataaaaaaattcagtgaaattccatttcagtttctgattgtttttccaggactactttcagggaaaatcagagtctttgtttttaaaaatgatgcctgcattggttaaaaaaatccaaggcaatacttacacccctttcttcatcctaaagaaccagctccttagggtctcatttgcatgtaggtagattcaaaacagctgaagttgtgtacatctaattggatggaattcgagtctttccccgaagctgtaaaagaaaaagcagggcctggaaacatgatgaatgttcttcaggcgacaaagatttgaaactgctgctctgagcacttgcaggaggtttctacagcagccttcaaggccaccctaccaaggcagtgctgaattagcacttttttctgccttatataaacaagaatgcacaaatgaacataggtgcagcaataaaaatcacaatgaataatttgagctgttgccaaatctttgaacctgattttgtttgcacttgactcccttggaaatagtaaaaagcaagaggtagagatgtgcccagtttaagttcctaggtggtccctgaggcaattgatgctctgcctatattttcttgtcactgactgttccaatacatacccatgacttctgactgcaagcgcttatgaatctccttgcaggcaggaattgttggggacttcatgctctggggagtagcccccagccagtggttggtggaagtaggtgtatacatatcctgcctatctgccccttgataagaccactctgtggcatgttccatactatctgccagcatgactgagcttcagatgcccacagtggtcacctgatcaatagttccctcgttgctggcttccttcccttccctgtcttctgtttccacttcccttctggtgcttcctggaatcatttcccaaataaggtatttgcattcaaatctttagtctcagagtgtgttcctgggagaatttaaccaagacataggaaatatcttcttttaactgaaatctatttgtgacatctaattctttgtctttctgatttggccatcattcaaagcatgttaaagctgagggtgcagaaatcacctttccagtggtgcatttcacagaagaaatagaaactcaaattacacagccaaatggttacagaaattagactagcagccagtggtcctgactcccaagctggtactcccccagcccctactgtcaggcctctgagcccaagctaagccatcatatgccctgtgacctgcacgtgtacatccagatggcctgaagcaactgaagatccacaaaagaagtgaaaatagccagttcctgacttaactgatgacattccaccattgtgatttgttccatttggtccatttgctacaactgacgaacctacattgacacatcattatcacctaaagaccatagtttacattagggttcactcttggtgttatacattttatagatttgaacaaacgaataatgacatgtattcagcattatagtatcatatggagtagtttttttgtctccatagttttgcctttttcagaatgctgtatagttggaataacacagtatgtagccttttcagattggcttctttcacttagtaatatgcatttaagttttcttcattccttttatggcttgatggctaatttctttttaacactgaataatattccattttctggatgtaccacagtttatccattcacctattcagggacatcttgattgcttccaagttttgccaattatgcataaagctgctatgaacatctgtgtgcaggtttttgtgtggacatgttttcaactcctttgggtaaataacaaagggcatgatcactgaatgtcttttaactttcaatctatagtttcccatcccatctctttttatccttgacatttatttgttgaaaaactggattatttgtcctatagaatttttcacagtttgaggttttctatctgcattcctgtggtgttgtttaccttgtttcttctgtctgctctattccctataaactggtcattaaatctagaagtgtgatcagattcaaattggattttttttggtaagattattgtatgggaggttttgtgttcttccaggagacttttcataaaggagtcctgaagatggagtgttgtaagcttaatgagggagatcattttgggtgatttggggagggatgttcccaaagtctagaaaggtgctattgactagaaaagtggctattagcttcatgcctgtacaaaatcacacctgtacaaaatcagaacgttcagtaaacgtgtgtgtgtgtgtacacacatgtgtctatgtgtctttatgtatgagttttgtccccagaatgagaaaataatgtgtagttcagattgtagcttagttagggtatgccaaatttcctggcttcttaaggaagtggaatctattaatgagaaataaaacattctgatattaatagtaaagactgtaatactaatatgactataataaggaattgtggccacaaagaccaagagaaacagtgttgctgctcttgtggcaagcactttccctaacctctccctctttaatttttcaatcggtgtgtagcaattacattagttgttgtatttaatacatagtatatttgttcttagacttttacgactgctgctaattaactgtacagtcttttattagtgtttgaaattctaattactgcagtaccaggaagttttaatattgttagaatgtattgcttctttattgactcccagcttttccaactctggttgtgaaccttggtgagtcagtattcattagaggagcacacgctggtttgaacaacccttctcttttattaacgaacaaagacgtaaaaaaatgtttccttagaactggggttaatgttgagtagcttgttgcacatcccatgccaatggctgattttcaaggagccgagggaatttctgtgactggtaaagaattacctgtgtaatgtgcccacttctcctgacaggctggtcctcttcctgtcctgcccacacactatgctcttagctcttactggctccatgtacactcttggcaggaatgtcttcttttgtgcccagctatgcttgctcagatgtcactttctccattaagccttccctagtcccaaactccccagaattcccagtctaaacccctgattagcttgcaaatttatcctgtgtcattcattaattgcctgtgtgtgttaccatcatgcccctaactggaacgtaaactctgggagggtaaagatcacctcatgggtatcttcagtacaccccacagcactgtaatgctgcagatactcaattatcacttcttgattgattgttccctatttgtggggaatgaggggtacagagcaaaatttaaaaacaaaatttatgacctatgtcaactgctttaaatgtagaattataaaattgttgacatttgggccatacatgtattaatgtctgtctcaaaaccttgccttgttcccatcctttcccacatatacatactgggcacctgctaagtagcaagtgtgatgtcagcactagggatgcaaaatgatgaagacctggagcttgtgtctggtggagcagaggcatctgatgagtgtatggtatgttatgacatgaccaatgatgtgttagaaggaagtcacagatgatgggatgccagaggaaagggtgggaaagtcctcttgcggggaggattcctttatccttttgcctccttactgacttcagtgagtaactttttccaagaatgggattttctaacataatttaatggtggtttctgctatgattatcccttaactctggggagaagcagttccccatgtggctttagagcacaggctctggagttacatctgtgttctgggcatggtgctgatattgtctaggtgtggccttgggaaagtttcttaacgttcccaagcctcagttttcttatatgaaaaagggagatgatcactattcagtcatggggatggatgaggattcaataagatgatgcagaagttgtgggtctgctgcatcatgaacgttcagtaaatgttggctgttatgatattgctattccttctaactttactccctttcttctccccctccctagaacttaagcccctttcctctggtgccatacatgccattagcttcacagaaatatctcattggttcctagggcttgtatatcagtcccagggacattgtgtagttagacaggagacagtgagggaacaggaacttggaagtttccggttctgagcctgcctcccatcccgcctgttgcctttgctgggcctactctttaccaagtgcagagccaagggctgaggatttctgtctcccattgggacgtagggggtgaatgagttaacatttacaaagtgctctgagctcctaggagaaaaggcacaatctaagtattctcattagtgcattaataatagatgagcataaagcactttacaaatatgcagttctttagcaatgctaaataatacttccaccaagctacctgtgagtagaggggctggttcttgaggctctcatggccctagtcttggctgtcactaatgcagagtgtgatctaggcaaaatcactttcccttccaggtctcagaacagacgggtcagaatggatgacgtcaaaggcatctcttaatttagtgccactttttagggttctttatttagatggagaaatgactacagctggagtcagagcagtcatttgtgggagggcatgatgacgtctctaaagcaatgccagctgttgggcagagattccaagcagtggctgcacctgcttcctctccctcctttgtgtcactgagaacaggcttgccttttctctagggtaggggtgggagtccttgcccccaggactgtggccaaaagatctgttggatctgagtgctagaaaatactttacaaccatattcctttaaaaaatgttgtggtaaatacatgtaacataaaatccatcattttaaccctttgaagtgtacatttcagtagctttaagtaactccatgttgttgtgcaaccaatctccaggactcttttctttttctccttttttttttttttaagagatgaagtcttgctctgttgcccaggctggagtgcaatggtgctatcttggctcactgcaacctccgctttctgggtttaatgaattcttctgcctcagcctctcgagtagctgggactacaggcacatgccaccatgcctggctaatttttgtgcttttagtagagatggggttttgccatgttgaccaggctactcccaaactcctgacctcagatgatccacccgcctcgacctcccaaagtgctgggattacaggcatgagccactgtgctggcccagaacccttttcatcttgcaaaatggaaactttatatctattcaactacaacttcccatttctctctccccaagcccctggcaacaccattctacttctatctctgagtttgactcctctagattcctcatatggatggaatcaatggtttgcttcacttagcacaatatctttaaggttcacacatgttgtagcatgtgtcagaacttccttcctttttaaggctgagtaatattctattgtgtgtatataccactttttgcttatccatttatccattgatgaacacttggattgcctccctcttttggctattgtgaataatactgttataaacatgggtgtacaaatatctttttgagaccctgctttcaattcttttgagcgtatacccagaagtggaattactggatcatatggcaatctactttcaattctttgagaaaatgaccatatccctttattctccaaagatggagttggatgagaatctttggtgacctcagattctccactctgcatggttatttccatcaaaggcctctgctctcccctgtattcactaaattatgaccctgaagataatttgcatttcatccagaggaatacgtaattttagaatttggagcttagatgggactttagagacttgctactcaatggaggtatgctttgatttggacacatccagggcctagaagctcatagcagtacaatgtaaactgtcctgagggtagggcaactctaattagaggtatcaagctaaaattgacccccttaattttacccttggtccagtgggacaacacacacacaagccacacatagccattctggtattttatgtcaagtcttctctccagcccacacatttggttttgaccactccttaccagaaacttctcactaccactggcttcagaggtgaaatttggtgtgtggtaccttttcagaatccttgatatcctaaacagatgcctggattacttcacctatgccggtttccttggctcactcaaaatatggacaggtcccacctactttaaacacagttttctgctccttgacagtctttcagatacgtttggggaaatcacaaactagtaaggggatgatctttcctgcaggatatacacaagaaaagagatctttcaagggaatgccgggttacatgtcatatctgctaagatgtgtgcggctgcaagtaacaatgtctagagtaataaagacatttaacgagctcacataaccaagagctggactgttttagctttggtgttggggctcagtggtgccatccaggaaccaggctctttctatgtgaccctagcttgttgtcttttaattcttaaacttactgcctcatggtcacaagtagctgcctcagttctaaatagaaaatccttacatactatggattaaggtaggaagaaatggaagccttcattcttatctctgtctcctttttttaacaggaaaaaaaccattcttccaggagaggctcctccaagcaaacttccccttacatctcttaccagaactgggtcacatgctcccatctaaaacaaccactggccattagaaatggtgttaccatgcctgtcttggaccaatcacatttgatcctctgaggatagagacatgttgccacctgaacaactgtggggtgctgtactcctggcaagcagggagaatggctgtggctaggcaactgacagcatctaccacaaatatgttactcagaagaagaatcgaggatggccataatttttatttaaagatttctattttacagaggcatatctgattaagggacatttaaacttccctgttaaacttatcaagacaaaaagacaaggcatcttgccacatttcttaaatattctctgcagtctctcttgaccttttcccagctgtgctgtaaacataaagataataacatatctgaataacattttatggtgcacagataattttcacatacattatccatttgaccctcaccataactgtgtggggtaggtaaggtacgattgtacttttcattaatttttttttttttgagacacagtctcgttctgtcacccaggctagagtgcagtggtgcgatctgggctcactgcaacctccacctcccaggttcaagtgattctcctgcctcagcctccaagtagctgggattacaggcaagtgccaccatgcctggctagtttttgtaattttttagtagagacagggtttcaccatgttggccaggctggtctagaactcctgacctcaggtgatccacgtgcctcggcctcccaaagtgctggggttacaggcatgagccactgctcctggccacttttcattaatttttattggacttaggattagaaggatgagcaaatcctactacttagtgcgtggaatactggcatctattgtttttgcttggctcctctcttgttttaataattaactaatcgatccattctcttttattgccatctcccactcacactttttcctccacataggcaatcattctaaatatgtccaatgtttatcttatttgtatgcgtatttataaagtgaatattttgtttagtgtgtatgcagtttcgtttgcataaattgtaatattctgtgaatctcattctgttttgtacttttttcattctgctctgtttttagaagtgatccatgttgctatgtgtatctactccattgcctttaaatgctgcataatactccacggtgtttgtcgatcatgttttactcatctttgccccctagtggaaaccatgatggcctccaactctgcacacaaatagtttcaaacaagaaccgctggtgaaatgtgactgctgatggacctgggtgggaatttctctgggatgccgactaaaaagcatggtggctgggtcataaaatgcacacttaatttgaataagtgccacccagtggctctccacaaagcctgcactagtccattctactagaaattattcacatttaactggaaactgggtcttggagatgttaagtaacttgctcaagctcacataaggagtaaaagtgaattaggacatccaggacccaaatccaggccttgtaacttcaggtcaattttattttccagggcaccaccctctaagtctctggatcataatatggagcactaataaaaagatttcttgaggcttttgttatttacataatgaatttcagaaatggcttactggtgctactggcaagttgcaggcagaagaaagaatgaaagcgaatgggcatctcatgttctattctctgattcaacctgttttgggtcccttttgactgctttaccacagttgctattacattattttgggaagtatttaaaaaagaagagaaagtgctggatatctgaactcctttcctccagtctgccatgggccaaaatgtagtaccaccatgcctgactagaaagtaaaagaggaatcatagaatcagatagtgttataaccagaatgggccttacagaccatttagtctagtcctcccattttatagatgagaaaatggaggcccagagagaggaagacagttgcctgaggtcacacagctggaaggagagcaggatgggcacccaggctttctgaaaaccagtctctttgatgcaggtgaacccccacattggggctcagctcaagagggttcttagctttgctcaggaaggaattcaagagtgagctgacagttaaagaaagcaagtttttagagcaatagtgtacagcaaaatggctgctccacagacagagcagggccatcccataggcagagtagcacttgtgcattgctggctagctctatttatagctgctcctaattatatgctaaataagcggtgggttattcacagattttctagaaaaggtgtggggaatttccagaactgatggttccttcctctttaaaccatgtaaggtaacttctgggttttgccatgacatcaactgtcatggtgctggtgggaagtgttttacagcatgcaaatgtattataattcctagtcctaactgcttttggctggttcctttgctacatcctgttttgatcagcagtgtcatgaaaacaagtcctgttcatctcctacctctccttgccctttccacttttctgcacacagcaactttcacctgcgcacccaggaatccacactttaagtcttaacaacctgaggtgttgttgagaaaaaactacaaacagtggtgcgctggcaaatctttaacaatcacctggggtggggtggggtgtggataaacaagccttatttgtagcatatggccaatttcaagctgccaaagtgctgtcactgaacgtgaagtagtgggagcagggcagcagagggccaccaatcagaggcatttccaccaaacagatgcaattggcataagtaactgcaagggcacggacaaccgcaaggtctgctaaaaggattaggaagtgatgagttttgagtgtttattacttttggttttagtgtaacttatttgtaagcttacataatttaatgtctaataagggcaatgtttaacaatcactcatgaaattcctgaaaattgaactgatacggtttggctgtgtccaaaccaaatctcatctcaaattgtaatctgaattataatctccacgtgttggggaggtatctggtgggaggtgattggatcggggagggggggattcccccacgatgttctcatgattgtgaatgagttctcacgagatctgttggctttataagtggtggtttcccctgttctcgctctttcctgctgccttgtgaggaaggtacttgcttctcctttgccttgtgccgtgattgtaagtttcctgaggcctccccaaccatgcagaactgtgagtcaattaaacctcttttctttaaaaattacccagtcttgaacagttctttatagcagtgtgaaaacggactaatacgtgaatactcagctctcctgagcttatgcgagtcagccccaagacaacattggctataaaggaatgaagccagcttctcggtgtagcaacccgccttcctagtttataaacttgtcctgattcttctgcatactctttggtggaaacataaaatatgaatatagtggaaaagaggggcaaaagataaatgagttattctggagataaactttctgtgtagtggaagtcttagctctgtaagctccgaagctatgatggttttaacttttattgatgaactttgaaaagagttgtgttgcattctttcctacctcattacacgtgagacattatggcttattacttttttatgaagaacccaggacatgttgaagtgtgcaaatctattttcccttggaatacatgacctcaaactgctaggctgttggggcctttggacttgctttttagagttttgctttttagagttttttttcttgctcactttccagaagctctgacttctttttactgtcagtgtgtctgcctctatcttttccctcctctttctaattgactagagaactagacttattagaatcatttaaaaatgtcagtaatctgttgcaatacaggcctattgagaaaaacatgtaaattttagtgcatggatcttgcgatatttattttggatgctcagataccttttgcaataacttctggtttttgtagaatttctggagaggtgatattactagattactgtgtttcagatcagtgagtattgctacagtaatgttgttatatataattatatactatatcaccatgcatgaattccattataagaggaaaattcatctctgggccaggaaatatgtcatgtaaaaagtagagcagtcctggactgtattttgaggaacccagtaacactactggaacatgaagtggtccatatggtgaactttgcaaaatacagtaagacttaaatggtcaagtttggggcatgcctccttgctctaaaaatggtggtgcttcgtctccttaaacacagacacaggcaatggatggggaagggagatccagtgattgagagttttcccctgctggaggcagggaggtccctccacacatctgcccatcctgggagtgctgcttgctggggctgagaaaggaagtagattgcacctggcaacctggctctgcccttctctgtgacattgggaccaccagaaaggttcttggtatgatttggatttgtgtccctgcccatattgaattgtaatccccagtgttggaggaggggacttgtgggagttgattagatcatgtggggtggatttccgccttgctgttcttgtgatagtgagtgacttctcatagatctggttgtttgaaagtgcgtagcacctcccctttctctctcttcctcctgctccagccatgttagacttgcctgcttccctttcacctcccaccatgattgaaagtttcctgaggccgcctccccaagccatgcagccttgcagaactgtacagccttgcagaactgtacagcctgcagaactgtgagccaattaaacctgttttctttataaattacccagtctcaggtatttctttatagcagtgtgagaacggactaatacagccccctacccttgtttcaccagcccggtcattcctttgcatataactgagaaagagacgttagggcattgtccaactgatttcaaagcagtggttttccatgcttctgttgtcttctccagctgcaggaaagcagcctcagtgctgatggaggaatcagcctcttccatgcagaaaaaggactccccactgtagttccaatatctccctcacaaattcacctctcgtttctttggagccttcgagcttttgggaattctcaggtctagtgagggaggcctcattacacttccttaagcccttattaactccttgaggagactcatgtgatgagctgtggcacagaagccaggtccagggttaaggtgctctaaggggagcaattgccaggagatgagaagcacaaagacaaactttctttcctgtgctggccccgggctgtatgctgttgatatcatttgggtaacttctatgaagtctctgagctggggtcaccctacatggggcagcagggagcccagtagcaagggtttgctcccctacaacccccctcatgagcctaattaacaagttgggtcctttccagctccttctggcggttccagcggggctgggctccactgggggtgggcagacagtcttactttaagcagggtattgatcctcacgtggtcctggtgcccctcttgggggagcactctcgtgttttaagtgcatgcagttactctcttgactggcttgtaaacaggttttaatggggctattagtgtaaaaggacaggaaactttcaaaaacaggctcttaaatattcatgaggatgttaaatctggtgcttaatcaccagtgtttgtacacagctaacagggagggaggacagctaacaggctgccttcactctgaacaattgacagggcattaataaacgctcttacagccatgattaatggcccagagaacaggacttctttttttttttttttttttttttaaacaaaaggagcctctgtcctttggggactcctgttcttgggggagtgtccacgtggggatgggattcaggggaacatggaggctggacagaacaaagtcccttcatagtcagctggactccccttctgactgtctgtttcctggagcatggcttccacaggggaaacttttaaacttaagcagaggctctcaggagaattccctacctggagaatccttaactcaaccttgagaagacccatgagggagtcacatggcttggtgagctgtgaccagctgcttcctcagaacctgcctcacatcctttcagacttgagttaaatgcaggtgaagatggttgactatggcccagaggtctcttgcaagcagccccacctctccccacctttctaaggtgcattttaatttctggagaggcatctttctctaacttgtctctgtgacatttaatgtagaacccctattggaaagtgagtggggggactgctttttaattggtaagtgatctgcactgttaagcttctggaatggaccttggagattttctaggccagtccccactccttccagatgaggaaactgaggcacagagaggtgaagcaacttgtccaaggtcaaatactgagggagtggcagagttagcactggacactggataccctgagtcctggtccacgaactcttttcatggtacccctgtaccagtgtgatgtgacttttccaggtagagccagggaacaccccactgacttccttcagaagtggtacaggcttgaaagcctgctcagtcccaagcatggcaagactgtgctaataaaaccaaagccaggttaagcacagagtcctgggaaacatctgtttctgtgtggtgggaaaccccagcctcattatctgagaccaactcagaaattcaaacctgtttcctccccacaagtaccagttgggattttcagttgacaagttccatttacaaatgaaatcaaggtgacctcccctgcataaagtaaaatctataaaagctgtcttcatggatctggaaaaaccctactgtgttttataatggtagatcagggcaaagaagtcggtgtcttccacaatacccttctcagcctccagcccttactgcccacatcccacatgcttctatcaagcctttcctgtgcacaagccaccgaattacaggttgtggtggggagggatgccatgaagatgtatagcaagtgtcactatccccaaggtactcttcctccagctagcaatttgactttagggctgtgtcagaaaaccaaatgcagtatctggctgagtatttttgcaaatatcactttaattatctcatactactgctcaagaattcagtggttcccactacatctgggtcccgcccaggcaggctctcctctgcatggccaggttgcttccccttaaaaccaaacacatcctttcttttgaatcagtggagcagggcacagtctacagacaagatggatatgattcttaatcatgagtttgttcagaaactcagtgcaactttttttttctttatggaatgccaaccaggaatgaaaaatcagcctctcttgctaaacagtttgcgttaatgacttccatcagagccaatctattgattttttttttaaacaaaactccacttgtctctttcatctggatatatagctggtaggtattgttggtaaagcaaccaatgtgagaaatagtttcctcttcaaaattagaatgaatgtattttgacagtttttaccaataattgtttcaatgtttggtacaaatgctgagcacagatgaaacttaaaccacagtagaattggactattttctcaatggaaggttgactgtcagttgtatgaagtataaggatggatttctatgtcttgttaagttactaaactgataccaaatgttagacaatgtaacattgatttcacagaacacaactttgaattgacattatgcctcttatagcaaagtcttctattatataacattgtttttggctggtttgtttaatcagtcaaatgtagtaggattcagcatggttcactgaaaacacttgtaccaggatgtaggaaatttagtgctactcctattagtcccattaaattattgtacccatcttcctcacctgtaaaataggtatagaaaaaaggacacatcaatctgttgtttcaagtgaagtaatgcatttatctacttgctgtttccattcgatatctcccagccatcttaaaatgaaactttcccatattgaacatagaatctccccctgcaaacctagtccttctctagcattctcaggtcagtcatggcatcacaaactactcaggtgcttatgctggaaactggaatcatcccccaacccattgtagtgaatcaataacacattctattctgtcttttaagtaactctcaaatctattccctccactgagcagcctagtccaagccatttcatctcttgcctgaatgaagacagttaccttcttactcttctgccacacccaccattgtctcctctagtttgtgtaccatccccaccccacacagcagccagagctattcttttaaaatgtaaagccacttgcatccctctcttaattatggctgtctattggctgtctcagactgggtacatggctcatcaggccatgacagtcttgtccctaccttccccttcagtctcaatttcaccccagtccattccagccacaccaccctcttctgttccttctatgctgcttttaagacccggagccttcacacagacacttcctctgtgggaggctcattcatcccgtcgttgcctggatgactaatctttcggacttcaggagagataccaaatgctaagaggagacttctttctttcactcgcattctccagtaacatggattcctctcatcactgtattctgtagcatttgttgaaactatatttcaaatatttagttgtggaattatttggactgtaagctccatgaggtaaaaaactgaccactttgtttacccctgtaccctcagtgccttgacaaagtgcttgtcacatagtagaaagagaacaggatggccacatacatgaatgaatgattaaacacccaatgccagtacaaatccaagttattttcatgcttgtgttcacgggacaccaaattaagtggagagataagatgtatctaatgagctggaagttgtggggtggtaagaaactcgtgttgaactagtttaaatattaaaggggagtttattagtccctgtagcctaactataggaagggcagggctggagttggctacaggtgctccaaagatggcagccaatttctctctgccttttatcctctgtctctgactctctcattcttgcttgccttcactctttaatgcagagagatttctccatgaggtagaaaaagaaaaagtgtgcatacagagccccagattcacaattttttagtctttcttgccaggaaaaccttcaggaggaattctgattgactcttatttgggccacagtctcattgctggtcactgtgtctgctattcccactgtggccaaggggatagagccatcactagtcaatcccaaagcttctgaggctagagtctattatcagaagggtaggctggcatctggagttggggaaaagtcccaggcagttaaagacagtggccaccataaagtatgaattctgcaggaacagagaccaggtaatatgggttgcaatgttcatagattgagcctcgatttttctggctcctgatatagcttaggttcatcagaaaacctggagcagaggcagctttacctgctcatagagtggacagccagcctcttgaaattctatgaaagaagtcattctttgggggtagaatgagagtcctcaatagagccagtagcaaccagctctagtccaaatattgttctctcttatttttgggaaattagcagtggagattatagacatgaaaaggcaatggggatccttcctgatggcagttgaattaataggtgaggaatttgaaatattcccaccaatcctccatagcctgattaaatgctcttctttccccccacaaggactaatagttaaagtcctattcatagaactcttatgagaattcagtgagctaatacacatgaagcccttagaatggcactgcacactctaagcactcagtaagttttagctattatcatcatggtaagacaagagggagactatgaacacagtggctaccaaaaaaagatgtcacaacctcttctgacgtctgcatcccctgagtctgcatccatatttcacttgacacatgtaacttttactttaagaacttgcttgggaaccagactatgggaatttctagtccaaaaccactgtgctggggcggggttatctaggtatgaccatttttcacctgagttcctataacagctttgcaaaatttagattgtgattgtaacattctgtgctgaatgctcactgctaaagcctgtgaaagagggttttccccaatctcctcctgagagattctgagtcagtaggtcagggtgagcggcccaggaatgtggatgtgttcagtggttctcctctcctgcaagtggttccagagaccatggtttgagaaacactggcccagaggaaggagaagtagggaagggaagaggtgagattaggaaaatgagcggtgcttattctgtagctgggttcacagagatagggagctactcaattacttttcaaagtcccaaagtgtccccagccaggaagagggctccccgatgtttccctcatgggtcagccaggtgctctccctttggggtgagtgccacataggtgtgaggtgcttaccatgcccactggtccactcagcctatggccatgggtgccagtgacaaagtcacagctctgccaagccccaaactaagtacctaatcactcgtgaggagtggaggccagaagtcccatgggaggaatgtctttgtgagcatcatggtggatgctccccttgggtccttgtccctgcacatgaagaaatttccaggaaggttcaggaatagattttgaatggtcatatgcaatcccaaagaccctgccctttggacaggagttggtgtgtattaaggcagcctgtcaggaacatgcattactaactcttatgcttttgtattaagcattatgtttcatctttacagtcagattaatggagattagtgattccacttaagagtttaaacatcgtgctgacccaaattgttggagccatcataacatggggctctatgttcaaggactggaccagctggtagtggagtgggggagggggaggtctatatattttgcaaagtgattttatttttctgtgtaagaaagctggggtgtctctttatacgtaatgcatatgtgatcctcccctgactttctgcacacttaaatgctcatcaggccagtctgatgatattcctttgctaagaggacacttaataatcaacggtcactcacacttggcttctgtgggtggaacccagtccctaaagtctccaatggtttcattaatgtattttatccgttcgaaggataaaaataaatctctcaaaggctcttagaaacctgccaccctggatgtaggaggaaaaaagagggcggctgttaattaataaacttaaaccatctccgcaggagtacacagctgtgatccagagaacataggaagcaagctcagccttcctgtcagttatgagttactttttattcattggacagacatagtaactctgtgcctattataaacaaatcagttgcaaattttgctttcaagtgaagtgttttgttttctcagcaagcatactcagggcaggtaaaatatccttttacatattctcaaaagggaagaacttggaaacagtcaaagcctatttggaaccaaatctggtgaataagatgtgtgatcaagctggggaagggcatgttaggccagagacaaggtaatgagacagtttcttggtgtggccagccagacccaaacactggctttgtcacagagatttacagttcctaagtgctttcatctgcactgtcttatactattatgacaataatccttgagagaggcagggctggcattttcacaaaattataagtcaagccatgactcaaaataggtgagccacactttgctgaagtgaaagttctgggacactgtagcagattacttcttcagaagtcctggccactagtcagcagtgtgcttttggagcaattcctttcctttgcagaacttctgttttctcataatgtaaaagtgagggtgaatcattttttcccaatctaattctatgattctatgaaatctaggctacaccagtatgtccaggacctctccataaacataagcagagtggccattaggagcatgcgggtggggcttcatcttctgctttgccgacagcacaaggtcaggttgaaaatgggctctgctgcacagtccatggtggaatccaacaggaccacaccaatgaccagcaaatctgcacgcttacccatgtgtctgcacccatcctcctccagtggaagacacatccaacccatcaaatgagtgcaactcagcctcttgcttttcagggcctcattcatttgttccccactgcccatctccctctttctgcacaccctcacattctcctctccctctactggttccttctcaccaacaagtgaacaacctgctcaagtctctgccatttcttttatttaaaaaaaaatagaaagtggggatgaataaaacaacgtgtccaacaccagaatgaagttttaatatttgctaatctttattattattctgtccttaccacccccaccccttcaccttcctttcttcctccccagaggcaggcaaacattgaatttggcatgtatccttcaagtccatggtttcatactttattatatacatgtgaataatatatggtatggtcttgtgtgcttttggaccaatcgacgaaaatgttttcctactatttgtgtcatttattattgatatgtttggacttgtttctattactgtaatgccctctggtatctcttgttgctaatgagaagtctgctcttaatctaattgtcatttctttttcagtaatcagtttttgttttctgatagcttttaagatttcctctttttccttgatggtttgtagattagctacaatgtatatagtgaatgaatttgtttttatttattctgcttggtatttacttatctgaagaccaatatctttcttcaatcagggagacattgtaaaccactatttctttgaacatttttcccttcaccattaattatctgtgtttggaactcctctttttcacactaaaattatctttattgttttatgttgggtgaataccttagtgcaacttttcagttcactaattctttatttgacagtgtcctgtttagaattatcctgattcttgggttaatttcagtgactgtcttttttctccagcactgcttcttgatatttttgtttcataatctatttttaacagctttactgagatataattcacataccatgcagtccactcatttaaggtgcataattcaatggatattggtataatacataatttttaaaaaagtgtggtaaaatatgcatagcacaaaaatttcccttgtaggggtgacagaaagtaaagagttggggggcaagagcatgccaacatttaaaagaggattcagggctatgcctttcccagaagaaaaggttgggtcaaatcccagaagaagatggtggagttagctatggagatcccaaaaaataagaccatgggcagaagaatgtgtgggacagccattttccactttgagcaccattggtatcccatgaagggctatgtaaacacagggatgttgatgccattggttctggatgagctttgggaaccactgggcagaagaaaggctcagagtctgcctcacatcttccagaaactctcaggaggtcactgtggctggagtcaacagtgcaaggagagaaatggaggttgagaggctcctggtggccaggccctgcagggctgggtagactttagtccatggaggaggcagtgtaaagtctttggtggttgacaggatatcctgtgggttccaagggctgtctttggtgtctgttggcagccagactgttgccagactgtcaggagcatagatcttttagaaggcaatgatggatggtgttgatttgaactgaggaggtctcagtgagatggtgagtggtcggattctaggtctggaagttgaacccaaaggagtccccacaagaacaaatgcaggctgtagttgtaccagtttgccagagctgccataacaaaataccacagactgagtggcttatacaatataaattaattttcttatagttctggaggctagaagtctaaggtcagtgttggtttctcctgaggccttactttctccttggcttgtggacagccatcttcttcgtgtgtcctcacgtgcacatctctctgtgtgtgtcagtgtcctaatcacaggacacagggataccagtcctgttggatcagggcccacccataggacctcattttacctgaatcccctttttaaagacccatctccaaacacagtcacattctaaagtctgtgggttagaacttcaatatgggagtttttcattgcggtaaatatgtgtgtatatacgtatgtgtccacatacatatatacacacacacaaatttatatatcatatatgtgatttatacttttatatttacctaacaaatgataacgcaagttatattaaatacatattctttacatttatatatttacataatatattaaatatatttatgtattaaatatatatctatatataatacattaaaaatgtattatacattacttacatgccacaaaattcactattttgaccattaatacattttcattgtcattaaatgtacaatccagtggcattatgtttacaatgttatgtgcccatcaccaccatctatttccaaaactttttcattaccccaaacagaaactttgtacacgttaaataactcctcattctccttttcctcctgctcctgaaaacctttcatctattttttgtctctactaatttgcctattctagatatgtcttataaatggagtcatacacatttgttcttttgtgtctggcttatttcacttagcataatttaaggcttattcatattggagcatgcatcatcattcctgttttatgctgaagaatattccattgtatgtatctatcatattttgcttaaccactcatatgttgatggacacttgggttatggtgaataatgctgcagtgaatagtggtatacaaacatgtgctccagtatctgctctcaattccttccggtatatacctaggggtaggatttctgggtcatatgttaattctatgtttagacttttgaggacccaccaaactgctttccatagtggttacgccattttatattcccatcagcattgcttgaagattcccatttttccacatctttgtcaatacttgttattttccactaaaaaaaaaaaatccagctatcctagtaggtatgaattggtatctcagtgtggttttgatttgttattaaccggatgtttgtgagcactgcaccccacctccccaccacctctgacccctcaagccctaaccctcagtgtggtggcatttggaaatagggcctctaaggaaatgattaaggctaagtagggctgtaagggtgaggccctgctcctctaggattagtgtccttataagaagggataccagagagctcatttttatctctctccatgcatgcatggaggaaacgccaggtgaggacacagaaaagacagccatctatgagccaggaagagggccctcaccagagcccagccctgctgtaccctgatctcagacttccagcttccagaaccgtgagaaaacatatttctgttgtataaggcacccagtttgtgatattttattatgttacccctaacagatgaatacaatttgcattttcccaatgactaacatggagcatcttttcatgagcttattggctatttgtatatttctttgaaggaatgtcagcccaaatggcccactttgaaattagattgtctttttgttgagttgtaggagttactgttttttgtttcatagtttcttgtctttttattatagatttgttatagatgttacttctttttctcctccaaatcattgctgattctaccctcctggtgcatcctggatgctgttgttgatgtccaacagcaatcatctctcctttcctccaccagtcctctgttcttacctattgtctctcttccttgaatccattctccacaccaaaacagaatatcaaatctatcatgttgctgttctgtcactactctgctcaaaggcattcagttgatctccaattcttttcagtaagttttgaattcctgtacatggcttttaagggcctccgtaatttgccttctatatacctctacccttccagcctcatttcttgttattctccctctgaaaatctagaacatgtctctgagtctctctctacaaggctttgcgtagaaagctctgtttgtactgttttgtaagaaattaccaaattgtctttcttgctcatctgtggctttgcaatagaagaggtccctctacttttctatgacctccttcataaagcaccccagatgcccccatgacagtacttatcacatttggttatcattgcctgctaaattgcctctcttccccaggtcagagcaagagtctgtcctcttcttcaatgtgtccccagcatttagcacaatatttggtacatagatacccagtgcttattattatcattagtggtattattcccaccccattgaatattccttttttttttttaacttaatgtgtctggcaacgtgtagcctctgtgcctttgttcctgttattcttctgatgggatgtccctcttcatttacaattttctccctaacatttgattatgacagttttcaagcacataaaaaatggaaaggatactagttgattcctattcttcactatctacatgctacaattagtattttatttgacttaacatgtgtattacatctatctttttttttttttttttttgaggcagcatctcactgtcacccacactggagtgcagtggtatgatcatggctgatacagcctcaaactcctggtttcaagcaatccctctgccccagtctcccaagtagtggaaactaaaggcaggcactatgacacctggctcttcttttttcttttatagaaacagggtcttgctatgttgcccaggctagtctagaactcctggcctcaagcaatcctcctgcctaggcctcccaaaacattgagattacatgtgtaagccactacacctggcctatccattcattaattcatacttgcttggggagtgtatttcaaagcaagtttcagacttcagtatacttctaacctaaccattgcagcatgcatgccacttatttatgtttttagatagaatttacatacaataaaatgaacaaatcttaaatgtatcatcttatgactgttaccaatgcttacaactgggtattccaaacccctatcaagagctatagcattgttactaacccagaaagtgttctcagaccacttcctgcactgcctccagcaactcccaggccaaccatggacaacggtttttctgatttttttcctccatggattaaattagttttgtgtgttctggaacttcattcttttattaagatctttttatttccctctatataatgttattgagattcatccatgttgctgcatgcatcaatatgtttttttttgttattgttacttgttttttcctttgttgttgttttccattgtatgactacagcacagttggctattcattctcctcttggtggacatctgggctctttctagtttttgactactatgaataaattcttgtacaagtctttttgtggacatgtttccatttctcttgggtaggtatctgggagtgaatttctggggcatgtgataggattgttttgttttgtaactgccaaactgttttccaaagtggttgtaccatcctccattctcaccaatgacatgtgagagttttggctgttccatatcattgtcaacatttggtgttgtcagtctctaattctaactattctggtgagtatataagtagtatcatattgtggctttaatttgtttccctgatgaccaaatgatgttgagaatttcttcacgtgcttattagccattggtataccttcttttgtgaagtctctgttgaaatattttgcctatttttgaaagtcagttttaatgaggcataatttacatacagtaaaaaatcatctcttgtaggtatattttctaagaattttgcaaatatctatagtcatacaattaccacaatcaagatataggacatttctgtcactgcaacagtgtccttgcaccctatatagtctatactcacccctttccacttgtaaccactgatctattttctgtccctaaagttgtgccttttccagaatgtcatacaaatgaaatcaaatggtatgtaggccttacagtcccattttaatttggttgtttgtcatcttattgagttgtaggagtgggtatatattctggatgccagcctttcatcagacatgtgtctgatgaatattttatttcagagtgtgatttgcctattcttttttagtggtattcttggtaagcagaaatgctaaattttggtaagttccaatttgtcagttcttaaatttgatagttattgttttctgtgctatgtgtaagaaaactgactgtccaccatagaagagatttttctatgctttcttcctgaaactttgttttaactttttatatttagttcaatgatccatctcaaattaatttctgtgtatggtgtgagataggggtcaaggttatttttttccctagccccctcagtcaaaaactaacctctcccagttctcccatagcatgttatgtactgggggtagacactcatcatttccatcttctgttatgtactttttattttttgtggactcattgtttcttcaattggactgaaagtttctcgggcaagggtcacatattttatgtaaagaagcagatagagtagtgctaatgaaatatgttttggggtctggtggaaccaggattgaaagcaggtgctatcacttgccagctgtgtaaacctgagcaagtcttagaatgcacgtaggggctactgtatgcctggcatgaggctaggaaagaggtcataaaggtgaatgcagctcaggcaggtcttgaggggccccactcgtgtgtagggggtatggaaaaagtaattattaaacaatgatccaaatgctgtgacagaaatatgaataggtggttaagggatcagagagggtggggaatggcttcctgatagaggtgaagctcaccttgaatttcagtggatgagaagggttagccaggcaaaggtagatgagacagggattccctggtggggacagcagcaagagccgaggaactgaagtgagtttccttgatggaaacaaacaaattacacttcatggagttgttgtgagaacattatgagctaacaaacgtggcgtaaggttgcactgtttgagacatattaatactaaaaaaagtacgtattgtttatatgaaattcaagtttaactgggcatcttgtatttttatttgctagatctggcaagcctaacgtgatggcactcagcacagtacctgatacatagttggcacccaaaaagatatatgttaaatttaactttaagctgttctcctctggaatagaagagaagggataaaactgagagataaaatctgaagaggagcaataaaatagaaaaggcagaatttggtgcttgatattattgaaaattttcctttcagcggtgatggcatttcctggcaagaataaactttgtctttaaataagtctcccttcatggttagaaatgctcctggaaagaaatgaaggagtccttccatgtgagcagtgggtgtagtttcggggccaggggaccagaaggaaaatattgtgcatagttttgctccagggcatgtcatgtaaatgttccttctttcttccttgttgtctcaggagttctgaaaatccaggtatttcttttgcagaaaacacttgggcactgaagtgcaccccccaccccctacccccgccccacaaatctgtatggcttggtttcccaccacactccaaacctgggcccccttggaagtctgaatcatcttaccctaccttgagccaccctgagggctccgctcccaggaccatgcctcctgacccactgtcggaggggagtcagggcgctcccagccttaggtgatatggctgcgtctagatgtgcttaacaaattgcctgttcactcaagtacattttatttaatcacctgtaatcatataaattatgcctgatggtagtaaatgttcatgtcagttcctaattacagattgattaattggctggggtgatctgtattactacttatataagaatatatgaggttgatgataaattagggctggtaatccgagcccgggaacatggaatatttccaactgcatccccctttttgggagtggggaagccattgcccttttcctatcttgttcctgtcagaggcttctgggagggtttctcttctatggattgattgattttggcaacacttgagtcaagaaatactatattatttaggtaatatacataagcgtttgtgtaaaatttttgccatgcagtgctcctttttggctgtagcagagatgaataatgacaagctcattaagttcagttgggctcattacagcctgctgggcccagaaagttccaggggttggatttggcctagagagcaggaatccagagaatgaagacacgaggcatttgatcagtgtctacaaaaccagtccttattaggtgattacgtctttttgtttccttagaagctagagtgttaaatggtccagaatgtaccttgcacttttttataggaacattagaccttggtggatgtctttcaggcaacttgcctgggatgtctaatagttagttctcagcttttgagaacatcatttacttagaacaaactctacttccatcatctttgcttctctcccactcatacttcgggttaaaggtaaagaggaagcaacatgggctaagacatgtgggaggagggagggagaatctgaaaacacaggggtggaccctggtttcagggaaggggcctgagacttgatcccaggttccttggcctctgagaagggatgggcagaggaagaatggcagagaaacctgtgggagttgaatcctctgaagatgcagcatcccaggggcttgttactagagagaaccatcagctgacctctccccttgacaagctaccatgggagcaatgatttattgccattgagggtcatgggtgaccttcttttcttggggattttttaatatggtgattgtatcatacagcatcatgccatagagcacagcctctgcctgagttccagtcttagttttaccacttagctctgtgatctcgggcaagttacttagcttttctatgcctcagtctcctcctgtaaagtggggataatgatagtcctacattatggggttgttgtcaggattcagtgagttaacaaagatatggatgctgagaacactgcctgatacattggacacatcaaaaaatgtggggagagagctgttttcgttataaactaatgtgatctcaaaacagccctggggatacactagggtggaatactaaactcctttgttgggtgagacaactgagtcccactgtagtgaacatcttgcttctggacaacaatttaagtagtgtagtggtaaggttggggccagtcgtggtggctcatacctgtaatcccagcactttgggaggctgaggcaggcagatcacctgaggacaggagtttgagaccagcctagccaacatggtgaaaccccatctctactaaaaatatgaaaattagctgggcatggtggtgcctgcctgtaatctccgctacttgggaggctgaggcaggagaattgcttgaacccaggaggtggaggttacagtgagccaagatatcacacaactgcacttcagccacttcagcctgggttacagagcaagattctatctcaaaaaaaaaaaaaaaaaaaaaaaaaaaagtagtggtaaggctggaactaaaacctgtgtcccctgactctcatccttagtgtgagaggcaatgtccctgcagacaaggccagtagtatttgttcagaggattcctagtgtccacacttgcatggaaaaatcttgcctttcttttagcttccttggtctgagaactcaactctcatctggcaaaagcagaggcttctcttgagtgaatgtatttctttccccttgattttcaatttacactttccccaacttggtaaaatgatcaatctacttctcctcactaataccccatgatatgatacaggggccaaactgggccttctaacttcctttatgagttaacactttgagtgtgttagggttttctttgggactccatttgaggcagctaatatgtggtgtgactgagaatatcacacaacttaggaccagggagcctgacacccaatgccagtttttatcactagggagctttttgctgcaagtaactgcaagtaaatgaaaataaactaaattaaacttaacacctaatgaggtttttttttttttttttgtttgttttttttttttttaagcttatggaacaaggtatccagagttatggcagttccagaggtgtgtggttcagcagctcaatgccatctcagcctctgcaatctgtttgacctacccaccttaccaggttcccccatggccacagatgactgctgtggtaccagacatcacatatacattaagtgactcccagaaaaaagatgtttcctcccatttgcttctttattggctgaagtttctcagctgacattttctcaggtcctactgcccaagattggatcacatgtttgccctaaactaataattgttgaagggactgagacaactgtgattggtctagacctattatgattgattccttggtggtctgaggagaagggccacctttcctgaacatatggcctggtaggaagtgacaccgaaacaaaatggaaactgtcagtcacaaaaagtagatgagtgtatatgtgcagggttagaggaaatttttttttttttttttttttgtggagtgggtagtcaacagtgtctgctctgggcaaatcacacaaagtccctgaacggcaggaaccaagaaaatcctgtcaggtccataggaacaaagattaaattgccccagaagaaaaccacaataagtaaggcatatctccaatataactttggtttttattcagctcttctcattttgctctttataataccttgcaatgagagatggctttcacaactttattctgcacatcacctggaggtgtcagatggtaaatctgtaaacaaaccacacactattttgtgatatacaggggaagtatggagtctccattctctactccttctttcaaatgggcccagttgacaccatctccagcttcagaggaggatcctcatgactcctggctaatcagagcctggcatccccttggctgtggtaatgggtctggagatgggcaagttggcccaatcagattgaaggaaaggactgctgttgcaccaggggaagattcttttccccgctcctgctgtgtgggaacgaggaagcacccagctctactgtccctggaaaccatcttgtgaacacgaggggacagatattatatctgacaagaggaagacagagctgagcaagggaaagacactagggcctcagcagcatcattgagctgaagctggggtctccacctttgatcttgctgagtaagatgacagttttccttatgacttaagtcaacttgaattgaggattttggctacttgcagctgagagcatccttattgaaacaggaatcagttattttcttttacaaatgaagaaactgaacaagagaaaggaagtgagctgcctcgggtcctatacccaacagagtgttggataactggaagctaagtcttttgaccctgaggtggcttttttttttttttctacccaattccctcctatcatgggggacttcttatcaagcaaaagttatcttgaggtgctctggggagtcggaggggaagggtgaaatgtttcctagggcaccaatagggtctggatgggaaatctaattccttctgggttggctgctggctgccatctggtcgtagataattattaccctgccctttctttgtctaactggctctgcagtaggaacaattgattccaatgaattgtgctggtaaacaatatcttctgcttcctgggggcaacttataaaacaaaggatgagggttcccccactaagagggagggagcagggtggagaaggggcatagactaaggagccatggtaacaggcacctctgaggttggtcatggggaaaagtcaggctcgggtagacccagcagctggagccattgtgaggttgttctgagggccacaccactccatctatgacactgttagtttcagaaaggagctcactggtagaattcccgtggcatagaagttggtctgtgatgcacaccagctgtaacctggctgatcccagggggagctctggggctaaaatggctcatcagagttgttccatattaggtggaaatagcctggcctttacagtcctaccttcatttgtcattagatatgggctgcccttggaaggatgtgacttggggccccgtggctctctgcagccgaagtgatcctggaggggctgacagcagagggctgacctataactgtgttcctggcagctgtgtcactagtcattcttgaaaggggatctgggtggtgcatctgtgtttatcatacctttccctaccaactactcactgagaatttctcattttggatttgcctccttagattcaaggtaacactgccttgaatctcatgtcatacagtaactactgtatggtaacttagtctgtattgcccaaatgtgtatttttgtgggagttctggggactgtgactccacctccttgcccagccatggtgctgtcataggagtggggcttcttgaacaggagactgttgcactatctaggtttatgcctcatgtctgctgtgaaccctggtggcaatgcgatgctcagcaactagcagcccaccttaagtcttagaggccacctcttggcttcagaagggcctatcaggctgggaagtggttctggccctttatggatggatggttagagtcagtgctgttatcactatgtagcataatatatattttactgactggctcttgctggggccagaagtgggacccaaccccagtctgtgatgcaagttagttgcaaagcctgactttgtctctttttccccatttatagaacacagataatatcttctttttgtggtagaagactattgtgaaagcaaatatagtaacaaatatgaaaataaaaagcctacagaattgtgaaacagtgccactatcatgtcggttattatcagaagtggctgctgaactgcatggaaacaatacttcatatgccttggctgcatcctagaaaagacagatgccaaatgcaaagcatttgactttggcctagtggttctctgtgcatcagttttctctgcagaagaaccagatccttttccctagaagacccagcttgaatctcacctctctattggttagtgatggatcacttttctgatctatttgccttgtgtttactcctgtcacacttaccaacctgctcttctgaaagtcttggttcggtgtgtaacatgggtaagaggatcagctcttggaattatctcccttctttttcccatccagagcctcccaaattcagagacagacagggctttgggcagcagaggcgttcccagactgtggcccacaattgagaggagccggcatgggtgcctggcaggtggccagagatgctgggagatgggcatggggtcagagctgccctgtggcagatattgggcttagactcgtgggatgcactgacagagactttaatgataatttcttgcaattcttgccttttctctcccctcccctaccaatttaatagtcaaaaaacatttttggagcaccttaaacatgccaggccctgtgaaagggaggggagattaacattgaacaaaacagattaaaatccctggcctcatgggacttacacactggtttgaggttcttctgagggaagaacattcatttctgggggtgtgagcagcatgtgcaaaggccctgagatggatcctggcctggcaaatttgaggtatagctggtggggccggggagagtggcaggtaggagatgatcagagagacgataggcactgacagtggagcaccacaaaggatcttgcaggtctttgcaaggactctggcttctgctctgagtgagacaggagtcactgcagggttctgagctaagggtggcatgatctggcatggatttaaaatggtgtctctggctggtgagtaaatagactgtaggaggcaaagggtggagcaaggagatcagtaaggtgtctgttgtagtaatccaggcaagagggagggtggcttggatgggggcatatcagtggaggtgatgagaagcagttgggttctggaagcatcatgaagccaatattggaaaatttaatgacagatgaggatactggtccagagagtgatttgggccagaaaggaatgatctacttgaagtggtacagctagtggcagactaggacgagaatagcctggaacaaaactgacttctgggcctgaacgttgcttcccttgtgtttgatgtgcttgttggttcatggacatgtgcttgtgctagtgaatgctttgttaatgtgtgcctgtgtgtgtatgagtgtgcgcatgtgttagcacgtggggtccttgcatgtgggggcaggtgaagctgggctggagcaaatgaaagcagcagttagagggagctgtgcctcagctgaccacctcccaccttggaggagcccataaccattgtctgcctctccctacatccatcctgcctcctcctggccccttccggcccagatccttcctcgcccagccctgctgatcccagtgcaggctaatctgcctttcatgaggcagtccttccccatctgttccaacaatggtaaggaaagattgaacccttagggcttcattctgacttttttttttaaaaaaaacatgtaatttgctcagtccaagtcccaggtgaccagctctgtgactgggtatctctttgtggcttggagctgggatggggacaggaaggcgtggcagatggggtaggtgggagaggatgactcacacaagataatggcagaaacagtgatgggatgatgtctttgtgtatctccaggagaaagtggatattcagtaatcacctgggagagatgcccatgacactagatgggaaaagggattttcattagaataccggaaagaccacactggccatcactgaggcccagggttcctccttgaggttttctgtgtggacctctcctggttctggcaccagctagctgtgacgtcaggctcaggcagcgcttctcctggttagctatgctagacacattggccaggaatttatataggactttggtaagtccagtcatattttagcatgaacttcatcctggggtattgattacatgaagatgcaagtgtcagttccctggtatccaccaaccagaatggacaccatgaatgatttggggcaaacattcccacgtttgccccaaatcattgcttcctgaaagtgctcactagaattacctggagagtgcttaaaaattaattttatttaatataaaaatgtaaaaagcactacagtgacaaatcttcccatacctcattagtgcattcccctccactgtgttaccgctgttatggggtctgtggtaccctctcagagtgtctcatgaaagcaaatattgatagagattcttctttcctctcacccactttctgtacaaaatgaagcattctaggcatattgctccacatgccacttctttcacttaatgcattttagatttctttttacattggtacataaaggatttcactttgggtttttttttttttgttcacagagatggacggcctggcctggtctggttcctcagtgaagaggagcccaccacttcctgtgccagtccacttctttgttggacaactgtaggggtttaattcagttgcattcaatgttgatggagtagctactgggtcttatgcactcactgagtggtgagagggcacagcccttgtccccagggaattaacagcttgatgaggatggcagatacatggattaaccctaatgcaccgggagccttgtggcagggtccctgcctagcctagggggcagtatgagggtgacactcaagaggaggaggtattcagctgcatattaacaatctgtattcattttctgtggctgctttcactagttaccaccctcttggtggctttaaacaacagaaatttattctcacaattctggaggccagaagtctgaaatcagtttcgtggggctgaaatcatggtgttggcccggccatgtttcctctggaggctccaggaaacagtccatttcttgcctcttctggtgtctggtggctgctggcattccttggcttgtggctccactcttggccccagccttcacattgccttctcctctttggtttgagtaaagtctccctctgtgtcttttgtgtaagaacacgtgattgtacttagggcccacctggatcatccaggatcatctccccttttttaagatccttacatctgcaaagacttttttttttcctgtaaaaataacattcataggtcccagggattagtttttgatatcttttgagtggtcattgatcagcctgtagcagaagagcggaaacagcctgctgaggaaggaaaggaaagtattcaggagggaatgcgcatgtgcaaggcacagggaactctgcaaactctctcttcccagagtccatggcctctggccatgtgaagaaatggcacaattcttctaaatcttcatttgccctggatgggcctgcatctgtctttgctgattctttggagggtgctcttatggctgtgggctctgtggctgcactggaggtctctagttcctggcctttcacagtctgcacctgtgtcctccactcatgttgtagaacaaagctggtccctagggacattggaaagtgagggaggttggtcttcagtgtcttcctccctttgtgatgctttttctctactctcttcagatgattttatttattccttcacaaacatatattcagctttgtctacatgcaggtcctgtttctggtactggggatagggtgttgaatgagacaggtgagatctgtgcactcccagagactgtagtttagaggaagaggcagtgggataaactagtgagcaaatatacaaacaagctcatttcagacagtggggaatgctgtgaagataccgaacagggccatgagataggaagtcggtgagtggagatgggaagggcagggaagacttcttagcaaggtgacatttaggtgagtcagaatgacaagcagcagcctggtacttgaagtcttggggtagaacattccagcaggggtgttaatgagcactaaggccctatggaggaaggagctggagagttaacagaagtgagagagggggtggccagaggtgacattggagacacagaaaagggccagctcatgtacagcattgaagggcaacttcaggacattgcttttaatctaaagaagctgggaagtgatattagctggggtttgccccaggtgctgccaacagcaggtgcacatgccagggagccagaggatgcatgagtctctcctcaggagcctgaagacacatgcctggcagtcataggggcactggaaatagttagatttgggtctgaataagctcatccaaacagtataaatggagatgagaaaagacccccaggctgagatctgagttggccaatactgagatggcaagcagaggagcaggtaccaatgaacggacagagaagaagaggcctgggaggtaggaggaaaaccaagagggaagaacgcatttcaagaatgcagagcggtcaaggttcacctgtcctgtctccctgaaaggaggactgctggcaaataaattccttcggcaatgtaaagtctcctggaatgagtgtttttgagagaaatcaaacccttaagcaagagttcagtattattaacgcagtattgcagggagggttttccctgccatgtctttgggccttagtgatgtcaatttataacctttttgaggttatcctgttggaggtagagccaggaggctgaagactgttggcagggaggagatcaagacaccatgttgtaagcacttaaaaattaaactcagcctgtgatatggctgtttagagagacattccttttgtttcaggatggaaggcaacatcattctgtagcaccacattgcttctgagtggacacttgccattgtctcaagctacctgttaggttgggatctaacaagccagacatctgctcctccaacagagctgctaacactaccaacaggacattctgaaaatcgtgtcaaatgtaattgtaagtgtttctacagggatctaagtgcagatttaactcatttaaccccttagtgaatggcaggactaagtcaggggatgctggactagggactctgaggcccttacaacctgaggagtctgtgatcctaggacaaattcttcattaaaatgattgagtgatgatgggataagctttcataaatgcagctgaggcacaagatttcttattcagcagaggcagtttttgctatatcattcaaatagtatgagcatggctgccagccaatgcatggacaggcctcctttttgtgagctaatcatctatgtagcctttccctaaaagtacccatgagatgaggatcagatcctttggtgtggcatgcaagccccacttcagtctggccccaacctgcctctgttgtgtgctgttgctgcagtctcttcccacccccatcctcatattcactgctggacacgtctcccctcatgctctctgcctgcccatcatccagcccctggcacaggacatccctgactgcctgcctgctgaccgcctgcctccacttcaacgggacttccagttcctggcctcttctccagcctctgctttgttcactcttccatacccagctggcataagatgactcgttttgcaaaaagctgctattgtccagcacatcttcctgcagcctgaacatactgtgcttctccctccagttccttagcctctcatgtgaacagctcctctctctgctcttccaacaagactcccaagtttttccccttccaggaagaggatccttactacatcagcccttggtaagctcatctttgcacttattctctataacttccacatggcctgtatcccatgctgtctagtgatagcttctgtatttcattgactgctgctattgcatgatacttgctagggaccccttcaattcatatgttgaagccctagctccaaagtgactatatttggagacaggaatttagcaggtaattaaggttaaatgagttcttaaggatggggttttaacctgataggattggtggccttataagaggaagatctctctctctctctttctccctctctctctcttcctctctctttcttcctctctctctctcttcctctctctctctcccccccctctctccctctctctccctctctcttcctctctctctcttttcctcttcctctctcttcctctctctctctcttcctttctgtttcttcctctccctctccctctctcccccactccacccctgaggaaaggccatgtgagtacacagtgagaaggtgaccatctgcaagccagaaagagggcccttaccagaacccagcagtgtcagcaccctgatctcagacttccaactaccactgaaaaagacagaaaggagagaatatggtggaatgtggctctccctagacaattgtcagaaagctcagttggttctcagttttgggggattaggagcaattctgctggaggcagagggttgaaccagatgacctcttggattccttctctctgatgatgctgggaagacatttctcatggtcttgaaccacgagataaattgctgctgtttaagccacccagtctatggtattgtgttatggcagctggagctaagatgatatctattgtcacttctatgtcttatctgcccaataaactctgtgctcctagaccaaatttgtgggtttttaaaaattttaacttatgcttaacatgcatcagaaagatactcatattctaagtatatagcttgctgaatgtttacaaactgaacacacctatgtgaccagtgcccagaccaaggaatgcacatcaccagtgccttgatgcccctgccatgccgccttctagcctcctctagccacaaaggcagctaccactctgactcccaagtatagatgagttttgcctagttttgcactttatgtaaatggaatcataaagtatgaacttgtttgtgtctggctttccatttatgaaattcatccatactcttgtgtgtggctgtaggttattcattctcattgctgtacaataatccactgtggaaatataccacaatctagttatttactctactgctgatgggcatttgggtagtttacagttttagccattacaaatagtgttgctatgaatattctagcatgggtcttttggtaaacctttgtatgtgcttctatagggcctatgcctaacagtgggattgccaggtaacagggcatgcatatgctcagctttagtggatactgccaaacacttttccaaagtaatcaaactgcctttactagccatgtgtgagaagagctatttcttattctcttttaagcctctggcatagggaggaatgaatataagttattcagaaatgtctgctgaatgagtagaacgaggactttcttggtgttcacgtatcagtggacccaaggatccatgtgtgaatgaaataggtggggttaatctgaccttagtgtccttggtaatctgaatgttcagaaactctccgtagatgttgaaaaaaaaaagttttttattttgagtcctggttgtggaggtttggcccgatcactaccttcctggtttccccattacttcattaaatatctgcagtggaaattcatttggaggaggcccttggcattgtcagcatgcagagcctggctctttcctctcatcagatatttctgcacaagaagccagaaagttggaagttagaggcaaataagagtcaatcatgcagctttggaagctgtggtcagaggaagatggattaaggagagctgtaaaggacttctaccccatcagagggccactttgggagaaggggaggaatggcagacaggaggaggccccgtggtctccaccaactctcaccacttgcacatgctacatcttttacatctttgattcgcacctcagcaaagaccctggaattcagaagccctggagttcatataagtgatgaggccattgggaactcctagtgatttaaaaagaaatcagttccatcaaagaatattgaagttcttgcaaggagccccagggaatttctgattccaccattcctcatagaaggaagctcccagcaccttcccactccacttctctggatactcaccaggttcaatgctccttttaaaatgtggaggccagaggaaggggctgcaagcactgctggggctaacactttcccagatagggatgttaaaattttgttaacaccacattaagattttaatttgctctcttttttagtaattatattacattgttaattcatattaagtttgtggtgagttaggccgggcgcggtggctcatgcctgtaatcccagcactttgggaggccgaggcgggcggatcacctgagatagggagctcgagaccagcctgaccaacatggagaaaccccgtctctactaaaaatacaaaattagcctggcgtgatggcacatgcctataatcccagctactagggaggctgaggcaggagaatcgctggaacctggaaggcacaggttgcggtgagctgagatcatgccattgcactccagcctgggcaacaagagtgaaactccatctcaaaaaaaaaaaaaaaaaagtttgtggtgagttgacaaactcgcccacacccacgttttcagtgaaaaccactgtccttccctgttagcacctgtgtaacagtcactgttttgtttaagttaattgcaatactttttgtttatctttaatttcatcttgcaggttgtgacctggggccttagtctgaccttcaagttaaggtagcaagtcctgttactttctcctcttaacttctcaaatcctcctatttcttggcaatgctgtctttgcctgctccctcacctggaagactcttctcctctctacagccccaccccagccttagcctaggtaattcctacctttgcttgctctggaagaacttccccttctatatccctgcagccaaggactgtgatccttgggaaggcaggtgagctgaaatccaggacatgtcatcatagactcttggtggacccccagcaggtaaggagcacttcgtgggcatcagcatagctggggagacaaggtgggcccccagctctccttcccatccccagatgcaccagtagaacaggaagaaaggagtttggcacttgaggtgcatgcctaaaagtctcctcatgctgagcctatgcttcctctggtgagacagtcctatggagaataaaatgctggctgtcatattgaaggggctttgaagaaaagcactaactatgaatatggagaaagccctcatactgcttacaatccagctgaagagatcaccaaagtagggtttctcttgggaagcagtgggagtacataattggaaaatatccttccctccttctctccttcccttcctcccttccttcccccttcctttccttccatatttattgaaaactcagtaagagtcttgtactttgctaaaccctaagaacatggcagtgaatgagacagtcatgacaccagcccttgtgggctgacagtgtaaagtgagattcagaaactaaacaagttgcttgatgagttatgtaaagacagttgtgacaaggaactgaaagagatgtacagggtgcaataagagcatagagctgggagccttgacctagtctggaaatgctagagaaatcttggagaaagggatattgaagctgagttctgaaggacaagcagctcctgttgcgctgttttaccacctgattttgataaggtaagcttttattgaaagaaagaccaaaagtaaacatttgagagcctcttatccagtctgacacatccactctataaattcaaaggttgacttgggtaagacagacatcatcagttgataggcctgtgactgactctggtttctgtgtagtagccattccctaagtgttacctccaatgatagtaatcatactattagtgataatcttactattattaaaatgaaagaggccaggcatggtggctcatgcctataatcccaacactttgggaggctgaggcgggcagatcacctgaggtcaggagttcaaaaccagcctggccaacatggcgaaatcccttctctactaaaaatacaaaaaaaaaaaaaattagctaggcttggtggcgggtacctgtaatcccagctactgaggaggctgagataggagaattgcttgaacctgggaggtggaggttgcagtgagatgagattgtgccactgcacatcaacctgggtgacagagctagactctgtaccaaagaaaaaaaaggaaagaccattttgtagagtggaaactgaagtgtagatattgtttgggacaaggcttggtggcctcactatggaagcacacaggaggaatagcgagactgtggatagggaagggtgaggagggcacatggggtcttcgctgctcaggatgttttggctgtttgggctgctaagtggagggaggactttgaaacacaatctcaatgtaattcaatccaagattctaagccctcataaaagaatggagaaaagaatggggttcaagactgggctagaagagagttacagggaatgggtgtccccacagtgtcagactcagaatgaaagccttccatcaacagtgggtgcctcagttttggaaggctctagccaagacttgatgcctagcagttcctgctgtgagtggcatgctgggtcagttcacctcactggaaggctgagattgtctgagaacctgatgttctaacatgagtcttttaggaggtgagagtgtggaatgaaaaatgaataaataagaaatggaatgaggtatagactttgagagtggggtgactataaactaaaggagtgagatgttggggaaatggattccagggacaaagagattgacccagagaagatatattggtcttgggattgaaaacagaagtgggagaatatggtagaatgtggctctccctagaaaattgtcagaaatctcagttggttctcagtcttgggggattaggagcaattctgcctaaggcagggggttggaccagatgacccctcaggattccttctctcctgatgatgctgggaagacatttctcattgtcttgacagtcctgaaatgtcttttcttaatggggaatttatctgctggatccagtttaactgttgcatttgtattttatacatgcacctgccctggggcaatggttacattttaaataaatcaaataaatcaataaatatgatacgcctcactttaatcattacataatgcaaaaaattatgataataccacattaagttgcaaattaagacacgtaaaagtaagaaaatgtggaaatgaatgttctcccagcaacattaactcccctgccttgtgatgtggtataataaagtctatatttatatctgcctacctagcagtctctcattcagcacgggccaatgtgggagattattgccaatttaaccttaacttttgtgtctgatggcttgttgtaaatgtgctgtcttaattgaagcattagcctggctcctgcaaggaagatagaagggtgcaatattgggttcccaggctttgagcgagattgcctgggcttggcatctcagttctgtctctgagacagagttctgtctatctgagttctgtctatggaaactgcccattagctcagttctttgtacctccttttttcaactgtctgcagcatctggatcttagattctcaccatcctccacaatagcttcaaccaggttactcccattattatcttattgtggttcatttattatataattttgagaaaaagtgttctgttgctcaaaataattttccaaggacagctctagttctaatatttcagatgagaaaatcagggaggcgaagtaacttggccaaggtcacagctggtactatcacggagaccctccacctcaggctatgactcccatgcaggccagccactttccactgctcttgttcttgcccccacctaaaagctgccttctgaacagtgcatggctcctggttagcatctgctgcggaaggacagactgggcatgtgcatgcaagacagaagaggttcccagagcagtaagggctgataggaaaatcataggtgttggagttaggtggttacagattccagctccactgtcatgtgaccttggaccatttaaagaaacctcagtttcttctgtaaaatgatggaagagagtccaatcttttaggattcagtgaaataatgtgtattaaatacccatcagagtgccaggctcttggcgtgcactaaagaaatgtaagctgagtttttttttttaaaatgctctgatttaaagtatgagtatctttccccaatttcccttgagccacctgaaattccatcagtaatgacacatttaaataggtcaatcatttttctctccccattaaataaccttaccactcttttgacttgcagagactttaaaagatgttgatattctaagctctcaacacctcaaatggctcctcattgcctatgggatcaattaaaatgctttactctgcagtctgccaacatgccagatagacagggcaactctttactctccgaacatctttttggcttttgcatctctatgccttttctcctactgcttcctcctcctggaacaccctctctagtctcccttctcccttgtactcccttctacactgctgtctctccactgatcaacattaaatctacccttcagggctaaattcaaatagcagatcttctctataaatctgtccagatttccccagactcacgtgccatcttccagtttcctgtcccaagagctgtattgcttcacaaatgactattgttttactttcccgtatggattggtgtgtcccttccactaggtctatgaggacaggaatcagatctgaacagacaactgtttgaggataggaatcagatcttcctcagctttaccacccttgcagtaatgatgagcacagagacttccatgctgggcaaatactgaattgaatcgaaacttaaatgttatcagctctatgcttactctcacatgacaggagaggcagaagcaggagaattgcactgggtcctaagggaagggtggtgggtgggagaatccagaggggctataaaggccaaattgaatgttgaagtccaagctattgggcaccacagtcttgccaagggtgggatctgcagaaatggaactaagaacctcaccaaaatcaaccagggcccaagagaaacggatgatggttgtgttgtttacagcttcattatttctgtgcaatcttttggaagctcatcagtgtaattatcccagcctcttaccaaggcctggagttttgaagtcccagggatggcattatttgggctcaaactgggggaagtgcaatttgtttttcctgttgttttactcaaaaactactgaatggggttcataatcacacttgagctgcaccctaaggagccttgtgttttataggccccacttcctggaaggaggggacaggtacaggattgagacagtgacttcctgcttcctgtaagaaccatacaagggatataaagctcacagcaacaccaagacatgaggcttctgtgggcagagtgttgtgccaggtaccgaaggtgacatcaaagaaatagaagagatactccctgtttgtcgggaacttacgctgaaccaggtcctgtcttagctaattagccccatagcaagaatttattgagcaccagttgcatgcatgaaattgtgctagaagaaactagttgtgatgaaactatgcaattggtattcggtctccagggctaccctcttgtccttgtgagctgtcttctccctttcacctgttcccaggtgcccaggagggctttagttacatgtaatccaggccagcaggccatcccttggcatgtgagtgcatgtgtgaattgctgggttcccctttccacatcatttgcagcttcaaacagaccttctttgggagtgaccacaaatatagaaccccaattctgggtcactcactatgccaggatttttgtcctcaaattataaaatatttcaaaggtgcagaaaagtgcagagggtataaactctatctacccagaattaacacgtgctagtatttggtcatattggttttagatctttctttaaaacaaacaaacaaaaaaacagaacctcacatgtatacttaaattcttcctagaaccctccctgatacattacctcatttaactcttataatagcccatttgctttaattgttttctccttttgctaaagagtgaagttgagcctcagcaaaggtaaacaaggctgaatacatagagcttataagtgggacagtaagcatcaaacttagccctcactcacctctgaagtccacatcctttcaacctgcccactactctaaatttttttcctaagaaggaagaaagactatattctttggttaaaggattttggaaaacagctagcagacaaataattgtgtctttgcagcagagagaaggggtctctccctgagaaactgcactgctccccacccaccctcccctctctcaaagccccttgcaaaaccccaaccattggtaagttagttaaaatcacagacagcccaagcatatgtacatattagatcttctctctttcctttagggaatttaaaggaggaaattaaaatcacctgatggacaaaagtgaacgctgtgggtttgtttccactgcgattcttgtcagtggatggtcactcataccagctgcatccaccaagctgatgtgaaggagttggagtcagcacttgctaattttgaagctgtgtaaatgagtcactgtattaagggaggatgtcttctgctgcaaagaataggaaatatgactcatggtggcatgaaaagcactcctttagttatctccagtcgtgtaaggccaagaggtgaaggattctgagaggaggttcaggtacacattgtccagggctggttctgagcccagcactgtcatcaaggacataggctcctgcctcctttcagtgacatcatccttggaatatttttttggtcctcatatttgttgcctcatagtcccaaactggatgcagcagctccaggcattgtagcaacaatgttggttaaggggtacaaaatttcagttagacaggaggaatatgtttttgagatctatggcatagaatggtgactatagttaataatactgtgatgtatatttgaaaattgctaagagattttaaatgttcgtaccatgcaaaaacataagtatgtgaggtaataggtattttaattactttgatttaatcattccataatgtgtgtgtgtgtgtatatatatacatacacacacacacacacgatatgtatacattatggaatgattttactccataaacatagaaattatttctcaattaaaatgcatattcctgagccgggcatggtgattcatgcctgtaattccagtactttgagaggccgagagggaggatcacttgaggctaggagcttgagaccagcctggccaacatggcaaaaccctgtctctactgaaaatataaaaattagctgggcatgatggtgcactcctgtaatcccagctacttgggaggttgaggcacgagaattgcttgaacccgggcgctgaaggttgcagtgagatgaggtcatgccactgcactccagcctgggtgacagcctgggagactctgtctctaaaataaaataaaataaaaatgcagattcctggatagcacttactaagtcaggatctcagggaacggagcctaagaatgcatggtttaccaataccctcctccccttaggtggttcagatgaagccatcttcacactgtttggggctgggagctgctggtgcaggagtagcagagtatggtagagagaacagtgagggcaggtgaggaggccagatctcagctctggctgtggtctgcagtgactggtcactctgcttcgtggtgcctgctgactacctcagatctgagatggcgtgtccttccagcctttaggtcagagtcaaggctccacgctgcctccctagttttatctccatgctgctttgttcactggtcctgcctcttttccacatctgtaccttctttccttagatcatgatatccatccatccatccatccatccatccatccatccatccatccatccatccatccaaaactgcttactgaaggctgacaactttctctcttgcctttaccatcctttctttgtgtctctgcttatttaaatcctgcctagctcctttttgaagctttttaaatggtcattgtcccacccacccacaaccctgtcctctgattctttcccactcttatcttgaacaccttaatagcatcatctttattccacattcagcaactcttgattgagcatctctgctgctcagggaaagttctagattctgggaacacaaacaaagacatacatcacagaccctcagagcagcttccagttcagtcttggtttggtctctttttacaaaggtgtttaaaaaaattataccagcctgggaaacatagcaagaccctgtctctaaaatatattggccaggtgtggtggtttgcacctgtagtcccagttacttaagagcctgaggcaggaggatcacttgagcccaggagtttggggctgtagtaagccatgattgcaccattccactccagcctaggtgacaaagtgagaccctgtctttaaaaagaaaaaataaaggaaaattataaaaagagaaactttcagcttttggttctgcatgtaaggagcttagaggttgccactgtgtcctaacagcaagtaaaaagcttaacaaactgaaaaacaatacactgttgtaagaaattcccatagaacgcagtgtataaagtgaaaagcaaaaacaaaactttgttctcctgctcccttcttgtatttccagtctccagaggtaactgggaataccagtgtcttgtgtgtctcttccagaaatgtaccaagccttcgcatttttctctaatggttttgtgtatgagtccccttctcccagttgggttgaaagcaccatgggagggggactcagttttctcccacgtccctccatatcacccttcacaggcctgggcacacaggggtgacccgtactaatagactgacatcaaattcagggactgagaaaactctttggggaccttgtacagatctggtagcattacctgtgtgaagcttcctgcccatttagagcgtaagcctccggaggacaggccacccagcctgtgttcagaccccttccaggcctatgactctctggcttgcctctccctaggctggagcttttggacattccctgggttacacaggggccagcccctgaagcaagagcttctccaaccagccatttaccccattccacttgtctcatctaaggagtatcataggccaggcttcattgcaggtatgatgcagcttgtaaggcatgcgggggccagtggatgtggtattctgtggaagcccaggagggaaggttgagctgtcggaatgagagagatggagagggagcaggggagagcaggagtatcagaatgagtgatgtgcaatgttcaggggtcagcgcattacaaaatgattctcgttaattattcagagcccgccatctattgtatggcaggtgtggacagctaggatgggatgcctgcctttttctctgagccactgaaagagggaagggtggggtcgtcttggatcagtcttaggagggtgagtctgggggtgacttcagtatggcagttcctggaagggtaggactagctaagcaagtctctccacctttgagatttctggcattctatgctggtggaactgacacatgggctctgtactaggtagaaggcagagagaaaaatctcccccaagaatacaacttaaaacacaatcatgctcaggcaggctaaagctatctgttcaagcagagtaaatagaagtaaatagagctgagaaagagaaacttcctctctggctcttgcctttttctgaaatatctctctcccccaagtcaagtctaaccatctctctgtgtccagcattagccggcctacctggcaggtgttctgtccccagctggagcactggagggctgcacagcttggccttgggttttgcacggagtcctttggcctctccttgttcatgacagcatgtctcatctgcccagttcaaggaagaggcctccctaacaccgagtcaggcacattagtagctggagagatattttgttttttttttttttccttgggttgaacgaaactgttgtcagagaaggaccagagaagaaggtgttgaggagaggcagggtgcagtggctcatgcctgtaatcccagcactttgggaggccaaggcaggaggatcgcttgaggtcaggagttcaagaccaacctgtccaacatggtgaaactccacctgtactaaaaatacaaaaattagtggggcatggtcgtacacgcctgtgttcccagctactcaggaggctgaggcaggagaattgcttgaacccgggaggcagaggtggcagtgagccaagatggcaccactgcactccagcctgggccacagagtaagactttgtctcgaaaaaaaaaagggttgaggagaaaataaaataaaaagatcttagtagaaagaacagtcacagagtggaggcagcatggtggtggctggctgagtggggctggaatgaaatattcttggcctgccgttggagagcggggcaaattgggcaaattcattaatcttgctgagcctcagctttctcatctgtaaagttgggctagaactagtagctcctgtgaggactcaaagagatgatgcttatgaagtgcccagcacagggcagcatgtggacgtggtggctgttcatgtgtgccctgcttgggtgaccaccaagttcaggtaatggtcctccaagggaagtggtggcaagcgctttcctcatctaaaggccttacctggagaaaattctgtcacctggtaaagaaacgttagatattgagagctggtgaagtgactgggggcggaggccttcctggtccccctgggagggagccacccagaccagctgagcctgcagcctcctttccttgggccagtccaattccattctcacctgggactgaacctgttgcccttggaaggaattttaacattgggaaaagcaaacaaacaaggcatccacctagcaaggcacctggtgagcagacagaccactggctccaggcagctggagacctgcttctggccctggctctggagctgactgtctgtgtgatcctgaatgccttgcatttcctcctgtgtctcggtatattcatctttcaaatgagagaggtggatgagttcacacttgccaactttaacagtcacgtaggtggttggctatttgaagattccatggaactgaagtgaaaaatccacaatgttccttgaaaccaggggcagcagtgatgagtgaggctgaattttataggtaggaggcgggtctatatttacatatcttgcaattaggaggggtctgtatttatatttcttgtgtgggtttggttttgtttcctcttcaaattgcatctcttccctggatcctttacaaacttctaggaagagaaaggaaggtctctcttcctggttcatcatctcaccaatgtacttatttgtggccgtgtggagtgtgcatatttaatcttgtctggttatgcttccgatgtttccaattcaaatgcccgaacagtctctgcgcatctattcgaaccatgcctttatgctccatgttggaacagaagcccgttgagtacacagcctgtctgctgttgtatggggccgatcttagtgtttagcagcaagctgtggagcttccaagtacccaaggaacaccaactgcagatgcagccccgttccaagccaagggtctacagacgtgtagaagcaaatctcttgccaagaaccctccccatctggatgtaacacttttagtgtgctagcagatttctttcactagatttcagtccccgtgttgtggggatttggctcttttgacctgtgtgtaccagcgcctgttgcagtatcagacacagaatgggtgcttaacaaatgtttgttagagaacgaataaaaggatggtctttgcaactcaatgtactcacacagtgaggaaacaaagtagtaggactatctgatatttactgagtgcttaggaaatgtcaggaattctcaatctctctctctctctctctctctctctctctctctgtgtgtgtgtgtgtgtgtgtgtgtgtgtgtgtgtgtgtacttgagagacagggtctcactctgttgcccaggctggagtgcagtggcatgatcctagctcacgcaacctccatctcctgggctcaaggaacccttctaccctagtagctaggaatacaggggcatgttaccacacctgactaatttttaaaatgttttgtagagatgggggtctatattagggttctctagagggacagagcttactaggatagatctacatatgaaggggtgaaggggagttaattaaggagtattgactcacatgatcacaagataaagtcccacaataggccatctgcaagctgaggagtaaagaagccagtctgagtcctcaaacctcaaaagtagggaagccaacagtgcagtcttcagtctgtggctgaagggcctgagagcccctggcaaaccactggtgtaaatccaagagtccaaaagctgaagaagttggagtctgatgtttgagggcaagatgcatccagcacgggagaaagaggaaggctgggagacccagcaagtctgctcctccgtcttcccctgcctgctttatttctagctgcgctggcagctgattagatggtgcccacccagattgagggtgggtctgtctctcccagtctgctgactcaaatgttaatctgctttggcaacaccctcacagacacccaggaacaatactttgcatccttcaatgcaatcaggttgacactcaatattacccatcacggggtctcactgtgtttaccaggctggtcttgaagtcctggcttcaagcaatcctcccacctcagcctcccaaagtgttgggactacaggcatgagccaccacacccagccctgagtgtgtttttatgtattaattcctttactcttataataattctatgaggcagatgcatttattactcccgttttactgatgaagaattagaggcacagagtagttcaggaacttgcccaagtctatatagctagtaagtggtaagactgagagttgtgctaagggcagtctggcccctgagtctgcgtgcttaatcatcatgctatttagatatgaggatgcgcttcaccttcagcaagcatctgaaagctgggagatgttatgagtgaacacagagtgtccagtggcttaaatataatgctgaggccacaaaaatgctggaacagactgctgtatcttttaccaactggggtatcacttgctctctggtgtccagagacctcgtttgttcacagctacacataagctctgatgtctttgggctgcttggctggtgttttcagtgatggcaatagttcatggttttatccccttccttctggcttgttctctggtggattcccagtgccttcccaacttatatttccaaacttccttcttggaggtttggcatctctggtgggagctctgacacagactgttgcacatgcccccatccagccagataccagcctttcccgttctctgtgccatatcttgggttatgctctgagggtgccacagggatgcccaaggcatggttttggcacctaatagatttctgattgcttgaaaagaggagaaatgaattatatgagagcataaaatcaagtgtcaggtgatacggttcctgttaagtgtgagaagaaattcagagacaagaaggtgacatcaggccagtgggagttaggagatgtgcaagcctgtcccagagtggtcacacttgctgtgtgaccttggccacttacttcccgtctctgtgcttcagttccctcatcagtaaaataagggagttaatctaaactcgaatgttgccttcaactctaaaatttaataattgtaagacctcctgggatgaagaaacatgtaaaatttgcccccagatgaggaagtctttgaatggggaaacaaaagagttggtaaatactttctggaagttcccattcagcacccccagggctgcccattggccccatctcaccatcgctcccactttgttccacaccacctccccaggttggcctcactgctttttccctccctccttccctcttccaagcctagattgttccagtatttgtaattggttctctgcatcccttagacatcgccgagtcgatctcagccaattttcctcccttttgatgcatctctttcatccctctgctgctggcccttcctcccccaccatcactgctttcccttcccagaaccttgactccagctcatccatctttccagagtgcggctgatcctggcgttccccttccagtgcattcgggggacaggtgctgtcgggatgcacacatggagagaatgagatgctccccccttccctgggcacaaggaggataatgatcctgagcgcttccctcccagggcatgatgagaatcagtgagttaatgcccataaagtattataatgactccatggagtcatctgatggagcgatgaggaactgggcatctggctctaatttacttagagctggagaattcaggcagaagcggcagcctcaatttttttttctttttgtaccaaccactcaccccaatgcagagcagaatttctaagcacaaactgacaccacctagtgagatttaaagacaccaaattctcaattcatgagacctgtgtcaggaagattcattacagatatcctgttgtccccacaccccaccctttcccctttgatggattggaaacatgttctgagcccttaagtgtcataattcaactgccaagctggttggttagtgggtctgggaggagaaactttatcttctaattccaaccatgtgttgtgttcttccctccctccctctgtcccttcttttctgccatgtgtatttattggggtacctcctttggtgtgaccacatgctggatatgacaccaggttcctcttttgggtgtctagacagcaggagaagaagaaactgccaacctggaactcagagccaggtggttccataaatagcttgtggaatccttgctttcactgcacccaccagccgtttctccacccacctccttccagcttctgagtctgctttgtgctgctcttccctctgcatctttgcccatgtggttcctccttccacaaatctccttcctgctcatccatggagatacaaccttctttaaaaaaaaaaacctgtcaactcacaccccagtgtcaccacactcaccaagcaacttgtcatcctgaatcctgcagacatccgaccatcacagccagccattcctctgtccacccccagactcttttgtctcactgtgtccaggctggtattgcaggtagacatgctgttttcacagggtggacttgatggggaaagccataccctttgtatcacgtacttagcaccacgaggctggcagcaaacccctttgctctgcctttgttcctggctaattagagcctgtttccaccgttgtcgctgtctttccagccatctcttcccccacaggaactccagcctctggccatgttgtttccatcctacttgtaaccccttatgataacaaatggccactctttgtaacagaataaaatccaaccatagctctgacccagcttagtgtctacctcacctggaatgcagccccttcaacagtgaaggtaatgttataaatactgactatcttggtccccacagatctctttcccgtcacacctcctctgagccctctagctttgctcctttgaaaacccataagccttatttctgtctttggagtataatcaccttgaaagtagagactgtgattataatagcatctcggtaaaccccaataaatatttgttggttgattgatttactgacattactgggccggaatctggtttctggactttgttgccgtgtttattgccatctgttaggcaagtgagcctcctcacaggttttgtctagtccaggctgagaggtggaaaggtcatggactctggtgctgggaggaggtgaaccaaaataattactagaaaaaaaagtgggctgggcgtagtggctcatgcctgtaatctcagcactttgggaggctgaggcaagtggatcacatgaggccaggagtttgaggccagcctggccagcatggcaaaaccccatctctatttaaaatataaaaattagctgggtgtggtggtgcatgcctgtagtcccagctacttgggaggctgaggcacgagaatcgcttgagcccacgaggtggaggttgcagtgagttgagatcatgccactgcactccagcctgggcaacagactcagtctcaaaaaaaaaaaaatgtgtttggcagactgcgtggccagacttgagttatcccttgtagcaaacactttaattttggtcctgctgtaactctgttataaggcatggccatttgttaatgtaagtgaggattgtgcttcctgggactctcattctgctaaaatattgaacacacttgtaaacctaagcaccttctctctcttgctggcaggcagtaatgactgtaagacaaaacagctactttcagttcaaatgcataactgtttttcattgatcacagaaataaaaacacaaccctaatgaatgagttcataaagcatcctccccactttatggaatttgtccgaattctctccatcatttgtctgccctctgctcccctgcccacttctgcatcctctctattctgaccataggaaacacttccacaagattctcactggcttcaacattcagtgcaggggggacctaggtttagtcagaaacattgtacatatacaacagtggaaattaggtgggtcctcaaatacattagcttgtagccaagaaaagcttatgtggaaagggcccttctgaaagatggtctgatttcttcaaggtcaggcttaccattggataaactcctggccactgtgaaagttctcctgccacccctgacagagactatgggtgggctgtcttctgcccagaggggcagctgcctccactacctcgccactgcccgcccttcttctggggtcctccagtggccccttgattgggcagggaagcctgcacccactcccttggccacgtccatcctagcctggggagaggcagcggtctattccgggggccccaagccacatccagcttcctgtctgtttttcttttgttaaagccaaatgaaacaatgtaattagcttgttacaattaaagtgactcgactggataaattgtaatcacccagaatcaagtcaggcatccctgcaggtcccggacatcgcagctgagctgcctcatttgcataattaaaatatacaaatgataatggattttgtactcaatttccagcggctgtgaatttgagaaactctgaaattagaataacagagatgaagcccgcctagaggtaatggggatgacaagttttgacagtaggggtgtttataacgctagtttctcactacaaaataaataagtacaaaaaaagattagagaatgatattagttaatagttccacgggcagtgggaagtggagatagactatgattacctctgtgaatttacactgtcttttctttctttcttttttttttttttctgacaagctcttgcctaaccttaggggataccttctccctgattatgagaaatcgagaatgaattaaatgcataaaaagggttgtcacagatcgactcaccaaaggaaaagaagagaaatgaaattagtcttgctgctcttgcttccagctagggctgcattaaacggaaagtgtgctgagcggggcagagtggcaggagaggtggggaggggctgtgacagttagaggagggaggggttggcatagtccaggagggcagacatcagggttcaggcagaactgaacaacagtggagccagaacacaatattacttgtggaatgagatttgagagagtatcggatagactcctttactcaaaatataccccgcagcggggacaaaacattttggtggatacacacttgcatataagcaccatgttctctgccaatacacagaacatcaaaatacaaataaggttgttctttttttttccctgtaaatttggtgaagttggggctagatctgtctacttcatctggtattcccaggacctaatacatagtaggtccttaaaaagtatttgttgaatgaataaatgtatggataggagagatggaggacaatgtaagaatattgggaatggatgggaaaagaccctgaaggctcaaatcatctgtattcctgttcttggagccagcagagcctggacattggagttcccattgggaatgggtgtaaggtgtcagagtccatcttccctggactagcctgcctgctttttgtggtcagtatgttgcaatggaaactggacaaaatctctctgccagaaacaaagtgaaagcagcaatttgcaatcagccagtgaggaccaggaacactgctgtctgggaaggaaatccagaacccaggctctgggcctctcccattgatgggctcagcacagaagctgtccaatggggcaagaaagaaaactgcctgttggggaaatgggggtgactctgactgatgtatcttcccaactcattggaaaagatgtgcagagtagggcaatcaggaaattgaccaggcagccaatctactttatggtcagggacttgggcaaggaaatgcaccaggggagctaggggcaggtggttggaatctaatgctgggtggagaaggagggatgtgaagggagtcaggttctctagcctgggctcttgggaaccatttttcctgggagcctgtaaatagaacagcttcccctggcaatggtattgagcaagccctctgagctgggagagagacaggaaggaccactgtcagtttcccagaggacttcacactggcctcccagccagagagtgagtagcaatccaattcgtctcttttgggccctggctctgaggtaggacttgcctaatcccaggttctgaggaacgatggggtgagatgccataataagagtgaagtttcttggaggaaggcagcaatgctcacagatctggaaatacacagacttcaggacagggatggtgattataaatttcaagttaatgataggaaaaagccaaccatgtccttgagggctagaacaggctgagttgaggcctttggatgtgcttcaggcctgctttgggcatcattgtactatggggatcagaaatgccaccatggaccatccattggttcatccagtcttggtgtctactcctgaaaaagggcagttgatggggcttcaacaactttgggatttcccccaatcctccaaatgtcctttaaccattaggaatattttcataagtttatctaaatcctccttgaatccacctgcattgctgtctgctgccttgtaatttttacctcttttaggaagttttatttatcaggactacttcttacatcttttaagattgggggcagctgctgaacaaattctgccacctggatgtaacaccatgtctgttttcatgcctctcataactttcagccacaatctcagccctcgagtctccagtctccatcctttgaaaagtctcctcaggcctcctccttatccctgggccacttaattgcctccccgtttgcctaccagtgcacaagacatttcacagagcatagggaagttggtcttgcagccagggtgtggcaaagttcgtgaaatctgttctacaagtgggaggcccctcactcatccttcagagagactgccatgtcctgccaactgggtcaaactctaggtcaggctgtgcaaagagaaatgctgatcttcaacatgatgctattggccattgtgtgggaggcttggcattactgctggagctgagggcctgggtatttttcctaggcacacagtgcaggaagagaaggcctgttagtgatgtgctggacagacagttcccatgtgtggacagggagggaagtgggaacagcatgtgctccctcctcccacttactttttctagaacgcaacattgtgtcaatatggatagtatgaagtgtaagttccttgagggcctggaccatacctattttattattatatccccagcatctagcatagtgcctggtacatagtagttgcttaataagtatttgtgaaataaattaatgaataagcatgtgctgttttttttacgatgaagatacattatggaacattacaaaaaagaaaatctattcttaggttcaaatttgtcagtttattactaaatctaccaattggtattaatcacattttaggttgacccagggcttgtcttctgagtttttcccttcttacatccacccattcattctttcatgccaggctctgttctcagcctgaggggtctaacagtgaacaagttcccacttccctcagttattctcgctagatcttatttcttgttatagcttacgtctaggtactgccactgtcacggctccgggccaggctaccatcatctcttacctggaatattgccttttgggttcccctaattcaatcttccaccccctcttgttgttttccacactgcagctccagtgatctctctcaaaaaagaaatctgaccacccatctctcttaggtaaaaccctttcttgccttcaaagctcatggcaatccacgtctgctcacctcttccaccctagccctcaccactcctgcctcacactcaccttgatttcctccgtggcctagaaacatcccagctctttcctctctctgggccttaccctcaccagtgtgtctgcttggctgctccccatggggccattctgttctccagccagacctcacgccctcctctggaaaacctccctgtccccgtgggttggggcctcttgcctgtgcctcctccatgttctgaagctctgcttatgtcactgggattgcttgtcttaggtgcctctttctcctattagaactggagacatcggagggcaggaatggccgtgcatctctagctctggttatagtgcctgtcatatagcactgttcaatatatttacttgctgaatgaaagagcgcataaaagatgatagctagaattatgagactgctaagaaagaagggaagtggagggaggaggaggatcttgaggaatatttacacccaaaggtcagagagaaaaagaagcactagagggaaacactccctgagaggcaggaggccagcaaaattcaacaaaaccgaagcccaagaggaccagaaagggctagccatctggccagggatgggttttctgcacaagaaatattaccttccctcctccctcccagatgggcccatttgggtcaggagatcacccaggtccactattttccagtccttgattaggaagaccagatcaatgttcccttcccatttggaaggctttgggacacaattttcttggggcagatgagtgtcaccagagctgctcatggaatcttctgggcacatggacctagggaggggatgttctactcctggatagcccctgcctttgagtctctccctcctagaggcaatgcacatctgccctgtatctgaaacctccgagcagccaatctgagcccttgtctattagagaattaatttttaatgggttttatagcatggtggataaatcagttagggagagacaaggagctggcaatgcctaatgaatatcgattgggccatttaaaagggaaaccttgccaaaagggggacagccaccccacagaatcaaaatcagctgtgtggagtgactaaggggcagcagtgacatcttcctctcttctgtggctgaaaatattctccaacttgttgaccactgatgctttaaattgcaccactttttgggtaagggccatgccttttgttaagattcacatatctgtgagacaggaacctattttcaatatgtaattccttagtataaattagttatgtagatgtttcccaaaggatataaatgagaagagcaggactgagttggagggatcttgaacattttcttggggttggctgtgtctgggaacccagaagagaagatctcaaacagacatacaaacacttttggggatacatggtggtgtgacatggggcaggcaaagccttgggaatgatattgcatattttgcaatgcccattttacttgaagattgaatgaaaggtgtttttcatcaaagcatattttcaggaaggagaatgcacaattggcagcataaagaaatgtcttgttttgttctctgttttctctttctgctataaaagacacctcattcagtgatgcagagagatctggcttcagagggcaaaagctctggattcaagtcttggttctcagcctaaccaaaaggagtacaagaataatgaacaaatcatttattgtcctatgaaagagtatacaattaagtgctaaagtttgctacatagactgtaaaacaaggggattctatgacctctgaagacccttccagctctaacatgccatcactattaaaaaggtgcattgttttaaatatgacatcatgttaaggctttttttaaattatactttaagttctagcgtacatgtgcacagtgtgcaggtttgttacatatgtatatgtgtgccatgttggtgtgctgcacccattaattcgtcatttacattaggtatatctcctaatgctatccctcccccctccccccaacaggccctggtgcatgatgttctccttcctgtgtccaagttatgtgccacattcctaaataagtttgcccatttccccttggcaatccctaataatgttttcagtgatagtgtcttcatgtaaaccatgttagaaacttttcctggaggattaccttcagggccagtaatgaaccatgaataagtaatcatttcattaaaaacagtcatacctcctaagcacaatgtgtgctgggagatgtgggaagatgggtaggtcaggggttcaggaagggtcaggtagaggcagccttagacacagctgtggagttgtagggatttttatttcaaggcttactctttcacctggttcctttatcacacagaacttgccttccttagttcaggattttcttgatatggccaaataaataaaatttctcaccacccaagatttggtcatgcagttctctcttccttcatcccaggaaaaccttttaaccctatatcttgtctgttgggggcccaggctcagagatccccaatgtaggaatgggctggagcagtggttctcaccaggtggggcacattggaatcccacaggagggggaggtatttcccttcccctctctatgacattcttctttccagagatggttttgtccctgtggtaggacccagaggtgtgcctcttacaaggaaaatcagagaccatccattcacaatggttaattttatgcatcaacttgaccggaccacagggtgcccagatatttggctaaacatttctgagtgtgtctctgagggtgtttctggatgagattaacattggaattggtagactgactacagtacatttcccctaacgtagctgggcatgatccaatccatcgaggcccagaaaataacagaaaggcagaagaagactttcctttctctagtggattgcttgagctgcaatattgggggacttaccatcagcaccctggttctcaggcttttgacttggactggaacatccctgactttcctgaatttccagcttgcatatggaagatcagggaattttcagcatccataattgtgagagccagttccttataataaatctgtgtgtgtgtgtgtgtgtatgtgtgtgtgtgtgtgtgtgtagtctcctattgtttctctggagaacactaatatgtcattccagtggggagttagctaggaaagtgatgagacctcttgtgtttcaaatcgtatagcttgccagtatagaactgtgaacaaagtcatttttttctcaaatctgtaggccaaaagaatgatatctggagtttgatacaactttaagagatcatctagggcaactttatcttcttatgaatgaagaagcaggtccagaggtcttgctaacattttaaagctagctggtgacagaatcaagtacaaacggtccctgacatgatggtcttatgatggttcaacttatgagttttccactttaccgctgtgcaaaggtgatacacattcatataaactgtactcaagtacccatacaaccattcactttcactttcagcacagtatgcaacaaattacatgagctattcaatactttattataaaatagcatttatgttagaagattttgctcaactgtaagtgttctgagcatgtttaaggtagactagatgaagctacaatgttcggtaggttaggtgtattcaatacattttctgcttaggatattttcagcttatggtgggtttattaggacttaaccccctcataagtcaaggagcatctttatgtaaatcttaacaccctaaccagattgtaggctccctaagagcaagtaccacatattctcccataacatgtagcatagttctaagtatgtagtaaattgctcaggaaaatcttaatgatcgacagcagtggttctcaaacttgagcatgcattggaatcaccttgtgaaaacacaggtctccaggcccaacccccagagtttctggcttagtaggtcggtggtggggccctgggaatttgcatttctaacaaattctccagtgatgctgaggctgctgatccagggatcacactttgagaaccgctgagatgtatgtttcaaggatctatccatttctaatataatttgaaacacttcattcccaggaagcctactttattagacactaagtggctacgtgagaaatcccagacttaaaagatactggtttaaaagtatttaaagtgaataattaccttcagggtggtctaggtagaaagattaaataaattaagttgagtcaataggagtttaagcatcatttgttaaagcagtactattagtttttcttttcctagtggaaattctcttcttgtcacataatcctaattaattattgtataaagacccgaaaacttaaatgcacaagggagtaataatcttatgtttcattaaccagcagcttcgaaagccagaaccaagcatgtagaaagagcatgagcagtatacagagtcccttccaagcgggcctgaggtctaccctcgtgcttttatttgtcgctgaatgtgttaacaagaacacacatttacactcttaaatatatcgtctctgttcaatacaatcttattggagttagccaatcaatatgaatttcaggagtatttgtcattgattttgcaatacgctttgtaattactgaatcaatataaaattctcaactcattaggagattagcttttttaaaatcatttatattaatgtgtttaaccaaaggcatcggagctcctttttttttttaaaaaaaaatcacttgtttaatcacctatattaaaaatgaacaaatgctatagactaaaagctcacttgatgtgattttcaaggatgacttgccctgtaccttgcctttgataggacctcaacatattggttacactgtagagcccaaaccatgatatggaacaaaatgggggtgcccatctgaataatttgatggagaaaagatggggcggggggaagaaaccattatgcctgataaatattggctgtaatttacccgtttaattctggcaattttgaattttgtatttcactagttgttctttgtgatgccttcctactggaacacagcttataacatttcatcaattaagagaaagcagacatttgggcatgtaatacacacttggaggatacaagaaaaaatatttttctactcataacacttctgaccacaaatatgtgggttttccacaccagttctctgtggacaccatctgggtgtccagcaatttaattcaattctggaaccacactaaataccctgagttagtgcagacctcacaggttaagggctaagtcccacaagaatgtcccccacttgagatgctggttacaagtattgggtgcccagggtattcccatttccgtccaacttgggtgtagagttcctgcaaccttctcctcagtttctgtaacttgctatataatagctcatagaacttatggaaacactttacttagtttaccagtttattataaaggatattataaaggacacaaatgcataaggaataatatgcctaaggaagaggtgcataggacaaggtcccaaagagtcctgagagcaggagcttctgtccttgtagagttggggtacaccatcttcccagcacatgaaagtgttcaacctggaagttctctgaatcctagagttcaggattttttatggaggcctcatcatacaggaatgatggattagtaactcaatctctatcccctctcccttccccagaggatgaggatggggctgaaaatttcaagcttctaatcatggcttggcctttctggtgaccagctcccatcccgaagctatgtaggagcccaccaaagagttgcctcattagaacaaaagacgttcctctcacccaggaagttccaagggatttaggagctctttgtaagatgcctctattatcctcatcagtcaggaaattccaagaattttaggactctgtgtcagaaaccagatgcagagaccgacaatatatttgttcttatgtcacagtggattaaatactgatgcagatttttggtatttattttataatagcaacgtctcccaataactcatgagtgagttgggcatgtgttgtggactttataaatgaaattgggtcctgggggatgagttacaaagcccaagtcaccatacacatttgtggtggagacagatctagaacacaggctttcctgttgttggaatatacagtactgtcctctggtgggttgtagctgtcacttgcaaaggaagtcattgcaggtggctttttgctttggacattcctagtgaccttagagcccaaggcagccccctctcatccctccctcaaggaccacataaacccaggctcccctggctccagctaatggctgatggctacagtttccaagggcttgaagtttagttctcagtgttttgaaggtgtttctttatgccctccgagattgcatcaccctagttaccatccttggaatccatacaataatgatgatctctttgatatgtcttgaaccagagagtttacacaatgcttattaaatacactatcctatttgagtctcacagcaagtctatgagatggactaacacccatggtcaattttacagatataggctagtgaagattatagaagttaagtggattgctagtagtgaacgattggaaatgtaatccaccccgacagagtgctgtctttccagagagaggaatgagccccaaaatacatagtcatgacaccaggctctggtatcctctctgtccttacttcctttggggatgtctttcatcctcactgtgtctcaattcccatctctagaagatgaagatgcaattcctgctcttcttctatctgtgaacacaggatggtacattatttccaacagtcagcaaacaattgttggcttctctgttgcttatagctttgggtgaggggcttgcttcatgccagatcccatggagcagacatattctctggcttcaatgacctcactctgtattgaaaacagccttcatccaaagagcctgtcataggatggagtttccttcttgtcctttgaggttaatgtgaatttctggttaatgcacttggcaaacacagtgtgctcctgcaaccatggtttcagcctgtgaacttccctatgctccatgcacagagtgaatctttagcctggtcctcttatgcccatcaactcctcctgtatactcatacagaccctcacaccaatacaaaaatgaataaggggcaaaactgaagaattcctagactgtgaatgattttatgcaactgcccccattgttggataaaccagtaagactgcttgtagtgagccagcattcaagcacttccatgttaggtgattgtcctgttttgagggagcattggcctgcaggcttcagccctggaatgcctagaaagggcctggtggtcctttcccttgtcttttggaagaagcctggatgaacaagatgaacatattggcagtgataacaacacttctatacatctgcatggtgctttacagtttataaagttctttcacaagcattatctcagctcattctcccagcaaccctataaggttggctgggcaagcagtgatgctgccattttaaaggtggggagactgaagcttctccagtcccacatctgagttcagtgaccctcctagaagctcccatagttccctgcccatctcttacacagcacttagctgcatgctactgtgattgctgttgacttgcttgctttcccagctagaacgagagcttcataagagcagggacttgtgtcactgggtcactgttgcatcccttgtgcttatagtgactggcatagtgtggattcaataaatactttttgaatgacgtttgggtggaagtatgaaaaatgggtgagagggtggatgaatgactgaataagcgagggtgggcaggttccctcagcctgggcctcttgtctattggttgcccagcattgtggtggccactggaggtcagtggggcactggctattggtctgtgggagaggccaatggatgtgtgggagaggtggtggggagagtcatggccttagtactgccctggataataccatgatgctggtgctgtttgcatttcgaaccagccacctctcctcttggggctctccctctcattccaatgggcatactcattgctctagacgacccaagttctttccttggacaccattcccaggctctaaaaagccataaaaatatacctgtgctgggttccaggccaacacacaccttggctgctgagcaaagaaaggagctgacagtcattcacacagaggtgtaaatgactaacaaagttttaatgtgttacccccctttgtgggtaggggagtggttgcaggtcgtgtagaaactacttaactctaaagggaatgaagagatgaagctttaattgtggaatttctgtcacctacatatgtgctgggccctggttaagggtgcacatccaccgactgctgggccctgctgctccttgggaaagaggggcactttggctgccatcccaggattcctgttaataaatcagagttctctgccaccagctgcttggcatattgctcttgtaccagtagtgccattgccaaattgtcagtgtgctgggctgggggtggcatgggggctggtgcaattaactccctcaatgcaccttaccctggagttcacccagagaaacttggcagcagggatggagggctgttggcctgactgctctcaccaggaaggatggatttgtcagggaagggtggttgacaggctggggagggagcagctgtttccaaagatgggagagagatgtcaggagctggctccatctccatatagaaatcctcactctaaatgggcagcattggaatttaagtagtaatgtgtctctttggaactttgaactctttcttccatgctccacagctcatttttcatcacaacagctttttgaattattattgaaaatataatgtaatgaggaaagaattcttaagtgacctttgatgccaccatcaccaagaatttcatatttatatggtagcatggacatccagttcacatgcatacgtattttaattttttgtagttgatagtcaaggtgctgttgtcattttgtattctctcatcatcattattattattattattattattttggtaagaaaaggaaacaggtgcaaggctatgatactgtctgcccacccagagagactgccccagagatatagcttctaactgcactgagctgctcttactgggaacacttgaaggcagggccagtgttacgggcagaggaatgggcaagaaaatctccaggggactgctgggttaccagccacatctgattctgggatctctatggaattctcatcggcagcagtgctcagagcctggttggcatcttcactgagcagtgaggcccctgggggtgttgctttcactttctagaccactgtgttagtctggtgtgttagtccatcttcgcattgctataatgaaatacccaaggctgggtaatttataaagaaaagaggtttaattggctcacaattgtgcaggcttgacagggagcatggtgctgacatctgcttggcttctggggaggtttcagggaagccttttggtagaaggcaaaagcggggagcaggcacatcatatggtgaaagtgggagcaagaaagagagggatatgcgccatacctttcaacagccagatcgcgtgagaagtcactcactatcacgagcacagcaccaagaggatggtgctaaaccattcataagaaatccacccacatgatccaattacctcccaccaggccctacctccaatactggggattataattcaacatgaagtttgggtggggacacatctccaaactatatcagttggtgtcagcaatcctagagagattgtagcccgcccttcccattataaagatgaggaagttgaggctctgggacaggaagagacttccctttccttttctaaggagaatattcccttatgaattgcatgtgttgcaggggttgaatcaagaccacagagaaaagtctatggttcacattaaggagtcagatgtgacatttaagttaaatcacagtgaatgtacatatatttttgagttatagagacagcagtttcatatggtttaacctgctagttggggaggcaaaacatgtatgaagagacctccccagaagatgagcaacagaagcagttaaagaaaacttcaagaatattactgaaaagctgccaccagacatttatcaattagaggattttcacttagtttgagggaaacagcagtcatgttcagatttgtactccaaaatattaaaaacatttatcctagtccctgacacatagtaggtgctcagtgaataattcttgaacagtcacattgctcatttctgattagctgttgactcaggattccattttgctgtttgtagcagaatctgaccccagtgactaaataattagtggctttagttttctttcatgaaaaatagaccaggaacagcgtgtccagagctaatgtagctattcaggcaagtcatcaggggccaggctgtttcttctgtcattctttttttttttttttttttaaactcatccactttattatttttttttcactttctctttcttttttttttattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcctttgggtatatacccagtaatgggatggctgggtcaaatggtatttccagttctagatcactgaggaattgccacactgacttccacaatggttgaactagtttacagtcccaccaacagtgtaaaagtgttcctatttctccacatcctctccagcacctgttgtttcctgactttttaatgatcgccattctaactggtgtgagatggtatctcatcgtgattttgatttgcatttctctgatggccagtgatgatgagcattttttcatgtgttttttggctgcataaatgtcttcttttgagaagtgtctgttcatgtcctttgcccactttttgatggggttgttggtttttttcttgtaaatttgtttgagttcattgtagattctggatattagccctttgtcagatgagtaggttgcaaaaattttctcccattttgtaggttgcctgttcactctgatggtagtttctttcactgtgcagaagctctttagttgaattagatcccatttgtcaattttgtcttttgttgccattgcttttggtgttttagacctgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcatcatttattaaatagggaatcctttccccattgcttgtttttccaggtttgtcaaagatcagatagctgtagatatgcagtgttatttctgagggctctgttctgttccattgatctatatctctgttttggtatcagtaccatgctgttttggttactgtacccttgtagtatagtttgaagtcaggtagtgtgatgcctccagctttgttcttttggcttgggattgccttggcgatgcgggctcttttttggttccatatgaactttaaagtagttttttccaattctgtgaagaaaggcattggtagcttgatggggatggcattgaatctgtaaattaccttgggcagtatggccattttcatagtattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttctttctcctgcctaattgccctggccagaacttccaacactatgttgaataggagtggtgagggagggcctccctgtcttgtgccagttttcaaagggaatgcttccagtttttgcccattcagtatgatattggctgtgggtttgtcatagatagctcttattattttgaaatacgtcccatcaataactaatttattgagagtttttagcatgaagtgttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcgttttgccagtattttattggggatttttgcatcaatgttcatcaaggatattggtctaaaattctctttttttgttgtgtctctgcctggctttggtatcagaatgatgctggcttcataaaatgagttagggaggattccctctttttctattgattggaatagtttcagaaggaatggtaccagttcctccttgtacctctggtagaattcggctgtggatccatctggtcctggactcttttttggttggtaagctattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcatctatttgattcttctctctttttttctttattagtcttgctagcggtctatcaattttgttgatcctttcagaaaaccagctcctggattcattaattttttgaaggcttttttgtgtctctatttccttcagttctgctctgattttagttatttcttgccttctgctagcttttgaatgtgtttgctcttgcttttctagttcttttaattgtgatgttagggtgtcaattttggatatttcctgctttctcttgtgggcatttagtgctataaatttccctctacacactgctttgaatgtgtcccagagattctggtattttgtgtctttgttctcgttggtttcaaagaacatctttatttctgccttcatttcgttatgtacccagtagtcattcaggagcaggttgttgagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtgctgaaaaaaatgtatattctgttgatttggggtggagagttctgtagatgtctattaggtccgcttggtgcagagctgagttcatttcctgggtatcctttttgactttctgtcttgttgatctgtctaatgttgacagtggggtgttaaagtctcccattattaatatgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtccttatgatgttagctggttattttgctcgttagttggtgcagtttcttcctagtctcgatggtctttacattttggcatgattttgcagcagctggtaccggttgttcctttccatgtttagtgcttccttcaggagctcttttaggacaggcctggtggtgacaaaatctctcagcatttgcttgtctgtaaagtattttatttctccttcacttatgaagcttagtttggctggatgtgaaattctgggttgaaaattcttttctttaagaatgttgaatattggcccctactctcttctggtttgtagggtttctgccgagagatcagctgttagtctgatgggcttccctttgagggtaacccgacttttctctctgtctgcccttaacattttttccttcatttcagctttggtgaatctgaccattatgtgtcttggagttgctcttctcgaggagtatctttgtggcgttttctgtatttcctgaatctgaacgttggcctgcgttgctagattggggaagttctcctggataatatcctgcagcgtgttttccaacttggttccattctccccatcactttcaggtacaccaatcagacgtagatttggtcttttcacatagtcccatatttcttggaggctttggtcatttctttttattcttttttctctaaacttcccttctcgcttcatttcattcatttcatcttccattgctgatacactttcttccagttgattgcattggctcttgaggcttctgcattcttcacgtagttcttgagccttggttttcagctccatcagctcctttaagcacttctctgtattggttattctagttatacattcttctaaatttttttcaaagttttcaacttctttgcctttggtttgaatgtcctcccgtagctcagaataattcgatcttctgaagccgccttctctcagctcatcaaagtcattctccatctagctttgttccattgctggtgaggaactgcattcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttgcaataccctgccgtgtgaggtgtcagtgtgcccctgctggagggtgcctcccagttaggctgcttgggggtcagaggtcagggacccacttgaggaggcagtctgcccattctcagatctccagctgtgtgctgggagaaccactgctctcttcaaagctgtcagacagggacatttaagtctgcagaagttactgctgtctttttgtttatctgtgccctgcccccagaggtggagcctacagaggcaggcaggcctcctggagctgtggtgggctccacccagttcgagcttcctggctgcttcgtttacctaatcaagcctaggcaatggcgggcgcccctcccccagcctcgctgccgccttgcagtttgatctcagagtgctgtgctagcaatcagcgagactccgtgggcgtaggacactccgagccaggtgcgggatattatcttgtggtgtgccgttttttaagccggtcggaaaagtgcagtattcaggtgggagtgacccgattttccaggtgctgtccgtcacccctttctttgactcggaaagggaactccctgaccccttgcgcttcccgagtgaggcagtgcctcgccctgcttcggctcgcgcacggtgcgcgcacccactggcctgcgccaactgtctggcactccctagtgagatgaacccggtacctcagatggaaatgcagaaatcacccgtcttctgcgtcgttcatgctgggagctgtagaccggagctgttcctattcggccatcttggctccttgatcttcttctgtcattcttagcatgtggcctttgtcctcatactcccatgatggctgctctgcctccagagaccaggtccaagttccaggcagcgacttttgcaaatggcaaaaggcatggtgttttggcagagtctttaccttttatcaggaaaacaatgggttcctgaatgccctcccactagacttctgcttgcaattcattggcctgaagtgagtcacaggtcacccttagctgtgaggaggtctgaagagtagccctgaataaaaccaggttcttctggtcagaaagctcgggatgcatattagtagataatatgcatcatctcccacaaatattttaaagcaaaaaatgattatttagatataaacaaatagaggttctaatttggaaatctctttatatagtttatatgctcattcatgcattcatttatccatcctgcaaatagtcacagaacgttcactatgtgggggtgctggttgtgcactaggaatacaaagggggacaaaacagactaaacctctgtcctcacatacacatgcaggtagtcagatccactgggcagcaaggcaagagagaaccaggcaggcagcaagaacagaacatgcaaaagggagtgggagagtctgaggaaatgaaaaggagacctgtggggcaggagccaggtaattgaggggtaagtgaagctgtaagtgtcttaggaaggagagcagctggtctgatagctccaggttggtgaaaccaggccctgggcacacactgtgggcatcagcagagggtggggtctagactaccaatctggaccaatgtcaaacatttaaatcttgccccagatatgaggcctgaaatgtcatgtcccttcctttgcccattgagagctgggaggacttgcaagatttggaccagagatctcattttacaggtcagtaaactaaggcccacagagcccaagtgacttgctgatggctgtcttgccagttaatgccaacatttggaccaaacctgcagtcttctgactcctagacttttccctttcagaaacattgtatgtttgtaaatacttaattttctcttgtctgatttgcgcctgatagcatttcaatgaaatagatccagtgaggttatttaccccagtttcacatgtggggagactgaagttgagaaggataaagggttatggtggtctttgattctctggcccagatccccttcagctggggaggttgccattccaactgatgtggttggagacactttggctcacattggctgtctcctccgaggtgagatgtggctcgaatgccactgctctgggccacctcctcatgtgggcctgtacgagtgagaaggggaggtttttgctgcatgataatgaaaatgtgacattctcacctgagtcttgagcactaggaaaacagggggctgctgtgctccgagtgtcctaattgcttctgacactctttatcatttgtgatgatctggccatgcttggccacctcaggtgaggggtggccctgagagtggggagaaaccattagggagctgacagggcacagagccatgggaggtgatggactggctgccagatgccctcgatgcagacatccatcctatcgattgaccttttggggagagaaatcggtgccctggttgttgccgggctggtgaggctgggctgtgatgagaatggtttctaatcaagacagattccattcagggttcagctcccctgctctatcttgaggccgatgaggacactgtgagagggccattttcacagggtggttgtgcagcgatgtgccccatggcctagtgggcttggcctgcgaggggcccttgggccaacaggtccagtctggggagctcctcctcctttccctttcccaacctgctccccgcagctgctactcttatatattctcatactgctccctcgctcctcggtgagctctgggtctccaggtctgaccacccaggccagtgttgctgcttcaaaacccttcctgttttttttttttccagcaaagagttttgctctcagctctgcaggggtcatgccaaactcacccctgccaagctactaacaccagtagtcactttctcagagccaccggcctctttggaggaggcagtcatgtggtaaactatggttttataaattggactctatgggaattttaaagtcttagtgcctttggttggataaaaatctaaaaatattaacataaatgaattatcaatctgtgagggatttctttaacaccaagaaaggcctcacaatttcaggaccacatatgctttcgagctgacaatagtattaacacaaagtagttctattttaatgaagaaaaagctggaggatactcaaaggtatgaatgtcaaacgaagacatttgggacacttggactcaggatagcaggagatatttggggtctttgcagctgctcaagtgatcctgtaagagtggtgtgactgaacatgggtatgaatacctcctaagcagttgcagccttgttatggctcatggatacagaaaaagaagcccccactcctacttcccacttccagtcctctggtcagggaagggccgcattctgccattgagaatggttgagcacagaaacttcaaagaaggttgtttccaaagcagagaaaatactgatgtcccagcttccaactgtggagatgggacagggagatatttcctacccttcacggtctttggatattgaagatatctccctgtttgaaatactaagtggagtcatggtgagaaaaacttgatcaagctgtcttagtccattaggacagctttaatagaataccatagactgggtggcttaaacaacaaacatttacttctcactgttctggaggctgggaagtccaagatcaaggcactggcagatccagtgtctgatgaagactctctgcctggtgtgcagatggctgccttcttgctgtatcctcacatggccaagagagagaaatcatacctctcatgtctcttcttgtaagagcgctgattgcattaataaaggctctaccctcatgatataattaccttccaaagtcctcacctcccaatataatcacattggggattaaacttcaatatataaattttgagtggaaacaaatattcagactatagcacaaacccactgtaaaggagtactgtgagagtaacatggatggcttacatttactgaatggttaaggcaggcaagtgactgaatactttcaggtaattctctcatttaatctttacaaacccaccaagtaggcactatttattacttccattttgcagaagagaaaactgagatatgaagaagtttagcaatgtgccttagttcacacagctaggaggagacagactctttcttctaactctactacactgttctgaacaggaagactgttctgggctctggtcagggctctggtctgagcttcacctattctgtgaatttgggcaggtccctttacatctcatatcttcagatccctcatctgcacaagataaggttaatcgtatgttctatcaatgggtcaactctattaacaaacaggaaatgaaggtatgaagtcctcttcagctggcctggggaaaatcacttgatatttctctcttagctgcttcaagtcccatttcttttagtcctgctgtatggggtggctggggactcctgagacccacatggtattgggggatccttgaaaggctgaattcttggtccagttctataaatatgcatttagggagctttaataacacatattattgaccaggtaggcctgtagagctatttgtgtgtaaatccatatttagtacactattgatccatatcaggtggccaaaaccatattaatttgaattgaagattaaaaacattttgtaaaagttgttggcgagtaaaatgagttgatgttcaatttctagcagcctaatgtgctttgctttcctttagatgtctcctttcagctggcttagccactttcttttccaactggtctctcattccctctcttccagggtggctacctgtcgtggatactgtggtgggctttgctctcagtactgaagcacttgcttccccaatggctgggagtgttgctgactgtggttctcagttgagttcctcttcagaatttgccatttttgtataattgacaaataaaaattgtatatgtttatggtgtacaacatgatgctttgatatatgtatacattgtgaactacctaaaccaagcaaatttacatatccatcatctcacatgcttatcatttttttatgggagaacatttgagatctactttcttggcagttttcaagaatataatacattgttattaactacagcagccatgctgtgtaatagatctccaaaacttatttaccctatttgaaatttcttactatttgaccaacatcaccccttttcctccgcactccaccccacactcccagtccctagtaaccaccattctattctctgcttccatgaagcagagattctggagtttctaagattctgcatataaatgagatcatgcagtatttgtctttctgtgcctggcttgcttcattagcataatgttgtccaggttcattcatgttgcaaataacagaatttatttcttttaaaaggctgagtatttcattacacacacacacacacacacacacacacacacacacacacaccacattttctttattcattaatccatcagtgggttggatgatttcatatcttagctattgtgaataatgctgtaatgaacacaggagtgcagaatatctccttgacagactaatttcatttcctttggctatatacccagtagtgggtttgctggatcatatggtagttttatttttagttttttgaggaacttccatactcttttccctaatgatggtactaatgtacattcccacattcaatgtacaagtgttcttttttcttcacatcctcaccaacacttgttacttttgtctttttaaaattttatttatttttattattttttttgagacagagtcttgttctgtggcccaggctggagtgcagtggcgtgatcttggctcactgcaacttctgcctcccaggttcaaacgattctcctgcctcagcctcccaagtagctgggattacaggtgtgccaacaaacctggctaatttttgtatttttagtaaaggtggggttttgccagttagccaggcttgtctcaaactcctggcctcaagtgatccacctgcctcagcctttcaaagtgctaggattacagtcacaagccaccatgcctagccttgtcttttttatagtagccattcctgagtagctgggattacaggtgcacccagctaatttttgtatttttagtaaagttgaggttttgccagttagccaggcttgtctcaaactcctggcctcaagtgatccacctgcctcagccttccaaagtgctgggattacagtcatgaaccaccatgcctggccttgtctttttcatagtagccattctaacaggtgtgaggtaatatctcattttgtggttttagtttgaatttttctaattcacatgatgagcactttttcatgtacctcttggccatttgtttatcttcttttgagaaatgtctattcagggtctttgctcattaaaaattatttacaaacgtttttattgatacatatttgtacatgtttatgaggcacaaatgatattttgttcatgcttagaaggtgtaatgatcaagtcagggtttttgggatatccatcacctcgagtagtcatttctatgtgttgaaaacatttcaaatcctttcttctagctgttttgaaatatgcaatgcattattgttaactagtcacctactctgttattgaacattagaaattagttcttctatctaactgtacgtttgtacccattaaccaacctctcttcatccccccatttcccagaacccttcccagcctcttataactaccattctactctctgcctccataagatcaacttttttgccatgagtgggaacactttgccaatgttttatttgggttatttgttttcttgctattgagttgtttgagttttcaaaaaaatattttgggtattaaccccttatcagatatatggtttgcaaatattttctattttgtagattgtctcttcaatctgttgattatttcctttgctctgtagagttttttagttcaatgtaatcccatttgtctatttttccttttgtagcctgtgcatttcgggccatatcaaaaaagtcattgccaaaaccagtgtcaagaagattttcccagctgagcacagtggctcatgcctgtaatcccagcactttgggaggccaaggtgggtagatcacctgaggtcaggagttctagatcagcctggccaacatggtgaaaccccatgtctactaaaagtacaaaaattaactgggtgtggtgacacgcacctgtaatcccagctacttgggaggctgagtcaggagaatcacttgaacctgggaggcggaggttgcagtgagccaagattgtgccactgcactccagcctgggcaacaagagtgaaactccatctcaaaaaaaaaaaaaaaaaaaaaaaagattttcaccctatgttttcttctagtagttttatactttcaggtgttacatttaagactttaatcccttttgtgttgatttttgaatgtagtgtgagataaaaatccaattttattcctttacatgtggatagctagttttcccaatatttgttgaagagactgtcctttcctcatttgtgttcttggcatctttgtagaagaacagttggccataaatggatggatttatttctgggctctctattctgtaccattggtctatatatcgtttttatgccagtaccatgctgttttgatactatagctttgtagtagattttcaaatcgggttgtgtgatgcctccaattgtgttcttttttcttaagactgctttgcctaatcagggacttctgtggtttcacaggaattttaggattgttttttctatttctttgaaaaatgtcattggaattttgataggggttgcattgaatctgtagatcactttgggtagtacaaacattttaacaatatttcttcctatccatgaacatgacatgggctatctttccatttatttgtgtcttcctcaatttcttttccttttttttttttttttttttttttttgagacagagtcttactcactctgttgcccaggctggagtacagtggtatgattttggctcactgcaacctccacctttcagctcactgcaacttctgcctttcgggttcaagagattctcctgccttagcctcccaagtagctgggattacaggtgcctgctaccatgcctggctaatttttgtatttttagtagagacagggtttcaccatgttggccttgctggtctcaaattcctgacctcaagtgaaccacctccctcggcctcccaaagtgctgggattacaggtgcgagccactgtgcccagcccctcaatttcttttgtcattattttattgttttctgtgttcagatctttcatctctttggttagatttattcctaagtgttttttttcttttgattctattgtaaatgggattttttctttgcttaatgtctgcatttcctcttttccgttttagtggacacgtaattgtacatatttatgggatacagagtgctaatttgatatgtgtatataatatgtaatgatcaaattagagtaattagtacatccatcacctggagcatttatctcttctttgtgttgtgaactttcaaaatcctcacttcttgctttttaaaaatatacactgaattattgttaaccataatcatcctacagtgctacaaaacactagaacttctttctcccattagctgtatctattaaccaacctctccctagcctcctctgcccctctaatgatctgggctctaatgaccacaattttactctctacttttataatctgaatttttttatatagctcccacatatgagtgagaacacatggtatttttgtgtctgatttatttcccttaacagactgtccttcaggctcatccgtgttgctgtgaatgacaggatttcattcgttatggttgaatagtattccattgtgtttatataacacattttctgcatccattcatctactgatggacacttaggttgattccatatcttggctattgtgactagagctgctattaacaggaatgcagaaatctcttagatatactgatttcctttcctttggataaatagtagtgagattactggatcatgtggtcattccatttttagtttctgtgagaaacctccatattgtttttcataaggtactaatttacattcccatcagcagtgtataagacttctcttttctccctatcctcaccagcatttttttttgtctttttgatgacagccattttaactagagtaagatgatatttcttcttgctttagatttgcatttcgctgataattagtgacgttgagcattttttcatatatttactggctatttgtatgtcttcttttgagaactgtctattcaggtcctttgcccttttttaaatcagagtatttgttttttatctgttgagttgtttccgttccttgtatatttggatattagttccttgttggataaatactctgcaaacattttctcccattccacacattgtctcttcactttgttgatttttttgttgttgttgttggctgcagaagttttttaggtttatatagttcaatttgtcaatttttggttttgttgtctgtgcttttgaaattttactcataaaatatttgcctagaccaatgtcctgaagtgtttcccccatgttttcttctagtaggtttatagtttatgttttcttgtttaagcttttaatccattttgaattgatttttgtatttggtgagagatagataggtgtctagtttcattcttctaaatatggatatccagtagtaccagaaccatttattaaaaagggtgtcttttacccaatgtatgttcttggcatttttacttaaaatcagttggctgtaaatatgtgatttatttctgggctctgtcttctgtttcattggtctatatgtctgattttataccaacaccatgctgttttggttattacagaattgtgctatattttgaagtcaggtagcatgatgctttcagcttcattctttttgctcaggattactttgactattcagggtcttttgtggttccatatgaattttaagattattttttactgtttctgtgaagaatatcattggtattttgatagggattgtattaaatctgtagattgctttgagtagtagggtcattttaataatattaattcttgcagtccatgagcatgagaaatgttcccattttttggtgtcctctttaatttctttcatcagtgtgttgttttccttatagaagtctttcatgtccttggttaaatttattcctaggtatctttttaaatagctattgtaaatggaattgcttatttatttatttagtggctggttcattattggtgtatagaaatgctactgatttttgtatgttgattttgtatcctgcaaaatcagtttatttatcagtttatttatcagttctaagagtattttgataaacttttttttttttttgagatggagtttcattcttgttgcccaggctggagtgcaatggtgcagtctcggctcatgcagcctccatctgctgggttcaagtgaccctcctgcctcagcctcccaagtagcttgggattgccggtgcccaccaccacgcccagctaatttttgtactttaagttgagatagaatttcactgtgatgttgaccagactggtctcgaactcctaacctcaggtgatccacctgccttatcctcccaaagtgctgtgattacaggcatgagccactgtgcccagccatattttggtaaagtttttaggtttttctatatatttctttcatattgtctgcaatgagggacaatttgaattcttcctttccaatttagaggccctttatttctttctcttgactaattactctgactatgacctccagaactatgttgaataagagtggtgaaagtgggcattcttatcttgttccagttcttaaaggaaagtttataggcttccccatcctgtgtgatgttagctgtggaattatcttatatgatttttcttgtgtcatggtgtcttctttctatacctaagaaaggagagagtttgttgagagttttttatcgtaaaaggatgttgaatattataattttcatgcatgtattgagatgatataatttttgtccttcatgctgttcatttgatgtatcacatttagtgatttgctatgttgagccatcctttcattcccagaataaatcccacttgattatggtgtattattttttgatgtattattggattcagtttgctagtattttgttgagaatatttgcatctaagttcatcagggatataggcttatatttttctttttaaattacgtccttgtctggttttgatatcagggtaatggtggtcttatagaatgagttaggaaaaattccctaccgttcaatgttttgggatagttggagaaaacttggtttagttcttctttataagtttggtagaattccgtggtacagccatctggtcatgggcttttttttgttgttgggagacttttcattactgattcaatctccttactcattactcatctgttcagattttctgtttcttcctgattcaatcttggtaggaagactgaatcaggaaaattttggaatttatccatttcctctagattttctattggttggcgcatagttggtcagaatagtcaccaatgatcctttatatttccgtggtatcagttgtaatctctttttttgtttctttctgattttatttgaatcttttttcttaatctagctagtagtttgccaattttgtttacattatttaaaaaaattttcatttcattgatcttttgtattgttttcttagtctctctctcttttttttgggggggacagaatttctctctgttgcccaggctggagtgcagtggtatgatcttggttcactgcaaccttcacctcctgggttcaagtggttctcatgtctcagcttcctgagtaactgggattacaggtgcacaccaccatgcccagctaatttttgtatttttagtagagatggggtttcatcagtgttggccaggctgaaatcctgggctcaagcaatctgcctgcctcagcctcccaaactgctgagattacagatttgagctaccatgctcagccttagtctctattttgtttaattgttctgatttttattatttctttctactaattttgggttttatttgttcttgcttttctccttgaggtgtattgttaggtttttttatttgccatctttctacgtttttgatgtaggtatttattactataaacttctctgttagtactgcttttgctgtatcctataggttttgatatgttgtgctttgattttcgtttgtttcaggaaattgttgattttctttctaattttttttgactcaattcaggagcctgctgtttaatttccatgtatcttgtaccgtttccagagttcctctcattattgttttctaattttattccactgtggtctgagaagatacttaatatgattttgatttttaattatttgttcggatttgttttgtggcctaacatatggtttgtcctggagaatgttccatgtactgatgagaagaatgtgtgtgctacagctgttggatggaatggtctgtaaatgtctgttaggtccatttggtttatagtgtagcttaagtcagatgtttctttgttgattttctgtgtagatgatctgtccaatgcttaaagcggggtgttgaagtttccacctatcattgtattgtggtttatctctttttagctctgataaatttacattatatatatgtgtgctctggtgttgtgtgcatatatatttataattgttaaatttttttgctgagttgacccttataatgaccttgtctttttatgttttttgacttaaagtccattttgtctgatataaatatagttactcctgcatgcttttggtttctgtctgtatggaatatttttttccattctttcagcctttacatgtgaagtgagtttcttgtaggcagcatataactgggtattgtttgtttatcatttcaaccagtgtatattctttaattggggaatgtaaactatttacattcaaggtttactgataggtggggacttattcttgtcattttgttaactggttgctgattgttttctatattttttgttcctttcttcctttctttcatttatctttggtggttttctgtagtgataatacttgattcttttttctttctcatttgtgtatctgctttgtcagtgagctttatacttttttgagttttcatgatggtagatatcatccatttgcttccagatatagtaggattcccttaagcatttctttctttctttctctttttttttttttttttttttttttttttgagatggagttttgctcttattgcccaggctggagtgcaatggcacaatctcggctcactgcaacctctgcctctcaggttcaagtgattctcctgcctcagcctcctgagtagctgggattacaggcatgcaccaccatgcctggctaattttgtacttttagttagagacggggtttctccatgttggtcagtctggtctcaagttcccgacctcaggtgatccacctgcctcggcctcccaaagtgctgggattacaggcatgagccactgcgcctggccaagcatttcttatagggctggtctggaagtgatgaattccctcagtttttgtatgtctgggaaatattttatttatccttcatttctgaagaatagctttgctgagtatagtgttcttgttaggcaggcttttttttttttttcttataaggccatgtgcactgatccttgggcccctggtggggggcagcatgggtgctggcagcagtggcagtgggctgaacaggctggtttttggacccccaggtggtggcacacatggacactggtggtggtggcaataagacttgggtgggccaatttttttttttttttttgagacagagtcttgctctgtcaccaggctggagtgcaatggcgtgatctcggctcactgcagcctcctcctcctgggttcaagaaattctgttgcctcagcctcctgagtagctgggactacagatgcatgtcaccatacctggctaatttttttgtatttttagtagagatggggtttcaccatgttggccaggatggtcttgatctcctgacctcatgatctgcctacctcagcctcccaaagttctgggattacagacgtgagccactgtgccgcataacttttatttaacaaaatgaaataactatttaactatgtctcctaccctttatatagtaaataagtacagttgacccttgaacaacaagagggttaggggttatcccccacatagtccaaaatccacacaatttttaacttcccaaaaacttaattattaatagcatactgttcattggaagcctttctgataacataaacagttgattaacacgtattttgtattttacatgtattatatactgtattcttataataaagtaagctagagaaagaaaatgctgttaagaaaatcataaggaagagaaaatatatttgctattcactaagtggaagtagatcatcataaaggtcttaattctcatgatctttgccctgagtaggctgaggaggaggaggaagaggaagaggaagggttggtcttactgtctcacaaatggcagagatggaggaggtagaaggggaggcaggcacattcagtgtaactttagggaaatacatcataatttctgcctgacttctttgcattttcatttctctaaaaatgtttctttgaagtaccaatccttcttccactgtttgctctagtttcagtgcctgtatcatagaagggtctatgtcataaaagaagtcaaaagcagtcttgaatagttaggcctttgtgccagattgtctaatgttaatttgttttctagtactgtttcttccacatcttcttcctcatcatctaacattggtttagaagcactcctctctatcaagttgtcttctcctaatttctccgatgtggcatctgttaactcttcaatttctctaagatttatatcctgaaactgttcatttccccatcttttttttctctatatccacaatctctttcatgatttctttgattggcactgttataaatcctgtgaagtcaggggcacagttttctccagcaggaatttattgttctggacaatgccccagccacccagaaccccatgagattcatggctttttctataacctcatgggtttcatggcattttcagtggtgtaatcctcccagactttcatgatgttctctctattgggattctcttccatagcattgacgatccgttccatagagtgccataggtaatgagctgccttaatggtctttatgaccccctgatttagaggctgacttagagacattgtgtttgggagctagtagacaacttcaatgcccttggtattgaactcatgcagttctaggtggccaggggcattgtccaacatcaaaagaattttagaaggcagtcccttactagcaaagtacttccagacttcaggaacaaaacattgatggaaccaatataaaaaaaaaagggtcacgattgtccagaccttcttgttgtacaaccgaagactggcaactggtgtttatcttttcttttcaaggctcaggcgttagcagctttaacagggcagtcctaatcagaaactcaactgcatttgcgtaaaacagtagagttagcctatctctcctgctttaaatcctggtactcaattctcttccttattaataaatgtcctttgtggcattttttttcccagaatagggcactttcaactgtgttaaaaacctgttcaggcagatatcctttctcctcaatgattttcttaatggcatttgggaacttgtcttttgcctcctggttgacaaatgctgcttcttctgttatcttgacattttttaagcaaaacctctttctaaaataaacaaactattcttttctggcatgaaattctccattctccagctttagatttttcactttctttttgctttgtcatataatgactttgctctttcttgaatcatatttgagtctatagggatgcctgtcttatagcaatcctgtactcacataaaagctacattttcaatacaagataatgagatattatgcaaaaagtgcaaggttttcacacttgctggtgtagctgtagtgatggcttcacaaatttcctttccttttttttttcttttctttctttctttctttcttttttttttttttttttacaatggttcttacctgaattcatttatcttgaaatggtcgacacctgcagcagcagacctcaatgtgtggtacagatcaagcaattcaactttttcttgtaatgtcatgactttgtttcttggaacacttccagcatcactagtggcactttagcatgggtcccatggtattatccaaggtttacagtattgtactaatcataatgaaaaacatgtaagaactgtgaaagagcactttttactgtaatacacaacttactggagagacaaactgctcacgtggaggtttagtgtcacacagcattttaagtagatacttgcaacacttgagctcactgagattgcaacaggtgaccacaaaattattacagtggtacagtatgtactatggttttatgcagttatgatttaatattagatcttaatgtttgtttacatttctcttaactgagaatggcaccctgtacagtctataagtgtttgtaagttttgataaattttaactttttataacagattcgtgtatattatataggtgtaaataataaaatagactagtatctacatatattatatgaattcatgacacatctggctttttcttaatttttaaaaatatttttaggctacacattttacctgtgagttttttcaaattatcacaaatctccaaaatttttttcagtatattcactggaaaaaatacacatataggtagacccacacaattcaaacccgtgttgttcaagggtcaactgtattttcattacacctcttaattttcattttgttagtttcagttctgtttatatattcttggtatcccaattataaaatttaatgtgtctatccatcctgatcagcaggagtctaaattttcagggtgaaggggagattctgtgacctgacactatatacacatcccacattccaggtggtacagacctggtaacactcttcctggggcagttgttctctgagctaagggatcagtagcacagggccatccaggccacacccatccaggtttacaagggcatttctctagagacttgtcaggtactctaccctatcataggaacaggtgagcctagctgctcaggcttaattatcgttgagcccatgaaagattcttacaactatagctttgtctccttaatgtgcataactcactttaaagagcactttctgatcccagcactttgtgaggctgaagaaggtgaattgcttgaccccaggagttcaagaccagcctgggcaacatggaaaactgtgtctctacaaaaggtacaaaaattagctgggtgtggtggtgcatgactgtagacccagctacttgggaggctgaggtgggaggattaattgagcctgggaggtctaggttgcagtgagccaagatcaccccactgcactccagcctgggtgacagacagaccttgtctctattaaaaaaaatactttaattgtatatatttttagatttacagagaacttggaaaggtagtacagagaggtctcgtatatcttgtgcctggatgtccctattaacatcttacattatgatggttcatttgccacagctaagaaaccaacattgacacattaccattaattaaactccacagttttgattttgcaagttctgtcctaatgtcctttttctgttccagaatcccatcaaagacatcatgttacatttcgttgttgcgtctccttaggctctcctggtctgtgacattttctcagtttcctttattctgatgaccttgacaattttaaggagtactgatcagggattttgtagattgaccctcaatttgaacttgtctgagtttatcttgtggtactgggattatggtttttttggtgagggaaagaccacagaggtgaaatgccatgctcattgcatcatgtcaagggcacatgctgtcaacatgacttatcactgatgatgttgacctcagtaacctgggtgaggtagtattttctagattttctcagcacaagtcacttttaacctactctaaaactttgccaagaaacagcacaaaggtttcctggtttgtgctttccaggatacattctttccctgtgcctgaaaaagtgggatgtttgagttcagttttccaattcctgcctcactcactatgttccccgaatgcttcctcactcaccatgatccctgaaagacttgatccatcattttccaattatgtctgcaaaacctttcagaattcagggatgcagtcaatctcaggaaggatatatcctcatgtttcatttatttatctattcaatgcatatttaatatcatttttattacaaggtcttacctaggttctgaaggcagataaatttataagccataacctttctcctggtagcccagccatgttaaaaaacaaaacaaaacaaaaaacactgtagttcagtgtactggtgtttactagggcagtaaagggaaaggttgtctaatgaactctgcctggggtggagtttgggggtcaagaaacggctcagagttggtggtggtacatagggtggtttgtctataacccttttctagcttcctttgaccttcaaggactttcaaattttgtttttggctagctttgcctaaaaccccagtgctaactatatgtacactgtgtagacatctgagacccaaaatgggacaagctttagactaaagggacatcggataacagtcacaccatcatcctttgcatcaggttggccccaggaatgcctccccataagaggagaaagttaacaaggcagggaacttcgacccagcccccagggcaattcaggttctcgggtggtgagcattacatacggcccacaggctataaaccaccttaacaggcataatgactttcatgcctccacctgaaggggctcattgcaataaggtaacagctcttgcagatgcctctaactttaactatgggaacacttgctttatagcaccacctgaatgatctatatcctgttctcgtcaatggcaatttcaggagtgatttggcttatgtcttttgtgcatgtgtgtctactcagcgccctgaaaacttgtggcattgagaacatgtgaagaagtgtgtgtcacagctgcagagctggagatagagatgggtcctgagctagctgtcattaagagataactctcaggagttcacactagtcagaaggacaggactaatctctattctgcatttattcaccaattcattcattcattcacaaacacttcctgagtcctccatttacaagcacaatactgcatcagtaccatggcttcatgtcagtcaggtttccttctgagatctgttgtcaaaggaatacactcaggcaagctgtgtctttactaggctgtggggcaaattctttcacagaatgatgagtggagctaatgagaccctgaatatatggtgagttaaatgtttggggacatttcctaagccaaaagcctatgcatcattcttcattcttctgtctcccttccctggagatgccctggacaattctacatcctaatatctttcttgaagcattattgtgtccccatcctcactcctctgcctacagttcattacctcttacctgaattaccacctctcacctgctctcccagcagccatccttgtctccctgcatccgttccccacaccacacactgacgagatttctaaagtgaaaatctggtcacccttccctcctgctctgtggtttcttgttgaccttagaataaagccccaaagctttcacattgcaatcttactcctgcttgtttctctagcctcatctctcaggtgtctgctccctctttaagtgtatgcccgtgcacacacacaccctcctccacaccccaacctgaccacttgactgtctctgcttagcttttatttccttggcagagcctttgctgacctcccccatagcccttacactcttgtattgtaatgtaattacttgtcttccttccaggactgtgggatctgccagggcacagactctagttgtccatttctttatcctccccatgtcctgtcatggtgcctggcccatagaagtaactcagtaagtttgatgaaaaaaaggaatggagacaagaatggaacttctgagcatgagtgaggttctgtgtgctggtagcagggaaggatggagctagcatctttgtgctctgcaggtcttggagaaatgcccagccaggtcccagagtagttcagcatggagccagcttctggaccaagatcagtaacaattaaaacaactaagaaatttttgtatttctactctaccgtgtttcaaaaaggatttattcaaaaaaatacataaaatttttaaaaatgatcaataagggagaaaatttggcttctggataagattattactctaaatgaggttaataccccaaaagaggtgtgtacacttgggcaatgaattggctctgaggtacctggcaggccatgcagagaaggaaatgtgatgggttataggctttatgatgtccatcaaatgaaaataagtcaactggggaggagaagacaaggtttcttggtactgaggccagaaagagacttctcctgtggattcttttaaagaagaagtcaggtaacacgatggatgataatctcagccatatcttttcaataaaacaatggggacaaatcttggaatggctctaaatgatagctgatagccaataccacagttcattctagtaagagtgcttccacaatgacattaaaatgtgatatctatgcacccaggtctctgatgattcagatcagttcagtaaacattttataatatttggaacaaggtccttaaattgatccttatatgaagcctatgaactcttgatacagcatgcaaatttttgagcacatgtttatgtacattcttctggggtgacagtccataatttctccctcaaagttccaaaccactaaattagtgaaatagctgggctagatctgcttagactatttcttacctatcaatcttctgctccatgttgcttggtcaggagtttggggctatgctatttaatgaaatccatatacatggaatcagatacttgatgctgcaggttaagatggtcaattgcattgggctagagtttatgactcccagtgaaagtttagctgctcaatgaacatgcatgtttgaacccaaggccagagctgttgcactaagtgtttatagaagaaataaacagaaaggacaacacttcataaaagtgacaagggccagaacaaccaagcagccatccaagccattgactgtggagtactgcagactcagtcaacacctgaagacacagagctggagccaacagagaagggaaggaatatggaagctctgaaaggaagcattcccctgatctgggttgcctttaatcaggttgattaataggagtcagtaaataaactctaatcaaaagatgccctaaaccctggagaactctcatgctgtctctcttttttggattaattttttttcctagtagagatgaaaaaggagccattatctaaatgaggctgggtaagatgattagatgttatttacagacagggcatgaaatcatccactggaccctgtgtgtgcttagcaagacattattttgttataagtgtcattgtttttatagttgcaaagggatgcctccggtgtggtgaggagggattccccttatttcagtaatcgctgattataggaactagaaaagtcagtcatttccaatacagcaatactcagggggcctgtatctaatgcaaaccacaggtttttcaatcaattgatcagcagatatgtattgatcgattgcctactatgtgcatggtacagagaagattcatgagaagtagatgtggagtacagcccagcctccaggaagctttcttgcaatgcagtgtgacaggcagtgcttccctgactttaatgtgcagattaaaatgcagattctgattcaagaggtctgaggtggggcccaagaatctgtattcctaacaaactggagcaaggactacacacttgacacactttgtttttttttgtttttttgtttttggcaggttcttattctattgctcaggctggagtgcagtggctcaatcacagctcactgcagcctcgacctcctaggctcaagggatcctcctaccttagcctctggagtagctgggactaaaagtgtacaccaccatgctcagctaattttgtaaattttttttttttttttgtaaagacgaggtcttcctatgctgcccagtctgatcttgaactcctcaagtgatccttccgctttggcgtcccaaagtactgggattataggcatgagccacctcaaccagcctaggactacatatgttgagtagccaggtgggagactacagattgccatgatgaaaagctgggaggtgtgggctgtcggtaaagctcttctgacactcaccacctgtgcaaacttggccaaattgcttcatcttgaacctcaactttctttgacataaaccagaggtctctttgggcagctggtgccctgcacaactccccgacgggcacaccaatatgggctacaggtgaatggcatcctctagagttgtgtggtacacaacctcaccaaatgtatgcagagttcttgaaagggctggattagacagtggttgccaaccctggctgcacaataccatcatctgctaagatttaaaaatgtcgatacctgcccctgccccctgtgattctgacataattgtcctaggatgagacctgggccttggtactgttttcgtttttcctttttttcctggatagatagatggaaagaagggttgtttctttgctccccagagattatgagatgctgcttaaggtccgtcccagcttgaggttctgtgactcttagactgtgcccacagaactctaagattgtttaactctgggagaccagagaagggaaagatcggtacagaacaaggagagcctgtggttttgctggaaaaagtcggtttaaacaaagagactgggatggagaagctatcctaggtggactgtgtgaatgttagtgaggcttctgttgatggaacacatttctatttgggttggtactgggaattgttctgtgaagtgttaattggtagagaaaaatagcaatatccaagaatgataatcacacataataatgagggcttgtgtattggcctgttcccatgctgctaataaagacatacctgagactgggtaatttataaaggaaagaggttttattgactcaaagttcagcatggctggggaggcctcaggaaacttagaattatggtggaagaggaagcaaacacgtccttcttcacacaatggctggaaagagaagtgcctagcaaaagggggaaaagccccttataaaatcatcaaatcctgtgagaactcattatcatgagaacagcatggaggtaaccccccacatgattcaattacctcccactgggtccctcctatgacacgggattatgggaactacaattcaagatgagatttggatggggacacagccaaaccatatcagcttagaagggaaaacagggggtggccagggaatgaggcatatgacagagccctgatttagacttggggggcttgaggatctagactgggggcttgaggaaaaggcaacaaagctgagaagagcagtgaggaggagcacctccttctgtcctagatcctgcttaaggctttgcggagtcctcttcatccagctcaggagagtcctgagaacatggggtgagtgtcaggaaggtgagggcaggccaaagccttctgagaggtcctcggcttttccccagaggtgcctgctctgtgtcctgcctgtgtatgggctgcctccaggaccccatgaacacatctggttagaactggctgactgagtttggtccccgctggccttgaaatacatgatcctgtgaatgtgggcattgatttgagcccaagcacccaggaggcagctcctttaagtattaaatgcactttctactttgtcaatccagcttttcagtcaaagctgtcttttcctatcctcatcgtcctcctgtcttgtgagccttggcctggagactggctaggagtcctagaggggccacctgggagggggggacgatgcatccccctacgccctgaatcaggcttcactctacctaaatcccactctccacaggcattttaactaaaacggatcctgcctgctgtgagcaaaagtagcctcccaaatctatccaagaagtgtgattgatagtgctgctgaggcttgagacaaagaagccctctctggttttcatattaatgctgggttatctcctacagtattgattttttgtttggcttttgaaatttctcttctctgtttctgagccattcctataaaaatgaaagaggaggtgagggatgatgtcgtccaggttgacaagctttgctgacttgcagtattagctgctgttttccattaggtctctccaagcctgtcaactgcctcttctgggcagaaatatatttaaaatgtggtatgaaaaggtccccatgtgtcaacagtaagagcctgccaccaagtttagtcactggattaatcttccaatccttagcatttgggtcctcttcaaggaagcagcaaagattttgatggactccagcctgctgctctcagtcctcctctccctctccaaagacagctcaacttctgcaaaactatcaagggatgaggctggcctcagcggctctcagcctcccttcatctcctctgtttcccctcagatatgtcccactcctacttctctcctcctcacccattcctgcgctgagagccaccgtcaacacttgggtgtgaatgtcttcttaggctgtagagggggatcctcgcctatgggattttgcctttactaggacgtcaggattaaggatgttaagctctaaacagtggagtttcatacatccctcagtggagaaaggatgttttggaggaaaagcagaaatgcagcattctctgaaatctgaatgttaccctccacctctgctttcctggtagcaccttcatcagattggagggcatatagggccaatgcgggtggcatggctgcatctcacatccttgggcccttcattcagttagtcaacaagtgtttgaattgaagtgagaacccatttgtttacaatgttacgctggacctacaacccttctttgttagagtctttatctctttagctattcattctggattccaaaaagaattatgcaggcctagtcccagacactgtgctagtgccgggggtgcagggatgggcaagagagtcaggctctgtccttgtggagctgtgaaagttggaaacctgggagtctcctttgcctctgctacctttccactagcacatccagttatcttctgtctccctgccactggccttgaccactctcctctaaagcttctagaacagtgcttatcacgtacggtagacgaacagtacatgttggtctatcatagtccccaccacacccctaagccatgatttacatccaagtctgacccctatcttgctcagaagtctccaatgaatcccccttttctatggtgtaagatggaaatggccttgaatggcacataggccattcaggatttggtccctgcctatctgtccaacctcatctcctgcattagtcaggcttctccagataaacagaaccgataggatatgcatgtatgttgaagccttgggggcactctgctttacccaaagttcaacaagttaaatgttaatcttatctgaaaacaccttccaagtgaacacgtgaaattaaccatcacaccccctttgccctgtatgttctggcaatattgcacctctttttagcttccaaaaatggtccactatcctgcctctgggcctttgcacacactgttccttttgccagacttatctttccccattcttgtccactcaacagacaccaattctcacactaatccagcctcagctgcaaagcactctctctcagtgaccccttggaccctcacagagagatttgggtgctctgtgttgttattcccattctattttgcacttagttttgtcacatcatttatcatgttaatgttggctggcatatctcccttcccactgggaagacaagggcttatctttttgtttttgtctaagtcaagccttatgttgggtattggggaaaatctcttgggcattacaaccttaaccaatgatcttattataatcatcctaccacctcattttaattacttataaagtagaggattgaactgatagagcagtaatcaccaattgcttaacttcatagtcgttctccctctacttcatgtcatagagctcttagctgagcccatggcctcctggaagtaaaactacattttccagcaggctgtgcagctgtatgtggccatgtgactgtacatcatggctagtgggatgtgaatgggtcctcagcaccttctgggagactttcttttctgtcatttcctccagccagctgcctggaatcataagcctactatcttggaccatgaagatgtgaagcagaggccagaagtggtctgcaaagagatgactgtgaatccaagatccacatcagctctgtgctgcctacatctgacttctccgggaacaaaaagaacaaacaccactactctgtttaagccaccatgtttagaatctttgttgcttgcaattgagcctaatcataaggatatatcttgagaagtgctttccaaattctctgagggaagtcaggagacatcatgagcaaagagagtttaaagaggctgagttagccctcctcactcactgccatcccaacccaattgtgtctgtgccacttctgtgtattttacctgttgacttagagtttgtttgaagatggaaggactagaagctctcccaagtcccatccatttctgacattctaaacatctgtccatatgtataaccattataaaaggaaagaattccataaagaggaggcggatctccctatcatgtgcacataggcaaacatgggcatcgatggtcatagccttcattcctgatggtggaatttcaggcatggtggcaggtgctggagaagatctctgtctcctttgtctatgtctcaggcctgcctgagtggcgtcctcttatttcctgcccaccctgtgctacccatcccagagctgggtaggtagcaggtatttaggggatgttgactggatatgctgaatgaacatgggctgaatgagcccatgctggcatctccatactaacttttgtacattaagtgctctcactggctgtctcaaatgagctgtgggtttgtttcttggcagttctgtagttgtggccttatttcttcccattcttacgccaggagtctttgtggcaggctggaaattctgcccagcaccaagcccatagcagagacagcagacatcggaaacaggctggacctgcagtggccgcgcctgtgtggtgcatgcgtatgcattcatggtttctcctcttctgtctctccggggctggtgtcactctgcccaggagttcacccaggcggctcagaagggtggctgctgtggaacgtgataaatttagagcaccaggaagttgggaagctgcagccatcagcagctgaagcagacgggggcagaactgaatggtctcttctgggtttttaatgaagccgccctaactccccagtccctgtggcttttatcgggtgctattagtaacccttttgtacagatggtaaagcagaagcacaaagaggttcagcagcttgcgtgtgaccccttagcctcaaagtgactgtccagttcatttttcacccctacttatctgttgatccagcaggtgtggaagtgctttgcaaactgtaggatgtaatctatgtggaaggaattgctgctgttagtgctcgtctttcagagagagcagtggcagttggcaccaccccttataagctgagacctacttcatcttcctgggtcccattcatgcagccaagatggagtgagtgtgtgagcaaatgtgcatgtgtgtataagcatgtgtgtatacacgcctgtgtgagggtaccctgcctgcagctttagccgaggctgtcatttctgatgcaggagaacctgcactttgccccatctccacagttcgttattttccagctgggcgcctgtcaccagcactcgggaagcacgtgtcagctgggcctgaaggatggcttagccagtcgaggggctctggcaggggtggggaccgtgacctggggccaggagtaggtggggcaaggaagtctgcccagttgccctagtgatgtgggggtggccccaggagacgtgccttgcccctgctcctaccccggggctctgcttcctgcctgtcaggtgagtatgagggagatgggctgattcgatgggggtagagaggcgggccacgtgagctctgccctggggtcagcctccattcatcactttctctgacacctttctgctgcagcttctctctttcggtgaaagggaaggtaggaggaggggaaggtaaggaggggaaacttccagagccttcagggcctgaggggttggtgacatggggatgaggcttagatttaggaccagggatctgggccagccttagaaaaattagtgaaggggcaacacctgggcccaggaggccaaagacctgggtgtcctagcagtgttgcctcagagttcttcacagtggtcctgcagccaaagcctgagctccagcctgggcgcccataagctaggcgcccatataaaaggcactgggaaacttcacctctctgtgccttagtttcctcatctgtagaagggaaatattaatagtctctgccttatagggcattatgagggctaaatgacttagaatgggacttggccttaggagggatttgataaagggtagctgctattatcactgttgttactttggttgaggctgtacccttaacccaccatggagaccttggtcaagaggctctcatctctgtaggcctaacgttggctgcataagctccccaagccctctcagccattgctgtatgagggggacagtaattccttcccataagcccagcaacagagaggggtcctacataagggacaagtaggaagcaagggggcattggtgatgcgatgacttggaaaggcccttccactgcctgtgggaagaggtggtctgcttttggaacttccagcctttttcatgatcccccaatacagctccatctgtaaccttctcctagaatttttcttatagccagttgtgagattggggaccaagctgacaagataatgccttcagggtgagccttgttctgcacatggcattttcaagggagatctggaagactgaaaaatccttggaggcctgataggctggcatgctaacagtggcattccagaccttgtggtaggtacagttggggcaagctgggtttttctagggaagagcctgttcaatgcctccctaatcataccttataggcagctgatcttcaggcatgcccatgcttggatgcctgtagctattttacctgtttgctttcctccttctctctctccctcctccaccatttccttccttccctcccttccttccctccctctcttcctccttttcttccttcttttctctctctcttttatcttggatatgtgatattaatatgccaggtagttgtcctaaaacccaatctgggttaaactgaactccaactgcccatgcatgtgtgcacgtgtttgcatgtgacttaccccgaagcttggtaggcttttggagaacactgcacttatatccatcattttgtagaataaactgaggattgggaaggtggaagatttccccaaagccacatggccagttacaggtagggctgaatagaaccaaggtctctttcctcctgtaagtatctttccaggatatcaagttcctcatttcataaatgagaaaacagcagcccagaggggttgagtgacttacctaaggccacacagccagggcgtttatctgtcctctctacccatgattctccagagattccagttttccctaagtgcctatagactgacagtgagggcccttgggtaaagtgccccattagcagggaaatggctaatttcccctggattccctctgactctctaggtttgagcagactctgcttctgagggctgagtatttatttccttctggagtcaagcagccttgctgaagtgcagactttgatgtgggtcctctgccctcctccctatgtgactgccctgcttccccagcctttccagcctggagtgcacaccaagcctccctctagctcacaggctcaactgcaatctggaacaggccctgttccagcctgccacaggctctgggctgtacatgttcatagtggataattttatttaattctccaatgaccctctaataataatattattttttataatttacaagtgtaaaaatcaaggcataaagagttttaatgtaatctgttcaagagcatgctgtaaatgagtgttagtaggtggtagaaccaacatatcaatttatgctattctccagcctcttttttattttttgtacttatttattcataatttcaacttttatttttagattcagggagtatatgtgaaagtttgttgcatgggtatattgtgtgatgctatgtgttggggtacaaataatcccattacccatgtagtgagcctagtacccaacatgagttttccaacccttaaccacctccatccctctagtagcccccagtgtctattgttgccatctttatgtttatgagtacccagtatttacctcccgcttataagtgagaatatgctgtatttggttttctgctcctgcattaattcatttagaattatggcctccagctgcatccattttctgcaaaggaaataattttgttctttcttatggctgcatagtattctggggtgtgtatatgccacatcttctttatccaatccactgctgataggcacctaggttgattccatgtctttgctattgtgaatagtgctgcagtaaacatgcaagtgcaggtgtccttttggcagaaggatttcttttcctttgggtatatacacagtaataggattgctgggttgaatggtagttctattttcagttatttgagaaatctctgaactactttccacaggggctgaactgttttacattcccaccaacagtgtataagcattcccttttctctgtagcctcactagcatctgttgctttttgactatttaatagtagccattctgaatgtgtatgagatggtatctcattgtggttttgatttgcatttctctgacgattagtgatgttgggcattttttcatatgtttgctgggcccttgtatgtctttttttgggaagtgtctgttcatgtcttctgttcactttttaatggagtttgtttttgcttcttgaattgtttaagttccttacagattctggatattaggcctctgtcagatacatagtttgtgaatattttctcccattttgtaggttgtctgtttactctgttgatagtttcttttgctgtgcagaaagttctttagtttaattaggtccagcttgtcaatttttatttttgttgcaattgcttttgaggacttagtcagaaattatttcccaaggctgaggtacagaatggtgtttcctaggttttcttctaggattcttacagtctgtggtcttatattccaatatttaattcatcttgagttaattttgtatatggtgatatgtagcggtccagtttcattcttctgcatatagctagccagctattccagcagcattgatggaatagggagtcctttcaccattgcttatttttgttgaccttgttgaagagcagatggctataggtgtggagccttatgccttggttctctattctgttccattggcctatgtgtctcttcttatactagtaccatgctgttttggttattgtagctttatagtatagtttgaagtcagatagtatgatgccttcaggcttgttctcagaattaaaaataaaaaccatattatcatcttaatatacacagtataagccttcaataaaatccaacgtccattcatgataaaaactctcaacaaactaggcatcaaggaacatacctctaaatagtgagagctatctatgataaatccaaagccaatatcatactgaatgggcaaaagctggaagcattccccttgagaactggaacaagacatagatgcccactctcaccaatcctattcaacatggtattgaaagtcttagccagagcaattaggcaagagaaggaaataaaaggcacctaaataggaaaagaagaagtcaactatctctctttgctgatgatatgattctatacctagaaaaccataaaggctccatcaaaaagctcctggaattgataaacgacttcagtaaatttttagaatacaaggtcaatgtataaaaatcagtagcatttctatacaccaataatgttcaagctgagagccaaccaagaaggcaatcacatttacaatagcgaccaaaactaaaatacctaggaatatgtctaactaaagaggtgaaagatctctacaaggagaattacaaaacactattgaaagaaatcatagatgacacaaacaaatggaaacacatcccatgctcatggattggaagaatcaatatcataaaaatgaccatactgcccagggtgatctacagattcaacactattcctatctaattaccagcatcatttttcacagaaataaaaactattccaaaattcatatggaaccaaaaaagagcccaatcccagactctttttaatggttttctagtacttgaccccagcccaagatggcattgcagcttgctctgtttagctcttggctggtggtgttcctgctaggttttattttttattttttggaaaggttttagagttttgctattttacatttaggtgtttaatccacatggaatttatttttccatatgatatgcagcagatatctcgtcctgaggccttgcagtcattctgcagttctgctgtctagtcttctgactgcctggagcagacaccaaaacccatttgtatttgtttagacattggctggtgttgtctctgcaagtttctcacagggacctagaacaactgttggctaagggcagagcccatatttgtcctgacagccagtcctaatcatggaatttaaatgtcagaaaggttctttaaaacagtgtacttcaaacactctcatgttgttttcttttcgcaagcaagctttattgtacttttcttcaaaagtgacaactcacattagagaaagctcagaaaacataaggtaagcaaaataaataaataaacacaactactcgtaatcctacctcctccagagataattctgataaatgttttggtctatattcttttcaccctttaaaaaatgaaatattttacttgaaattatgacagtacaggggataatatagaagacactcatatgtccactactgaggtgtgacaggatgttttatttgctactcattttactaaatgaaacgtaatataattgaggcttcctttgtttcccactccacactgccaccattttctcctttctggaggtaactccaattttgaattcagagagcatctttcctgcccagtttttatactttgccacattgataagttttcatccataacaatgtagggttgctttgtgtgaattttacgtgaatgccaccatccagttcacataatcctccaactttctgcttttcctcagtattacatttttgagattaactgtggtgttacttgtagatctagtgaattagtttttactgctgtatagggttccattgtatgattatactcctatactatactatagcagtactatactatagtgtcatatagtatgctatgttactatactatgcttttccagtctactggtgatccagttgacaacaagaattatcaatgtctgattgtaacaaatgatgctgcaaggaatatatttgtctagatctccttgtatagagagagaaattgctgagtcatgagatattaacagtttcagctttaccagttattgttcaaatagctgtgtccatttacatacctatttgaagcatgtgagagtctccatgccattacaccttggataaaactaggtattataaggcttttcaattttttctaatctgctgggtataaactggtatcttattgccattttaaattgaggcctctctaattattaatgaggttgaacatctcataagtttgtcaatcattctcctcttttgtggattgcatttaatgtatttaatgtatttgtctttctaatatatttgtaaaattcttagatattctggctactctttcatttttcatcatgagggctgtagatatcttcttccaggtcgtagcttcatttttcactttgttagggtgtgtgtgtgtgggttttaaggtgcttcagtttgtcagatgtttcctttatggtttttgcttttcacattttgttaagaaagttcttcctaaactaaacccatacagatatacttctatagtttttctttctttttttggaaagcttttagagttttgctattttacatttaggtgttcacgtggaatttatttttctgtatgatatgcagcagaaatttaatttcatcttcttccatttgactggccaattgtctcagtactgtttcaactctttgacattacatatgacaaaacagaggtccagagaggtggagggacttgcttacggtcacacaatgactttgtggtgagattgtgacagggaacaaagttttcttaactcccaacccagtgcgcccacacaacgatactactgtgttacaaaattttatcttggactattttctactatcctaatatagaaatccataaatatgattataaatgtcttgaaagtggggattctgtccttttctcctgccacctctatgtacttacttagtgcaaggccgaatatctggcaggcactcaggaagacattgctaaaaataaatcagttaattcaacagattgattctataataatcagttcttttaaattcagctctttgtttcatctcatataggtttctatatttagacatatcccttcattcaacaaacatttactgaatacctatcatgttcctggcactgtgtcagctgctagagattaaaagagaggagtaagatgtgtttcctgctctcaaggagcttaaagtgtagtgagagagactgaaaagtcaaccagtaatggtatgaacgtgctattaaacagtatgtaatgggagacaggaggagataaaatctgctaaaaaatcaggaaggctttctgatagaggagacacttgagcctttaagagtgaggaagtgtgattcatttgccaagggtggagaaggtgtaatattcagaagaaacatcatgagcaaaggcagaaatctaaggtactcagccacagttcactgtgacatgaacataaaataattagtcaaccaaatgacatttgttcgtttttaaaaggcccctgcttcctgggtgtttctagcctaactcagatttgaccacagccaaacacggcatcccaaatgctgcctgccttgtcattgactaaaccatgtgtatttaggggctctattttgtaattttcccttgtctaaagtggacaccaactttttgtggaggagtatggctttctccttgttttatgtttgtaaattgaccttcccatttttgccatcatttctgttaccagtgctattattctgggcctctctcatgcagccagaataacatgtgagacaccagcctggagtgacagtgtgcctgacaaaaacagaaatagcccagctcatattatttccaaaagaattatcccctggaggtgatttttaatttgggggttttgctgcaaaatggaaacctgactactaaggttgctttgcaacccaaatgcttctcctaccagtcaattatcaaaatgagacttgctggatactgtagcaagtctttccgggctttctcctttaatgggtcaagtccaagttgcctcctttattgggaagagctgggggcaactgcacagtttaatttgctagttagggggaagggaagatggcaggcggggtagggaggggaaggttctcacatgcaaataaagaaaagcacaaaaggtaggcagagcagccctaaattagagctagttacctcagctgggcagcagtgacgcgatggtggttggttgtaagggattaagaattcaacctgggaataagattagggtttatgcacagcagaagcaaacttgcacaaagattaattggtatctattgggtactggtatgaggcatttatgctattttggtatttttttgggacttgagggaaaaaagaaaggagatagagacagaagcaaagttgaatgtggaaatccagagaggccttttcttggtattaggatttcatgaaattttactcccagccacagcagggagaaggaggtggcctcagagccttgatgggcttgaaaatgaattctgtgttgcctccattgtgagccttgcatgtgctatttaaacttgacatgtcataaatccaatagcagcaaacagaagggcactggcttgctgtccacttttatttgcacggctgcaggaaatgatgttagcatgtgaaagtggtaggcactgcaaaccactcagtctgagggactcgggggctggacctggggaccctaagatgcaggcttgggggccactgtgtgatttagggcatccagcctactgtgtctagatggcatctgcctgactctggcttaggatcagggcatccccctacctcccagaacaacccttacttcaggggaattagtgtatgtgtttctaagctgtaataaaacttcgtggtttccatctgtgtataatcagctatcttttacttagctccttggggacaggaccatgtcttgttcatgcctttgtcctcagtgtgaccacagcatgagacagttggtgtttgtctagatcatatttgttaaatggatgaaatggatggaaaagttggggctgcaccagagctttccatggggcagatgtcgtcagtctgtattggatttagcagtcatttaagtgcagtgttgacttaataatttgaggagctctaaaagaccttcctggtcaggtgtggtggctcacacctgtaatcccagcactttgggaggccgaggtgggtggatcacttgaggtcagtttgagaccagtctggccaacatggtgaaaccctgtctctactaaaaataaaaaaaaattagccagatgtggtggcgggctcctgtaatcccagctactcaggaggctgaggcgggagaatcacttgaaactgggaggcggaggttgcagtgagccgagattgcaccacttacttgagcctgggtgatcgagtgagactctgtctcaatttaaaaaaaaaaaaaaagaggactttcctgtgtccaacatctcattcttggcctccttgtctgcttggactttcccccttagtccaatacctcgtgcatatcaagagtctccgtttcatttgtgcctcttcatttttcagtaactaacaaaaacgtcttgttttagaatccaaggactgtaaatcagctctaggttttgtatggggcctaatgttttcttttgatagcatgagcaactgatatggtttggatatgtgttcccacccaactctcatattgaaatgtaatccccaatgctggaggtggggcctggtgggaggtgattggataataggggcggtttctcattaatggttcagcaccaccctcccagtgctgttctcatgatatcatgagatctggttgttttaaaagagtgtagcaccagcctgctctctcccttcctcctgctccaaccatgtgaggtgctgcttaccctttgccttctgctgtgattgagtttcttgaggactccccagaagctgagcagataccagcatcatgcttcctgtagagcctgtggaactgtgaaccaattaaacctttttttttttttttttttttaataaattactcaacctcaggtatttctttgtagcagtttgagaacagactaatacagcaacattgtactaaggaagagtccagctcagaagaaagtttctaagattttccttttccttttctcttctgtgcaatcagagaatgcactgaaaggtcactcctcagataagtagcacattacggaggtcagcgtggctggtcctgggagtgtcagtatgcactcttgctcttgaaagcatgcttcattcaaggactcaattttaacatttttagtgcaacttcttattaaagccaactgtccttgaaacatagagagctggaaggaccttgcaaagactttcagctcattctctttcatcagtgttgaattttattatatcatttaaagtcctcaagattctttaagaagattcctcagtcttctgggggtctgtcttccttggcctcagacccctgttggtttaaatattcatctaattttctaattccttattttccagctgaaattcacccaaaaggctttctctgtgtatcaaaatagtttgctttcattccgtccttggggtctggagaaagtggtggctgggatagagccctggggagatgggaggtggacatgtgtgaagggagccacatcaagaagttctccaattggggtgtccctggttcctgtttcatcctccccacagtatccagaagcctcctttgccttgttcccctccatgagggcagagatgttggaggctgtcagggctttgagcacttgggctggcacctgagacttgagtgaaagaaatgaggaaaatggagtgcagtcctcaaccaaaccttcctgaaatgaaaggtgttcttctcttcctattatgctgtgattaaggacattatccttagcaaaataactcaggtacagaaaactaaataccactaataatgagaacaaatggacacacagaggggagcaacagacactgagacctacctgagggagggaatgggtggagggagacgatcagaaaaataaatattgggtactatgcttagtacctggttggtgaaataatctgtacaacaaccccaccccatttgagtttacctatataacaaacctgcacatgtacccccgaacctaaaataaaagttaaaaaaaatagctaggtaaattggggtttaaatctcagtcctgacacttaataaccatgtgaccctttggcaaattacatcacctctcatgttccatttccttacctgtgagataggaatagcacctaatttataaaccgtggggagattatatataaagcattatgtgttgtggctaagagcagtcaaaccatctggtaatccttgttctgctactctttagctttgaaaatttggaaacatcactgactctttttatgttgcaggtttatcctctgtaaaatggatgaaaaatagtgcttagctcatgagattatcaagaggcagatggtggttaagggtgtagccttcgaaatgagactatctggatctgaatctcagctctgtcatttcctagctctgtggccttgggtaattcacttaacctctctgtgcttcatttccagcatctttacaatgaggagcataatagtaccgttatgcagggttattgtaatgattgaattaatatagacaaaccacttagagcacatactggcatcttaaaagtgctatataagttttagaaattatcaatgggccgggcgcagtggctcacacctgtaatcccagcactttgggaggcaaggcaggcggatcacaaggtcaggagttcgaggccagcctggccaatatggtgaaaccctgtctctactaaaaatacaaaaattagccggacatggtgttaggtgcctttagtcccagctacttggaaggctcaggcagaggttgcagtgagccaagattgcgccactgcactccagcctgggcaacagagtgaaactctgtctcaaaaaggaaattatcattgaaaaagttgagtgaatgatacaggcaaggttgcttaaatggtgtctggtacatgcgaaaccctcaataactatttgctgaggcacctggaacagagtgggtcttcattaaacattaattctctttctcccctgtcccaggtgtgtggagtgggggccctgtccttccttcacttacccaacatatgcatagcaccaggcaggtaggtaggtggagaaaccgtgatgctcaggactgggaaggatggagagtgcgtttataatgtaggtggagaagccatgtgcttcaatggcactcttttgtttaaagtaacaccacaaagccaagcagaagttctgccctaagcattcctatttttggtcaatatgctgcgagggagcaaaggaaatggggctaaattaaagtagcatttataaataataatgatgaataaatgattcatcaaagttgctttgcaaagtaaattattccgagacacacagagacctgtcggaatgattgtaaactagttaatagatgatgttgttgcaacttgcgaggaagcacttcggagcagcagcccaagcagttatttatgcttctgcaaattctagcataatttaagaaaaagggaaatttacttaccagctcttaataaagtattcatgctaccttaatgtgaaatgttaccaaaattatttagtgacttattgattccattgggttttatgttactcttggtattctttggtgacaattaactaagacagtgtggcctttgatttaaacagttcctttctttggcaaattctctggatttcaggaaactttgcagggtagagatggagggattagaggagagtctggggcatggagcatggaacatatggagccatattgtggacctggatgtccttgggagactgtcatggatctatggatggccagaggtggaaggaacttattacgtcttcccaaatgaataaactgaagatccaagaggctaaaggatccactgaagcccatgcagcagaagagtggcaaagtcctagacctactacgttgggctaaagtcctgtatggtgtttctccctccatggggcaccttacaatgggccaccagggatccatcccatgcagtggaaaaaaggtattaagtgcttactgagtgcatgacataaacacttgagccaactgaagattaagtttagatagataaaacagaaaatccaaataagagtggctaaaatgaaatagtggttatgaacaggaagtctgggtgtaggtggctgtttatgtgagctataggtgagatctctactattggcctttctctactgccttggcctttccctcatcgttgaaaaatggctgcagctccagccatcatctgtgttcccagcaggaggaagggcaaagtcagttaaaaaggataagacctgtatcaggcaagcaaatatttcctccccatggggctgccagttacatctcttgggcaagacactaccttctggcaatccaggctgcagtgaggctggaaaatataatttgtttagctgggtttaatgaactcccaacaaaattggggctccattagaaaggtaggagagactggatatgcaactgaaagtctctgtcatgcctgattattttatttcttacagcaaccctataggatagatgagtattattgttcccatttttcagataaaaaaactgaggcctagagagattaatctgctcaaggaatagagttgaggcttaaatgtagggactgtgtggcatcaaaagcctcactctttttttttttttttttttttttcagagacagagttttgctctgttgcccaggcttgagtgcagtggtgtgatcatggctggctgcagccttgaactcctgggctcaagcaatcctctcacctcagccacttgagtagctaggactataggctagcagccagcatcagcgtgctcagctaatttaaaaaaaaaaagttttattcagatggggtcttgctgtgttgcccaggttggtcttgaactcttgggcttaagtgatcctcttgccttggcctcccaaaatgtgctgggcttacaggtgtgaaccaccacacacggcccaagccttactcttagccactgtgccatcctacctctctggtaggaaatcttttcctgccttgcatctgacaacagcttcctagaacctcaatctcctcatgaggggtgatcggagacattccaaagcagggggagaaactggcagaaagatcccttgcctggcatgtgacaccaggctttgcatataggggaccccatatatgcctggcacatgacacagggctttgcatataggggaccccatatatgcctggcacatgacacagggctttgcatataggggacctcattcactatgaggggagggaagtaggaggcacagaaagaggactctaagagggtagggtcacatatagaattccacgaggagacaaatatgacagatgcctagcagccggtgccagccttgagcagaagagaagttggagatggtgatctctggcacccttggtctgccacccttgcccaggcccgtttccccctcactggactcccactctcctttcagctgcccactgcgccctatgtccttatctgcttaatgtaatcccaatctcatggaaaggccttctaccagttagcttgcatcataacatgactttatagaaaatcatggagggacaactgaggatatggaatttacccccattcccttttatttgacagaaaagaaaattgaggtgcagagaggagaaatctacctccaaactatatacagaaagtcagtggcaggctggaaagggagcctaggactcctgactcctagtctagtgtgtgcatatgtgtacaatgtgtgcactgggtgtgggtgcacgtgcatgtgtgtgtgtgtgcatgtgtctatttcctgtttgcattttaaatttcattttgcacggtgcaattgaagacatcccctcctgctaaggaatagagacttcagggaacacatggggaaaaactgacagcagggtatagtcctgatctcttaacatagaggtggatgcctactctacctagtcagagattgaagtctcttgacaatcagtgaaaaggaggcagatagaaagacccacagctgtagagaaaatgaagaatagatctggagccagggcggctggttaggggaacctgttgacataaggttcagaaaattcaggtgcagagctttctactctattacaaatgtttagtccttaaggcagagacaagagctcagggcagcttaactttgcctccagctgcattggaatcagaatggacttagacctgcagatgcacagaccaacatggcagctcctcctgggtcctggccttgctgctgatgggatgaaggctgccttggttaagggtgggccaagatttctgctctgaggatttttctttgaagttttataaatcagccagcaagacagccaatttcaagctgagatgtcatattgaaggcctcaacccaagatcaattgctggctgactttgattctctgtcatggagcctgggccagtcttgccccaactgggacatagtcaaatcttgacttttgatgctttcaactcagcccttcgttcttttcttggccccaaccctgctccccgggcaactattttccatgttaaggggttcatcgattacccttttgccctggagtacactgattccagaggtgttacccctcagagaatatcctgcaatttggctatgctgccataagggggcgatagttccattgaccaggtactaagaatggtaacgtgagaggagaaaactagcagctgtagtgttcagtttggcagtgcctttttaaaaatcttgaattcgtcacaaatattttaacagtaggagcctgcccataaaaattccgatttggggcttcttttgaaatatcaggatatctagcaacattccctccagcagacagccagctggtgctgagtagggactgccgccttggggcaggatgtgcagcctcctgtggccactgtcctcacctggctggcagccactcatttacattacccgtctgcttcccaaagcccctgtttaagctttaggcatatttgagctagagagaatattaattaaaaaatttaaatagcatagctttaaaaaagttaaagcatctgaacttaggtggcaaccaaggtctgcacttccttaggatcaactttcaagtagacaaaaatctaagattctttgataactctcttatacacttgtcttaaacttgaaccaatttcagttttcagaatataccacactttctcttgatggtgatcaatcatcctcgattgcctggtacttagggctttcctagaatgtggaactttgagtgctacaaagaagaaagtcctgggcaaaccaggacacattgttcaacctgcttatctgtgggccacgctgcctacctggaatgccttcccttggcctggctcaccactcccgcacccttcgggtcacagcttagacaaatctgccttgattacccctctccctacagcctgcaccaggtatccccactcccccttgcactgcagtctccatctgtgctaatttatctgctcacctgtctgcttcctgctagaccatgagctcccaggcattggctcaagggtctcccactcaaggctgagctcccagcacacagcacagtgcatggcccagagtaagtgttgagtgctgaatacagactaattcctcaatgataaggggcaggcacgatgtataacttggatgtgcaccccttgcaggcatgggacatggcaggtgcccaataaagcgtttattgtattgaattgcattaaactgggccaaagatttggatggacatagatctcttctgatgaatgaagaggataaagtgaaataatgatctctcatgacagtctctttcaccctgttttgactgtgactcttcttttttatttcctgggtgttcctcattttcctaagtagacactaagccctcctgtgggcagataccatgccctatgcaatttgtgtgttcctcttttaacaggcatgctaaaagaaaaaaaaagacatattgaattgatgtgtttcaaccaaagtgggccttctagtgaggggctgattgtatgttaaaatattctctcccaccataattcctggttgcctaggatcagtaaagaccctgctcacccattctccattctcaggagcacataaattgctcgaaattggatcagacacagattatggcaagacagatgaaagtaagataaagaatggacctccatgttgagtgatttatcagagacacttaattttggaggacaaaattggagatcattgccataggcctttaagaagggcaaccctgtttttcaagatgtagaatgctgtgagtggcttctttagaccccattctaacctgagacttggtggcttcttgagaagacaatgagagcaagtgggagtggccagtggaagggcaggggagtcaccccagggacagctctgaccgccacttgctcttgcatggccacagtgcaagttggagtgtctgggttggagtcaagttctcccaattccacattgtcttcatgcaccagactttcccatctgagtgccatgactgggtgatggtttgctgagctattgaccctttcagccatctgggcagccaagttggctctgtggcaggcaagatccccaggttgggcacctctgacctctaggaacctccccctacctcagcatgggtcagtttcatgttctgtctgcattgacttgaaaaaggcaaggagactgtcttacgccacactcatgggaccatcagctgtctgtataattccccaaacacactatagcaaagtgggtctgacctgccatccagagactgggttccagtcctggcactgcttcctaccagcaagagtggcctagactggactatttcttagctatattatatgaataaccaccaaaagtccatgccaattactgatgctggtggaaagaatatttgacattcttgtttaacatgtagtattctctgttgaattgaactgctctcagtcaatattccacagacatttttgggggagccttctctgggccaggcttgatagtcctagggatacaatggtaagaaaactgccctagtggaccccacattctagctgtttctagccttctgttaggaaggaggaagcctatgcccaaccccatccttcacttgtgagtttttccttgaaatggggtaacaatgctacccaactgtgtgaagggctgaatcttgagtgcagtcccaacagcatgcattcagcagcactgtgcctttccacaatcatcctcccacccagggccaccacactgtgcctttccacagtcatcttcccacccgaggccaccacactgtgccttcccacaatcatcctcccacccggggccaccacactgtgcctttccacaatcatcttcccacccagggccatcacactgtgcctttccacagtcatcctcccacccggggccaccacactgtgactttccacaatcatcctcccacccagggccaccacactgtgcctttccacaatcaccctcccacccagggccaccacactgtgcctttccacaatcatcctcccacccagtgccaccacactgtgcctttccacaaccatcctcccacccagggctaccacactgtgcctttccacaaccatcctcccattggggccaccacactgtgcctttccacaatcatcctcccacccagggctaccacactttgtctttccacaaccatcctcccacccggggccaccacactgtgcctttccacaatcatcctcccacccagggccaccacactgtgcctttccacaatcatcctcccactgggtccaccacactgtgcctttccacaatcatcctcccactggggccaccacactgtgcctttccacaatcatcttcccacccggggccaccacactgtgcctctccacaatcatccttctacccagggccaccacactgtgcctttccacagtcatcctcccaccggggccaccgcactgtgcctttccacaatcaccctcccacccagggccaccacactgtgcctttccacaatcatcctcccacccagtgccaccacactgtgcctttccacaaccatcctcccacccagggctaccacactgtgcctttccacaaccatcctcccattggggccaccacactgtgcctttccacaatcatcctcccacccagggctaccacactttgtctttccacaaccatcctcccacccggggccaccacactgtgcctttccacaatcatcctcccacccagggccaccgcactgtgcctttccacaatcatcctcccaccggggccaccacactgccttttcacaatcatcctcccacccagggccaccacactgtgcctttccacaatcatcctcccactggggccaccacactgtgcctttccgcaatcatcctcccacccggggccaccgcactgtgactttccacaatcatcctcccacccggggccaccgcactgtgcctttccacaaccatcctcccacccggggccaccgcactgtgcctttccacaatcatcctcccacccagcgccaccacactgtgcctttccacaatcatcctcccactggggccaccacactgtgcctttccacaatcatcctcccacccggggccaccgcactgtgcctttccacaatcatcttcccacccggggccactgcactgtgccttttcacaatcatcctcccacccagggccaccacactgtgcctttccacaatcatcctcccacccggggccaccgcactgtgactttccacaatcatcttcccacccggggccaccgcactgtgcctttccacaatcatcctcccacccggggccaccgcactgtgactttccacaatcatcttcccacccggggccaccgcactgtgactttccacaatcatcttcccacccggggccaccgcactgtgcctttccacaatcatcttcccacccggggccaccacactgtgcctttccacagtcatcctcccactggggccaccacactgtgcctttccaaaatcaccctcccacccagggccaccacactgtgcctttccacagtcatcctcccaccggggccaccgcactgtgcctttccacaatcatcctcccacccggggccaccgcactgtgcctttccaaaatcaccctcccacccagggccaccacactgtgcctttcgacaatcatcctcccacccagggccaccacactgtgcctttccaaaatcaccctcccacccagggccaccacactgtgcctttccacaatcatcctcccacccggggccaccgcactgtgactttccacaatcatcctcccacccggggccaccgcactgtgactttccacaatcatcctcccacccggggccaccgcactgtgcctttccacaatcatcctcccagccggggccaccgcactgtgcctttccacagtcatcttcccagccggggccaccgcactgtgcctttccacaatcatcttcccacccggggccaccacactgtgcctttccacaatcatccttctacccagggccaccacactgtgcctttccacagtcatcctcccaccggggccaccgcactgtgcctttccacaatcatcctcccacctggggccaccgcactgtgcctttccacaatcatcctcccactggggccaccacactgtgcctttccacaatcatcctcccaccggggccaccgcactgtgcctttccacaatcatcttcccaccaccacacacactcaggacatgctgagataaccacccaacacagactgaggaaagtcacccaggagactgcctgggtctgaacgcatccctgcactccctggccctgtctttttgacatctgatgtgtttttgatacttgcaccctcatctcagctcttccctacctgcagtctgctctatgtcactgctcaaatgcctctattccaagagggctcagggacacccccgaggagagaggaagcattggtttccaacatctacacctccagcaaagaagtagtgtgagctggggtgaatgcaactgcagaatcttttgttgaatgaaacacctttcacgtgaagaaaaagcagcaagacgaaatgacactttgctaatgatgtattttatggactgccatctgtctctggaaaggtcagagaaaagtggcaactcagttgcaggtgattgggcagggaccgtggttggggggacaaatgtctctcatcggaacatgacagggagccttggtgacatcatataaatgccctaattgggaagtggtcaatcgagcgggcctgactcctgaatttgatgtgtcaataaacaagctcaaggtgagatgctggatcaataccagaggacaagaaccatctggcaaatttactgcaaagtaattgggtgcaaaatgactcaactcaaccttcacgcttttgaaaagcaaacaaacggtgggcccaccagcaactgtttgtatgcgtcagtggctgcttacgagggctcactgtctgctaatgggcctggggaatgggagccccccagaagggagggaaaaccatgaaccctggaagatgatgctggctgcagcagaagccttctcacagttggggagtataatctagatgcttctatcagggataatcttaaatatagtaattataattatatatatccattttttattctcattaggttgcaaaatacatgagacacaaaagaaatatttatgtctatatatctatgtctacaattatatctactaatggttgagatcagtggcagcttgttctctccacccatgggtgtagggaaatgggaataaagattcttcattgctttaacttcagggtatgtgggcttggaggtgggtagtggaatgaagagagcatgtcctgccctgacccagtggtgggcacggcatcccccgcagagcctcccacttactctctaggcctgctggtctctgagcaggttggggagggtgtgttggaactgcctctgccagcttacaagagctgatggttaactatacaatgaactatgcgacaaacagtggtgtttgtttacaacaaacaaacatttaaacattagtagcttgaaactggccatggtgggagtattcacaccatgggaaccagcaaacgctctctatcaggcccctggagagtcatttactaacatgctgctaagagcaggggtgggtccagggatttggggtccagccaaggaagggtgagtgtctggcaggttgcacccttggaagttgtgctgctggagaatcacacttgggtctgtgagctgttgggtgaggtcgagaggcagctgaggacaacaggagagccaatgactaaggaagagatgccgtgcacatgtgaagccgtgtttctcaagggcccagtttaggggctgcctgggatagtaaaaagcaccaggaggccagccttctagccccagctttgcacttcactggatacaagctccagtatcaataatcagctggcaagtcccagagagccctacaggttgtgacattaaagtaagtttatattggctgcccaaacccctggggtgccctctccatggctctggttcctctcctgcctgtgacttcttcatccaccatctcttcccaatccagcaaccaaagggttaacacctgtcacacatgggggcatcagggacccttctcctgctttggtcctttgtgtcaatgcccccagcttgtctacattacaatgcaggaggaccatagagctctactgggtgcctgggggtaaaaatgcaagctggcccattaccactagcaaaccactaggatgggtaggggcagctggcggaggctagcaggaggctagcagagtctcctggatgtgaggagatgggaggctccctggagagaggcaggtgggtgagcaacagccgctgacagcctgggctcagaccttggctccgccactaactgaagttgtgtggcctgaagcaagtcactgaacactctctacaactccgttgccccgtctgtgaactgaggtgactagaagaatccacattattggtttgtgagctctggatgagctaattcatagaaggtgcttagaaccgtgtctgggaaggtggcaagctctctgacttcatccaatacttccatcatttcatgcctcacagcaactgtgcatgaagagggttttttttttttttttttggtttgtttgtttttttaatcaccagtgtttccatttttatgacacggagactgagcttgagatgtctaatgacctgcctgtggtcttgtggcctgttgatgttggagccatctggaacccaggctgttctctgtgcgtccagcatattctccacccgcctgctgaactgcaggtgcccaggtgcgtggggagggtcaggcttaggagaaagttgccagcccagaggatgagggcagtgggagtggagaacctggccagaggccagtggtgcagtgagagggctgaggggaattcatgggtccacatggcctggggagatagggagaaggtgaggcagggagggtaagtgggaaggtaggcaaaactaacttcatttttccaaatttagcttacctcgtgagctctgtatccatagggaggaaagtaattctgccaactcaaagtcatctctgcccattttaaatgcagtctctttgggggaaatactagtaaatccaggattctccctcttctccttctctttccctttttttctgagagccattttagtctagaggaaggggcagcagtgtgcttgtgtatctgtgtgtgtgtggcttgtccagcacacgcaggtgtgtgtacacccctctcccaacacacactgagtgctgtgaggcaccctcaggccggtcagcccagataccccctccaacctttgctacctggacaaacaggtgccaggtgaggtgcagaccaggcttaggggctcctgctccacactccaggatgccaggacactccgccttctctggtctctcttgtctggtctgccctgatattcggggcctgttgggtgctgaaccccgtctcagtgactttggcagtgattgctaagccatagtcatgctctcttcctcctcctgccggctgctcaatatttttcctttgagtgagaactgtctgtcagcatcgttcttccctgcactgagggtccagtgtagcctctgggcacagagccctccagccccgtggatagtgagaagccaaagtcaggcttttggcctaaaaagccttgtgtcttagtcaagcttctaattccttaacatgaaatactttcaggactagtatttcttcagtgagttaaaacatccatttggccactccactgaccttgttctaagctggtcctattagcctgattcacggggctagagacatcggaggaagacagacacatgggggaaagcaaaagccagtttttatctgaaaatactgtcctgcttacatcagtgcttagcctatggcctggcatctacttggtaagagctgagtaattgttacctattgtcatgatcaccattattttatattgctgatcttgcaacgtataagagcaagggagggacactgagagacaacacagctatgctgtcggtagagtgggaagcttagggagccagggtgcaagtagagtagtttgaaagcggggagaagtcttcctgagagaagtgatgaggaaatggaaattgcagcttccctggcctcacctctcagcacttcttcactttggcctcactcaactccttctaatcccagattcatcatcccctttcattggatccctgctgttccccactttctccatgctgagaatccttaccaggcttcagtctccagctggattgcaacctcatgagagaccctgagccaggaccacccagctcagtagcccccaggttcctgatccacagaaaccgtgagataataaatgtttgttgctgtcaaccacgaagttgtgggttaatttgttacacagcagtaggtagctgatatgcttttacattcttccctgactaggatgcttctcactctagtgcatcctagtgcaatttcttgagcctaacaaataattcaacaaatgagagggagagttttgcagtgagaaatgcctgagaggagaagccaggaggttcaggtccctgacccagttctgtcatccctgtgctgggtgcctgagatcaagaccctttccctctctaaacctcagtcccgccacttttggataagtggttggactagacaatctctaacatgacttccagctttaacaaaacttccaggtgaagttttgtgaaatgctttctggtggactctcattttgcagatgagaggggtctaaatttcctgacaggacatgcctagcagagacctcctgcctccctcttcttcaggatccctgggaggcctgaggggcccagcctgatcagcatatttggcctggagcagggcaagagacccagtcagaagagaggccaggcccttccagatgacctctggcctgacctccagacctccaagcctcacctgatccttcaaaccccctgctcactgggtagaaatattctgtgtgctccctggctcagtcctgggatcatcaattgcactggttattttcttttttgacttaagaggattatccagactagatgctttactttgtcagtattatgctgtgacacttcccttcactggcccccccttggcctgaggactgccaggctttctcccaagtcaaacagtggcacagctggactgttctgatgccccaaatttttgatgtcagtgtttcaaatctttgcaagcaggtaggcgccaacagagggaaaggcacagtgggttggagttcctgcccccgtccacttgctcctccatccctgttaaaggagactccttcaccagcgtagctggagtgctttgggctgcacaacacagaaacgcaatgacttaagtcttgaaaatatacaagttttttttttcttaaaataaaaaatacattggcaactagaattaacagcttgggccagagtgctgactattcaagacaggaagaaagaggcgtccccagtaggcatctgctgatgtctcagtgtctagaccaggtcttgtgattgctagttgcaaaggaggcaagaaagcttgatgctgtgggtgggtacctgagaaggggaaggggaagggggtggaggttaggcaggaatagtttgttgcaagtgataaaaccaaaagagaaatcacttggctcctataactaaatgtcaggaaagccagggtgtggctgggcctcacgtgctgccagggctggttctcacacactccagagctcagctttgcatttctctgtaagttggcttgtgcctctcaggtaggcttcctcttctatctagtggaaacatagtctgccatggcttccagagagaggtctttgtctctaattccaagctgaaaatctcagggagggtctctggcctgacctgggttctgtggctacccatgggccattcaaccctggccagaggagggtgtctgtggtcaagtggtggtggggtcatgatgcccccactggatgtacaggttagaggtggggcataggaggagcattcataacaagagggaggagggattagcagaccaagcagtgcttgtcctgataccagagccacaagagaccacagagagcatggactccagagaggtgagggaacttggcctacatcacacagcaagttagtggaggacctgggcctacaaccctggcttcacactccttctttactctgttgacatttggagccgaatagttcttggctggggggggactatcctgcacattataggatgttcaccccgagcactgcttctgaccagcaatgtttcctggctgcagagagctacttaatctcatggggcctagtgttttcaatggcactaacaataactacctgcctaccttagaaagggagttaaaaaaatagaaggtttacaaatactagttatgaaaatcatttgcaaagataaaggcaggatagaaatgcgggccttttttaaacaaaaaaccaggaatccctgattccactttatgccagagaaaatggcagagaatggttgtgtaagtgtgagtgtgtgtgcgtgtgaataatcacttctccctaaggaataagaaactcttccaccaaattgatacacagtaagaaactctatacctggtaggtgaagacaccagggtgggcgtgaagggtctgttccagcttcctctcattaatccctagtgtaaccatttgtggcctaagaatcaacctccgaaaaggaggtgcagcttccagtgtgcttggaatgcagcacacagccacccacagcttcaccaggaccccgacgtactgacttccactcgcctatgacttcttcaaccccaaagcgaggtcattttgccaagaaaaccaacaatcccatcagccagccaacaggggccctgggctgtggagggtgatgcaaaacaatggttttcaataaggggcaattaagcccctgcaggggacatttaggacacctgcctttgcaggggccaggccaggctggaggcctaatttttttttttttttttgagaaggagtctcgctctgttgcccaggctggagttcagtggcgctatctcagctcactgcaacctttgcctcccaggttcaagtgattcttctgcctcagcctcctgagtagctgggaatacaggcatctgccaccatgaccagctaatttttgtatttttagtagagatggggtttcaccatattggccaggctggtcttgaactcctgacctcaggtgatctgcccgcctctgcctcccaaagtgctgggattacaggaagtgagccaccgcgcccggccctgtgggctgttttcatccaggttgtaggtagatacagaccctgggatagcagtgcctgggggtctctctgggcagagatgtcgggtcaaatggacatgacctcttgcttggaggactgggccaggcccctggaggagccaagagaggaggcctttcaggaactgattggccagtgtggggagaacatgaattaacacctgtaatccctcatgggctggagcctgtgcctgggtggtattgtgagatactggcatggggcctggtacccaaggatcacttcctggaagacacagtgttgggaccgggcctttgaaagccttatgatgactgcacgtggaccagagactccagccttggggtcccttttttgacccagctccacagctcccctaggaggggaggctggcggtctgagcagcctggccttgctctgtcctgaccaaggtgggagaaaagtcctgggagtttgcaagaggaacttgcactaaaaagaaaagagcatagggggacacaagccatcctcgtccccctgcattagaggagagatgggacggatttgctgtagtcaggacagtttcaagggcttgtgtggggcagaaagaacctgagcggaggccacgtttatgaggaaagatggaagcctggtaaagagcccaggggtgaagcagcatcacaggaacctccctgtctcttccctttcctctctgcaggctagcttactgccccgggccccacacagacaggagggggttggggtcgtgcccaggtacgaagttggtgggagctctgtcactgacagtgctttccttctcataggtgctcccattaagataacactgttcatgtcaaatctcttgcttcaatctgaaggttctgggtttctgtttggtgtctttggtcttcatcaatattgtcacatatttaccccatattctgctgaagggaattcaacaagaactaggcatgtgcccagcctggaggagtgggctgtaggaaagagaaactatggtatctactttcattaaggtacaaggctgatacatgagaaacaatattaaaaactgttatcaggagttgagtaaaacatattaagtgaattatcaatgaaggagaacttgtgtgctttatttgaaattaagtcagtgttgtggtcttatctatcctggagggcttcctggaggaggtgaagtgggaaggctttcatttcagtgggaggaagtttaagcacaaggcagggcaaatcctggcacggggcaggtgtgactgctggacagccatcctggtgtagctggtaagattttgcacaagcatgtcccatgtgtctgtactgccagccacacctctctggcctctgcaggaggtggctgatagactgatttgccatggaagctttccctggggccattacctgcaaccacatttctttaggaacaacctccccagcaatttcatttctgctcaaggttgtgctttcacactaggctgagtttccatccacctgcaagtgttcttcccctttcccatttcacgctcctgtccctaaataatgtttgctttttctattaataggactgtcttgattgtgactggtccagctgacctttctccagtttcctattccagaatggtgctgcctgactctcttagcaccgtctactcttcagtcatttattccacatgtggttatatagctcttgctgtttagagactacaaaaaaaaaaaaaaaaaagaaaagaaaaaaaggtgtaaaatacagtcccaggcctctggtagctgagagtctagctgggaagtcaagacagatgctcacatgggaatgatctaagcaggcaacggagtgccttttggatgcccaggtgcactgcccatatgtgtgtttgttccctgctcagagaagggagagagcccagggctgggtaaaccttggaaatcttcatggaggaggaggtaggagctcagtgagttgtaatattttcccaggaagtagatcctgcaggcttgaactctcttgcttccaattcataatttcttagttcatcaagaagagacaagggcacaggaagacagtgttagcgggtttgccacccacttattcccccagcctcatgcccaccctcttttccagaggcaggtgggtctccaccgtctttactgcccaccctgggactgtattttacacctttttttttttgtagctcaatttgggtggcacatttcctcctggctccatttctacaccagattcagatttgcctctgtatctttgcttatctggttcttccaggtgggatatctttccgttctctaataactgtagtagatttttaaaaatttgccttcttcccacacacccctgcgccctccatacacacttccttgcctgaatgatgttaggcttgtctatgtgacttgctttgacttcacggtggacaaagtgtgtacctcacctcccttccttcctttattaaatgcgtggccatctgatttgctttggccaatgggacgttagcagataagacgttaacatgccccttgtgttttgctgtggtcataagaacttgtttcaactggccagctggtgcaaggaggatgagaaaccaatgtgggcacctggacccgacctgcagctttgagccaagggtccagcctggatcaatgagagtaggtgattgctgttttaagcctctgagttttgtgatggtttgttatgcagcattaatgtggtaatagatgactggtacaaccactggtgcagaaattctccttttctcattacttaggggccaaagttgcttccttcaggaggtcctcccagattggtcatgcctaaatctctctttcttaatctgctccatgcctctctaactctcattgactctgcctttttttatgagtgtactctcttgtcatctctcatgtgagcttcttgccttgtaactgtgctgtgagcttgagagggctggacatgtctctttcctgtcactgtgtcaccatagaagccagatatatagaaagctctcagagctacacaatgcctaaagaaaagaaaagaaaagaaaagaaaagaaaagaaaagaaaagcatacactacctctgacatccccgggattcttccctggagactggcttgggttccagtatcactaaagcatttagtaattagcctgtgtttccagaatgtccagaggcaattaggtgcaggctggattccacaggtgtggcatccaggggacagtcagggatgccctggtgcacttggcctgccgacctcactggccacctgagtttcaacaaagctgtttccactgctggactaattcccaggaaatgtcatgtacttggagttcctgggctccatgcccatctctatagagaactaaccatatcctgggcagtaaagctgcgggtgttctctgaggaggctggtttctcaaaatactcatccaactgctcctcctctggacactcccctccctggcccatgctgttccttttgctgggttattccccactccctcatgcacacacatccatgcctgcctgaggtctcctcagcccaccaggccacttcctctgagaaaccttcttctcaattccaggcagaattcatttcttcattcccaggtactcccataacccttgacttattcacctttgtgggcactggaaacgacatcatatgctagatatttgcataaacccttttaggccctctagactgcgacttgtaccagggcagaggtgatggttgattcatccctgagcgccctccatccttagtgtacgtccttggtacaaggggcaaagagcaatggtgaaatcttaagtgagaagatgagatgcaatgagaaatgagataggctccatagacactttgaagacttgaggatggtggaaatcacaaagatctctggcatgctcaagggatgtcactttgtagatggtggaaagggctaaaaatatagcttcccagagagctgagatgaattcctggatgggaattattgaaagatgctgactgtcaaggggataacccctcctgccttcagagcctgggccaagactggcctttctgaggatgcctgtggcagagttctggattgccaagtggtgtggaggttggagaaggagggctgccacgggggccagccgtgttcaggtaaaggccggtcactggggctgatttggaatcctagaatgtaaggtaactgggaggagcctaaggaccattagggaagagtctcatttacagatgaggaaactggagcccaggagtgaaatgtgtcgcttcagctcacccagctgaaatagtgctagaaccagggctagaatgcaggtctgcagaactgtgtgaaaacatttctgaaatggtgacaggactgaataggactcatgggacatgggcaagtggttgggaaaaaggatgaggtcaacctatgtcagatgcccactccctggtcagcctcctccacagagcacagctgcttgtgcacctccagtgccttctgccacagttgaggctggccctgggtgcttgagaagtacacactaaggctggacattttcatatctctttcttctgcctttctcttttgctctccctcctgagcaccatccccaccccccgccttctgcctccaacatattgaatcaccagggtgtgaaatataataaagcattgtaccattcaatctgtcggctattccttaaaggtgtactccaggtaaatatccccttggcctgtgaaaaatgagcttacctgcaacaaatgactttgatgaacctcaggaactggccctctatcattcttttccaattggcttccccagacaagcatgatttccctgcacaaatgtgtcttgctgaaggaagagtttctctaattcactttccttccaatgcccagcttctttgcttgggcatccctttatccagccaccactctcagagatgtctttcttctagaagctgggaactcatgcagtcatcaaatgcttcaccaggttgatcaaaatcagaacccaaattaatcagtccatccatgaacactcattgggtgtggcagcgtggaaatggactgaacctggatttgtgaaatgggtgtccccttatctccaccacttcccagctctgtatctcacttgcctcacctgtgaagcaggacagataataacacctggtcttcttccttcacaggagcgtctgagtagcaaacacatttctccacgtgaaaatgctccaaaaagtatacatcactatataaacacaacgtttactattattattgtcatctaaattctttagggggtgaaagaaaagtttggtcattatttcattaaaacgttattcaacaaatatattctgagtgcctactatgtgccagccattgggcaaaacagttggggtatttgagggagtaaaagggacaaaattcctgctcccacggaatttgattatatttccttatgatctagttgagatgacaaaacccacatgcgtaagagccaactgtagaacaaaaaggcatattgtatgttggtgaactaaataatgcattttaacttacaacttccaattacctgagtacctagtatgctatcatgtgtaattttatttaattctcaaacaactctgcaggctaagcatttttatagtgaaacctgaggcttggggaggaaatactttttctgaagtcccagaggagaactgggagggaggcttggggttgttggattccttggggcttctttttgtccaccctagttctcccagccttgggtctgcactgtgaacttgctcttcagtttcaggaattgacagtgctcagagtgctatggtgataggaagcaacttcaaagaagaagttgcctcctacttggctttgaaggataggaagaatttgcatcagcatggtgggcggatgggagagtttctgatagtgctggcagtgggggtgtgtgaaccactcaagtgggaggcaacttgagggaggacggaggagacactgctggctggatgggaggcagagatggagagcgaggttagacagaaccagacgatgcaggggctcaaaattaagactgaggaacattcctgtccagagacacaaagtggagagaattttcctgtgaaaacaagaggtataccttctcgctgcttaaggatttcacagctctctacccagaaagcttggctatgctgccataactgagtgaggtcgggtgattaatagccttcctgtgggccttagtttccctcatctgtaagaggaaggtgttagaagagagaaatgctgaggcttcttctaactctgagatgtcttgattttgtgattccataatgaactcaaaaacatgtacgtatgccatcacagccacgtacctgtgagggcttttttccttctctgccgctgtaattttagataagtgccaaatgcctctttattctcaaatataaaaacatcgagaagattaagccacagcctgtctcataataatctgggcatccaattccagctttctgatgaaaacatcactgttataagaaaattgaaaagtttaatatttgcaaaaacaaacaaataatcctccccccacccccatccttgaataaggctgaatgttttcggtgacttcatatttctcttcccagttttttgatacatggagctttatttgtggattttttgggattttggagacatgctgtgattacagtcctcatttgggtctaacctgtcctttgaggatggaccctgggtcagaatcaggtgacagatctgtggcctccataggaggttgaatctccatgtgggatattacaaaagaacttgcacagttcaggttagtcacaaaactaatttgagccacttgatggacttacacaaaatgctgatgatggtgatactgatgaaacacatttagtgctgcttatgtgccagacacggtgctaagcactttacttgccttaattcacctaatcctcccagcaatcctctgaagtgagtgctactgttactctcattttgcagaggaggaaactgaggaccgaccggcaaggttaagaaacttgcccaaggctacacaggtagtcagccctataattgaatctgaatcccacagtctggcttcagagcactggtctcccatggtgctttactgtcttgcaaggatttaggcggctgctgttgggaaccaattcccacccctcattctcactcatcctctctggttttttcttcattctccaagcagacccacctcacacaataaactgaatgacttatcatttggggatctgaccaacagacacccacttctactgatattgggcacctacttgtgccaagtgctagggatgccaagatgaggaagataggctccttccctggggatttcatgcacgagtaaggagccaagaggcagcaatggcacagtgtgctgggaggacactgggcccaggggagggagtggcgttacttacaggaggcagtgcagaacaggggacttctcattccctcttctcttctcccggatatcccctttccttcttaccagcagacctgcgaacccatgggttcctccaacttgaggggcaaagtgtaccttttctgtgctccccacagaaagccccgtgactttcttttctcttttcctctggcacctctttttggtggccttctgtattttttctcactcttttgtggccagtgttcattgctgtcctgttctgatgctctgatactgagtaccagggcagctctggctagaaccacctcttagcatcgccagatgagtcaaactgtaaaccaggaaactttagctgaagtgggtgtattagtaagcattctcctgagaaacagaaccaatcgtgtgtgtgtgtgtgtgtgcatgtgtgtgtggtatgtgtgtgtgtgtgtgcatgtgtatgtggtgtgtgtgtgtgtgcatttgtatgtggtgtgtgtgtgtgtgtgcatgtgtatgtggtatgtgtgtgtgtgtgtatttattttcaggaattggctcatgcaattatggagattgagtagtcccaagatctgcacttggcaaactacagacccaggagagcagactttgtaagttccagtgtgaaagccagcaggctcgagacccatgaagagccaatgtttcagtccaagcctgaaggctggaaaaggtcagtatcccagctcacacaggcagctgaggttccctcttacccagcctttctcttctgttcaggtcttcagttgattgaatgaggcacacctacagtagggagggcaacctgcttttcccagaatttacttatggaaacgttaatctcctccagaaatagtccttgaatgctctgcccctttggggttgctggagtaataggcatttctcagtgtcacacgtggctttcatgattcagtggcaagaaaagtaggcaaggaattcaggaggttggtttgaatcttaactctgacaccttccctccccagctggaaaactctaggactctcctgtgctcccattaaactttcctcgttggagagagaagtagaaaatgcagcctcccacatgccagggagagggagtggtctcctgaaggggaggggaggttgaatttctgggatgtaatgtcagaaaatcccctgttgtcacagatctaaggctgcatcttccagtctggcaatgatgaagcccattctccctctgctgggctcagctgcttctgagtcatctgtctcagaagagaagtattatttattgacctctaaaatctcgttaggagtcacttcctaagtaaagcagaggacaagagccaaaccctttcaaagtagtgttactcatagtgaatttacaaatcacccccatttcacagataaagaaactgagacccagttggggaaaataaataattggctcaatattcccaacagccctctggaattggcattactttccgattttaccaatgcaaagccagtaagaggaagcgcataccacagttggtggcacagctgagatttgaacaggcctctggaatcctttgcgtacttttctttctttctgtcacgctgtgggagccacatgtgtaagctatatgaaaaagagaaggaggaggatgaagaggagatagggggaaggaggagggggaacaaaacaggaatccaaaccttaggctaaaggaaggactctcagatgataaccctgatggcaggtgggggtggagaacaatctgaaaccccagaaataattccacatttcaacctgtaagtaaagtgggcgttagaccctctcttccctttcttttcccttctccttttcttcctctgggagacactgtctgttgcctttccagcagctattctatttcatccgtgctaaaaaaaaaaaaatccatttcatacctgcttaaaaaaaaaggtattccaatatgggagtggtcattgtccagataatggttggagctgtgggcttggagaggattactcggggaaagggctgaacagtgtgaagaggtggcacccagatgacaagaaattaagatttgatggaagctgaaaaattgcaggtgtgaaaaatatttcccctgacagaaaaaagtgatttttggcactagatggagaaggtgctgggaaaggtattttcaaactggaagcccactgagcatgctttgggattataacagtaactaaagcagctcacattggccatttgatgtccctagtctaagtgttttatagggagtatttcatttcttcctaaaaactgtgtgaagcaggtgctattattccagttttcagaagtggaaatggaggctctgagagtttaatagcctgcccagctactaagcaatagagcagggtttaaatctgtgcagtgtgactctacagaaggggaaagagcaagtagggagggagagatggcaagtactagagagcttggggatgattgatctagcaaagttctggaagagatggaaagggatgggatcaatagtccaggtggagggatgcaccttggcaaagtaaaagaatatgtcttcctttgagacaggagggcggatgaaaggatggatgataataattcacggagtctctggggcggagggaagaaagtcaaggcagtgcatattacatgaccttggtcttcacaggaaagtcgtgagcaacccacataagtaaagctgtcctctttctcacttcctcttttttctttcttgcccaacccctcttcttgctttaacacagaagaaacaacccaggttatactctttcatctaaactggacatttatttgtaaatgagggattgggctgttgttgaataaacaggggataagttaaaagagattgcttgaagaaggattctgggagttaacaatggctgtggacatgtgaaggaatagaagaggtaagcactgttttgattttattaccaggattgaggtggaatgcaaatctcggtgagccatgagaggtgagttgcactgctcccgaggagaagggaaacagtaacgtggagtccacgagcttggggtctggagctagaggagacttttgttgtggatggattggaaagcagagatctttttaaacttagctttaaaaaaatcaaattaatgtatggtgatgacaaaaacttggaaagtactgaaatgtaggaaaaggagagaaaaaccacttcagaaaattatgattgatattttgtgatttttcttttagtgtcttttctatgcattaaaagttgaaattccaccacgtcaagcttttactgtataattgtattacaaggattttccccatgttattacaaacttctattaaacatatatattaaaaatagggataagtaattaaaattactggtatttaatttggtcacatgtttcctctatgtaaacctgcttcttaattgctgtcgagcaatccttcatatggatccactgtgtttatttagctattcccctaatgatggacagcaggttgtttctggtgattttctttggtgttaatggcctgaggaacatcttcatgcacagacctttgcttgcagtttgattatttccttaagataggtaattagaagcaaaatcactggggtgaaaagtgtgactactttaaagattgctttctagaaggattgcttgtgtccatttacatcccacccacaggggcaggcagagagtgcaagcctcaggagggcccagattctgggaggtcagggtcaggaaggacagcccagcaggctcattgggactgtgaacttggaacctgtgcagaggctatttgctggttgttctgctctggttatgaggggctctctatcaggtgtttgttctgagcacaaggttagagacccatggtgagtcctgccccagctggaagtcaaaacaggggtgctggggctgtgtttgcaagtctaaacatggggtgggggtgggggagtggcaaaccgagaaagccacctcaccctgacaaatgtaccatcactgtagcagctctttcttccatagtcataaacctgaaaaatctaatgaattcgaggaagcctgtccctccctggacacagacacacacacacacacacacacacacacacacacacacacacccttcgatttcaagggactcattgatccacaggggtctcagggttgatgaacactgttaagaacatcggctttagagaccattagcagttggggccttctttccagatagcttagcaccttggggacccttttacatactagaaatttcaagccacattcaggataactgtaagggccagagtctggccttttcagacaaaactcctgcatcaataacttcttaaagcctattgggggaaaaactctaattctcaatagtaggggttagacaaggtgtctggatggcttaacaagctgggagagagttcatgggagagaaaacatacacacattcacacacatatattcccagagacacacagactctcgcacaggtacacacactctcacatgcatcattctctcatacctagacacacacacactcacacacatatatattcctagagacacacatgctttgacatacaagcacacatacatatgtcccttctcacatgcacacatgcatacacgtgtgtgcacacacacacacagccctaggacccagtcctctactgcctcaggctcagtcctgggaccttcccttttctccttcacttggtgttggcctagatcctcctcccactctctttttctcccacccaatggtaaatatactcacctgacttcgagcgaatataaaagtacaggaggaaagtggtagataaatttaacaagcattaaagttaatatataatttaaatatgtataaaattattccatgtatcgattagaaaatgggctgttgaccatttcaaggcaacaatcaatttcagagttcacaggtcaggtcaagtttctttctaatgatctaagaaagaaggcagcattagagggataatgaactccaagacttacagatgcgatctatggctagtggccacccagcggcagcccgggctggctgcagagggagttatcccataggtctgtgtaaaagcctggctgggtaacagcccatgatgtaatcaaggcagtctctgggatgactggcgtttttttttttttttttttttttttttttttttttaaaaaaaaaagaccaagtgattgtcgaagctcttggttgtcaatgggcagctgtggtggaaccccattaatgtggtttgtgcagagagcttctccttttctgggaagtggaaacaggcccagccagcactgttaatcacctggcctgaaagggagctgggcaggcttagaggagggtgcagaccaaggggacgtgacctcactgctggtctgttccaggggcttggccacatacaacttgttaacaagcagggatcccccaaatcactgggtggttctgcagctgaaagcagaaaactttgcccatgggtatccctgggtctctttgtagaactgagagagaccaaggtttggggggaggggcagtagaaggggtagaatgggacatttggctcagagaaagtgtaaagtgaaggtgtgttgagtcgctaaggatggcccccacataacctcaaattctcttcctacactgggagtgcatggggaaccaacctggctcctggcctggaaccagattgggaaccggatcgggaagtggatctgccttctgatcacttccaccttatgaccaaatggccaacagactccaaaggccagagacaccaggtcccagagtttccatttttcatcctgagaggaaaaaggctttgagattttttgacctagtgaggtatgttaaaaaatgtccactcaactcagtacaccagagttggttcagtccctgttattatttgaggggcaatggagaagggagtcccatcctcaaaataacctctcaggtggcctgttcttggtgactaaaagtccaccctttgagacacattcatttcatgaagcttcacattctctttcttttaagatctaaatatgccctgcaggtgagtggtctaccagttcagtgtcggtggttaatctggtgataagtggtccggaaaaggagggagaaatgacagattagctggcttctattccttggtgtggacaggggccgctcttcaaacttgagggtccgttgaggggtttgcactggccctgagcctctggcaaagttcctctgggaatgagtgagggaagtggagagggagaaaggaggaaagagagagaaagagggagaggaaaggaggggagaggtaagaaaagggagctgcccctaaattgccttgaccattctcaaacctccacgcctctgtgcatgctgttcccaggcccatccttctgccccatttccctgctgtccatttagaaaactcctggtctttcaggccttccctctgctgtggaggggttcccaagtgttccctccacaccccccagcattaacaatccactctctacactcccacagtgccctgtacatggatgtaccagactaaactgtaccaatgagtttgttccactccatacttggttggaaggaagaacctgtcttttcaccttggtgcctctggtatgctcagtatatgggttccccaagaaaggtgcttaagtgttgaattgaatgcaagtggacagccagatgctgggctcattccattccatggatgcccagccagacctgggtgagcagatcacacccagggaggccagaattgaggggagtttctgagagagagtgaaggaaggggctgggctgttcctagaaggccatggccgaggccctgtgggggtgcagagaagggattgttagtgctggggggtggagggaacattcaggaacacctccacagcagagaagacgcctgaaagaagaccaggagttttctaaacagacagggaaatgtggcagcaggaagggcccagaacagatatggaaaggcatggaaatatgaaagtggccagggcagtttgggggtggctcccttttcctacctctcccctcctttcctctccccatttctccctcccttctcccttcttctccttctccactggctgtttctagaaggccaggcccatctctctgcaagcattttctgaaggatggaatgaggctataaacaccaaggtgagttttattggggaagaagaacataaaagaacagcccttggtgtgtggggcagaaggaggggccatctctcctcttctatcctgaggactgcagcagggatggcagggctaagtttacaggcttgttggatatcgcgatgtctagaggattcccagctttcccccttgttccacttggcaaagcctccttccacctctcgctgtcctctttagctgctgccctgcatgtgggcccaagaggcctcagcatttcaggctcttgccataaggggcaactctgaccctggaatgcacacctagttcagtccctacaagacaggcccaatagcatacggagggaagtgtggggagacaaggaagtttctgatattgaaaatgctagaagtcaacatcccctaggaaggccatttggaaacagtggttacagaagatgtgatatcaggacaccatggaggaacgggttgtcaaagttctgtggagagcggcacccttgtcctggtctttctcccaggcttgccacccctccgagttcagctgcattggaggctgttgatggcacccctccttccagcactgctagggagacgtgctcagtgctaaatgatgactatgtaccccctgcagtggtgggcaaggcagatgccaagtggcttggattgactttggtcatcatcacgggaggtgtaaagaacaaccacacaaacaggtctgtaacaatgtcctctttcttcccttcattaatctcgtgaggaggagggaggaagagagcgagtgcagctatgcaatgtacatacattactgaattaaccaggaatgtaattagcgctcaggtgctcagcagaggaagaaccactcacgattagtcaaattttgcttgaatgtcctgaagttgggggagctgccttggtgtcccccactctccagcaccccctccctgcttcccctctctcatgttcatggaatgtgatgtttggggcatttgcagatgtttatggaaatttatgtgactgttcctaatgtcataaatcatattctgacaagaaaagtccatgatcccggtagtaagatatcaaggagcctgttgtggaagcagttggcctcctctctatttcagaatcttacaggaatgagatggagatgaacgctgttattaattaaatgttaattgggccttggttataaagccatctttgcagtctgtgtgaggcatttgtctacaaggtgatgctgtgttacaagtacggtaagaaaactatgagctctcagatgtgaggcctaaagatgaggttctggccttggtctttctctcagccttaactcctacaacttcttggtaaaaattgtcctgacaaacaaaacaatttgccatctgagagcatagcttgccttttttggccatccctgtcattactctgtttttgaaatactcctgctcaccagcccagttcacaagtccagttcaaagctcatctctgccatgaggccttctctaccaagtgcttttgtggaaggaactccaggaacctggagggtaagacttcaccttcccagtcacaaaatggggtggactttattgcctccactgccaggccagttttactctaggtcagcatagcggtaccactggaaccaccagccagggaaaggccatctgggaagttacgcatgaggaaaggaatgggaacaaatggggatgggaaaggcaaggcttagggttggcctacagtttctaggccagcatacaactttgccagcttcagacatttgaacttgaattagaactataggtgtgttgccttgaaaagatggcagctggtgacaacaggcttatttctagagcatagatattcttaaatcagctttgtgctacttattggcatgcattttttttttttttttttgagatggagtctcgctctgtcacccaggctggagtgcagtggtgcgatcttggctcactgcaagctccacctcctgggttcatgccattctcctgcctcagcctcctgggtagctgggactacaggtgcccgccaccatgcctggctaacttttgtatttttagtggagacggagtttcaccatactagccaggatggtcttgatctcctgacctcgtgatccacccgcctaggcctcccaaagtgctgggattacaggcgtgagccactgtgcctggccctggcatgcatttttatatgttcacctctaagggatttcatatgcttttatgtgtgtttggcctatctccctattgaaattattcagagttggggttctgtaagcttcatgggtttggtccagaatgctggtgttcagaattttttgtgtattgacatggattctgcatgccatgctattccagctcagtcttctctctttcagcctgctctgaggttagggctagaagcaagaagtgattagacagcatcagtgatgcaagatgacctcaccctatgcaaaataatgccatgcataccctaccatatctgtgtctttttagaagtatctggttttatttttgttttttcagaggcagggtctcattctgttacccaggctggagtgcagtggcacaatcatggcttaatgtaggcttgatctcctgggctcaactgatccttccacctcagcctcctgagtagctgggactgtaggcacataccatcacacccggctaatttttttttttttgatggggtttcgccatgttgcccaggccgatcttgaactcccgggttcaagagatcctcctgtcttggcctcccaaagtgctggaattacgggctgtgggccaccacatctgggctagaagtacctggttttagagcagtttaatttcactttttcctgagaccctggtatttgaatcctatcagaaaatttcagtgagttttatgatgcagagtcttcccctatccctattttctcagttataactggcagcttctattctattttgcttttatgcaataccataccaacagagtttcagggcaccttaggataagccatgtctctaagcctcatgtctctgagcagtgtgtgccaaaagtttattgtttgggtactcattgatggccctggtctcccattcttgaatcttctccttttgataaaacaagctcttcaattaaaaacatcctccagacaccgagacggctgttcattctccattcagcagctgcaaagctggaggaggagagggaagggttggggaaatggctgaggcccataacttaattcctgtgcattagccctgccctgtattcgccctttccaatcttggcttctctgctggtgaaacaagcaggattagcgcgtgataagagaagctggggtcataattacaccctatgcgatggggcagcacaaccaccaaataaatccctggacaattattaaaatggcccaatgcattacacaaattagaacaggctgggactttttgggaggagggaggggagtgaagacccagtatttaagtgttcttgtaagccatctaagatattaatgttgcaaagctccttatgaatatttaagaacataaaatggagcttcgctgcagccccatatcaccacagaagcctgtaatacagctgagtccacttaagaagtagagcctatgtcctcggcagattgaagccagatgaagcagggctgcccgtttgtggtggaatgctcctcacagaccaatttaatgaggttgccttataactcacagaagaggagttagttaaagactcgaacaactttgatgggtgggactccctcatgatggtagcccatttcccccactcctcaaggattttaagggactgacacagaactgacgaagtctttatttacccattccgttcaagtctcagttacacataaccctcttagaaccagacacgtgggaccccttggctcgctgggcagtgtttctcagagctgcatttggggcagctgattcttcacagggggcaattagctccaagttcttataaggagtgaatgaagtctcctggataaaagagacggctgctctggtgggagaagggtcatattctgaaatcaagttagatggtgtctttcccaggactggccctggtgcatctttatattgggaatgggggagtggactcttgtaaggtggctggagacatcaagtcagcaggacacagggaggatgatggacaaaacctccggggccttgagttctggcttcagcttagccatgttcttactttcccgctttttacacatctgtcaaatgggaataaaattcctgggaagtctgatcattaatggaataatagatctaggtacacttgggaagaagggtactatagaatgtgatgttagtattatttctatttttacttgtatttgatagcggttctgctttacacccttcagagcttctctgacttcgttctgcctccagataaaggaaaagaaggaaatgatcctatccctgatcactgactcccttccccacttccaggcttctggctgcctctttcagagttagggaaaccccaagggaagtagaccccataacttctgtgggaaccctcaggtgcggaggcctttgagaaggtagagcaagtctctgcctgcacagagggatctgaaaactccaaacaaccttctttatgacacagagatgttggggtgggggaggaaaggaagactccacacctcctagggttccaggccctagctgtagggaagagaatatagcatgaggggtagacagacagacagacagcctgtatgcaggggaaaggaagcctagccacagaatgttctttgctttcagggtactccccatagtccaggaggagagcagcacttgtccagccaagcctggcttttcacattgcatggtgcccatagcacacacaagaatatgaattggcagtacatgtattttctcagaagctaataacaacaattccttgatctcattatttttcaaactttgataatgatagctactatatattgagacaccacacaagcatcctgagagctagagctaggtattattatctctgcttgacacatagagctcagggaagtcaggctctcattgatagcctctctctctctctttctctctttctgtctctcccctatcttttctctgtctctatctgaaggtttcaagtacatacacaaaggtatcgtcatctcaagaaggattttctctctggcccagaccctttgacacccactgctagccctcatggacaccttcagcctggcttaactatgaaagaatctataagctattaattatagctttattaaaactcaacaaatctagccctaaaaagacagctgacatgggtttaggtcatatcttcttactagctgtgtgaccttgtacaacttatcctctttaagcctcagtttcctcatggaagaaggggtgggagacaaataagagtacccacctctggcttaacatgaggattctgtgagacaatgcctggaaagggcttggtacatggcacagattctgtgtgcatgacgtggtagttaccatcatcatcttcatcacaggtctgagattcctcttgcagagactcattccactgagaatttaaaactcagacacctggggggaacagattgcatatgaggcctttatcttccaacagtgttataagtccagcagcatgcaatgtagaccagatgccttccatggtccatgtcaatgctgggcttttctaattctattaagtatcttagggtgatggggaccttgtaggaagggggcacacatgatgtgtctagagacataggaaggaggtgtcaagaaggaaaagaaagcctacagcaaggacagaataatctttaggaggaccatgtttctgtaggtttctgggccagtcttattctttgcatagtgggttctttggattgttttcattagctgtctgaggcaaatgtttccaaatctgacttttccctgagtaacaggtaacttacaaataccatcaatcaacctctcgatattaccattaattaatgtttgttagccatgaggcaaaatactttgtcatttaacccctgctcacaataactatcatccttacgttgcaattgcagaaacaaaggcttgaagtcacacagttgggaagtggtggcactgaatttgaaaccagacagtctgaatctagagctgtacctaggtgatacaccctttacaaatgtttctgagattgtgatgctttcagcctggccctggctccaaattcaccttgcagttgtagaatacatgtggtccctttcctctacacacttaccactcaaaaacatttagtatatacctgtgggccaggtactgatgtagtctctgttagaaaagatgctgctgactcatcatcactagggcttaaaggagggttgcattggggtttgtgttgggacatccacattctctcgactcccccttaactgggggcttgcatacatttataggatgcatcagagacacagtctggagccagcgatcagagggtttctcttttcatgtgaaactaactggcttccaggtacaacgataattccctgaggattacaggatcacagaattatggagctggaagagtctttgatctcatcagcatttcgactaactgagctgaacgggccatgtgaggaagacagcaaaaacaaacaccagcagagcaaaggcacttacatgcctgccgtgtgtggctccttcactcttgcttaggaaacctttgtctttctccttttgctgtctaaaccagatcttattctttttcatgagatcttttgtctattttagccctcacttgtttccttttcctttgaatgcaaggggcacttataatctgtagacacccacattattgtattcttttggtgttctctaattgttttatgtgtaagagttttgtttctactaggtatctaggatggtgagtgctttgagaaatggggttgtgttcaccagcttagtgcctgaaacacaatactcagtaaatattggctggtttaagaaatgaatgaatggagagaaagtatgtcttcccttgaattccgcattgagcctagcacaggactgagcacctgatggatacatggtggttcattgataatactgaccctgcacaaataaattctttttaaaaaattactttaaggcaaccttccagtacctagatatgatggagagtgccacacaggtcctggtatggcctctaaggtgctgtgcttttcatcaagagaagtatatgtcacagtatgctcttggaaagagatgtggcttcctgacaggctcggtggatttaggaaaaaataaaccttgaagcaggaatgcagtcatttctgggggctcccctagaatcccatgagggacatcaaaccaacccatggtaactagaaaatcatggagtcttccaggtggacttcaaagttgattgattttagtggcttcctaaccatttttttgttaaagctgtagatcttatcctcaaatgaaagctgtaagttgaatttgaagtttctctgattaaagtggagcatagggcccagaaccttatattcttagcttctagaggggctctgagaatctcctagagcttcttggagaacactttgagaaccacattggtgactgtaggggacaagtgttattcattttggtgacccagaatctaaactggcttttcattttggggaaatataattttaagtgaagccgaatttatggatatgggtacatttatcagagatattagattcaacatgctggctcaagtatctgagatttctaagtatcttctcagatggcttactgaaacctgctaatggctcataaggaatcaagatgccagaaaactcttgatataatgtaaagaaccaaaaaaagctaggaaggttaacatgggtttatcctgtgtaacctgtgtaatttatccatgtataacctgctcacacacccttaactgtattacctaagaggtatctgaagatgcttcctttaccaaagcactgagaaatactacaatggggagggccaacatctttgatgagtgccataagggctgtgactttatgctgagagtgctgtggctgaaatgggatccctgatttcacaggggatgccaggatcctcagggaagaaaccaaggagtgacaattgtaaaacctccagaggcaaggtggtacatgcattatttaatgttcttaattgcatcagaatccatgctggctaaacagaaaagagattttataaaaggatatgaggtagtacacaagatgcctttgaacaaagcccgtggctgtggggcagctttagtgagacgctgccaccccctggcactggtaacactcaggactggatgcctgagctctgcactctcccccttacatagctggcggtctctaccactgtgcttgctaggtatcagttccactgcgtttagcttcctcttcatcttgctcacttccaagtctgattttcacatagatgtgtctgatttttcagaatctaagtcacatacctataacctaattgcaagggaatatgagaacttttagctaggcattttactgcactacaaaaaaaaatgcatttcggttaacaaggaaaaagtggggaatggccattgggtaagcagctaagaatgcccaatacttcatggttccataataagcagcagactagtttgctaattagaatggtctggatccatagggatcttagggatggctaattgattatgaggtctttgcactgaaatatatggacagtctcctaagatcattcttggtccatagagtcaaaacaaacaaacaaacaacaaacactagacctagaggacaaagccgtctttgagtcaccaagtatagagaataattgctccttgttcaatttctaaactgaagccatagacccagagcccacaggaaaaaggagaggctagatacttttggggaagaaccctgaaattaaatcaaatgtatatactgcaaatcctactcctgactgtctttaaagagatctggggcaatttaccaaggtaacaatggcttgggggaaataggatctataccttttagatctttcattgactttggttggatccagtataccactttggttcactgatcaggaggggaaccttgtaggggtcagatgataaattttgaaatcatagttggcctagtagtctccaagccattctatgttatttttctcagttcctgactatatggttggaatggatatgttcagtacaaggcagaattgtctccctgattttctaaaagatttctatgttagaaagtgccaaatgaaagacttaaagtagtaaaccaaaggcaataccttgtctccaggggatatcactgaagccatcagagacttggaaggtgcagatattgtgatttttatcacaaccccattttgatcacttatttgtcccttgcagaaagtggagatatcctgaaaaatggtagtagattattataaatgtgatgaagtggcctccaatgacagctactccagatatagccactttactggagcaaataactcagctcttgacacttacgctgcagctatttatatggcaagtggtttttttaaaaatatagtttcaatagaaagacaatttgctttcacctggcaaggattgcaatatactttattgctctggctccccatctctatgtcataatttagtccacagagatatttaatcatctctttaacctacaagaaatcaggctggtttagcatattgataacatgctgaaaggacttggagagcaggagatagatgtactatagatatctgaataagatacatcaatggcagaggatagaggttgaattatatgaaaatacaggcacctaatggtcattaaacaatttcttatttctgtttggtattttgcaatatacaagcatagatttctaaataaaattttatatagttataatttgttgtttctattttatgttttttcacttacaataattatatatatatatttatgtgtgaacattgtgagttttcacctctacctaaaatgccatcatctgcttagctttgctgccccattagagcttgggttgttactggtttttctgtattctaaatactgttgctataaatgtctttagagaaattgcttttttttttttttggtttgggttatttccttagggtgtatttccttaaaatggaattattatgtcaaaaggtacaaacaattttatagcttttgttacatattgccctattgctctccagacagattgagccaatttacaatgctactgacagtacctacgcatgctattttcccacagttgacccagttggattttctatgttttatttattttggtcaatttaatattgtgcaatgataccctatggttgtgttaatatgcatttctttaattgttaggaagtctgcgcattgcataatgtgacaacactatttgtgattctatagtatgctcatattattctgttttccctgatgggtttgtaagcctatcagtggtagagactgtgaatcatccatgtatatatccatctgtccatcatttattgagtgcttattatgttttcgtccaggcactgtgctagggcaaaggcatacaggagaaaaatatgcagtgctgatcctcaaggggttttcattgtagttggagagagcaaaaaagatcaatgattataactaaatgtgactttaaatgtgcacaaagtgttatggggttcataaaaggagcataagggaggtttatccaagttgtccttgtaagaacatggaatgcttctaaaaggaaccatgcttatgttcagatagccaaccctcaaagaggatgaatcaagcctcagatggtaagtaaaagttagctatggggaaaaggagtaaaagatgggttgtgcactcaaggagagagaacagcatgtgtaaagtggtcatgaactgacagtgttacgtgacctcaaagaaagggctcagcagtgacatgttgggagaaaggctatacacttaaatgaatctgttagactgtttttggctttgaaaagtagaaaactctgactcaactaatttaaataataagacaaacttgttatctcattaagcaagaagttcagaagttgagctgctccagggtcggctaactctatggcttgacaatggcatttaggatccaggttctttccatttttctgccttgtcatcctatggggcttccttcatggttaccagatggcagtaccactgtgcaaggcatcttttgtagacagaacaatgtcgggtggaacaaaagggacttcctcttccttatgtctcttttcaagagcaaagaaacctttcccaaaagctcctcagaggacattctgcttctcagcacttgctgagtcacaggcttagccccaaagcgagctccagagagggcgatggcattaccatgactggctgagatgttttaggacttatttatggattgaaaataggctcaccttccctgagcattggaactgatcaaaatcatagataagcaaagaaaaatggggaaagggatgttggatacataatcaattgcattttttatattagagatttattatttgtgtttcctgtgaggctagttgattcatgcatggtcacttctaaattatttcatatggagatcttatcattaatcagttttgaaccatgtagtgttccagcagtatttgaggggtcatagatagcagtaccctcctcactcttccctagtaaaacagtgggtgaagggagatgaatagttactacataaatattcattgcatgcctatgatgtgtcagacatagtgctaggtgccatggatatagagcagaataagatacagtactcacctgttgcccccaaagagttcacaacgaaggttgaggtgaggagataggtgaaaggataaatagatacactgataatatataattataaatataacaattaaagctgtcatttattgagtatctgctatattatacctcagaactttacctagttttacatttaatttttacagttaccctgatttctcccatttgccattgagtgaagtgagcctcagaaggattaggtgccttgttcaagttctcatggctagtaagtgtgagagctaggactcaatctaaggtctgctgactcagagcccatgctcatcactgctttgctatgtcatctctttgttgttgactcaaacaccaaagtgccacgaatccccagaggagggttatgctcatgttgtcaagggtagggctatgaccattctgcaaaacaagtgcagtgtaagctgcagtttggagggttggaggagtaaccagatgaacagagtgtgaaagacctagccacagggaagaacatgtgcaaaagctcagagcctaaaagagctggaagatggaatacattaagagttgggactgaaaatgtggggtggggccagatggagataggctagtaccttgtgtttagaagtttagacttgtctttgaagcaaagttttcaaagcaaagaccaccttggtagcattttggaagatgaatttgaaggattcaagatcctggggaggccagttagaaagctgttgtacgatccaggtgagagacaggagacctttttggagctagaatcaagagaatttggtagattgattagattttggggtgaaagaaaaagatttgaagatgactcccacatgcctggattgagcaactgggtggattatggtacagtatattcgtgaattggcttaatcaaaaagaaagttgtcttgaggtagctcctagagctgaaggaagagatgtaggaaccaaggtcccaagacttgtagggagttatttgtctctcgtctttgcttatatctgcttggcgttttctgtatgccagcaacgatgaccaccaataactttaaatatgcatccccaatcattggagtggaaaggcaacttttcttacccataagcctgcttgaatcgtaggttcattctagaccaatccctgtaaccagggagatgagatattatggtggccaagccagaatcaaatactaaatgctgtggtcagaagaaaggaggtggggcagaatgcactgggcagcccaagataatacctataatgcttcactttagatggtattgaccaagagagaaagcaatgggggaagaacattaagtggctttcaatctaattctaatttgaatgtgtgggattcacagtatcaaactccccagcagactccaagtgccataatattttactgaaatcaacatgctggtgagacaaggagcctgacagacagcagatggctcccacacagaaaggctaatcaattcagacatacaacagccatcataaaagagtggaacatacccagcatgcacactcatctgagcagctcagagaaaaagcctcttgcttggcctaaccaggagagagaaacagcctctttgagacaatggtgtgggaatgtctgggcatcccagaccctctctggctgaccttaccttccaccactcacccacacagatctctgcaccactcacactgaactcttcaggctacattagactccttgagctttcccacctctgtacctctgctcacttcctcccttcttcctgggctaccctatcccctcccttcttttggacccaatcctcaaggtccagctcaagtcccccctcttcctaaagacttggagtgttgttaatgctccatggatgtgtttgtgactgatatagtttgagtgcgtgtccctgcccaaatctcatgttgaaatgcaattcccagtgttggaggtggggcctggtgggaggtgattggatcatgggggaggtttcttatgaatgatttagcaccatcctcttggtgctatcctcatgatggtaacttctcacaagatctggtcatttaaaagcgtgtggacctcctgcctcactctcctgctcctgcttttgccatatgatgtgcctgctcgccctttgccttcttccatgattgtaagtttcttgaggcctcctcagaagctgagcagatgccagcaccatactttcttgtcagcctgcagaaccatgatccaattaaacctcttttctttatacattacccagccttgggtatttatttatagcaatgtgagaatgggctaaaaaagtacctaatcatctcaattagatatactaggttgcagatttcttgagaacaggtggcatgctttatacatccttgcatacccaggagcatttggctcaggaccttgaactaagttcttaatacagtttcattaattcacttccaatcttggggtaggagagttatatttcttaagagatggaaaaagtatttacaatatatagtaaaggattattaatgttaatatagtaaaataaggctttacaaatcaataataaaggacaagaaatccaattgggaagtaggccaagaaaattaacatgaaattcactgaacaacccatacttatcaaaagatcaactttagcagttatcaaagagatgcaaattaaaacaattttattaaactgttgcttatcaaattgggtaagattgaaaaatagattctgtagtgttagtaagacaatggtgaaacagctactcatatgatacaaggtgggacagcacatgggtacaactttcctgatgataaatttggcaatttttattaagtctttaaaatgttcaaacttttaaaatctgtaattctgcttctaggcttttatcctaagaaagttatcaaagcttcacacatagattacatatgaggacgcatatcttagtatggtggtgaattaactggctaattctcacttattcagtgtctagaaggcagcccataaagagaagtgagatttatacagctccttctcacttgcctgacttacaggttgataattgatttgatgcctgctggaatgtggtaagtagatttctttccattggtaggggatgctctaccttacccgatggacctccacctgtgatcttttattttaatctaagcttcttctatgaagacctctgtttcccataccatgctgcagcttctatcattattctgctcacctctcagatcctgaatgtctttggagagcttgatacactatgcaagagactgaaccagccagtgaggtacacactggaagaaggaaccatgctttattgctcctcaggttatttaagcactgtgaacccattcatccatccatccatccatccacccatccatctatccaaatgtccatccatccatccatccatccatccaaacatccattcaaacatctctccctctttcccacccagtagtgattgagcacatgctatatgccagagactgtgctgagtgttgggtgctagatttgcacaagtaataggcatgttccctaccacaaaattactcacagttcaggggcatgatggactagtaaagaggcagttaactgtttcttctagaggtcaacacacagaatctggagcatggggtaagggagggggtgtactcccctcagatggtggattctggaggtagaacctgagaagggttttcagacttaactgtgagttaacctaggaataaggggaaaggggcataaggtattttactgaaagagagagagagagagagaagaaggagagtgagggagggaggatgagagagagagaggagagagagatgtttaaagacccaagattgagaggaagcatgcagcgttagaggaaatgtatacagttccacatgactgtggagtttgaggggtcaagggaaaaataagagccttgaagggcagagtggggcagggggtgaagttcttattggtcattcctaggagtccaagctctatctgagaggcaagttcgggggcattgaaaggtttaagggagaaaagatttaagtatttttgaaaaatcagagtacaatcagggagatggatggattggaagcttaaggccagttgggacatgactgcagtgatacagatgagaagtgataattatcccaacaaggagctggaataagatatgggggcaaaggagagggaatagagtcaagagatgttaccaaggccaagttgtcaggacccagggactggtcaggagtgtgtggggtggggagggtaatggggtcattgcaggaatggggagcaaggaggcatcagccccaaggaggcttctgcagaaactcataggttcttggcatgagctggccagtctagatctagaagttctgggggaaggcagagaaaattatttccactctttccccatttcctatggaagcccacctcagcattcagctctcctctgtttccttttctcttctagtctgtctcctggagctcttcggaagtagcttcagctcatggctcaaacacagccctgtggccacggcccagcatccccacaatttcctggcccacaaatgggtttcctgacagcaagttctgcagcgtagtctcaggaatgggcaactacagacatttgacccagctgagaagcttcctgaatggagtttatacttcatttaacaaaatgttgttgagggagggcctgctttgtgctcagcatagagcagggtgctatgcaaaaacaatctcttagatactgattgtattttttattctgctttcaagatccagcttacatggcacctgtcctacaaagtctttcttaagactcctcatccccctgcaaccctgggttcccatggtttaaccctctattccattcaatttcacatcaaattatcagtatttcttcatacatctattccttctgctaggctggaaattccttaggggcaagggacaaacacagtctgctttccccctccagcacatcccatctttgctcttcctcatctctcagcattttgaaagtgtttgatacagttagtactcacaactgggacttctaacttctttggtggggcaatgctgttgtttatttcttcaccacaaacgtttgctaagattcttgaggggcagaccagaaaacgttcacaggtttaaaaagctggtagctgtagcctgaagctcttaacactctccttagttacctaatttcctccagtgggtctggcctgctccagggaaggcattttgccctgaaaatgtgatgctttcaagactccatagaaagcaaaacagccggctttccgcttgggaaaggggcttgtgcctttaagacctgccttgggaaatcagcctgagcaacgtaattgctgtgaaattaccccagatcacacccacacattcattatgagattccttattgacaccttgacaatttgtttcagaagacatcactgcatattcctccctctggaatagatacagatgcatatagacatacgagcccacacataatgtatatgcatatcagtgtgtttttattatataattatacaaggctatcagtcagttttcatttgaaactctttgcatttatagttcaggaagttatttaaaatcaagagttggagaagatagcctcctagaagaaccaaacatgaagagtagaattgagtaagacagggggcatgtctttgctatttgagaactgtgcctacccccacaccacacacattctttccttcttcacaatgacaggttttttgctaccattgggaattcagtcctggaaagcactcacaaaaggagggtgccagtggaacaactccaaggggaacctcttcagggacataacagtgccatctttggcctctccaggcccttcccttgagtctggggtaagctcatggccacactgatatacatacaatggcaaagggacaactgggtgccagtcagattcatacacctccacaggtccctgaagatcaagcatagtatttgagaggatagcttcccagccttttaaagtcatgatacacatgaaaataagaatattcatattgcacactatagtaaactgcagaggacttgaggcatttatacagggcttgggaaaaaagtctttccattttctttatattatacaaaattaaaatgcagtatattaggaaaaacattatacattaaattagtataaaacatttttctagttctaatgagaaacttgagtttgcttccttccatgaatataagtgtttcatatcagggtttatgctcaaaatggttatacatagtgcctgacgatgacttttaaaatgatgatctctacaaattcttggtagtcacccttgataagaaactttgcacaagtgggtgataaaaaatttaaagcaacttttataaccattaaagattcataacagttgaaattatatttaaagaatttaacagctcttccttttatttcattgacaaatgtagtgttgaaagtttttgtgatggtgcagatgggtttcaaatccaatagaacttattcatgtcaaggaatcagaagaatgatggcactgtcatttgcggaacttggtggatgtgttgctggaacgttcactctgcagctggcttggatgacacttgaagggtacaaccactgcaagcagataaaagtatatagcatatatgaagctcaatctagagccatttctactatgcccactgttaaaccccacctgtctttctgccacttttctcctctgataggtgcacttggagctgcacacagtacccttggcacatgaacatctccaacagttcatcagacttcctgtccctatcatggtgacaagtggggcttgcagctgtctgctagagtaggtgtctagaggtctccttggttattcttattgcagctctgcagagcagcatggatcaggcactactagtcatgcacactgtccctggggaccatagtatatgccatgagaccctgctcaccttgggtggccttctgaggagccaccgatagggttacttgtggctgcaggagaccattcctaggtactcggtctgccccaggtcctgcctcaatgttctggagctgagagggtcagattttacataactgtaattcatttgtggcatgctggctgggaagcacatgttagacaagtcccttctcctctctgagctgcattttctcacctgtgacttcactggttgcttccagtgagaaatactgtcatgacatagaaaatcagatatggttgaatataactaggtaaacaaatgagtaatttagataagtgttcttggcccttgtctggaagttgctaggcagggaggggtccatagagttgtgttaaaagggagcaagggtaagaccatcatatctctaggccccttcctagggggcacgagctttgtggtgggtgttctggtaaacctggtaggaataccagcccagcaagcataggatagtgtcctggagctggtaggaacaggctaaattgtttcaaaaagtagcagaaatagattctggaaatcatagaaagagaggaccaagtgggataaagttggaaaagagccaggagcaatgcagaggttggcagagaactgcacatcaccataactcatgtttattgactactattaggtgccaggtagtgtgatcatgtatttatatatattgttaataactaatgaatcctcacaactcctgataaagtgggtactattttcacttaacagatttgaacactgaggcttagagatgttatttaaattgtccaaagccacagagctatgaaggggcaaagccaggactccaggccaatatgaaagtggtgcctgcaattggacatatacttgttttttggaggccctgttttattctgtgtgccgtgttctttgaggatatttaagaggaggagatgttgtctttcactttttaaaacgttccaactattcaaagatctaaacctaaagagatcccatgaatcatttacagtggccaggacctgctgcctcttcctttatagggtctctctctgtctcttcatttctggcccccttttcactgccgtactgtttgtaaaagctcaaactcaggcagacattcaaagtctctgtaatctagcttcaactgaatcctgaaagagtagctgacacacagtaggttttcaactgatgttaagtgagtgaatgaatggatggataaatcacgcctcggtctctttcttcttttccccccactgtacatggccctggctctcaccaaccctgttggcttgctgtgcccttaaacaccctgtgcattctatgcccagtcctttgctccttcctagagtgtgtccccaacttctgtcctcatcattaagtcctacctggcctgcaaggcccagctcaccttctctgccaagttctatctgactaatgtggtctcaaaagacctgcctcccttgaactcctagagtctgagccctcaggcagcactgacatcagtgatttgtgatacatttttgaacctaatatgctcttgtccaggctgaagagtgagcacccaagtgcagctagtacctcaggggccctgtctcacaggactctggaagagacttatctcttgcttagtcctgcatagtgccttgcatatagtaggtgctcagttcatatcatctgaataattgacaggaagcaacttgtacacagtaaacatacataaatgatatggtttggctctatgtccccacccaaatctcatcttgaattgtacttacataattcccatgtgtggagggacctggtgggagacaattgaattggggggcggtttccccatactattctcatcgtagtgaataagtctcatgagatctgatggtttgataaggggaaacctgttttgcttgactctcattctctctcttgcctgctgcgatgtaaggtgtgcctttcagcttccaccacgattgtgaggcctccccagccatgtggaaatgtgagtccattaaactttttcttttgtaaattacctggtctcaggtatgtccgtatcagcagcatgaaaacgcaggtatgtctttatcagcagcacgacaatgaactaatacagtaaagtggtaccagtagagtggggtgctgctgaagagatacccagaaatgtggaagcgactttggagttgaggaacagtcaaaggttggcacagtttggagggctcggaagaagacaggaaaatgtgggaaagtttggaactccctagagacttgttgaatgactttgaccaaaatgctaatagtgatatgcacaatgaagtccaggctgacgtggtcttagatggagatgaggaacttgttgggaactggagcaaaggtgactcttgttaggttttagccaagagactggcagcattttgcccctgacctagagttttgtggaactttgaacttgagagagatgatttagggtatctggtggaagaaatttcttagcagcaaagctttcaaaatgtgacatgggtgctgttaaaggcattcagttctaaaagggaagcagagcataaaaacttggaaaatttgcagcctgataatgcaatagaaaagaaaatcccattttctgaggagaaatccaagccagccacagaaatttgcataagtaatgcccgaatgttaatccccaagacaatggggaaaatgtctccagggcatgtcagaggtcttcatggcagcccctcccatcacaggcctgaaggcccaggaggaaaaagtggtttcatgggccaggccctgggtccctgtgctgtgtgcagcctagggacttgttgccctatgtcccagatgctccagctgtggctgaaaggggccaatatagagctcaggctatggcttcagagggtgcgagccctaagccttggcagcttccatgtggtgttgagcctacaagtgctcagaagtcaagaattggggtttgggaacctctgcctagatttcagaagatgtatgaaaatgcctggatgtccaggcagaagttttctgcaggggtgggactctcatggagaacctctgctagggcagtgtggaagggaaatgtggggtcagagcccgcacacaaagtcactactggggcaccacctagtggagctgtgagaagagggtcaccatcctccagaccccagaatggtagatacaccaacagcttgcaccgtgtgcctggaaaagctgcagacactcagcacaagcccgtgaaagcatccaagagggaggctgtactctgccgacccacaggggtggagctgcccaagaccatgagaacccacatcttgcatcagcgtgacccagatgcaagacatggagtcaaagggagatcattttggagttttaagatttgactgccctattggattttggacttgcatggacctgtagccccttggttttggtcaatttcccccatttggaatggctctattttaccccatgcttatactcccattgtatttaggaagtaactaacttgcttttgatttttacaggctcataggtggaagggatttgccttgtctcagataagactttggactgtggacttttgagttaatgctgaaataagttaagactttgggggactgttgggaaggcatgattggttttgaaatgtgagaatatgagatttggcaggggccaggggtggaattacatggtttggctctatgtctccactcaaatctcatcttgaattgtactcccataattcccatgtgtgatgggagggacctggtgggagataattgaatcatggtggcagtttctctcatactgttcttgtggtagtgaataagtctcaaaagatctgatgatttggtaaggggaaaccagttttgcttgactctcattctttctcttgcttgctgtgatgtaagacatgcctttcaccttccaccatgattgtgaggcctccccagccacatggaactgtgagtcaaattatacctctttcttttgtaaattaccaagtctcaggtatgtctttatcagcagtgtgaaaacaaactaatacaataatgatgctgtttaatatattctttcaaaaataatgtttaccaccaatgttttgtgcaagattctgggaataccaacaactcctcagagcaaagaatgtttgaattctgactggcaaaatgtactaatgtttctcttctccccttattaatggaatatcaaacaaatgcgctattaaatataacattacaggctcattggcatttttttaaaaaacttttttaaccagctagttcatcattttcactttttccaagaggcatttctgctaaaagggagggctataaaaatgcaggctatttttgcaccaaaggagccctcccactctgactctccctggaaaagacttcaccaactaggaagggggtacaactgcaggaccaggaaggagatggttaacagccaccttagggaccctctaggagttgaacttggagttcagaatcctaggttgcttgagtgcctgttttgattttttcttaatttaagtttgtgattgacttatgtgcactggcacttttaacagattagaataaaacacagagttcagaacaaatgtaaatggcctcaaagaaaagtggggggaatgacaataatcttttttaatggctgtaaaatgtaggaaggatagatcatgagctcgctgcatggggccctcgtctgatctcaatccagtattgtaatttagacatgactttttatttaatttctgactgagaaagggaaattagaaaacagcattatctcagctgcttcgttatgatgaacaatatttcatagtgccagctctgaagttaccttcagaacttcttttatgaggccgatgttgactccagctctaggagagtttgaatttccccacacacttgaggagcagttgttgcttgaggagcagaaacgtaagtatggtttttaattagaagctggtttaaggctcaggcagcccacaggtttgcaggtaggggaagggaacagagatcataaaatgaggcgctggaagatactaaaacctggactaggctgtgctggacttccttccatgtaagtaacggtccccttctaatctcccaaccccgtttatttgtttaatttttaaatcagggggatttatcccatctgtaattaacccttgcatctggccagagcagtactgccttctgtcccttctcttccctgctcctggccactaaatacataatggtctgataaatatttaagcagtgatgagggagataatgcaagtaatccattagagccgcctgcctgggctggcaccggggaaaatgggggtgctaaagtggatggagtaaatgctgaaatcccaggctgagcggcaggctccctgaccacagagggccctaagcaccaagcccggctgtcgatagaccagaaatttcaggctgaggaagcccttcctcccacttggcctacctgagcgcatgcccctgctcccacagtcagcatccctgctgagccagatggggttgggcccatattctggagtgggggaaaacatgggagtggagctggcactgagggatcagtaaggtagattgggatgcctacactgctgctgctgtggggcctcaaggacagcccactgctaacttctagagccagggcagctgcaagcccgtttgcacaggacagttgcatgttatgccatttgtccagcatagtggtggacagtgccccctttcactttcatgtgttccaatttgggtgataaattgtatggtcaccccacctataatatgggtcaccccacctataattgtacggtcaccccacctttctaataacatgcattagaatgatggagaaagtggggaggggatgatagcagcacactccttatagcatataccccaaatgcagccatatacaggcgttcaaaatcctacactcaaccccaggagcccttcaccccccccccccacatacacgcacgcgtgcgcacacacacacacacacacacacactcttccatctccaatctcctcttgcatttcacctgtatctccctcttggctcactgcaatctctcctgattctaatgttggtaaatgtgccttcttaccctcagtcccttcagggtatagtctgcgtctgatccgttgtggcatccgtcatagctcccagctcaatgttgactatgcttgtggagtgaatgaatcaattgtggttatctatgattatgttaaatctctcctattatctcagacggtctgtgactacagcaaatattttttgatccatctttactcagggtattaatcatatatccaaatacacatccgtataaaactcccctttatgtgaatgcacacatcccaaaataattgtatatgcacttcacgcatactctccttcaatacctcctctccaccctcagaaaatagatcaagttccccatttcttatgatttaatctttactagctttctcttaagtttcgcctctttggaataagtagacagtaaaaattcaagatggtccctattattcattcaattaatcccttctattccttccctccatttcattcatctatttcatttatttcttcattcattagacattcattcattagatattcattgaatactatgtgctgcgctaaatcagttcctggtgtgacttcagacaagtccttctgaggcctcagtttccccatgagcagaatgaattaaatattacattgctggctttagaaacatcatctgggttgttcctccagatctgacataaatccatgggtctgcctcctttaagctcccagggggcaaatctggagcgtgagcagggaaagggtctccaggggcttcacaccctcaagtctatttgtgcattgactttccctcctgttccaaccctgggtcagctcgtgcttaatgccggtgactctgctcctctggggagctgccttgggcccagcccagctgccccattcctccagggttatgggcctctatggccttgacgtcagtccccatcactgttgtgcccttggggcttttactttagtgctagatgccagcagcacccctatagtctccaccacctccccttcccagaagggaacttgcctggacacacaggtcttcacgttctgtcagcgattctaagggttacctatctgctcactgacagccacattatccttattcacacacacacatgcacacacacacacacacacacacaggcaggcagatgcacatgaatctgcgtttgcaacacacatgcactgatacatacataaggcttgcaaatattgcccgtaaaatcaacacatgcttgtgcaaccataaacttcaggtgtgcacacattttatacacatataggcacacacatacacaacatacacatgagcatacgcaccctaaaatcatggaaaacatgagatagacaccagtctttagacatctgcaggactccacgtgtaaggcactttgctccatgctgtgtgggatacaatgagtgaggatgtgcacttgtgcatgcgtatgcacaccctgagcttatacaccacctttcttcactctctttcacaccccttcctttattactggcattgcaggtggctgcttacagcaatttgcgtttgttgcatgtatttacagataagcctggacttttgtgctaaaataaaacttcaatttgaatccggagccctgctgtccaagatctaaatgttgcaggactgcgtgttggtgataagtgcccaggtccttggcttgaccacttagctgaacactggcctcggccatcagaggcggccaggggtaaagaagcactttctgcccctggagagacaagcatacccatgactatagcaacaagacagtgcacagctctgcagtcggactgagtcaaatggtaatgattagttcggtgaccttggacaagctcatatcaaccttgccaagcctcagtttcctcatctatgaaatgagtcaatgatggcccttcttcatagtgttgttgtgaggaccaaaagaggataagctaagtgttagcagagggcctgtcacggtgtaagtgcctaatagaactgttagctattattaccagatggagtatacacacaaaatatgctgtctgcacagaaggtagaagggagcaagtgaactccttacagggcagggagaagctggtgcattctcgagttgcttcaacttgatcttggcctctctctctctgcttcccttactggtactagccacagcccactggcttctgaaaggactactcttttggctgagttataaggtcttcactgtggaacaactttgtaagtctttggtggcatttccttgggctgggaggcctcagtggagggtgctatcatagctggagaccactgtgacttctagaaccttctccgaaggcctccttccctacatcgataaacagtggagttgttggtgctgcgaaggccacatgcattaggacaggtctccaggcctatttttccatcatttgtccacttggggaagtgtaatttgccttagtttccccatctctgtaagaatgtggaataaaatgctgagggaggtttatacttgtaatattggaaaatatatatttggcctgtcacatcatttcctggcagacaactcctaaaatccttagaatctccaaagtgattctttgtatgctaataagctcactaatggctggcagccttcaagtagtttcaggatgggagttggccagtggaaagaccaaggcaggattagaggattgggactttcagctccgtcccataacttcaggggacgggtgagagtctgaaagttaagttgattaccaatggccaatgactcaatcaatcaagcctatataatgaagccttcataaaaaccccaaaggacaggatttggagagtttctgggatagccgaacatgcagaggttcccagaccgtggcaactcttcgttgaaactctttgaccctcccctgatacctcgccctatgcatcccatcatctgtatcctttgtgatatcctttataatgaactagcaaatgtaagtgtttccttgagttctgtgagcctctttagcaaattaatcatgaagccagttggtcagaaaactgggaggcccgggcttgagactggtgtctgaagtaggggcagtctttgggaccaaacctgttacagtaggtagctagtcaggtataagcagggcaggagaaggctctccaaccaacacacaccggaagtgttgggcagccatcaggtgatggtcaggcgattgttaattgttcctctaaagtaataattgatcacagctggcaccagggaaaggcagtctcctaatagctagagatagaaaacacctgaaactgatcagcagcttcccaataagatctcaagagtggggagaagttacgcaagatcccagaagtatgccaatgtatgaaaccccaagtcaagtggtcaacacacttggtttctgaagctgcctgcttggctctcttccaagagaactttccttcctttctttcctttccttactgttctaaagctttttagtaaacttccactcctgctctgaaacttgccttggtctcgttttctgcattatgccccgcagtcaaattatttcttctgagaactgaagttgcggcagacctgtacagattcactgccgggaactcagatacctttcactggtaacaaaccctcaacctttgggatctgacactatctgcaggtagacagtgtcagaattgaattggagggcacctagctggtatctcctgcagaactggttgcttgcttggtgtgtgggtgagaaaaaccacacacatttggtcacacaaggcttttgtgttgattgttgtggtgtgagagcagaggaaagtacagtttgtgtttttccactctcaatcctagctttggatggatgatagggatttggtgaaacccagggaaaagcacccaagaccttgaccaaaaagtcaaacttgttactaaacaggcagactgtccagccagccaaccaaaaagcaaaatgacagagtggagcacagccagacctcacacagcaaggcaaatgctggggagtttacagaacacaggaccagggccactagggagggagtgcttgggtctctaatcataccatgtgaacctctctgcacaccccaacattgctacttagggtacaatgaacatcgttgacagccttcaaggggcacataaagtgcaaaaggccactctgaaagaattggaggagggagagaagcagtatctccctccccaccactccctgtcccgaacctactccaacagcttgtcttggtgatgagaaatgacagggcagagacttgggggatgtgctcctgggctgacaatgggagttgctatgaattgaatgtttgtttccccctaaatttctatgttgcaaccctagaccccagtgtgatggtatttggaggtgtggggcctttgggaggtaattagggttagaagaggtcatgagggtggggcccccatgatgggattagtttccttataaggagatgaagggatcagcacttctcagtctgccacatgaagatacagtgagaaggtatcatctgcaggccaagaagagggctctcaccagaacctaaccatgctggcaccctcatctcagacctccagcttctagaagtgtgacaaacaaatgtttgtttgttgttttgaccacccagtctatggcagcagtccccaacatttttggcaccagggactggtttcatagaagtcaatttttccagtcaggggtggtggaggtggtgggagggatggttttgggatgaaactgttccacctcattattaggcattagattttcataaggagtgcacaacctagatccctcaaatgcatagttcacaatagggtgcatgctcctgtgagaatctaatgccaccgctgatctgacggcaggcagggctcaggtggtaatgtggtaatgctctcttgcatggcactcacctcctgctgtgtggcccagttcctaacaagccacagaccgctacaggtccatgggctggtgattggggatccctggtctatgctattctgttatagcccgagatgactaagacaggtgtgtatatacatcagccatggccagcactagctgcaaccttctcttcgagcctctcgctcctctgtcagaagctttgtctttcagcaaccaagggcccacaagcctcaaagcagcaatctctggcccagagtgtctgctcaaagcattgtcgtctggagagagcctccaaaatatcccaagagcaggtgggaaccgaacctggagcaaagccttcagccctcagtgtaggcagctttgcctttggagggtggtcaggggacaaagatttggatcccattgcacagatggggactgcccagagccatatggcatagaagaagacttctcttcctggccaggacttgttgatgtgatattatagtaggctgagcccttgcctctgtgcccggccacatccatctctaattgcgcaggtgtgagaggtctgtgggagtgcttcctgcccttataaacaggagctctttcttccatggagtttcactggcagaagcccctgaaatctgctgttgcttattaacaaggtagttgttgtgttgaggccagtctggaaacttagtttagacttggggattaggacaactagtttctagccctgtaataacagaaatctctatctggatcccccaactgactgagctggttggcgttcatggaaaccattgacaagaaagaagacagaacaagtgaggtgtaccttggacccttcccacttctctttgcagccctttagtgggtttgccgcccccctgcctttttcttttttcttttttttgccctcctgcttgtcagatcccctgaagtctgatcttagtcctgtgctcttgaaggaaataatgtatacagtggttcatttccaagacaaagcaccttgaatcagcttaggtcagtaaactggagaagaaacaggatgtactaggcccctgcttggatagcagatgcctacttgtcgacctcccctgccccaccactctgcccccaacttagttgctctcacctgaagcaaagaagtttagtctaaaatgaaagtttactagcctgcaaaatagctcgttttttctgttcttatcagcctgcttagctacttaggtcataagtcaaatacttgaagagcccctaagttaactgggattgcaatgcattgtggactgcaataaaatgcagcaagataaccctaagaaaaacacataaagcccctacctaacaatcagtaggaaagattgtaacccagtagtactcagcctatgaggaaccgagggagggacctgcgcactaggggataaattgcttgttgtggccatgctgggtgtgcctgcccatcagacccccgaacttgcaagaccatcattaaaagtctcactttcactgttctccaggtctctaagtccattctttgggtttggatgggtaagtttgtttcgcacactctgaaccacacctttaccatcaatgtcccagattactagagtttaacttctacagagaacttccagctggacttatctttgaaagaacctaagaaacataagtcctgttatgctgtaaaattttatgaggttgtaacatgcaattccttcctgtggttaattacatattgataggggcaaggtcttaaccaaaaaggcagacttcccaagtaacagaattttaggcattaagaagtggtaagtcaggagtccctagaatcttggcagacgttttatgcctttcagacaagtcctagttagtgtttccttcccagtgcagacaccatcagtttgcttcgtggtgtcaaataaagctccacctgtagctcaatggcccattgctcatagtcaaaatagaaaggagagagaccagtgttactgagtctagtactacttggtgaggtccaggagttggagaaagttttcttatatatctgcatgaggcacctggatcaataaacaggtttttaaaattgttattcattttacaactcaataaaacttaattatgagaaaggaaggcaagcagaagccatgctcacataatattgtattcctcgcagcaattcctgcggggccttcacacttgcatcaaaatgtagaacaaaccaaattacggagactattcagaattcatttaaaaacatcattgaggagcatcataataaaaacacaatgaaaatgacaagcttgggctgttaatttgtagcactgtgtgtgtttatgggggtctgtatgcatgcatacatgtgggtgtgaggtacatgtggcttcattagctttgcagggagtagcagggaccaagggctagagggtttgaggcaatggattggaatagcctgtcccaaaggggcatggagagggattggggactgttgggaagtacctgcagccctgttttctgcttggccaaaggtaagccaggcagtgttggggcttgagtcccagatcaggatctgggtggtggggggatgaggggcagcccaggggttgggctcagggagtgcccagttgtctgcgtctcactcactgtgtttggccaggtgagccttcctgtccccacctgcagacaaagagccccatgttctgattagctgtggttccaatagggagcacccagtaagtgctgatggctcaggggcatttcattgtgtgccgaccaccagctgatcagttgacagctgagtgcctgtcattcaaacccagcagactccagtgtgggtgcctgtcctgtgaggggctcagaccctctgtcagaagcctacccagccttttctggatctagggtgcctgacctcttggtcttagcacctgacctcttggtcttggaagggaaggacttgtgcctacagccttagtttaattcctgcatcttgggctcctctcaccctacttcagcttctctctcaccaacttcctgcttccttcctcctgggcctgccctgccctgcccttttgttgcctgagcctcaatatgttggattgaagttagtctcacccccatcccccaatcccatgtggccacttttcctgttgggaccttgagcccattgctttgggcctcagtttactcatctggaaatcgggtgtcattaagtatgccttccctccctccaggagtgtttcccaaattaattctcttaattaattaagtaaagcgctttgagatgcttagacaaaaggtgcactagaagtgcaaattattatttattcttaatgaacacttctttggagaaaatttactcctgattctgaaggggaaacacaggggaccccaggggaggagaaaatgacaaggtttttttttttatttgtttgaggggagtagaagagaaggggaggttattatatgggatttttcactggtaggctaatagagaattagccaagcattctttccactgctctgcagtgctgcctcagccagtattgttcacccatgaaagtgcaaaggtggacagctgcaaagacagaatgatttttagattccaattgcaatctggttttaggactaggaagtcatcagtattagagagagatggaggaagagagaagagagaaggggagacagaagagagagggagagcaaggagagagagaagagacagggagagtcaggaaagagggagagagaggaaaggaaagagggagacagagaaaagagaaggagagagagggatgagaggaagagaggaaagagtaggaaagaaaagagagagggatgagaaagagagagaagagggatgagaggggaaagagggagagagagagaagagagggatgagaggaggagagaggaaagggagaaaagagaggaaagagagaggaaaggaggagagggagagaaaaatgagaaatgaagagggaagacaggaaaagggagagaggaaagagagggggagaagaatgagatgagagggaagagaggaagaggaagagagaaatgacagagggaaaagaaagagggagagaggaaagagggatggattagagaggtaaagagagggagagggaaggagagagagagagattgattttcagtgtatattgttaccactgtggttactccaggagagaggacacatggaaagggctatttgttgggacttccagctgttccgtatgtatttatcagccagattctagccccctgggcaccctctgagtttccttccagttctgaccatacctggacttctagcaagcttccttccctccccttttccttcctgggcccggacctgagccaaagtgtaaagtttgcatatttcatctacagtgctcctgcctccctgctttaccatctcctccatctgagaccccattatctccaaccaggcccatgattatcttccccactcccttcaaaacctcatctcaggaaatgtgtgcgtgcatgtatgtgcatgcatgtgtgcatgtgtgtgtttgcaggggtcacatgatttatttcattcacatgagggtaaatgacccagggcaatgcaacagggcttcttttttcaggggtatttgtacctcaacagagatcaacttgtataatcaaacaacttacttttggggcctagaaccgggaaggaagaaggaatgggaaggagctttagttatttcctttctatgtctttgtatagtttgacattttttccagtgaagatgcatgatttttattatcatggtctcctatctcaagtagatgaacaagcagcctaaagaggacatttaaggcatcagccagaggcagttagccattcttctccttgacagtcccaaccctctgaagtcacctgcctggcatgggagctgctcctgggctgacctgtgaagacaggaggttggtcaacaaggccagagaagggggaagtaaactgggtggggcaaatggggagagagccaagaaacgcctcctgaagcccttgtagaatctggatttttgcgagggattgaaagtctccccgcaagacaaagagcagctatggcttcttaactgtgacagatgtgaattctacaaagctgtggaagaaacattctacccgaaatgagtgcctgctctgcattggcaggatttggacagtttctgcccctggagagacagaactacaggatgacttgggtggtcacataggtgggcgctggaggcagagggcccagatttgaattacagttttgtcacttgctttctagtaaccttgggcaagttactcaagcactttggacatcagttttctcgtctgtaaggtgggagtaatagtagcatccacctcacagggatgttgtaagcattaaaggagtcaaaagggtacatgcacttagaacatcagctggcacatggaacatgctatatgttcattagccattaggagagttgacgaaattgtagctttttgtctctgagtgcagtggggcttgggctggcctaagctggtatgcaatgtgagttcaggtctgttgatgcatgcatggaagacaggggctgtccttagtctacctgcatgggcactgaggaactcctggggatgaagcccttctgaggtagagcatgtattgtaggtccaggtctgtcaaaggagtgtgattctgtacaatgactggttttcagactgaccccctcctggtcctcaagacccaggcctggttcctagagaggctagaggctgcagggaaggaacgaacaagcaaaattgataggagctgacaacaagcatttgtgtaaggcacagagaacaccaggcagcagcctctgctcagggtcagtagaagtgagcatggggaaaacctgcagggagagtctgagcaactgcgcctgacgctgtaccccgaggcctgagctgggcagaagagaagactaaagaccaaatctcgtggtaactgggagacatccccaggactccttggcaaaaattggaggtggcagcagttgccgtagagtgagtaggatcaatcctagaaaaaaggtgagcttgttgtaataaaaggaaaaacctaaaatgctgtttatgatggcacctgccgtctaaggagatggggggcctatttcagaaaaggccagttaactcctgtgaagtttctcaagctcttggtgctgaaggagtagttttatttaaaaaatttttcaatttgtcatatactgatacttttggagaatcaacaaaaatgaatcattagaaacatgaaattaaaaaaatgtacaaactacaagccccaatttttcaaattattagaatccacagacataaaattaccccatcaaactgctgtgagtttgtaaatgcctaatctcaatttctggacttatttcttcatggactggtatcaaaagttcagggcctgccctgatcaatctaggatcaatcactgtgagtcacatgggatctgatctcatggagacactgatgttgggatcagcagttaagggctatctgcctcaagactaaggaagtgggaagactgtgttaatgtcctatggttgccacactgagtggcttgaagcaacagaaatatattctctcacagttctgaagaccagaagtcccaaattaaggtatcagcagggccgtgctcttgctgaaggctccagggagactcttcccatgtcccttcctatcttctggtggcctcaggcaatcatcggccacatgactccagtctctcacttcatcttcacatggctgtcatctctctctgtgtctgcgtgtcctcaaatctccctctccttatgaggacaccagtcattagatttaggacccaccctaatccaatatgacctcatcgtcatttgattacatctgcaaagaccttattttcaaatgaggtcacgttctgaggttccaagtgaacaagaatcttggcagggggcagggatgggggattactattcaactcaatacagacagcacacacagactcagatgctggaagcaccatgacatggcataaatcaggggatggctttggacatgggatttggaaaaggtctaggccaattaattattcctggatccctacagggcaagggagtcctggctggctgactttgatcgtggccatctttatgcccctgggccctggtggcctgaggaagctatttacaggggcaagaagggaatccctgtggtacccagggcgttctctctcacagcttctgaggatacagagaagagtgagcaagtggagcctgaagcaaaacccatcactcttcatacccagagtgtccagaagggccttgggcagagtgctagagggaaggccaaggtgctgctaaagcctttcttgtgtgtgaggcaatgttgcccagtggttagagaaccagcggttagagcaccagtgctggtgtccacctgctgggctcagtctgactctaccattagaagctttgtagccttgggcaaattactttcctttcagtgcctcattttctgtatctataaaatgggggcaataatagcacttgcttccatgattgctgtaagcaataaatgtgataatatatgtaaagatcttggcgcatgttgatcactcaatcaatactacttttcatcaatacaatgaaggccagggaaattactgcaatcctgaactgtacctattaggaaagacctcatgttaattaagcgccttctatgtcaagcattgtttgggtgatttacatgtttacatactatcaacagacatttttgagtggttaacttgtggttgatttattttttaaaattgtcaagcatttattgagcacctgctatgtgcaagaggtagtggggaatccaaatacattttaagagaagcccattgcaatgtaaacaaagaaataaggcaaggttggttctaaatggggtgtcagccttcaaagaaggattttatgcagttttgtcttgacaaaaaagacttgattaattgacctcttaaggactcttccagctgtttgttctgcagtacagtgtgataggagaggaaggtaaattattttcatgaatgtgaagctttgccagctttgcttatctttgtttatttcactaagacagtattaataatttgaactcttaagcagcttctgtgttccaccaaagcaaagtcttttcagttcattttgtaaaatatcttattttacttcattctcattatgattcataacaaaataaaaaaataagttataaccaaactggattactagtatgtaatctgtagcattgcttaatttggcttgctatgaaagttttaatagaaaatatcatttgattgcaatttagaaataaaatttgatttccgcattataactaatatgaataataagcccaaaatgtctaatatacttaggcatttctattaacacaacaaatatgtttcggatgcttccagcatactaattcaaagtgtcattgtctccttgtactcgcaggttagctctcctgagcgcttactgacctcacccaggcagcctttaccagcaattagttctcagctgtattagccctttggagtgccacaataattaaagtgttatgcctctttaaatgaagttggcttctggtgcctggctgaattgctctcagaagagtgcccctttctctgtgtagtctgaggttgtgggtagctctgccattcttgtctctgggctgggacctagagctcatttactcacaatacttgccatttccagatccacaggctcgttctgtctcaccgtaaggggagaggctatgtgccttccttccctcataaacaactgccatctatccattcatttattcattcaccagtaactatgaatggagtgcctaccgtatgccagcactgtgttagatgctgtagttaccagagtgattaaaaacggatacagtacctactctcacagaattgagtaatcataacaaagaatggatgaaggattggagatgaaaggcagcaagggaagagagatgtcaaaaatggcctccagcaagttcactgatcaaactcccaccaagttcactgatgaaactccctccagtggtgctgctgtctggctgctcttctgttgtcaccccgtggcccacacttgcactcgatttgagctctactcaaccgtctttccctgccactctccctctcctgattctgcttagttattttcatgggaattttgaagacattctattaaatattgatttgtttgttgcctgttctctctggtggaatgtgaacatcatgaggtcatgaatctgtgccccccatgcctggaatgttgcctggcacatggcagcttctgaaaaaggaatgaatgaaagaatgaatgatgctaggttgctgcctcatacaataaggtggatggtagcatcatgactcagaaagagatgactggaatggaactaggtttggctcaggcgattgggagagttattgtgttcaggctcagtgtggatttggtgcacactgatgcttagtaaggccttcatggatctgccaattatttcaaacttctgggtctccttttattgagcacccactatatgctagtgtttgagggtctgagagcaaagggaacacaatctctgcccgttttcaaaggtcctgagttagtagtccccgctgactttggctgaagtgcctggtggtatccaagttgggaaagctggtgttggtcattcctggagagtgcaggtagtcgaaatgcgagggcagcaggaatgattctaactccctttctggctcttgctcatggcggggatccccaagggaccagagagcatcgattgggtggcctgtgggccatctgaacttcttggcattttgaggaggtgggcaaagagaacaagaacatagttgggatcaatttttagcacctccctgcctggggtcctgctcctagtgatggaatgtgacacatcacatccataaacattgtccacacatgggatttcaagaatccccccagtctgaaggtcagagttcactgagcttgtcttcaattcctcggaggatggcaggagcaagggaggacccagcctcggaggaacaggtacctgctgaatgctcaggcacaggctcagaggacaagcagggaacagctgtgggcctgcagtatgaggcaaggacaccgttatggaaagtggggcacagggtcagaggagcagaaagtgggcattgcctgatgttcgcctgcaccgattcccctagacccagggcagagttgactttagaacccaaaagggtcagcggaagcagagatgggttgggagcaagaggctctagccatgtgggctggaaggctgctaggacctgagtcaggcaagacagaggcgcctcttcaggaacagttaactatggcccctgaaactgcatccttggcatgtcagggcataaacaaaatgaaaaccaaataaactgtctagaaagtggagtcctatggagatgaattgcatcctccacccattgcctggtttcctgtggtgtttctttttacttctcacccccatcccaccttccaggagctaaggcttattgccatagctgccatatgtggttacttggagaagcagccattgggtaacctctggggctttgtacaggcctcagttttctcctctagaaaatgaaatgagctatcccctctatccctcacaggggctttcacagaagtcataaagtgattagaaagcaactgtcaatgctcaacaatatggagcctcacccagctccttcctccaacactgggccagagcaagggcaaggggtgccctcatcaacaggcagggggctgtccttcactttgtggggcacctggaattaaatgagaaagatgagtctctctcacagcaggcactccataaatattgaatacttcccccctagaaggatttggaagagattctgggtgagctcagagttggaatgggtgaggaagggacccattaggccccaaggggctaggctagtgggctccaggggacagagagtgggaggctgctgcaggcctgagggtgccctggctctccagggctgaggctgttttctgtcctccagtcctgcttcccctgtgtggagggttggtgcttaatattattattattagaggggacacgatgaacctgccccagacctggctcacaagtgtatgggtgcagtcggcaggatttgttgaggcggggcgttgccccaggttcttagtgcattcccgtgtgtggccaaaagccatcatgtatgcagctcctgcttggctgggccacgttctgggtcattaatattttccaactctcggttttgttcattctgttcctcccagtgagaatgttcaccttgctatactgtgtgcattggatccatctcaggttctccttctactctgagatgtttactttgggagcttcttcctcccgtggttctggagttggtgctgtggcagaatggttgggcacacaggctctggagtctgaatccatgggtttcgatccttgctctgccacttgctagctgtgtggtgttaggcaagttcctaaagccttctctgcttcagttttcccgtctctaaatgggtgtactgagagttcattcacacaggtgcaaggagcagtgcttaatgttattattatgagaggggacactgaatctgccccagacctgacctcaacactcacctaacgcctgcctccctacaacccaggtgttggccacttgccttctttcctgaccatggtgaccctggggaagctttacactattcctgtggttgaaaagccccaactacttcctttgccatagcccaaggagcttctgcacgcagtgccaagtgatgaggagagaccacagcatctgcactgaccagcaggacccgcagaggttctggccaggggacacgacaaggtcatgcctcatggggtgggcttggatgacagagagaaaagagacaagacagacagagacaaagaagacaagatagggcacctgctctttcttttctcacattctcttggatgttcctagaggcagttgtttcatatggcttctctggaaatgtcttgcgagaccgagcagcaaactgcttgttgtatgcctggagtggctggctcagtcacgcccctctcattttatactccctgctcccacttcacttggctctccctcacttgcccttccctgggattgcaccctccagtaaaaccgtagcaatcaagcctttgcctccagttctgttttctagattactctggctaaggcaagagtcttaatataagatttgtttagtgatcttttacaaggcacgtgtctttttgcctaactagaggataatctctttggaggaggcaggaggctatacttgctcttgcctgtcatgtttcttggcaaaatggtggacctagagtttgctgatggtttaattggcctcatctgtgattattcaaatcagcaggtctgagcccagtgtgaatacagcaaagtccacttacctggggcttggaatgacccatactgatcccgctctgaaatctcaggtgcctacagcccattctcagactacaatctctgtatagctctctctctctctctctctcatttcccccaaatcttctacctcttcacctccacagttggaagacatgttcatgtcattctcatttaacaaccaaccagactgaaccaaaccctcactcaaccacacatcctccttctaggttttatgctatctcactcttgccctccacagccgaggatttgcaagatctctttccctcatcccctcatcactgcccaaattcctcgcaacttattgcagtctgtcttataccccatctaatccattgagcctctccttgctggtcaccattgaatccagtggagatatttgttcttactttacttgcttgaattctgttgtcatcctacccttttaagcattccatcctttttgaaactcttcctctcttaatttgtgtgattccacgatctctctgtttcccaactacctctcaggcagctcattctcatcttcctttgcagccttgcttcctccactcacacctgagctgttggcgttccccaagacttgttcttggtgctctgtgcaccattttccatgtaacctttggttatctctttcacattgtggccttagttatcacagatatgttgaataggtcctgaatctctgagtccaaactgagcaccaacctatcactcacctgcctgcagatgtaccccaagcctatcaagcccaacttgtccaaacaggattctcacttctccctgaagcctgtctgacccttgcctacctgaacaccaccatccagtgaagaatctaagcccaggaccttttttttgctagactctaccttccttttcagctccccttgctaagcattcagaaaagtctgcagcctctatttctctgtgatcactaccttagttcaggctcttgtacctggatcatggcaataattgtcaactgattactttgtctccagactatactttccctttaattcttatttccactgccaccgaagtacagatgctccttgacttatgatgtggtcatgtcccaataaacccattgtaagttgaacatatttcaaacaaaaaatgcattgaatacacctaatctacaaacatcatagcttagtctagcgtaccttaagtgtgctcagaacacttacattagcctaccgttgggcaaaaccatctaacgcaaagcctattttacaataaagttttgaatatctcatgcaatttgttgaatactgtactgaaagtgaaataaagaatggtggatgggtaggtacttaagagtatggtttctactgaatgtgtataatgtttgtgtaagttgaaccatcaggggccatctgtaatcttttaaaattccacaccagattttgtcatgccttttcttaaaagccttcaattgctaactccaaaagctttcaacttgaagttcaaattcctgagcttcatgctacaaggtcttttgtggtctgccccttgaccagctcattaaccttatctcttcactcttctgcccacttttctccagccaaattggaatttttcaatttccttgaacatggcatgatgctttaaacctccatatatttgcattttctgttccctctgcctggtaccccatctacccacatccttagctagctgatgtctatcatccttccaatcttggctcatatgcccctcttaggagaagccttcccttggccttcctttctagatccctgttatctctgttaatatttttccagatagaagcatgtatgacactgacttatgagttgatttatctgtgctctcaagccccttggggtcagggactgtgtcttatatgactgtcccctcaatccttagcacaacgcatagcacttagtagatgcccggtatgtgttgaatgaatgagcataagcccctactgtgcctcaatgaccacagtgaggagtgggctggagaggacatgttgatggctcttgcaaaccattcccacctctgagaagaactctgttgcagagctcttggcacttcagcttctatatatggcagaggtgatggcagctttgctattagtttctaattttgacccttcaggtctccttaggtggatgtttccaccatcccctcttgcccagtccatttcacccccttaatgggcctgggccaggccaggccaggcctcctccttcctcccttcttgcctgcccgagtgcctctcaagttccctccacatgacagggagccagcttttccttagcctggcattcctacttcagcttttaatctttcctcataaattaatctctcttgctacctaatcatgcctggtgcccttttctgaacactctctactttgcctacccctgtcgggtaatgagatgtccacagctggctgcaatatcccaggctccctctcaccacccccagagatgatttcctcctggctttgtgtcctggcccctgcatatgcacatccaaatcaacttgacttttttgaaaaatttatttcactgcaacttcccattgcaaactcatccaatttgcactttgctctggggctgtgtcgttctctgtgggtgcccacttttggggttccccccacttattgaattcatctgtgtctttatggttatttttttccttcctgtgctaatgcttatgcctttccaagcagagtctcatttagggcatcttacccaaactcatctcttctccaggtcacaggatatttttctttaccccttcccagacaggagtggctgtcagtttcatgagacagtttcttataaacgctaagaaaaaaatgggtctctcccaatcatacttgcttctattacacaatctcagcatactttttggcctcaactatcagaaaacttaaagctaagttttacttttggtggcagcaagtgtctttctctcgagactctgtgaaattcaattttcctcttattatgtggcattctttcataaattattactataaagagactaacatatatgggtttgttcataagtttgtgaaatataaagacgttttaagtttaaatatttttggaaataagtagagtctaaagaatacatttattaactgggcagttcatatactttttttttctttcctctttttatccctagtcccttttccttggccttctgaccatgagtagaagatagtgtggatgagcttctgagtctgggttgcctccctgcccctcaccatcaccctcaatgacagttatttgtcagtggccttgataagggacgcagtaggtgatctgcacaggtagatggaggaagtggggtaatgagggggaaaagatcctgactttgggagatagcaggtgtcagcatcaggctcaattctgttccttctggttctgtaacttcagaccaattaacctttctgagtttgggactcttcaccaaaaagaagtgaataatgaaactttccagggttgtgagaaacaaacaaaacaaagtacagaaaagggtcgatcacagtacctgatgtccaaggtaagggtgggggtgctccattcaactttctatccttggtttcttagaggtgtcccctgcccatagatatgtccccctggatcttgtatggccttaaattccacagttacagtctcattgacttttactgtcagacaaaacatccctttggtatttatacctcagtctggctgagactccctggaagaacaagctgtcagtagggtatcaaggtaatgtcagagccgtttgaagcagtgtgactccagtaaataggggctgggtaaaataaggctgagacttactagactgcattcccaggaggttaggcattcctagtcatgggatgagattggagataggcacaagattaaggtcacaaagatcctgctgataaaacaggatgcggtaaagaagcctgccaaaacccaccaaaaccaagatggtgatgaaagtgacctctggtcattctcactgctcattatacactaattgtaatgcattagcatgctgaaagacaatcccaccagcattatgagtttataaatgccacgacaatgtcagaaagttaccttatataacctaaaaaggggaggaatcctcagttctgggaaatccttgcccatttcctggaaaacttatgaataatccatcctttgttcagtatataatcaagaaataactataagtatactcagtcaagcagcccattctgctgctttgcctatggagaagcataattctttattcctttactttttaagtaaattcgcttttattttaccctatggatttgcctcaaattccttcttacgcgaggtccaacctcctctcactcttgaggtctgcattgggacccctttctggtaacagtaatagtttatgatggggattcaaatagtttatgaattttggagcacagtattttgggggaccacagtccttcctggatgacagtgttgctggggaacagggtaaaggtgagggagagacagcacctgattagagggttgcgggagaccctccaactttgcagggttttggagctgtttctgggacatcagaatctagttctggaatgtgtatatgacttccctggaggtcttgtcactagcagatgtagatacaggacatctggggtggggcttgaaattctgcatttctggcaagctcccagccttgcccatgctgctgctgtctgaaccattcagagtggaaggtttttagcagactttactgaaacctcattaaaaattgggctctgggcaatgtgggggcacccctgcagtgggggtctccaggccaggacccccgaccaggcccatttgaatggttattatttagtttttactcagaaccttgcccaagttactatcctcaagcactttcctaaaattgagagcatgatattcaccccttccttttatctcctcatctggcatttctataaattagaaaaaaaaagcaattaagtttgtctggcatgacttgcaccacatcaagtcctgctatttactgactgtgagtctgtcctcagactacaaagagttcttcttaatgctgcatccttggcttgcctgggaggtaacttccattttaagtttttggaaaaggtgatgcacaggcctcaatggactcaactaaatgcatcattatttttatttttatgttttaatttttttaaaggtgattccaaattgccatttactctatgtttacactcaacaaatgctgacaaacctaaactatagtgacaatgagaaaacaacaacataaacaataaaactcttgcaaggaagccagtgctaaagtggcacatgggtggcccaacttgcctcacttaatcagtgtctctcattcacttgcatttaaatctgctttcttttcttttctttttttgcagcactatttttaaacatatacatgcatgctcacaaaatggctgggatccggggatcccaggcctccctccatccttgactagacacttgatgccaaaatgaatgtctaagtctttggagcctcattttcccatctgttaacatggaagtaataagacacatctaacacgtctcactgcatgagggcctactggaggacttggtacatattaggcgctaaatgaatgtttatgcaaaaaaaatacaagtattactaaacaaggcctgattttgttcagggtcatgcccagctagagctacactccttccatggtcccttgcagctagaagtggccatggaacactgctatggttggatgtgttccccccaaactgatgtgttggaaacttaattctcaaattcatacgttggtaatatttggaggtagggcctttgggaggtaattagggctagttgaggtcataaaggtagggccctcatgatgggattagtggctttataagaagagagacctgagttggcatgtctcctctttcttaccatgagaggccttttgccatgttataacacagcgagaaggccctgacaagatgcatctccttgactttggacttcccagcctccagaaatgttagaaataaatttcttttctttataaattacccacattctgtccaattagatttaagctgtttttggaaggggatgaggttggggtaatttttgggaaacctatgctttcccaacataggggccactccctcttctggatctgaaacaaacaccatacagaaatagccctattgcaacatggggcaataagcatgaggattaaaataaaagaaaaaaaatagagtggagagatgggaaaagaatggtttcctagtggcatcaatgggcttccacacagccccactgcctttgcctgggatgcttgttacaagagagtgtgacaattcaacaaagtctttgtcactatccctagagtccctacctactccaagtgctgcctgtgaactagcagcatcagtctcaccagggagcttgttagaaatgaggactgtcaggtcccaccccagacctactgtgtaagaacctgcactttaacaaccatcccctggtgagttacactcacattgaagtttgagaagcactgtctagtcaaggtttctgttgcttacagctaaccacattcctaacctaacctctcttctacattttcttgaaaaagagatacaagctaagctctggatttttaaaaatgatacatccaggttctgttcagacccttcattcaaatttctttcaaatttttaaaaatctgcctcccttatggaaattatcagtctgctatgtgaccagcacaaagaagactttaaatatttgttgtggagtaaatacttatctgactacatgtttcatcttccttactaggctaatagctcaaagtgggcaaggattgtgtcctatttctgctcataccctccagtgcttagcaaagtgtccatatagctgtgagtgcttgataaatatataaattacttcactatatattccatttactggggcaattaaaggaagtttctggcaaaccttccacagcaccctcaaaatcctgtcacattctctgagtatttgggaagagtgtgtctattctaaatagtcgatttttatatacttttattagctatacagtagaatgacttttcctcttctctttggctttcaggaagctcagctaaatgcagttcagtggcaaaaactaactttggtttggctttccttatttcctctaatctctctatggctcctaatttgctatttcagctttaatgtttttattttatttttgacttttatttttcagtttctcatatatattttttgaaatagcaaggtgaaaattatacgtaaaaccaaaccattaggagtctgaaatctgctaagggagtgatcttgtctaagggagtgaaagagttttgcttaatggtaagaacctggtttcagtttttttcctttattaaataaaatttaggggatttgccacctgtgtctgtactgtggcgatattcacaccaccatggctgggtgagaaaggagaaaacacagaaacagagaaaaagccttgcatatgtttgataattgacattttccacaacccactctattcccctttccccctctgtcaacgcctgtcattcagtcactagtcaagcaactgtatccctcactttgcttttcacactgctatggtctttattggctgtgttgaagtctgagaagctctgtcctcactcctgcctctcctagagtggctcctcttctttctggaaattctatctgtgctgggaggtccagcttagttatctgctcctgactgctgcagctcatacgaagccctgtcccacctggacccatggtccgtcaactttgtggtgtcttgtttggcccttgtcttgcttcattgaaggggtcctctcttcccagggcaggaaatagaggcattcctgtgtttctctaatagtgtctagctaggggttggtatacagtgggcacttaacccatacctcattagatgctacttagcatgtaaccatagtcccagatatggtcacattatgtattatacttctaagttccctggtcttacctacaagaacacaaacaggtcagcttgtaaaccaagctcattccttaatacaaagccataggattagtgttagaagaagccacagagccatgtgaatctgatccttcatttctagaagaagccccgagaggagaggactttgtgaagggccccaaagctggttaggtgtacagcagaggctgaaactcaagtcatgtgactttgtgtcaccatagtcccacttccccctgtttatccatgccaatccttgcaccctcttcagagttttagcatgaatgcagcaggctaaggtttgtattaaagcaaatcagggcacatttcaacacaatactgggtgattgtctagaaacatgagttgtacaaaatcagatatattttaactacattgagctgtctgaccaattaaaggattttagaggcaatgttttataaaatgaaggaaccatttcatgaggtgaataatcacctcttttacccattgagatttagcagtggtttgcttcataaatggaagatttgcctgttacacatcttggttagattcaaaagtaaacagttatgaatttgtttataaattctgcaataggtataagttatttatgcagttgtgattttagatgtgtaaaactataactttctatgtttctgtagaacagaattcacctttattctctacccctcatttcctccaaatgtggaaaacaaacttcccagtttgagataacaagccacttttcatttaaacatagtcagttcagatttgacctctgtcttgctctcttcgttgggaataatctaatttctaggtcttgggtacctctggccctatgggaggggcaccttgttgactctgttgaggtgtctcttgtcctgtgagttctggactattgactctgccctgctgcactagtaggaagtgaccttggtctccactggggcttgcagttgcaaggtcaatgctttttgctttcaccttgtcccacctgcaaagcctctttgcctcttttccagctgccctctgggctacacctacatttcttctctgcatgccagggtgaacagtctccccaggctgatctggccacctagacatgtactctctgccattgcaggtcttctgcttaggtaccatgttgggcaagagacccctggtctcctagctacccttcagaaggtgaacaatattccctgttcccttcagctttcagatctcctatgtccatctgagatctctcatcagggtttcagtcatcctgaagtccccttttacctacccgctacctcccagctctaatggggcagtcctattgggctccatgtctgggacctactcatttaaatcccaggcccatttccactgattttctttctcacttgcttccctgtgtctgaccctggcatttgggaagagcaggtgggtaagaaaatggctttcaccttgtattgttctctactctgtgtttaagacctatgctctgagacccccaagcctccttaaagtgccacagaattttctcttgcaaaacaccttgctttcatgccttcatttttgctaaggacttttaaagtcttgctctgaaattccaaactgggcaaggcaccatgttcctggctatatccatgccctccccccaccccgcccctaccactgacccgggagggcagggcacctggagagctgcctaagtggtaaagaaaggtaacatgaagaaagcaccaagaaaggagccctcagttgttgcctcaaagtattatctaccatattcaatcattgtagtaggaagcataatctggaacacagcttctcaacaggtctccagctacaaatggtttataagtaggcagagacatagtgatgccttcagctctggaggctcctgagatacccagagcccttggagctatcagcattggctgaaagtagccaaaagggaataggtttcaaaggacctgccacaggtcctcacttgcagcaagcacaggaatgatgctctatccctctaggttatgctgagtgcagcaagaggtgctctgctacctgcctgtcaatttttgcaggcagtcaccttttgtatgcaaggggcatggggagctgctggaggacttctccaggcacccagggagcacaggatgaagcctcagctttgagggagatccctaagtctctgctttacatttattgattctcccttccatttgcaaccgatagctcttttagggaggtgtaagctgactgctgagtgggtgactactctaatgttgcatatgcatccctcaatcaaacttcatcattatgctgaaacatttgacatctaaaatttcagctcaattagaagtccaaatgtaatatcacaagaaatttcaacagtacaattcaacagtacagaaaactcaacagtacaattgtcagtgaaaaaaaggcaacgctgttagagtcttaaaatagaatttcaactgttatatatttttaactctctgttaaaaaatgatttaaattttttactacctacttgtgtgaacaaagtttcttgtgggtggtggttattgagaatttgaggaaaccattttttataaagtattgataaggaataggtgtgtagtcatttcaaacataaaacattttgttcatggaagcaagttcacgtttttcattacaaatttcaaaaaaattagaaaattttatacatattcaatatttagtatcttccccaatacttgttttccttattgtcattatataatgtaaagaaaaggtaataaaaaatttccatcaagtcccataggaagactcccaaatctctttcagttttattccaatgtgcagcacagtttcattattttgtgtatgtgccacaatggaaagaggtttgggaaacactgctctgctgcaaggaatgtgaattctggaggcaaaccagctagggctcaaatcccatctccgccacgtgctggctgtgtaactttaagccacttaactgacctgaacctcagttttctcatctgcaaaatgggaaatgacctcgacttccaggattggactaagacccaaagacccacgctggtactgcaaactcatttctgcatctgtatgtgaccttgcccttctgaattctatttcccagagttgtgggttcagatgctgccccttgtgagctagtatgatagcatgtgaacctactgcctgtcggtaggttgtgttaggagctggacctcgggaggaacagggctgggtcacagagtccccataaaatagcagctccaggaagaggggaaccagctcccagcacccggctgccatttgctgatttagtattcagaattcagaatttatggagccgccttcctctgtcacatcatccatcagagacagacactcaagagacggaaggggaaaaaattaaaaacctgtttattgctcaacttgttctaggcatgttttagcttattgttcagctctgttcatttcggtgctgcaatttgaatggctttcttagttgccatggctaacatgtatatatacgtatagatgggtgtactcacacagatatctttttcttcagaaaaatgaaaagccaccagaaattgtgctgcaagtaaagtttttaaggctcagggtcggctggggcctgctggaagccaccgtggccctgcgcaagcttcctgcatcctcatacccacccaggcctcccttcactggtagagggtgctgcactgcggatgcttattgggtatgctgcatttgttcctgtcgatgtcaaggagagtttgtgggcagaatgagtatggaatgcacaatggcgacaggcaggaaaggcaggcaccaggatgtatagagagcgagagaggcaggacggcaacaaggaccatctttgtagaaaagggatgatttgatcacatccagttctttatgaaccaaatagttctttaggaaccaaaccttcataatttagcaaacactgaaatatgtctgttgcagaagaaaatgctgtgaacgatactcaacagcaattcagaatcctgggttagaggtgcctttaccaccatcgcagttgagtggggcctctagggtcagactataaggatttggttctctccttcaccctttctagctgtttgaccttgaggtagttacttaaatatcctgtgcctcagtttcctcattctcctcatctgtgaattggggataataatatccctgtcaggatgaatgaagtgcttggcaccatgcttggcaggcagaggatgcccgatatgtgttgttattatacatttgcagtgtgtgcgtatatggttccctttgcctccctggctgtgagcattccatgagtaaatctgagatggaaatgcttcccacccacctccagggctgttaaactaatcactccaaggtgtgggatgtgtagttttcagaagagtataaactgtcaccacatggtagggatggttaacactggaagccctccacccataattgtcaggtattgagcccagcctattagagatgaactggagctggatttcacgaggagagaagaggctcttccttgcctttccctggaaatgaagccccctggcttggcttggaggcatttgctgggcctgctcagtgaaagtcctggctgtggcttcagaatatcacatcttgttcagtttacattataatcagtacccattatataaaagattattttatgtattacagacttttgtttttgacatatcaattccctctacttactctgcatctagagaaggtgcgagagaaatgcagtgttttagcaacagttgcttctagaggggggcctggaagaaagccgtgctttccagtccaaggcagaggaatccagcatggtctctgcccatgttgggggacaggatgagacagaaggggcctgatctggaatggctcaagaccattgctagaccaggtaggattggggctgaacttccatggttgtttgggtaggtggaggggaggtgatggggctgcagtggatgtggggtgggggacgtgggggtgccaggagtacctgtggatctctgacaagtcacctgagatcttttttggacatgagcgaggcttgtgtgcacacacatacgtacagacacacacaatctgaggataattagattctgagaccaaagaggtcaacatgacacccacatccatagctcataaagaacctttccacaaaagaggatgctggcagagacagcaaatgctgtccactgtgtgcacaggggttggctaggacagtgcagggctggaaactacgccacatgaggcaaagaatgaggactggggtaaagatcatgtcggactctcaaggtccattcgaggtagttgtggcttctggggctgccaactcttctcattagctgtgaactcagagtcagaaggatgttctgtggggctgaagcctgtagctgaacttgtcactgtttgatgacaggagaacacagcgtctgagaaagagtggggtttgggattcagacaggttcaaatctctgctctgctgcttcctggcttcatgaactttgatgagttactcgacctctctgaacctcagttttctcatgtgtaaaatggatctaagactatctacctttcagggttattttaagaagtataatccatgcatgtaaagtgcctagttcattacaggagctcaacaaaaggtaaaaagtgcctaacattttgcaaatccttctgtgtaccatgttctgtgctaaatgctttacgtgactgaactcaattaattctcacagtaaccctttcaggaagacactattattatccctgttttcagatgaggacattgaggtgcagagaggctgactaacttgctcagggccccaccacttgtcagtgggacagccaggaaaccggcggcttagggcttggtgctgcctctgtcactaccacttttctagtgtggaattgcaatgagggaagacggttcaaaatcgttcccattcatatgcttgttaattaactcaaattttttttatattggttaacatatctctatatagttgggcaacaaagccctgtgaagagccatttcactcttccttccttgctaagcagaacctcagttctcccgtggcagattgtgcttagctaagccagccacagcccacctctgccttcccagtctcttttatgttggggatggctgtgtgggccagtctggccaaggtgggagtcagatgggacacttctggggacagtttttcactctgaaaaacaattaattgggttctctattaccccaaatatcttctctgtggagttagttttcaaagataacctgcagaatagcttgtgctgttttctctgctgcttcttgagctcctggggctgaagaacatttgagtagagaggagggcttgagactgctctcccttcacctaggcagaaacacccatttaggcagacaggccaaaggcttcatatgggactggggtgcgttcctttcccttccgggtcaaggacacgcttgtggtgaggtaggaatggggagtggagctgtggcaccactgctaggcactgtgctaagcagggaagaggcaaacatgtatcagaccctggccctggccacatcgctcccgcttcagcaatatgaagggcttcatcctttcccaacaaaacaaggagccataaaaatgtttcctctcctgaccccatgacttacttccttcttcacctggtgatctcctccccttcacagtcaaggttctccctttccctcccctcccaaagcccaggtcagacctggcacacctgtctacctctgcaggctcagctctcacctccttcctggcctttgggctcctgctcttgaagtacactgcagccctgctgggtgtagctcatgatggtctctgctcatgatggtctcccagagtggatcattttgtccctaaattcctaattacaatttttcctaattttcactcacctttatacctcagttcaggtgccacttctctgtgacatcttatctcagccccacgtacttccacatttcttattttgtggggcagttgtcttttcatttgctttccccatcactaaacttgactggttggagggcagtcagtcgctattcttttttttttttttttgagacggagtctcgctctgtcaccaggctggagtgcagtggcatgatctcagctcactgcagcctctgcctcctgggttcaagtgattctcctgcctcagcctcccaagtagctgggactgcaggcatgtgccaccacgctcagctaatttttgtatttttagtagagacggggtttcaccatgttgcccaggatggtctccatctcttgaccttgtgatccacccgcctcagcctcccaaagtgctgggattacaggcaggtgtgagctaccacacctggctgtggctattcttaaacaccacatttttggtgtccagtacctggctcagcacctgatacctactaagtatctaacaaatgttagttgagtgagaagactaagccttactctcaaggaatttggaataaaattgagaaatacaatatgaaatataataaataaaaatacaagccaggggcacgtgaatgggtctaggatttctgaacagagagatctgttaggagatttatgtagttatctgggcaagaaatggtgaggaccagatctgggattgcaaagaaagacactggggaaattctatttcctcaatcatccagcaaccattgataaaacacctactatgtatcaggctctgagcacacatcagtgaacaaaacagcctcaaatctctaccccgtggaggtgacatttttagttgaggagaacaacgagatggataaataaaatgtatagcctgtcagatggtgctaagtgctgtggagaagttggggcagggaaagcaggcgtgctgcccagagctcaagtgcacggctcagtgaactgttatacaaaccccttcaagcctcccacccaccgtggctttccccgaagccttttctgtcctctcttgcctacgttgtctttgctctaatttaaagagactgcagggcactgaaggccctggctgtccacttgacagtggtcacacaccgctttgcgtcattgcacggttcctctggtgtgtaggagagtctcctatgctcagtcagaagctccctgcggacagggcccacattccagacttctatttcctgctctcttgcagcttcatgctcagctcctattaaatattcaataaatacttgttaatttgattgattgcatgattcataaattgcaagtgaaacctccagttaaagtctcttaaggagttttttcaaggcactgattactaaacattttacaaaggggaaaacatctttagaagagaaattagggtactaactattctgggtctgatgataaaatcagaaacatgaacacaccatcttttccccaaggaaaccaggatctagagaggaaaacagttcacccaagaggaaaataatttggccatgcctacagtaaggctttttgctgactcgatgttcttatctgtaaaatggggtgaagtaccacctagatcatttatttcaaaagatattctgagggtcaagtgagaagtggagggatttttaaaggaaagacttcagcttagtgtaattgttcatttcctggttgtgacttctccctttgttgctgcagggacagagggctcctggtccacagaacacattccctcacactcatctgcctccttccctgttggaaaatgaagacttgcctcccctgtgcagtcaggaagtacctgctatcagggagaagggaggtcggggagaaggcattctccctgtgaaccaactctgcctaacagcttgcctatttttaatttaatctcatgccgtcctcattagcatctggttattattagaccataaccacaataataagtattccacttgtgtcttctatttgcagagtgctttgcaatcatttttgttagttagttgcagttcagttgtcctagaaaccaatatacacacaaacagaaagaaaaatggggtgggggttagggtaaagtgtctaccaggcagctcaatttgtctttgaccagcaggatgccaatgttcccttgggggcacttggagaagttagactaaggtaaggtaaaattttctttggccagaagaaaatctggaacccaacttggggatctctattcagtgggaacacctaaatgtacctgcaggtgacctggctactgccatccagttagttagttcagagctagccccatggttcaggatgtagagagagactgttctttgtcttgcatctggggcgacatctgaagaaatcgccttgtacataagcaaatgtacaactctctctctctgggagatcagtcaattacagccaattgagctatttcatttcggcttgcaaatggctttcagttacactagtagacacattaatctaataactaatgatcatatatttcactaatcatacagccctgcatgtggtataatatctaatttaatattaagacattttcacatgtgcatttttaccaacagtctagctcagagagccatgcaagagcagcatggcaaagaggaggaaccggcttccaggtggagggccggcaggcaggcaggcaggcaggtaggaagcgggcagagtccaggaggctgagcgctacccctctggagggggactcttctttgaggatatggaagaagatctgtgtcaaatcaggaccaaagctaactcataggaaggttttgtgataaaagcaccccctcccaccccaccaaggcagactcattggaaaagtggcccgttgccctgaactgacatatcctgagcccaggagactccgttgagcagcagagcatgcactgatttcagccccatttgggctccctcaccaggtgccctagttcatggcaccatccgggtaaccctagactgctgccctggagagcttggaggcagaataggaaaagggaaaacacagccctctgcagggccagctcaggtatctcatcctgtatctcttctgaaactccaaccctgcaaacagcaaataaccttgtttgggggctagcggaatggcgttactgcacagcatggggagggaggaggtgatactaaggaaggcctttgggtcctgggccaagtgtgtgtctgagctttgggtccttcagtatcagcttccagctgtcacctcctccactcctggctgcatccctgggagactggccatctgcctggtcattgcagtgactctgggattgttgtcctgggatggacaacctgtgtcactgttttcttcagggactgactgattggggtgattgagacctctttccagcccagccattctgatgttctgggactgatagtaaacaattctcttgaggcttagaggtgtgaaaagggccaatcaaccaggagcctggagtccaagcttgagcaagtactgatgagctccatgacctctggcaagccagtctacctctgagcctaagctactcccacttccaaggagataatgaccccctccagaactttaaagtggcaaaatgcaaatcaatagagggtactaattcacccttaaacaaaagagctgcctcatcaatacccacggacagctcccttgcatacagacaaaaggtgtgttccctttgggaacctgcactgcatcccctctccaggcatcatcaactcacatggctacaggaaccatgcaggtgggcactgagtgtcacaggagggagtggagggggtcatggcatactagggaagcacatcctgactaaagacagtcaaatttgaaaaagagaaaagaggtctgtagccaccactgcacagtctttcacaaagatccctacctctctgcaccttcaggtcctctggcagtcattgcccatcaccctggactcagctccaaacctcttcctggtgctcaagccatccccttgtttcctctgcagggaccctgcggctatgagacttttccaggtacaggtgcttgtgcttctgtgcccagtttctttgagcactttttttgtttgctacaattccctgttgcagttgagacagagactggtgaggagtgagaaatttaagaacacagcaggcagcataaagatgagcattagaggctgggcgcagtggctcacacctgtaatctcagcactttggaatgccaagggaggcggatcactcgagatcaggagttggagaccagctgggccaacatggtgaaacgctgtctctactaaaaatacaaaacttagctgggcatgatggcagtcacctataaccccagctactaggcaggctgaggcaggaaaatcacttcaacctgggaggcggaggttgcagtgagctgagatcatgccactgcattccagcctgggtgacagagcaagactctgtctcaaagaaaaaaaaaaaaaaaagttgaacatgagagagtctgaaaagccaaatgctacagtccactgtgatggcagagggagggcaggggtcagtggagagaagagagcctcagcatttcaaggcattaacccagaaggcagtggttgggctacatccataggaataggaccaagtgggatattggctcattcttcacatcttcagccaggacttaggcatcagtctgacttctgcttatatccatgcctttctgtgtgaccttgaacatatcacttcatgcctttgaacctcaattttctcaattttaaaatgagggatggcatggcatgaataaaaagcaaatgactagaggagaagagatcaaagagaaataaatatgctttgtgaggtgcttcgagaagtggtgatcaaggtctccccagatcttatggttgagttggagagatgtctagaaaacttctcatctataaagtgagagtcatcatcccagttccttcacggggttggagttaggactcaacgaaatgatgcaggagaagcatcttgtacattaactgttattattgttattactattgttgctgctgttagtcccaaccccatcaggcgtagttgatatgtaccatgtcagaggcaggaccaaaaaccagagtttgcttatgtaggtctggatacagcctacagatccagtctagatacagcctggatctggggacaacctatagatgtgctttttctgtagtttatacagtgtcttaaagaaaatttgagtcaacatttaacagagggggacatagtgttaaaaattgtagatttcttggaaaattaagatatataatacagtgacaatgggcctacactccatgtattgaaaactggctgggttcaggaggggcttccttgcggaaggaagctgtggcctcctgtgtgccccaacctgcatgcaccttcactgcagacctgctctatccatgtatagtagcatattcatgtatctgttggcttctggagtcttcagaatttgccatgtctgtaatgaatgcctttggagttcaggagtaaagttatgctttccgtcctcaaaaagaacagctacctgctaacagtcaagccaggctaggctatgctgctgtaacaagtgttcttaaaacaacaaagttagtgtctgtgtctctactcctcttaattactcagggacccagactgacagaggcttcatcttgacacacaaatccatggtcccctggcaggggcaggagaaaggaagcatggcacaccacacactggttcttgaaatgtcagcccagaagcaacactcattatgtcccctctcatattagtggctggtgcaagccatatggccaagcctgagctcatgggatttatagccctcctacaggcaggagaaccacataatgcagactaccaaaaagccataataacatagctcattgttccacagttttaaatttactacaggccaccagtccttttctctaaaatgttcctactccagtcactccctgaaagtcaggcatgaatagtcagttgccaggatattagagagagaggaagaaaacaggagcttgaggcaattaaagaccaacgtggcctcattcacagtggtgctaagaattggtcctaccacccacaactccaagagagaggcaaaaatgtgtggtgataaaggacaagcctggagccagaagtcctggctactggttctgatgctaaccttgctcttggctgtgaggtgttggacaaatcactttcccactcatggagtgcaagggcatcagtggttttcaaactgtgttcactgacaatcccggagccccaccataggcaggaggtgagggaaggagaaaggcccaggtgacagggaggtggttgcccaagttgtttcaaccagaacagccttacttttctgcattttgtgcattgggctgccaaaggagatttgctttggcaaagggttctattgcttggacaagtttggccaccattctatctggttggtgctctcttggctcccatgtgggaaagtttatgggaaagtcctaacagagaaagagctcctaccatcttgacccccaggaaggtgacccaaaggaagtgagagagatgtcagaagtttagagtttacagaagtagcaggggagacagttggagacacaggcagcaaacacaggccacatggtggagtttgaactgtatcttgatcaggaagtctttgaagtgttttaaacaaggaggcacagtcagatttggaactaagaaagatcaagcctgaggtatggtcacatggcccaggacactcctgaaacagcgcctccaaaatgtatctggaacaaacttttccctagcctctgcctccatctttctctccatgcctctcctttgggaggtgatgaggtggatcggggttcagaggaaagtagaattgacaggtaaacaatagagcctggatccccctgcaggctctcagctctttgaggacacccctcccctctttcccctcaagcttcctacaatgaggacaaggagaccaccccttgggggctcccctcctgctccaatcaattctcctcaattaccaacaaatctaaatgtgatttatctgtgcaagaatcattccaatatcacgcgagaatctatcaataaaacccccaaggcaatcttgcttagagttgtcaatagaagctctaaagcacaaaggcatagcagctagcaatcagggtatttttgcctccctcccccctttttggggagcacttaattaagtcgaccagaagctgtcaaagataattttcaaagcacatgacctcagcagctgacatttgataatattacattccacgttgattgaaattgattttcccctctttttgggggggatggagaaaaggggggagggtgaggtcacagaagaggggaggcttagatctctttcactgtggtactcagcccagaccagcaacgtgtggggtcaccacaggcaggctgttgggctctcctaccttcaatggaaccagggctgggcagctgttttccagctgagccgccatccagagccggtgggtggagctccacttgggaggaaagatacaagaacctggtgtgcaaggaccggaagctgacacacaaatagcacccagcaaagttgacggtatccaatggcctctgtttgctgggaagatattggcactagaggggcagagcacaatgagaggtggcaattggctggttttggttaagtttgtttctcacatttggccatttagtctataatggatgtgctaggtcactatggaggttggctttcctttgactttactgctgttagagaagctcattccagcatctccaaaacccccaccccgaaccctcctctgaacctgaataagggcatgccggcagtcacagtcttctcattactccaccagtgcaaatctctaaattcctcaatagacccagagtagtcctcatgcagacacccacccctcatccaaatgatgttcatcctcggagtaggctcagccttggttcttgtcctacagtgcgtgtgggatgctgaccatttggcttcttggtttctggatccttggcattaactcctggtgttgactgaccccttggctgaccagtttgtgtcttacttctggctctaggtaaaaaggaggtctctaacctctgttcccaatccttggtttttcatgtgttcctgctttgaagcactggctgggaccagaacactgacctccacactggacttagtgcatggacagggcattgcagactcaagatgaagttgcatttaagatctcaggcccctggttggttgtgctcttggcatatttgtatccctagcatggacaccttctttcctaggtttttgaggccttgggctgaggttttctttagagacctctgctaagacttcttatggagggaagggaaggaaaccttgaagacacttccccactacccaggattttccactcctagccttcccccttgacatcctccacccccagcgtccctaaaactaacagagcttttggtctgaggctcctcaacagtgagatcagccccacgtctgtgccgttccgagggaaaacagaacagagagagctggtatttcctccagttttagactcttgcttttaccactgcaggaagtgattcaaggcttaaccctttcatttttggcttgtcattttaatcagcctctctgacacctgacagctcagcaccctctcccagctcagctgagctcctgccaactttaacacatgagtgacactgactagattgaggcctgggaaaggcattccaggaaacgggtatggcataaaggaggtaagaggcacaagcagctctggggctttttcagccaatcttgagctggaggagataatagtgaagagtgtacagctacgaaggggaggggagtttagacttggtgcaggaggcacagggcccacgaggtcttggtcctattcatacatcctgttttaaaaaggaaaaacaagccattataagttttgagccagatgtttaaaggcagtgtggtccagttggaaaagtactagactgggagagaagacttggactttaagtctctgcaactagctgtgggcaaggcatgtcgcctttctgagcctccactttctcatttgtatagtgaagcttcagaggtgattgtgtggactaatggtgctatatatcaaaatatacagtgtaatgatagtaaatcttttctttctttttttcctcctccccagatgattggcatatataacttttcacatgtatgatgtccttctcttcgggattgctttcctaagagtaaggagaaagatggatatatgtttatggtaatggaagaaaatagtggctcagatgatccaaagcagtagataaaataatttagctaactttcagctgcataatgctattttatttttattgagatacattcacgttttaaatttttttatttttattttttattatactttaagttctgggatacatgtacagaacgtgcaggtttgttacgtaggtatacatgtgccatggtggtttgctgcacccatcaacccgtcatctacattaggtatttctcctaatgctatccctcccctagcccccaacccccgacagaccccggtgtgtaatgttcccctccctatgtccatgtgttctcattgttcaactcccacttatgagtgagaacatacagtgtttagttttctgttcctgtgttagtttgctgagaatgatggtttccagctttatccatgtccctgcaaagggacatgaactcatccttttttatggctgcatagtattccatggtgtgtatgtgcagcaatttctttatctagtctatcattgatgggcatttgggttggttccaagtccgtgctattgtgaacagtgctgcaataagcatatgtgtgcatgtgtctttatagtagcatgatttataatcctttgggtatatacccagtaatgggattcctgggtcaaatggtatttctggttctagattcttgaggaaccacctcactgtcttccggtaccaaaacagatatatagaccaaaggaacagaacagaggcctcagaaataacgccatacatctacaactgtctgatctttgacaaacctgacaaaaacaagcaatggggaaaggatttcctatttaataaatggttttgggaaaactggctagccatatgcaaatttactttttaatacttcttttctaataattaccactccatctataaacattttatctctaaattatacaagaggtaaactgtatacatgctttcagacagaaaccatgtgagtcagggtaggcctggtgatgttacattaagaaacagcccctgcaaactctgtttattatttcttgctcagccatgtgttcaacaggggtgaacaacgggttctatgcttcatagtcatggcgggtcccagactgatggagtcgctaattcaacacatgtttgcatgattgcagagccagggaaaagagagagagtgaatcacatactagctgttaaagctactgtccagaagtgttacttactcctatagtttcttggccaaagcaagtcatacaaccatgactaagtccatgtggcaaagaactgctattctactatgtacttaagacaagaggaacaaacataagaccaagtgacaactgttggaacccaggtacatagtggttacacttgggagcataatttcaactgtgtaaaatttctgaaatcttggtcagagcctctgaagaagagtaaaccatgattaagcttctttcctttgacttttggcaaatagaggtcttactatttgcagaagaccctttgggtgcctcatgtcagatcctgttggcttatttccaatacagatgctactttgagaggcagttccaggtgagctcagacacgtgctggcctagttccatcttgatatggttttcctatgtccccaccctaatcccatcgtgagttgtagctcccataattcccacatgtcatgggagggacctagtgggaggtaattgaatcatggagatgggtctttcctgtgctgccccgtgatagtgaataagtcttatgatgtctgatgcttttataaggggtagttcccctatacaagctcttttgcctgctaccatgtaagacgtgcctttgtttctcctttgccttctgccatgattgtgaggcctccccagacatgtggaactgtgagtccattaaacctctttcctttataaagtatccagtctcgggtatgtctttattagcagctgagaacagactaatacacacctcaagcacacaatggtttccacccctgggccttctccagcaggaattttctcaatcaattaaaaagtgcatcacagaaatgcaggggtgttatctctgagatgacactcaatcaatgatgggagccagtagataaatattccagccttctatccttcagatggaattctctatgattctcagcagacttgtgggctacaatgcctactgcctatggctgcagccttgaccatgaccccttacgctggctttttctcctttcctgtcccactcttcctgatccttcactccttggatcacctcccaaataaataacctgtacccaagtttttgtctcaggctgtacttttgggagaacccttcctaaaataacaagtcttcagagggaaaaggattgcatatatctgctcaaaaagtgtagggggtgaagaagcattgttggaaaagagaggaaacagcagaattaatttagtcctatatcaaaacaagtttacattctctgatgctgaggtcaaggggaagactgggaaagggaagtaaggatgtccatttgaggtttaacttgtcagagcaaatttacagttatttgcaagtagttatttgggaggtaactgaagctagctatctgattcaatgttgtaaggaaaactggggatcaacctaccctgtccatctcctgaagactagagaagagaaaggccttgacccttggctgaaaagtgtagttaagatctctaagatttcttttcctggcttcaagggaatccttgactgtgcaaagcaggtctgggtgggagtttggggtaacaaacagagcatctctacataaagaagttagagaaatggattttttgctctggtgagagaaagccaatagaaagaacaaggtgaagggggaagagtgcagcgctactctggagcctgagttgtagagatggcctaggtccttttgtagttactattttcttcttaatgtagaaggatgtctggtattaatttccgagtagcttgttttcgtagaattccttccacctcttcaaatactcagtaaagtctactacacgctaaatgccttgtgttcatgggtatgcctggaaattaatggaaattttattctgagttctgagccaggtaaactctatatccaatggagatagctggcttgggacagcaaagtgttctacaaatgaaacaaattcaaagtatttggggctcagagatgggggtttgcagaaatcttgggaaagggttggcctttccctagcctatggaaagaaaacctgagttagtcttaccatgaccctaagagagatgggggcctcaaatgatatctcagttactgaacacatgaagaaaggattcattaacctatcttggtggatgaggaaatagtgctcagagcagctgtataaattcaacacttatttctttcaccttacagaatattttgctaagtgcctgtggggtgctagacttagactgtgagtgacattttaaggcacttatgccccgaccctgcccttacatcctgcctaatgggctagggcaaaatcaaatgtgcactctggcttgctgacatcatttggggacctgtcaatctcatagcctgctgcctgtaccttttcttgtgttcgctaagaatcaggtgctcaacaacagctaccttcaaaccccagagtggagcctctgctatgcccaaatgagtaaagttgatggtttttaaccactgcactagattcaactacttgctgacgtggccattcctagcttaatgtggcctataagcctacaattagatagagatatttcagaagctgagactaatgggtcctgacttctgggatgctgatgaattctgtacaactatgttaactaattcaaccacagtttctttccttagtcaacttatcaattggtgactatgtgttggcttcctactccgtggggagggctctctgttgtccactagggtgaggtgatgagactgtgttaacagccgtgattcaaacaggtagtttgaatggaaacattagaatggaaataattaggctgagtgtggtggctcatgcttgtaatcctaacactttgggaggccaagcgggcagattgcttgagcccaggagtctaagaccagcctgggcagcatggaaaagccccatctctactaaacttaccaaaaattagctgagtgtggtggcgtgcctgtggtcccagctacttgggagactgaggtggttggaacacctgagctcagggagtcgaggctgcagtgagccgtggtcgcaccactgcactacagcctgggcgatgggagtgacaccctgtccttaaaagaaataataaaaagaatggaaataattgagagaaaccttttcttctagctgatttgttgttccaaggccctgtcttcctcaaattgagaacagcaaacttgggccaatgctgcttctccacatgaagtcaacgcctatctcctttctccctgtcaacatcttgctcattgttcaaggcccagtgcaagtcccctctgtcaagaggactttcctggccctctcgcccttctaatttactgggcgtgtgtggattgttactcaattgttacttctgtctatgtcagtgttcttttgaacactgatccttggaagcgtcaatagacatcagtgtaaaataccccattctcagatgcatttgggaaaacatcaggtttaacaaaggtaaatgggcttctttaaagcaggatgactcagagcctttaatatgcccatatctgcacttattaccaggtgaccatatctagaagggggtgccactacaagtgatatcaggacgatcaacgaaaactgggactaccccaagtaaattaggacatattgttaccctaattaaaatctctccaagtggtgtttcccaaactcctcagaccaaggatccttttgtcaaggagcatatctcagggtactattacgtgaatcacagtttgagaaatgctggcgtgccatgtgacccaactagcacgtgtgcacctcaagagcagggcctgggttgtgtccatcttttcccccttggcagttccctgtccttctaatgcagttccctgcaatagcaaaattaaggaagaaaattacttctattttccttgggcatgtcaagtaagaggtgattttaagaggttttgatacatatattagatttcttcagagaaatagaaccaaaaggaaatgtgcacgtgcacacacacacacacacacacacacacacacacatacacacacacacacgagagagagagagagataaagattttaagtaattggctcataagattgggaagtcttggtaaatccaaaatttgcaggataggcagtaggctggtgactcaggggagggctgcagttcatgtccaaaggctgtctgctggcccaactccttgctcagaggaggtcagtctttattctactcaggacttcaactgattggacaaggcccatctgcaatatggagggtaaatctgttttctttgaagcaccatcttaaagttcatctcgtcaagaaaaatatgttcacaggaacatccagaataatgtttgaccaaatatctgggcgctgtggtgtagccaaattgacacataagattaactactagaataatatgggaggttcacttcctttaattggggatgtgtttggagcaggggacccagctctagcctcaggagagtcatacagggttgagcacgtgtgatgcctgtaatgggcccactataatttgaattgaatgagggtctttggccagagaagagttatggaaaagcctggaaagggaaaagcagcagctctctctccttactgaggcaggtgtgagctttgtggaaggagggaaatgaagagctgtttgcataagggtcttgatgagacctcacggtgttgctgtgtcccaagtgacaaaccgagacacagaattgggggcagcagccctttcccacttcatcatggaacccagagtgagactgagaggaccagttttctcggtggggcgggtgggggtggcatgcagcaccagtgggttccctgcagggtgaccaactgtccatttaaagtaatggcaaaactgccattacttttgcatcagcctaataagactctcagttccagaatcaggaaagtcctgagaaaatcaagataagttggtcaccctacctgagggtctgcagctctggaagccctaagagacagccctttgggcatggatgtaccagctacccaacacagagcttcagcagtaaatgtcacagagattctgcctctaatggcttcttggggagcacatgcagagacgagaaaaggagtggatgacagaacatgagctcatgtgggacaaccccaggagatcccaaaaagatctgggagccactttgaaggcagccggagtgtctgcatcatgcagtggaaggaggaatttgagtaattgctgttcatgttactccatttacacccacaggctggcgaggcctggggaaactcagattacaaattcatgtcatcctgaggaaagttccttcaaaaaccaagcctctggtctaagtgcgaggtatagccctcgaaatttttctacacctgtttgttccagtaaggtttattcactcactcactcagccagcatttactgagtgccctctatgtgctgcgcaccggccacacaaatccttgcagatctcacagtctacgagggaagacagtggaaaacagcccttaactgcagcataggtggtgaaatttgattttagtggagtgctgtggcagccctgtgtattgctgtgtggtcacaagacattcttctcactggcatttataaaagggtcactttattcctgcacattgttagtgctgctaagtggatgcattggaaaggaattttatgctaaaacaaaacaaagaaaaagatcacctaggtccataaacatcccacctccctgaagaagtagaaaatggttttggagccacattaagtcccctactggggactgttttccaaaagaaagaacatggctcagattttccggagcttactgctaagctcactggttacagcagaccctgcttggtgcctattcaatgtccatcctcccattctttatcatttatcaaatttaaatttattcagcatggcaatgtgtctagttaaaaacactcacctcaatcagagtatttccaaatcaataaacactagccaaatcttggaaataactgttctatttgtctcagagagatggggcataaggaatattaagatgtaagttttattgcttaatatgtgactaaaggaacacattggcatattaatacctaacagaataaaacaattgagaaaaagttattagagagtgtatctgacatcatgcactaagttttaaaacaaggaacggtctgtgctcctgttattttagtgtgcaaggaacagaggtgtgcctggaaggaatggagctgttatcagtcatggcttaatgtttgctacagtccacacaaagtaatgtgacacagcaactgggtaggtaagaatattaacaacaaatgactggcatttattgagtcattttatacaaggcactatgctcatatctcatatcattttaatggaatcctgtaagttagatgttatccgcataaacacacacacacatactcatgcacactcacacatcctcagcttccccaggccaatgagacttgagatgatccaggaagtttctgatgaagtgtttaaggagagcttgtaaaagagggcagactcagctgctaaagggcattatactttttattcccccattccctctcccattcttctggcctggaacttggatctggtgcccattggtggagcagtcaccttgcaagtttaaaaaccaaagtcacatgctaaggatggtgaaccaggaagagagaaggagcctgttccttgaattctgcacctgggctacctattcctaaactctgttacaagagaaaagtaacatctaatttggttaagcactcattcaggttgtctaatctgtaaccaaccacccacatcttcatgacttgaaacaacaacagttattttgctcatgaacctgcagtctgggtaggtgagggcaaccaatctctgctctacctgaggtcagttgggagattagaggggttggagttatctgaaggcttgttccctctcatgtctggtgggtgacattgaccggtgactgagatctaagctgggactccagctagaattcctgcatgtggcttctccttgtggcttgggcttccttacaacatagtggttgggttccaaggtcaaacatcccaagagagtaagatccaggcacaagacgggttatccttcactacctagtcttgtacatcatgcagtgttgcctccatcaccagaagtgtggctatggccatttttgtaaaacacaatctgccacagcactcttatcaggtttctgttgcatgcagcggattccaacactgactgagcaggcatgactgccatgtgttccctgtgaccacttcacactttcctacctgtctctggtttgccgtgtgaggtctacagtgctactggttctcaaaccacctacagcagattatggatggctacttaaaggagagcatcctaaggtgtgaagatgctttcaagtcctgatcattagatatgcatcttaacatttcatctgttcacatatagaaagtgttttgtgacaggtataaaagaagttgtgactcctaagagtatttacagtcttcttagaatatcagtatttacacacaacacaattagcaaacaacatgcaatggtgagtaacatggttttagaaggggtgaagcggatcaagtgctatagatgataatacagtgtaacaatcagtgtggcgtgaggctaatcagggacagctccatggagtgtacagaggggggaaggagaaggaggactttcaggtaagggtctcaacaggaacccagcatagaagtgagaatgaatttggtgtgttcatggacgtggaggcaactgggctgattagatggtgcactcttttaggggagcagggaaacaaggatgaagggggaggaggtcagtggagacagcaggattatagataagaaatttcttatagcatcagatgtccaaagaccctctctctgtgtcccttcaaagagataagggaagtcggtctgtcatcttgaagcacaaggagtgaacaaagaatagttcccttcttcctcaagacaagagcaaccataccttatttatttatccaaatcccatttacagatacactagtatgttttaggcactgaggacattaaagtgaacgtaaaatatccctgatctgacctcaaagaccttctagtctactgagtcacgcatggcagaagttgggctgtcactatgatgtcatagtgtgaggggtgtgatggtgaggcaggcataaggtggagatagagcactcactgcagcctagtgtgggatggaggccaaggaaggtgccccagaaagggggatttctaagtgagtgttttgagggactaggtcccaacttctcctctagctccttgatggataatgagttggccaaggagtaggcactatagtggagtagaaagagtcctgccagattgtgaattgggaagcctggaatcttaggtatatctttgtctctatgagctgtgttaccttagaaaaattactttccctctctgggccttaaatgtcctccttcataaaaatggccaatgacctctaaggtcacatcgagctcaaaaattctattgtcagatggtttctctgaaaggaagttatgtgaaggtgcttaaggaatgcatatgtttagttaatttcataacttggcttcctatgtacaaattacggctaccccaagagagacccagttctattaaaagcctggcattcgttttgatcatgcttagaaatactgcgggatatcatcagcaatgcacatgaaacctctgctcactcatactccagacagatgacaaagtgataagcagaactaattccccagggcaatatttcttcccaaagcatagatatgggtgaattattgccattcttaattgcctaatgatttttttcccctttcatgtaatcttttcggggggttgtatttttaccatcttgcaaattcatattggcagagtgatatacattgtcgaataaaacacagtggccaatccatcaaaaatcaggctgcagttgccttgagatttttggaaagagtctacaaaaaaggggaggcagagaggtggggagagagggtgcttcagtaacatgggcgatcgcttcctggctgttgggtcagcagttctcacggctgaccctgggatgggctgagcatttgaatctactcccaagtcttttccttctgggttcaagttttggctcttcagggcgttagccttattagccgcagctgtctggggaactcagaaggcaattaggccagggagtgagccgtataggggattggtaatggaatgtggattcttttctccctgacttaattgtttgcatctgaccagaaatcattaccagctgatggctgcttggtggcatctgtgaactaaagtgggacccaatggagttcttaatatgtgatgagagagggttcttgggagagacctcatagacagacagcttccttagctccgttgatggcgaggagagtttgccctgaactaatgtgtcctttaagaggtgatgttgctagtgtgttgcctcctttccactttccatgatgtgaggaccaacaacaattgctggaagatttggtgatgtgacacccacaagtccatggcggactctaagtggttctcagcttttgctgcacattagggttagctgaggatcttttcgacctctttttgcttcacccaagattaattacatctgaatctctgagggtgggacctgggtgtcagtatttttacagctccccaagtgtttccaacatgcagctaaggttaagagccaccacagtgggaaggggtttcatcatcactcacttggaaacagtgatcttgaatttcttcactgaggcgggtacaaagaaagggaataaggaagaaaaaagtcaggactggggagagccctgcaagcaattttctcaacatgattttgagacccactatgtgccaggcactggactaggtgctactagggctacagctggaatgagacagtgagtcaccatttcctggaggatacaagtagctgatctcaacagggtgccaagggtgcacagaaaagttcctgattatttatgatgagaaaccagaatctaaaggaggaagagaggcagggtgaacacagagtgttctaggccagtgctggccactaaaatataagggagctacatatatcttttgacattttctaatacacatagcaccatttttaaaaactaaaaggtaaaattaattttaatagcgttatttgattttaaccaggtatatccaaaatattatgtcaacatataatcactatacaaatcattaatgagctattttacacttttcatactaagccttcaaaatccagttttgattttatccttatagtgcatctcaatttcgactagctacatttcaagtgttgaatagctagtcactactgattttcagagtcagactggttagcactgacttagacagagggacgagtgtgtttgctgtgctgtgtgttgaggaccatgggaaattcactgtggccaagcacagagtgagggtcatggcaggcgtgcccaggtatgtgatggccaaagtgtaaaaatgaaaatcagggctcctttttcaaatgctaccaagaaatttaaatgctagtcatggtggcacacgcctgtggtcccagctactcgggaggctgaggcaggaagattgcttgagcccaggaattctaggttgcagtaagcagagattgcatcattgcactccagcctggataatggagtgagaccctgtctcacaaaaaaaaaaaataaaataaaagacagataaaataatttaagatggtggcagcagagaattaaaccaagctgagggcaggcctgagtgactgcacaggttgccccctcttgaagtcagtcctgggtagggcaggcactgagagaacccatctacaatgatttcctcctcctcctgcttttctaggggtggaagcaccatcttgatccagtatgcctcttcccaagtgcctcaggaggacaactcctccccagccccaggggaataaatcaacattgccctaaatcctatccacgtaatttcattccctttgcttgtgactgatttataatgtccctgtgattacccagaggatgctgagggaatgaaaattaaaaccacaataaaataccactacacattcatagaattggcaaaaatttaaaaatgtgaagtggaaaaaagtgcaagcaaggaaaaagaatgataaaaattcccagtgacagtataaaatattacaaattatttggagaaagtttggcatctaataaagttaaaggtatgcatatcctgccactcagtacttccattcttaggaaaatacacctcgggaaatatctatagtcatgctcgtagcaccattccagtgtatcagccaaatactggaaacaacccaaatgtccatcaacaatagaatgaatacactgtgatgtattcataccatagaatattatacagcaatggaaatgaacaaattactactgggataaattagttttcccacttttggcctggctgctttatagtgatggtctgaagcaaataacttctccagccctcaatttttcatctgcttcatattttggtatgatgcaagtgagatgaacatgttacaccgtcactgtggatctagccttcctaaatgagcactttgcagcctgcaggccatctggcagctttcctctttgactcagggaaggaagcctgtgagcaggcctccaccactgcggttggaaaatccttaacattgattctccagaggagcttgaaacagaccaggtgattgtgcacactaggaacagaaagggattgagccacaggaaaagagaacttaatagaaaactaagacagacaaggagaaaaatagaggcagaagaagcccctttctcagagaggaagtccaaacagggccatgatgatgctagtccatctgaggccaggccacttggactcatggggtctgcaacctggggaggatatatgagggcatgacttagacagtgcagagcagagaccaaagcataatcaggtagatgcttactcatcccaggaactcctcctactaacagaaggaggaagatggggtcgagcccttgggaaatgggaatagcagggactagctgagaaaataggacccagctaggcagctgtgttctcacagcaaggcctcagatgtcaaagcatcagaaatacggaaaataaaaagcatgattaatgcagttgggatggtggatttagtggcgggatctcaagtctttgctgaagcatagtcctcctcctctgagttgtcttggcactgtatgtgctgttctgcacccctcacaggctcttccatttcttgccttgcattggtgttcttggttgttcataaaacagttgacatggcaggccagagacttgtatcttttgcctgtaaaaatagcccttgtctggtgtcttgcaatttggatttcaggagtgttcttaaccattcctaaactctgcctaaatggtttatacaaataatgtggttgtactaaatacctgctttccttctgggtctggaattacagcatgtgccaggcagaggatgtctatgtgaccagccccccaaaaaaccttgggaactaagtccctactgcacttgcctgatagccaacatttcacaagtgttgtcacaactcactgctggaggaattaagtgtgtcctgtatgacactcttggggaaaggactcttggaagcttgcatccagtttcccttgcccttgaccccatgcatcttttccctttgctgattttgctttgtgtcttttcagtgtaataagccatgaatatgactacatcctgggtcctgtgagtcctccttgtgaatcactgagcctggcagtgttcttagagatccctaacacattggtatactggtcttacttatctcaactgctttttaagcttttgcactgcgagcatcaggcatctcagcatcctgacaagaatatcagactaagaaccagaacatctgtctttgaagctctgtttctctacttcctggctgtatggcattaggggagtcaattgtctttgttgagtactccttagttttctcattgagaatggatatagtgatcatcccccacctacttcatagtgtattgtgagattcaaataaaatgatgggtgtgaaaatattcccaactcttaaggcataatctcaatgaaagatgaccataaatccatacactcataccatgccttggataaggtaaacattctgttagtttccgctgaatagataaatcaatgcaagtgatctcattcttttctctgctatggtttttgtactcccaaaatctatatgttgaaacctaatcaccaatgtcataatgttagatggggcctttgggaggttattaggtcattaggttattaggttccaccctcatggaagggattagtgcccttataaaagagtctccacagagctgtcttcccccttccaccatatgaggacacagctagaaggcaccatctatgaatgaaagcaggccctcacctgacaaggaatctgacagtgccttaatcttggacttcccagcttctagaacggtgagaaatagatttctcttgcttataagctacctagtttagagtattttgttatagaagcccaaacagactaagacactctccagagtccatagcatgtggcagaattctggacattggaggaataaaagaaacaattttcaattgtcaggatagaaaaccaaaaccaaaccaatcgccaacaccctagtgcagtgttcctcccccacaattccattcttcttcattgacaatccttgaccatggggtagtgcttttagagcctcctaaactcccttaaaccatttgcttttgaactccactcatcagcctcttgtcagccaccaccagtaggaacacgaaggccttaattgatcaggcacggcagtagccttgagaacttgattcaggtattgacttctgaggagccagtttcactctggcctccacagctaggagcagctgaacatcaaaactattaacctctagcctgagcagttggcgaggcagcccagcagcagtaattaggaagtcaatcggaatcgcctgtctcacttacactggcatgtcaatcaatagcagcggtgacaggttcattaggcccaggccatgcaagcccagcctgtaacaacctcataaaatacaccaacgactcaaggcagagagaaatctgcccgaaggactagagtggatgacaatatgtattgattagggctccagcaatttatgaagtgctacttgttggccaacctttctgactcagtgctaaattttcccaagtagttgcaagatgaaaccaaatattaccctttaaaaaaatgaaagcaagctgttgtctgacagggcattttttacattagttactcctagcaaataatctatcggggtaaaacttcaatagttacttaaggctgaagcgatacctttgtctctgtgaccatcagactttgaaagaagtctgcagaagaaaaaatatgatttgacgtgtgattaggcaagactctaccttcggagagacagggtgatttaggcattcatttctacttggcatttttagtggctcatctgggttgtttagggcgggggtggggatggctgacacctgggttttcagggctaatttaagagctctatagaaggagggtggggagggggtgtgaaaggattcctctggctccatccctccctcatggctgacactgcttgaccacatttgctggagaccttgcttgcctctaaagcctgctgaataacagggcagttattccgagactcatccagtctgtccttgaaaacaacacaaggagggggtgacatgttcactgcgcaaccagacttacgtgtcacctcactattagtcctgggaaatagccagaggtttgtggctagccaaatgtctcctaagattgcttctgtctttggtggtcaaaggcacacacatccacacctatgcattcattatcagaaaaaggcttaagactgctttacatttgaaaaaactccaaaaattcatgacatgcccaaagctggtccctgtttggactgtccccaaaggagtgtgcacactgaagacagagctggtggtcagagtcaggttagaagggctgaattcagtccctgttttgttgcaattagctgtcaccttgagaaagaccccctacctcactaagtttggtttcttcatcaataaaatgggataaaaatgtcactgtttctatccaacatggttattggaaatcacaggtgaaataatggaacagaaactttttttttgtaaaacactgtgtaagtgtaaaagtaggtatatagggagaatatcaactgtgttcatcccatctgccaagtagaaggggaggttccaaatcatgacatggaagttgagatgttctctcctaatatcttaaggacacgcccacatcaatcaatccacaaacatttattgagctttgtaagatactatggttgatctttacctccctctcttctggtttcagttacaggaactcactaacagtgtggagagggaaaacactggtttttcccaaccaagtcccaaggcacagatctttatgtaaaaccaatcctcaagcaggattctcttttgtcccctaggttccaggaaacttgcttatttgttcccatcccccaatcctgccccactgtgggcttcacttcctctctggggtttcttttctttctttcaagaagtgcttgccattttcccagtcaccatctttgcatcctcttcaacaaacacagaaatgggaatttaattgcgagtcaccaagaaaacaacaaaatagcacaacaaaaacaagacgaaaacaaacaacaaaattcaaatgacatgtcctagctgaaattgtcccttatctgtttggatctgttcagtggggccaggccaaccttttcattgcctcctccctggccactctttccctgggcctgtgaattctcatgttcttgcctcgcagatctgccctctcagttctgagtagattcaatgctcagattgaggttagtggtggaattagtttggaatagctgctagggctggagagattctcagtcttttctgagccctgctgtccaatttagtatttgtgcagtccccccaagactcttcctcttgccccataattataatccctgaaaaagatatcctctccagactggttttttttgtttgtttgcttgcttggttggttggtttgttggtttagttgtatttaaagtgtattaacaagcttgttgttaggactgtttctacctgtaggtgaagcctggctttttggacccatggacctaaatgggcttctagacctggtctttctaggagccatgtggtctgatgggggagagggagtgtgccatcttcctcaggcttgtctatgtgacctggggctcttaaccagctctaacagatagctgcctcttctgctttcaaaatctctctcaagttcctatttctggtctgagaggccttctgtttagagctcactggacaagcagataataattaacatattttgagcccaaaccctgcctgtttagggttcaccagccattcatctcccaaggtttatcctctgctttatcacttagcgcaggctctgccttctgtcctggagggaccccttccaagtccccaaatggaggcaagtctttaccatctgaaaacacatgaagcaataaaagacaattttcgccaggggaaaagcagccccagttgtgctctgtaagcctacttttaacctttcaaagcctttccatacccttgaccttatcgcttcttcgtttccttatgaggtatggatggtaacatgttagtccaggggaaagacaatgggaattgatgccccagcagggccactgtgagagtagcagaggaggccatctggacattcaaaagaggcctgttctgacttctacccctcaacttccctcacttctgatgggcctcagttttgacctcagtgaaacagagaaatgcctttatttttaaatatcatgaagtgcccaaaattattaaaccatgaaaagtatagaaatgtttagcctaggtactaccatttaaattattttgctgtttgtatttgtatgccataagagcagtatttcaagcaaaaagttttatgttcttattcatccatgtactccagtccccagcacaaatctgggacacaaaggcaaacctgttattttgaactggtctttatttataagggaaaggggaaaaagtggagtggacattttaatttttttaaaaggtcataccatagagactctctctgcctcccagcttcttacaatggcatcgtttgtcctgtggctcaggtttttgttgttgttgttgttgttgttgttgttgttgttgttgtttgagacagagttttgctcttgttgcctaggctggagtgcagtggtgcgatctcggctcactgcaacctctgcctcctgggttcaagcaattctcctgcctcagcctcccgagtagctgggattacaggcaagcatcaccaccacacctggctaatttttttgtatttttagtagagatggggtttcgccatgttggctaggctggtctcaaacttctgacttcaggtgatccaccctcctcggcctcccaaagtgctaagattacaggtgtgagccacagcgcccagccgtggctcaggtttaatttggaagataagatgagtcacgccttgggagagtcaccctcttttccgctagagccaccactctcagtcctctaggccacgtgttcctgccaacccattgcaatgtacacatggatatctgcaaggtgccagaggtgtgtgttttgggggattggagagggacaggagtggccccctcagcctgagagaaccaagcacctctcctgcctggcaccgtgagtgtccccatctcatgaataatcctacatatctgctctggcaggggcagtttgagagcctgcaagatgctggctttttaatgctggtttgcagcaaggcctgcaggagaaatccttatgctccaagacagagcaaccagccaataacgactttccttgcacctgtgcctgttgcaaccatttttatcattttgccacgctccattgaccgatggatttttttccagctttgcacttttttattactattatttctatcttcatcattacctccatgcctctgatggcatttagatatgaaccgcctatgaaccttcaagcccaattgtgccatgacaaaaatattgtcgtttacattctgtgccaaagtattatataaaaacacatcaacgaaaaggaaattcaggaagctgggagtaaagatatatagtcagcaaactatataacttctggcatattactgcttaatcctaacataattattctcatccttttatttgattaacttctaatggttcctcttggtgttaaaggtcccactctgatcatttgattttagtgtctgctataattaccgataatgttctttgcaagacaatctaatgataaccgcataatggcctatatgaagaaagctgcagggtttcaaagcttttgagtaatataaaatacattagactaacacaagctatcaacatgacagggaatgtttgatttacactcaggactatgttatagcatcgtggaatttttttcttttccttttcctttttcttttcttttttttttttttctttttgcagccatttacaataaatgacagaacagttggacaatctgcaacttgctgattgcaaaaaatgtatcacaatgtttggaatggtgcagtggcagctaggggagctctggggaaatggtgtccttggagcagggctgggacaagagccgtgggcctggcttcctgaggacagtgaacaaatagccttcccctgggtagatcagcccaaaaggtaaacccacttctctttgctcttctccttgcgtgttgcagatcccaacaactgagattctttctgccagtcatattcaccaggttagtggttagctattggctctgtttgggtagccaaagtctcaatcagttaactatttttaggatcaaaataataattagtttgttttcagttacttcgtctctccttcaaaaataagcaaatgagtgattacacggaaaagccagcctaaaacaaaagaacaattttgtccaagccctgccagcctgcagtcaacactgtcctcttgccagcccctctcctggccagtgccgtcggcagtcaacgttccagatttgggagcctggcacgtgtgcctcttttgtttgaaataaagtgatcagtcaccactctggccaaatgcagcataattgatggtgtgagtggatggagaaaatttcctgtcagaaaaaaggttaactgtggacatattacagccagggtctctgattccagtataatggcatttggacaaaagtagggcccgtcctttttatagcactttatgccccattagtattactgcaagtcccaggacctgcctgttcgggcacttaatcaaaagcaatgggttgaaaatcatgtcccagatctcctcatatttgattcattccttttagataggaagaagtaaaaaacacattactagcatccaaacagcacatgcattatgcgctaagcagttgagaaggctatcattgggttttatccctttgggtacttggatggacaagtactttcctattcatccattcactggtggaggcagccatatttcattttttttcttctgctgacagacaatccgttagttttccacagatctctcttttaaagacacattcatgtcacttattttaattgtaggcttcaggcagcaaagcccagaaatgtgcgctcatgtgcacacacacacacacacacacttacacacacacacacacacacaactggaaaaccactacttggatgtagctcctctgagagtcaaatctaataatagaagaggaacatttcttaggggaagaattaatttatacacttaattactcgggatccacttcaagctctccgtcttaacgctctttcttttggagagagtttttaactaaacacagagtgttctgacagaccctgaggacagcctgcctcatttagacagaggagcccggcctcttccacccctgccctcatagcccacgcctcaaccctcagggaggagatgagggcatcagccatggatcgaggccccgccaatgttcgtattgattgggacctgggtgagagaagcttcagctcagtgagctgctgtctcactcccatgctctctggggcttccaagtggatttcctgctcgatggcttcgccccagcataactgtgaaaaatgaaacattttttctatctgttcaaaaatgggggcaatagccaggctcctcgtcattcagaaggcctctgtctgaggaatgggctttttgttttgttttgtttttaaaaatttgttttatttgccaatatcttgctaaagagtggaagaaggatatagtcaattataaaattgcacagtatttggaaaggcttacctctgctggattaatgtgaggcaggagagttataatctgtttttgacatcatcaaaaaatggattagattatggtgtattatggagccaaacagatcagggaggctgcccctgacagccttatgggttgatctaacagactgggaacctgaacactagggttcccaaagtgagttccagctgggtgcagaaggagcaactttctgttccctgagaagttgctgatgcaggcctgcaattgtccacaactgaggaggataggagctttgaaaatgtggccaaatggaatagacactcagggagaggggaagaagtatgtgacccttggcccctgatttggaatggggacctgtttagcctcctggtttgtggttatcccatcggcctcctgcatatccctcccccgtgtcaacgtttagagttcagccattgtttattaataagccctgttaaatgcacacctaatatctgagagagaggaaacaacacaaaattaacatgtcatcacattaagatgaatttaggctcaatcttttagtgcctttatagactattttacttaaattatgatatcatgggccaggcacagtggctcacgcctgtgatcccagcactttgggaggccgaggcaggtggatcacctgaggtcaacagtttgagaccagcctggccaacatggtgaagcctccgtctctactaagaatacaaaaattagctgggcttggtggcgggtgcctgtaattccagctacttgggaggctgaggcaggagaatcgcttgaacctgggaggcagagattgcagtgagccgagatggcaccattgcactctagcctgggcaacaagagtgaaactccatctcaaaaaaaaaaaaattatgatatcatgttgaaaaatatatttcttagggtcttatatcccattatatatcaatataaactctatatgatacagagataattatttttaaacctcaagaaaatctagaagaaaattaaattgaccgtttatcaagcctcaggagagggatgaaaatgatttttctaagcttagaagcaatatagaaaccctcagaggaaaagagtgacaaatttgacaatatagaagaacaaaacacttctgcatgttaaaaaaaaaggcaaccaagagattgaaaaaatattagtagctactatgacaaagagttaaaatctttgttatttaagatgatcatactaatttacaagaaaatatcaagttccaataataagctaagaacatcaacataatttatagaaaacacaaccagtaaacaaaaatattgaaagatgttcagcttcactagaaatcaaataaatgtaaattaaacaaataaatgaaaatttaaagaagtaatccttctgtgtatttttttaaaaatctttttaaatgaaaattcttaatattaacaagagtgtcctgaatatttgttgaatattcctggtgatcttgtaaaaagataagaccctttcagaaagcaatccaaagtcataaaaatgtttataccctttgacccaggaatcccacttctgggactctaatctgtggaactactctaaaagataaaaaaaaaaaaaaaaaaaaaaaacaagttaatgtttttattgcagtgtggcttatagcaacaaaaatcagaaacaacccaacaccaacaagaggtgcttgtctcacatccattcagtggaatattagtcaatcttaaaatgatgaccatgtggaaaagggctccatttactattagatgaaaatttagtatacaaaattggatgtaaacttggatttccagtgaaaaacatgcaaatatgaaaaaaaatagaaacacatcaaaaatactttgagatcactgtgcatctaccagaatgaatgcaatttttaaaaacaaagaaacatactgacctcaccaagtactcacaagtttgtgagcaactggaagccccatgcattgctggtgggatgatgctactacgacaaagtggtgcagccacttcagaaagcaactgggcagtttcctatgaagctaaacataaacttaccatatgacctagcagtcccactcctgagtatttacccaagagacatgaaagagaatattatcaaagagaatattcacatgcaaccaaaaggctgtatgtgtatgtgtaaagctgcttatagcaccttaatcataattgccaaaaaatgaaaataactcgaatgttcatccactgaagaatggataatcaaactgtggtacatccatacggtggaatgttagtcagcaataaaaaggaatgaactactgatacgtgcatcatagataaaccccaaaagcattatgctaagtgaaagaagccggacatgagaggctacatactacattattctaaatatttatatgacattttggaaaatgcaaaattatagagacagaggacagataaggtgttgtcaggagctttatgtggagaaagaagattgactgcaaaggagcacaaaaggaaacatttttgacgaggctgttctgtctcttgattgtggagttggctacatgactctgaatttattaaaattcatagaaccgtattcctcgaaaaaggtgatgtttttctgtacataagttatacctcctaacctggctgccataccccagaaagctatccatagttctggtgaaacagtaagattattatgggtgattcttttctccattttcagattttccaacgtaactttgaaaaacaaattatataaatatattattaatatatatataatctgtatgtctgttgctgtcataagggaggaataatccacgagtaggggcacatttgtctaaatatgtataatacttctattcaaagagccactgagcagaagctagcaatgtgaaaatcctttgcaaaataaaatctcagaaccaggaggctactctcccattggctctacctctctttggattttttaaagagctctacttttcacctgacctgactctagctctcaaattagcaataagtagtaaaggaaccgtatgcatttcattggaaaaaaaaagacttggaagtggaatttatctcagatatgcaagattggttaaacatatgaaaatatatcaatgtagtataccatattgaaagaataaaggaccaaacctacatgctcatctcaatagctatagaagatgcatttgacaaaaaatccaacaccctttcatgatagaaacactcaatatacttagaacttcctcaacctgataaacagcatctacaaaatactcacagttaacattatatttaatggtaaaaaactgatcaggaatacagtaaaaatgtctactcttgccaattctattccacgttataccagaggttctagctagggcagttaggcaaggaaaagaagtaaaagttatcagattgaaaagaaagaattaaaattatctctgtttgcatgtgacatgattttgtacatagataataatcctaaaaataaaactacaaaaacccctatgagaactaataaaagagttcagtaaagttgtagaatacaaaatcaatatataaaaataaattctatttctatacactggcaataaacaatcaaaaaatgatactgagaaaacaattccatttgcaatagcatcaaaaagaataaaatacccaggaataaatttaaccaaaaaaagtgaaagacaaatgtagaaaattaaagaagatctaaatcaatgggaagatccaatattcatagatcaggagacttctttttaagatgtcagtattctccacattaacctacagatacagcacagtctccatccaaatactagctatatttttgcataaatcaacaatctgattctaaaacttatatggaaatgcaagggacccagaataaccaaagcatgaaaaagaacaaagttggagaacccatactttctaatttcaaaacatattacaagctatgataatcaagactgtgatactagcccattgctctatgtatcaacagaataaaattgagagttcaaaaatcagcctttacatttatggtcagttgattttcaacaggggtggcaagattcaatggggaaagaatagtcttttaaaaaatggtgctggatgtcctgacgcagtggcacacacctgcaatcccagcaatttgggaggttgaagcaggcagattgcttgagtccaggagttcaagaccagcctgggcaacatggtgaaattccgtctctactaaaaatacaaaaaattagccaagcgtgatggcacacacctatggtcccaactacttgggaggctgaggtgggaggatcacctgagctccagaagcagagcctacagtgagctaagatcatgccaatacactccagccttgatgacaggagtgagaccctgcctcaaaattaaataaattaattaattaaaataaaaattaaaaatagtgctgggacaaatgggtacccacaagcaaaagaatgaagttagtcccctacctcacatcgtaggcaaaaatcagctcaaaagggatgaaaggcctaaatgttagagctaaccattaacataaaattcttagaagcaaatataggtgcaaatctttcagaccttgtattagtcaatggcttcttagatataactccaaaagtacaacaacgaaaggaaaaatagatacattggacttcatcaaaattgaaaaattttgtgcttcaaagaacaccatcatgaaagtaaaaatacaacccacagaatggaagaaaatattgacagattgtgtatttcataaggaatttgattctgtaatatatataaagaactcttacaactcaacaataaaagtacaaataatcaaattttaaagtggacaaagaatctgaatagacatttatccaaagaagatattcaaatggtaaataaacatgacaagatgatcaggatcattagtcattaggaaaatgcaagtcaaactacaatgaggtctaacttcacatccactaaatagctctaataaaagcaatggatacgaacaattactggtgaaaatgtggagaaattgggaatcctcatacattgctggtgggaatgtaaaatagtgcagccactttggaaaagttgggcagttcttcaaagattaaatgtggagttaccatatgacccagcaattccactcaaagagaactgaaaacatatgtccacacaaaacttatacatgaatgtttatagcagcattatttataatagctaaaaactggaaacaacccaaactctatcaatagatgagtgggtaaacaaaatttagtatatgcacataaaggaatattatttgtcaataaaaagggaatatggttctgatacatgccacaacatggatgaaccttgaaaacattatgcaaagtgaaagacactgctcacaaagaccacatattatgtgattgcatttatataaaatattcaaaataggtgaatgtatagagacagaaagtagacgagtggttgccaggaactgaggacagtgtggcaaaaggaatgattctgtgggtacagggtttctttttggagtgatggaaatgttctgaaatcagatagtgttaatagttgcactacttgaacatactaaaaaccagtgaattctacactttaaaggggtgatttttatgataaatgagttataccaatcaaaaaatgaatgaatataaaagacaagaaaggaactagggtgggtgggtggagggttcagcgcaaagtgtatctaaagatctgacaggctgtgtactaaagaatcagctggtactaaagaatcagcatcagcttcagagttttctagccattggacttccctgggagcaatagagaggtcatgggatgggcattgtccaggccgccactggttggcgagtttagactagctttggctgacctcctgatctctgtcgcctaaagcaaactgttcctctatatttcagccactcacaggcacacatcactgactgtgcctgtattgcaaatatctgagcacacattttttttttctctttgattataaagtctttaagtggaaggactatgccccaatgtgtcaactcagtcacttggacacggtagatgtgtctaaatgttaagtggtgaaaaccataaagtaggggcaatttctattggtgtatcttccttctatagctctttctcaggggctccaggggttcctcaacctgctccttgacatgtccctggtgacctgagggttctggatgtggggtgacactgcagggaggggctcagtttaagccagtgtattttcctccctggcatagtgcctccttactttggatgactgcatcccacatcatatcaaagattacaaatgaactcattggtacacaaatacatggaatctcatttatatttaactatctgagttgagttgtggttgaatagttggcaaaacaatacactctgcaaacatttgattgaagtttaattaattttgattttgcaattttcttattttagaacctttttttttcaagtttgcaaaaataattttacaggctctcgcaaagcacttcattcagcccaaggcatcatgttgcccgaggcagcatattggatgagagtccctgctttgtaggcactgtctgggaacagatggagaggcatttgggggaacatggagtcgctcctgggccgtagaatttctcctctaaggcggtttgcctactgcacccacgttttgactactgcacccacgttttgactgggcctgtccctttaagtggtaagcagccccctggcccagcacctcagagaaccccccccccccccgcagtgcccactccattgcctgtctcagggcccaatgctgcccagcagtggcatagaagtgggacacataggtgttgacaaagattaggaaagatcgatgaacacggacgcagattcattcccagctgctgaactaatcagttggttttcacatgcactttattcccctgtcatatcagccacaaatacctgctttaacgcttgggatcagtcctgcgccagccaaattgattatattatttggtttgctttaggaggagaaatggaaaagacctttgccctcccctatatatatataaaatataaaaaaagctaaagcaaaaacaagtaaaataacaattgcaggttctgtcggagtagaagaaagagcctgcgtgctgggttcagataatacttttgagaaattaaacgaccatatcatcctgagtcttggtctccaatccattggtccatgagagcaagaggcccggagagaagacaagggtttctctagacctcacgagcacaagtagaaggaagtgaatccctgggctagaaagtggctttgcttagaaagaggggaaacaagcaggacacagtggctcacgcctgtaatcccagcactttgggaggccgaggcaggtggatcataaggtcaagagtttgagaccagcctggccaatatggtgaaaccctgtctctaataaaaatacaaaaattagctgggcatggtggcgggcacctgtagtcccaactacttgagaggctgaggcaggataatcgcttgaacccgggaggcagaggttgcagtgagccgaggtggcaccactgcactccagcctgctgggtgacagagcgagactctgtctcagaaaaaaaaaagaaagggggaacactggaaagataaacagactccaaagggagagaagtggaatacaagtatcttgggaagaatcatccaggagtataatacaatgatttccagtgggcagcggcagtggcagtggcagtggcatcatggaggaactggtcctgcacataggtgcaggttacctggtcttgggggctgtgatggaggcattccttccttgggaacttacaggagggtacccatttattctaaaaccaccctgctggaaggaagcagtgaaaacaagcagtctggtctcctttatttatacaaaggataaattaaggatcagagagaaaagagacttaggccacatgactcagtaccaacagagccaggactacaattcagatctcttcaatcccatccagggctcctgccatatgatcattcatgattcagggccagggtgactccacaaggtcgtgtcagcccataccacctatttaagctgtagaggggagtgagccacctgtctcttctcacctggagacaccctctctggtcctaagtaaccagccattggttgtaaccccctggaggacccccaagaagggaagggcaagatgtgaactaaaacaccaaagtgttaacatcagaggcctgtctgctcaggccctgacagggagttgatgggattcaggacacactaccccaaaatatgaggtattttgagaaaatttttctcgggatttgagaaaacagcagaggcaggaaggcctctctaaccttcttccttaaggcaggccataaaagaaatccctcctccaaagtaggtcataagacccccatttgagaggcaccctccctgtatctaaagaaaagaaatatcctaatatctgaagacacaaggttgcagagaagaatctgaacaagtaggccttgctaaattccttttagtttattaccataagatcatacccgctttgtccaatcacacttctacacaactgtctgctcgtcatcaaacctaagtagagtcatgggctgagtaatgacttttcagtcaatgatgaaccacatatacaatagtggccctgtaagattataatggagccctagagaggtgtaccatttaaaatctgctatatttttactgtgccttttctatgtttagacacacagataccactgttacaactgtctacaatatttagtaatgcaacttgctatacagggttgtagcctgggagcaataggcctatcctgtattctagatgtgtagtaggctgtaccatccaggtttggggaactacactctgatgtttgcacaatgatgaaatcacctgataatgcatttctcagaacatagccccatccttgagtgacgcatgactgtataaaaatacacaggtttccttgtttctttgggtcttcatttctgaaggctcccatgccatgtaaaatttacattaagtaaatctgtatggttttctcttgttagtctgtgttttttttatagaagcctcagtcataaacctagcgatgggtgaaaagatatattttttttatcccctacagaacccacaaaggcttctgagaaagggcaggtgtaccagggcagaaaaacaggagtgtgacaccagtgcataaggggcaggctgccctggtggctcatctgagagcctcatgagccggcccaccctctccaaattccatttgaggagtaggaattctgtggtctagtcttggatgcagaccagtctctgccttccagcagtgactctgagtctctggacctcaattgctcacctttgaaatgagtgagcaagagtagacaatatctcccagctctagagcagaatgggtctctctggtcttaggggtcttctttccttatcttcaaataaaggacaccaaattctctactgactgccatttctctgtagctctaccctgccttcctttcttggtaggaaaactttttgtaggagttgttgaagcctgtgtctctacctccccaccccatattctctcttcagtgccacctcatgactgagactattcttgccagagtcaccagttactttcactggccaaatccaaaagtccttgctctgttcttacctttcctgacttttcagtggcgtttaaaatataatcacttcttccttctttaaacatctgtttctcttggcttcccaaatatcacaccttccaggtgttcctgctgtctaccctgccgcctttctatgctaactcctcctcctcttttgtactgactccaaaagttagagtgctttgggactcagtccttggccctcttctctcctttatccactttctctcactcagttcgatggctttaagtacctactgtactcaatggctactgaatctatatctgcagtgggagaattcaccccagactcttgcactctttcatctcaaccttctcttttcttcttttcttttctttttctttctttctttctttctttcttttttgatggagtctcactctgtagcccaggctggagtgcagtggcacaacctcagctcactgcaacctccgcctcttgggtcccagttcaagcaattctcctccctcagcctctcgagtagctgggattacaggcacgtgccaccatgcccagctaatttttgtatttttagtagacacggggtttcaccatgttggccaggctggtcttgaactcctgacctcgcgatccccctgcctcagcctcccaaagtgctgggattacaggtgtgagccactgtgcccggccccttctttctagatgaatagctagcagtcatcttgaattttacatgggccaaagaagaacccttgattttctcccttaagctgctccctagtcctccccatctcagtgcataaattactgtccactccgtgcttcacatcaaagacctagaagttgtgtctgattcctcgctctccctcatctccacatcctgaccatcagaaaggcctccaagttcatctagtgctagtttactctcagcctccacctccacttcaatatcctccagactggacttcctgcttcctctcttgcccttccaatccattttcccacaactacaaatcagatcaagtcacttctctgcttaacaacatggtatcccttaactcttagaataaaattcacaatccttagcatggttttcaatgggtgacctgaaccagcctctgcctccatctttgactttgtctttcacttgggccaaaccatttttgacctggacctttgaccattcttccagaccttcacatggtgggctttgctttagtgttatattctctgaaatgccttccctggccatcaaactaaaattgtcttttgcatcttcccaagtctctgcatatcacttgtgattatctggcattttttatgcttattcatatgtttacttactgtctctatcccccttactagaatataagctcccaggaggcagggaccttgtctatataattttctgccatatccctaatatctagattagcatctggcatgtggaaattgtgtatttagtgcatatttgttcaatgaatgaataaatgaatgcatgattatctctgggagtggagtttgggaatccgtatttaaaatacattcggcaactaaagtcaagaactactatgcataagatctaatgtatttcccaggtaggataaagcaagattttccatttctaaagattatgatgggcaatgcttatcctaaaggaataaatctccagtagtccaattgcaagtcccgtgacttatgttgaaaagatatgggtctagggctctttgccctgtgtttttgaggcacagaagatggttatgtttgcttccccatgttactggccctgcctttagctcaacagctgggagataaagtgcctcctgtcttccttgaaaggaatcaatagtaagaatgagtacttggctctctccaaaaggtcagcttgacacctgagttctcaggctactctcttgattcctcctccccattaatggggaagccttctcctgcctggcagacaactttctaagaacaaatttataatccgattctgagaaatattatggagattaagatagtatctcagggttcatttggtttggccccttgaagaatgggacgtaggtgcagagcaaaggtcagcgtgtgcccagcacatgtgagcatgggtacaagaagagagtgtaggtagagatgtgtgttagcagtgaaatgtgccacaaatgggaaggattctctctgcatggacatacgtggcactatatgtagcccatgtgcctagtggtgggtatgcagaggcacgagcagataaatgttggtgcatgtgtttacatgtgtgacacaaattagtgcatttgcatgtgtactagacaatgctttgccagagtctgtgaccacgtaaccatgtgactccaagcagtcacttaattttcctcatctgtagactggtacagctaaccaaacctatgcattttgcatgtttgttgatgggaataaatgagatcatggaaggaacattctttttacaggaaagctaccaacatgttacttagattgcaaatcttttcgcatgtaacctcgggccacacacttgcctgtggctacccacagtcgccgccccacccctcccctcagcctttcagtacagggatgccccgttcaagaaaacctaatatacaaaagcagaagtcccaaacacaagcgagacaattaacctgcggggcgaggttaccaagggcgggctgggatcctgtggtttagaaaatatctgggccccctggtccagcgccccacccccatcctgtacatcccacctcttgcaaagccgcggggaggaggtggattatcttttttttcttttttctttttttttttttaatgaataggacgggctgtgggcgcctggcaggccccatctgtccgctgccccaactcaatttgattcccattcacccgcctttgtttgcctcctttttttgatcagcaatgttgtggggggtgggagtgcaaaggcttaatgttctcgacggcgtgatggagccccgacccctcccagtcccccgcccccttggccgccgtggcccagcgttcctagaggtgagggtccccgcgctgcaggccggccctcaaccacgcggagcccaggctagcggggagcggaggcggtggcagttagcaggccgaggggaaggtgctggttttttcgggtcgtggggcctgggtggctgctgcccccaggatgggatcaaaatgcacctaccagtgacaggggcctctctactgcgcggggagagggaggcgcccacaacggagcttaatgggagccacccggatttccaagtggttgggaactgcacatctggaggtggcacctctgtaaaccatttcactcccttttaaatagaaaagataatagagcagccccatttaaaaactcacccataatcccatagcctgagtgctaaaaccattttggaattttcttatgatcactggtggccagttttgttgggtgttttttgtttgtttgtttttcgcgggggggggggggggtgtggttgctgttttggtttgttttacaaattgccatcctgagtgaaagggacctagggaacttcagaaggggcttgacaaagtgtcaccagcccattttatagatggcctgcccagagaggaaagagcccaggcccccagactcctggctcagggttggcattgcagctagggtcaagattatggaagattgagggagtcagccagctaccctccaaactactctccagtagtttgccaaagcctagaggcacaggtaccagctcaacaggaaagaaattaactcccagcatcctctggggagctgaggatctaaaatcagataacagcagtaaagattagtccagaagcctccactgtgtgggccatgccagtgagaggcaggaaggctcagtttaagacttacgttgataaatagggctgtgctgtctggtattttggggagaacccatttctgcctggcaggggacactagaatgtgactctgcatctcgatgtgcagtttttcatgggtcacagttggcataggctacagctgaaaactctaggcttcctggttatccaacagctatctccaagcaacttttgtcttcaaggagttcatatcctcaaagaaatgtaatacctaggcccataactataggaggtggtggaaagttttggagccctaacaggtacaggcaatgggccatggaaataggagatggtcacagggaaggtttgatggaggaggagactgagctgggtttaggtggaggagatggggctctgggaacggagcctggagacacttttgcagagaggtgagtcaaagcagaagctgggacaaagtcaagtatgtattgtggacagtaactggaaaaaggtccacaatgcaggtgccaaggtgatggggcaggtgacctgggtcagggggcagcaccagtagaagccctgaggtaagggatatgagcattggctgcaagagggttggtgatccatttggttgcccagcattatcaggagcctgaaaggaaaaatgtcttttcacatgaagacagcatttttcacatacttatgggtgtgtgtgattgataaacatacaaatgcatttaaaggcattatcacattcttaaaaaatttgatcattctcaattttctcagttgatcgatgctattctcaagcggagtccttgaaatttacatgaaaaggcatccccccacatgaaaaggtccttagtgtttctggagagagtcctctgagccttgcctgtgctcagaggagagataaaaaggatgttcatacctccaggagataagactcaaatacgctaacaacagaaaaaatgtcatgagggaaagaatgaccaggtgccaaacccagtataatctaggggccaaatgacggcattatagacattcagaggagaaatctctgtgggtgggttagcaggatggggtttatgggcaagataggatttgattaatccttaaaggatatgtggtaattggataggtagatgagcaaatggcatatgtgcttctaggtaattatttatttgtgttcatccactttttttattttctgaaattaagaaatatggaaatataaagagaataatacaacagaggctggtgtgtccaccacccagaagtgacagttattaatattgtgtcaaatctccagcattgtgttgagtaagagaaatggagttgtttgagtggaatttacttcccctttttttctctccccacttcctgtcttgccaatccctcctgtgtcccatgaccaggctaccatcatcatggatttggtgtatatacttttaatatacttttacaatgaactgtgtgcctatgaacaaatactagcagtgtttgtgtgtatgtttaaatgaatgtaaatggtgtcatattgaacgtattgctctgcaagtttgtttttgtttatttattttgtattgaattgtgtgttggtggaatagtgttctttttacctgcaatgtggcattctgtcacatgaaaactgcacattttttttctacaataatactgttgcagtaaacatcttctacatgactccttgcacacatgtatgagagtttaagaggaattatgctatgctagggaatgcatagttttagatttatggttatatcaatttatattactcataatggttgattttaattagataatttcttttaaaaacacattgagtgtggaatggattatatttgtgcttctatatacacctctgtttacaaagcgtactgcaccaaagcagcctactttaatcagagatacaaacatatcatggttttggtgcgctggctttcgtatcagaaatataaacccactttcatttactaatgtttacaagaagaagaattttaaattgttgatcttggagaaggaggataaatgagagaataattcttgaatagtagacttgtgtctgagctatggatagaatctgttcattagactttggttattgtaaaaatgtgtataccacagaccaaccttcttttttaactctgggccttggcatatgtgtgtgtgtgtgtgtgtgtgtgtgtgtgtgtgtgtgtgtgtgtgtgtttataatttgccagcctcatccttattgaatatccatgtatccagtacacacacatactacacaagtgtatcattcactgatagtgaaggtcggagaatggcttgggcatctcaacaaaaccatctagatagcttagttctaatgggcacaatacatgcaaatagtagttatggggccacctttatgcttttctgagtttggtgctttgtgaatgttgtcttctgatacacctatcatcatgtgagttccactactgaaatccctcctatgcattagaactttcataatcacagaaggagcaagataataaagtgttatcttctttccatctgagtataaattcacttgtcatttctctgtaaagaagatattaatagtttctataaaataggacatggggtaattttctgaggtgggcagtgggcaggggagggcaggtgggaggtagttccagagctgggtatctggagttggataggcatgggcattgcaggaggcactgagcttgagaaacccaggctgaggatgagtattgcttgtggcttgcagcagaggggtagtgctcagaggcaaagaaggggcacacctaaagggctttcccttaaagggatgagtgtagaccactgctccaggcaacatggctggacaagccctgaattcattctcctaagtgaaagaaaaaaaatttcaggcatagtttagatctccactacccactgttctctgtggtgtacacataattttaaaacaattaaaacagctgggtggaaacttgaatagcagtagagggcatataactggtgagattattttatttaagtttgcaaaccatccatcctgtcagagggaagtccttcccaaaatcatactcttcctggcatctgaggcacgttcttctctttcaaagtatttccacatccattatctcagttgatcctcacaatacccgggtgaggtgagttggaaagatattgaggccccatttgccagaggttaaatggctttactgaggttttatattttagcagcagggccagtctagagtctggtcctctggatgccagtgtcacacacacacacacccccatgcacctgcatgcgcgcacacgtgcgcacacacacacacacacgcaaaatttggattttatagcattttttcacaaggctactcttcaacttaattgcaaatccttgaggccaaggactgtgttttacacctctatgaatcctccattaaaaaaatagttacttgtcaagttgagtctattccttcctttccagggttgccaagactcttgtgcatttccagaaaccccttctattagaggtggaggactttttaggatcaaacaaatttataaggcaaagcctcataattgccactcatcagcctagttcagacttccaaaattggcctgcttactgtgtgtcgatacaaatgtgaatggattagctgccactttcccaaacacctatcacatgccagtcactgctggaacggctgcccctagaaggtcatttggccctcaccacagtcctacatggaggtgttgctatcccagtgacatgagcaggcttcaaggacctgctgtcagctttcctggcctccctgcctcttctcttctgcaccagcttcccgggtcctttcacctgttcatcaaaccatcctgcttccctatacccctgccttcttcacttttgctgcacatgccccacttgccagtgtctatccttggtacccagaaattagcatgaaattagaaaggagcaaagccaaaaggcagccaactaaccagtggccaaacaaaccggtagccaaaaccagtggttggagaaacagaccaaactcaagaactactgggagaccaaggcagggcaggatagaacaatgctctgaatacccagagaaggcaaagccagggccactgcatggaggaggcggaggcctggagatgggctctgaggatgggaagagttcagacaaaaagaaaaggaagagcagaaggctcccaggctgctagcctgcctctcctcattttcctttttctgcttccaaccttgaaaccttccagacctgtctgggcctggaggcaagaggcggaacctctggcaatccttgggtgccttctcttctgcgtgtagtcgtctttgtcctcagccgccagagatgagaaatttagcggcaggccactctttctgttttcctgttctttcccttttctttcaaaagccagaaagagaaggaagatgggggtgggagggggcacaggggcttcctgcaaagcccaggctgactggctccgggaaggataaatgactccggtctccgcgccgctggtgttgcacaacttgtctgtgctggcttgagaccccggtgatccccttctaattgaaatcactttcccctgacctcccccgtaagcctgggagcttgttgctctctgcgccaacactcgggctgcggaggtcgggggaaatcctggctgggcaccagagctgcacgcacgccgcatccatcttccggccgcccgcgctcttggccgcgccaggtgcccagccagggtgggcgtcggggcagccccctggaaggcggccctgctggatcaccggctgcttggaagctcgcagcggggctgacactgccccctaaggggcattttggacatttcgtgggggggcttgttgattggcactacaaatgggggtgctactgcgcgttgggtggggataagcctgggatcggggacatcctgccccgtgcaggacaagccctcatttgcccagcacgaccagcaggcctgcagagatgaacagcctgcttacaattatctgagctgagactctgtttcacatataaatcgaagtatttttgcaccgttataatatactctggtgtttccaagaaggcaactaccacgtaaatcaaaggagacagggctctttttccagttcatctcattaagacatgtttaccatttaggcacattataatacttgagcaatggcaatataacacatctctctgtgtctgttatctatctgtctgtctgtctgtctgtctgtctgtctgtctgtctatctatctaacgatggatccattgtatgggagaaaaagtattaacgtttcctcacaaggtccatggctgacacctcatacaaaattgcattaacaagagaaaagcataataaatttatttaaccaaagttttacatggcacaggagcattcagaaatgaagacccaaatacccagggaaaactgtatattcttatgcttaggtttgaagaagaatggacagtcatgtagaaatgtgattggacaaaaaagggtataatttaatggtataactgggaggaactcagcttatttgttcagattcttcctggcttctccatgcagcattcctttcctctaggtatgggccagacacctgtcacatgtatgtcttatgacctatattcaggggaggtagacagagaattcctttattgccaactttcacacaaaaacgtgggagaaggtcagggaatgaccttgtttcagtgattttcctcagttgcgaaggtgctatattttgggggtatcatgttctgagccccaacactgtctgcctatctacacatctatatacatatatatacacacacctagacatatgtggataaatatacttacatatacacatgctacacacacctgtgtgtatcttaaatacaaacttatttattctgagtaggtatgagactcactgtcttctagtgaaaatatgcttgaatttacatagagaaatgcacactattttattataaattgctttcgttttatttctgtttataattatactaagaaattgtgatgattttttgaaaggggtttgaggtcttttagagttgagaaccattgtttttgcctttctgggtctcagtgtctgcaaaagacccgaagtgggaacaataagatgttaaaaaacagcaaaaatgtcacacaaaattatatccatataactcatagcccaagatgcagctgcagtgagaaactttgctgatcacagtccctagggggccccaggtcccaatgtggagggatatagagcccgggaggtagaagaccccttgggtagaggttgggggtgcataactgtgagcccaggttggaagaccaaaggccgtgtgcagttttccaagtgtgttatatgcaatgaatggaggtttatatgaatggagatgatatatattgcatagaaattgtatatatccaggtgagttatatgcaatgaatggagactttttcctcttttaaatgaccagagagagagagagagaaaaccttccctaagcacttagtgaccacacttagtgaccacctgctatgcaccaaaactctgtcacctgctcggcaaaccatatctttcttaattcttgctcctacccagtgaggtaggtatattatggttaacatagatgaagcagctggggctcattcagtaaacaaaatttgaactgaatctatttgactacaaagtcagtaggacatactggccctaaaaaattgccagtgggcttgtttttatttttacagattgctgatttaattaaggtcttctgtcttagtcagcaagtttagtctgtgatacttgtctgagcctaactcctttgatggtaaaggcaacacaaatggaaatttaaacatagaattcaaccaatataaaaatatttatatatttttgaaagaaataaaacagtatctgtacaagtcaaaaacataccacattcttggatgggggaacttataatatttcaatttcccccaaaattactttataaatataatgaaattataattggaattcaaatggatttttacggtattaaattacctaaaaattgatgtaaatgtctgagaaaggccaagaaaaacttttaaagaatagttggggagggtagcttgatttcttactaaatataaaaatataacatataaggcatgggactgacataggaatagaaaggaaaacccagaaagacctcagtggacaaaggtggtctgtttaataaatggtattaataatccatttagtagaaaataaagttgaattccctgcctcatatcaaatttttaaaaatccatctggagtaagtgtttaaatgtaaagtaaataaaaccatcatcttattataagaaaatcacttacacacatacacacatatgagatagatagatagatagatagatagatagatagatagatagatctccaaagggtcatggttgagggaaagaaatggtttttgccaagtcagaaaacttagaatgtataaagaaaatgataggcatattcaattatgtaaaagttaatataatattagaatggtgaaggatgcaataaacaaaggcaaataatagcttgaggaacagtttcaatgcagacgattgataaaatgttaatatctgagatatacaaaaagattctaacaaattaaaatggcaaacaataaacaggaagatgggcaaaggatatgaacaaagagtttagagaagatcaaactcaaatgtcaatacatatatgaaaatatgtttagcttctctagtagtcagataaacacaaatggaagtaacaatgagacatcatttccaccacaaagttggtaagttaaaaagagtgataatccctcccactgacagaaatgttggggaaaaggtttctcttatatatgattaggggaaatgtcagtcattatatgtttttagaaagcaactgctcaatgattatggtaaatgtgagttacacagacccttcaacctagcaatctcactcctaggaatttgttctttaaaaacaaaattccagtaagaaagtatctgttcaaagtcaaggatgttcacatcagcattgtttaaaactgcacaaatttggaaacaaaataaatcccgttggcagaggaataattgaataaattataggacaattattccatggaatattgcacagctcttaaaaacactgtattagatataacttcctgttaactttgaggggtattatgatatatttttaagtgagaaaagccaaatgcagagaaatgtatacgtatatgacctgttttatagtgatgaccttccataaattacatacatatgtttatgtatgtaaatgactatattagcatacaaatattatggaaagtttcaaaacaagtgatgccagcaaacatgagagaggaatgatgggggtgaggtatggtgtgtgtgtgttcagggaatcagagaggttaaaaaagataaaatcaatatgaatttatgtaaaactatatgtatataactatacatggagagagaaatttgaaagaatattcactaaatattaatgatgtattcacggattgaatattggtctctaccagttatcctcaaattaatctatagattcaatacaatcctagtaaaaatctcagcaggtttttatgtgcatccaaatgtatacatgcatatgtgtacattgacaagctaattataaaatgtattaaaaatgcaaagggcaaagaatggctaagacattcttgaaaaagaaaaacaagatgcatagaggagggcaggagggtatcttacactatcaaatatcaagactttaaaaaagcatttatttatttatttttttgagacagtgtcttgctcattcacccaggctggagtgtagtggtatgatcatggctcactgcagcctcagcttgctgggctccagtgatcctcccacctcaatttcccaggtacctgggaccacaggcacaggtgcgtgccaccacacccagctaatttttttgtatttttttgtagagatagggttctaccatgttggcctcagtctcccaaagtgctgggattacaggcatgacccaccttacccagccagtacttaagacttatgaagctacagaaactaagacaatacaacattggtgcaaagacagatgaataccccaatgcagttgaatcagtgtccagaaacaggcatgtggaaactttatttatgacaaaggtgaactgcagagtattagggaagggtttcttttcaataaatgatattaagtctattgaatatctgaatgtagaaaaatgaaatttgactcctatctcacaccatacagaaaaatgaattccaagtggattttggctgtcaatgttaaaggtagatcaataaagcttctagaagataatataggagaatttttttctcaaacatggaataggaaaataattcttaaatctgatacaaaacccactaatcataaaggaagaaattaatacattgggctacatcaaaattatgaacctcagttcatcaaaagaaaccactaaaagaagaaatttgcaatatgtaaaaagtaacaaagaattcacacccagaatgcacaaagaactaggaatcagtaagcaaagaccaacaacctaatagaaaaatgacaagagggctgaacaggaattttacaaaagaggatataccaatggccaataaacatatgaaaatgtgctcaattgtattagtaattttaaaatttcatgagatatacatcccctttggctaaaatgaagaagtgtaggtaaggatgtagaaaggaaggagtgctcaaaaactgctggtgataatataaattgatgtaatcactttggaaaactaattaaatgttcaatgtacatatacatgatgaaggagcaattctattgctagatgttcacttagagtgtgggcacacgtgaagtaaaaatcatgtacaagaatgttcatggaagcaatttgtaataatcccaaaccaaaaacacaaaatgcccaacaatagtagaatggataaataaataatagtatattcctacaatggcatatttacaggagtgaaaatgaacaaatgacagctatatacctcaacatgaatgaatctccatataatgtttagcaaaaaaaaaagctaaacataaagaaataatctgaattatttcatttatataaaggtgagcaagtaaaactaatttatggtgttaaaagccaggacaggccaggcacagtggctcacgcctgtaatcctagcattttgggaggccgatgtgggtggatcacgaggtcaggagttcgagaccagcttggccaatatggtgaaacccccatctctactaaaaacacaaaaattagctgggtgtggtggcacaagcctataatctcagctacttgggaggctgaggcaggagaatcacttgaacctgggaggcagaggttgcagtgagccgagattgtgctattgcactctagcctgggcgacagagtgagactccgtcacacacacacacacacacacacacacacacacacacacacacaaccaggacagtaataacgactgaggaggactgggagaggcactgggaggtggcaggaggacctgtagggagctgctcacattctctttcttgtcctgggtgatggatgcttgggtattcattttttaataattctttgggctgcatgtgtatgatttgtgcaaccttctgtatttgtgttgtacttcactaaacagggaaaaataattttaatggcatttactttaggtgatgagatttcaggtaccttttactttcttgaatgatttacagtacacctgtattgtttaatatgatccagaaaatcataaagcaatttatatacaaagagagccaaatatatttcagaaacacaaatatgttcatttaactagttgaactaaagctagatactctttcacaaaattagtttttttaaaaaagatcataaattgccatgtgcacacttttctcccctgctgggttattgaatccagtttggtcttgagaggtcacactctcaaacctctgctcctgccatgagtggactctatagcacccaggctaagtcacacaagcatagggtcacaggttatggaaagagcctcagcagaaaaccaagaggacttggctcaagtgctagctcttccagaagcttccagcagtggaacatcaggttggtaacatcacctttaggacagcaacactgatctaaccatgtcaaaggtttccctcaaatctgaaattttatgactgtgtgtcttagtgatgtggggtagatttgagattgttggagggaagtgcattgggcaatgccaacatctatccaacatctaccatgtggcaggtgccagagtgggcaccagggatacaccagtaatttaaatacacaaacatcccacccacgggaagtttacatttcagggtgggagacaggcaacagacagataaataaatgagtatgtaacagattgagaatatgtcctgtgctaaattctagctaagagggcaggataagaaccaaaaattccctgtaagacttggcagcaggaaggtaaaactggggacctggagaagaacagttttgttttttttttaatactttaagttctagggtacatgtgcacaatgtataggtttgatacataggtatacatgtgccatgttggcttgctgcacccatcaactaatcattcacattaggtgtttcttctaatgctatccctccctcagccccctacccactgacaggccacagtgtgtgatgttccctgccccgtgtccaagtgatctcattgttcagttcccacctatgagtgagaacatgcgttgtttggttttctgtccttgtgatagtttgctgagaatgatggtttccagcttcatccatgtccctgcaaaggacatgaactcatccttttttatggctgcatagtattccatagtgtatatgtgccacagtttcttaatccagtctatcattggtggacatttgggttggttccaagtctttgctattgtgaatagtgccacaataaacatacgtgtgcatgtgtctttatagtagcatgatttataatcctttgggtatacacccagtaatgggattgctgggtcagatggcaattctagttctacatccttgaggaatcgccacactgtcttccacaatggttgaactaatttacactcccacaaacaatgtaaaagcattcctatttctccacatcctctccagcatctgttgtttcctgactttttaatgattgccattctaactggcatgaggtggtgtctcattgtgattttgatttgcatttctccaatggccagagatgatgagtattttttcatgtgtctgttggctgcatagaagtcttcttttgagaaatgtctgttcatatcctttgccagctttttgatgggtttgtttttttcttgtaaatttaagttctttgtagattctagatattagccctttgtcagatgggtagattgcaaaaattttctcccattttgtaggttgtctgttcactctgatggtagtttcttttgccgtgcagaagctctttagtttaattagatcccatttgtctatttcagcttttgtttccattgcttttagtgttttagtcatgaagtccttgcccatgcctatgtcctgaatggtattgcctaggttttcttctagagtttttatggttttaggtctaacatttaagtctttaatccagcttgaattaattcttgtataggtgtaaggaagcgatccagtttcagctttctacatatggctagccagttttcccagcacaatttattaaataaggaatgctttccccatatcttgtttttgtcaggtttgtcaaagattggctggttgtagatgtgtggtgttatttctgaggcctctgttctgttccattggtctatctctctgttttggtaccagtaccgtgttgttttggttgctgtagccttgtagtatcgtttgaagtcaggtagagtgatgcctccagctttgttctttttgcttaggattatcttggcagtgcgggctcttttttggttccatacgaactttaaagtagttttttccaattctgtgaagaaagtcattggtagcttgatggggatggcattgaatctataaattactttgggcaacacggccattttcacgatattgattcttcctatccatgagcatggaatatacttccatttgtttgtgtcctcttttatttccttgagcagcggtttgtagttctccttgaagaggtccttcacatcccttgtaagttggattcctaggtattttattctctttgtaacaattgtgaatgtgagttcactcataatttggctctctgtttgtccgttaatggtgtataggaatgcttgtgatttttgcacattcattttgtatcctgagactttgctgaagttgcttatcagcttaaggagattttgggctgagacaatggggttttctaaatatacaatcatgtcatctgcaaacagggacaatttgacttcctcttttcctacttgaataccctttatttatttctcttgcctgattgccctggccagaactttcgtcactatgttgaataggagtggtgagagagggcatccctgtcttgccagttttcaacgggaatgtttccagtttttgcccattcagtatgatactggctgtgggtttgtcataaacagctcttattattttgagatacgttccgtcaatacctagtttattgagagtttttagcgtgaagggctgttgaattttgtcaaagttcttttctgtatctattgagataatcatgtggtttttgtcattggttctgcttatgtgatggattacatttattgatttgcttatgttgaaccagccttgcatcccagggttgaagccgacttgatcgtggtggataagctttttgatgtgctgctggattcggtttgctagtattttattgaggatttttgcatcgatgttcaacaagagcaattttaaggcaatgtgaggacagaagccaactggggtgcacggtggaaaacacagggggtaatgaagtggccatggtccacatagacagttcagaagcttttctggaaagaaaacagaaatatcaggtggaggctggagaagaaggcaacattaagaaaacagtgttttctggccgggcgcagtggctcatgcctgtaatcccagcactttgggaggccaaggtgggtggatcacctgagttcaggagtttgagacagcctgaccaacgtggggaaaccccgtttctactaaaaatacaaaattagccaggagtggtggcacatgcctgtaatcccagcactttgggaggccaaggtgggtggatcacctgagttcaggagtttgagacaacctgaccaacatggggaaaccccgtttctactaaaaatacaaaattagccaggcgtggtggcacatgcctgtaatcccagctactcaggcggttgaggcaggagaatcgcttgaacctgggaggcggaggttgcagtgagccgagatcgcaccactgctctccagcctgtgcaagaagagtgacagctttaatgggggaggcagttcttccatgaagacaggaggaaagagagaagatggcacaggtgcaggtcagactgaagattaggtggaggaaggatgagggaattcccatcacctgcttcgcttttcgccttcacgtattagatgagttcaacagctgagaagggatatgggatatttgagatataaatatatgggctatatgggatataaaggagaaggtaagtgtacttaaagagaaatagaattgctgggcagtgttgggttgaagtttgtaatcataaaatctcagtaaatactgtaatgaacttggaggccagcaatttctttcctgagaaacggagatagtaagacccaggccctcctcataccctatgactctgtgagtaacccctcaatcctttctggaaaatgctttaaaacccatgatcttattatccatggtgtcaataagtcttgcagctaagaagaagcttggggaactataagatctaatacaactggtcaaaatatcagcacaatctcaaatgagttgtgtggggtttatccacccacccacccatccacctacccacccatccacctatccctccatcccattccatttaatggactcttctaaatcatgtactggatgttaaaataacagcattctcattcttcgatgattagttatttggcaattcagtgaataaatttgttcaacaagtgtttgttgagcatccactattttgagctcagccctttgctgaggattgtggagaacatacaaatgcaaaatgaattctcttcattctcaagtagcttataatgtagacgggaaggccattcagtctcacattgtaataactcagtgtagaatacaagtgctaaatcatgtgcagagatcaggagctatgaggagggagctctgagaaggaagctctgtgtacagaagcacagctctggcagggaggcagggtttaagctaggcctgatcatctcagctcttatcttcggagaggggaaaaaaagattccaaacttgaagaaacagtgcagtattagagtgcaatcataaacataaaacattaacatgtaattcccttatgcttttgaaaaattacttcataaacacaaagtaaaatatttttccctttttattacctgacaattacatattaagaatttctttttatgtttaaaaacatatgcaagctggggaaggcagacgccaaaatgtaattgctttccttctataagaatcagatgtcattttcttccaactcgactctgaaaagagataggaaaaagcaaattgttgtgtacattaaatttggaaacatctgatagctttcctcaattaaactatttaaatggaaaaagattgctgtacagctctatcatatcccactgaataaaacctcagctgaggcaaattggcagtggcaggtaccaaatgcatcggcaataatgagattggacaacccactggaggtcattggtaattgttattatatgcaatattgcactgtcagaagaagaaaaaaacaactctgtagcaggcaaagcccataccagggactgcatgagttgggagtacttgtgaccacccagccagggtgacttaaggagtgtcaggagagctggaaccctgagtctcgagcccactcttcatgagggctctttcgtggctggctgtgcatctcagcatatggggggcaaaccacagcacattctatcagcagagatctgcttatctggcagctgagagcaaggtctcagcgggtggcactggggcagaggagagggggaagagacagttaggggaaagtgggaccctgagaagggacgtggaacagaagtcaagacaaggtttttgtatttgttgtgtgttgtggttttgctctgagctgaccctgattcaagctattgaaagttcatttccaccacacccctacctcaaccaactttccagatatggaggaaaagagaacaagaattcacttgtgttccaaggtttcaagtctccttctcaaagttcaaacttgagaaagaaggggtgggagttggtttgggctgcctcggacctaagcaagcctgcctgcctgcctgcctgcatacaacctctcctgagccctgggcctcaggagtaaaatcagttgctgcatagtcctgtgcaaatgacagccatacaccaacttgtctgcagtgaaacgatgggtacacataaatgtatttgattgccatttaaccacttatcagacaggttagtgtccaacaggctgcagcaggtgcatcagtgcccattgcactttgtctcttagattcaatcatgaggtcacttgaaacagaatgtgaccatttacaagggccaagagccccaaatgactgtgatgctgcagtaccttgttaaagaaggaaggagtggggagacccctcatggcccaggctgctgatatcatgaagctctctgaatacagttagagtaactctatcagaatcgttgccaattgcctcctgctctcaaagacatcttggagagtattctttggtgctgagcaagtgtctcagtcaattggggctgctataacaaaatatcatagattgggtggcttaaacaagacatttatttctcacagttctggagactggaagtccaagatcaagatgcagtgtccggtgagggccctcttcttgctttgcagatgtccccattcttgctgtctccccatatggcagagatgttgggggtggaggggagagagagagagagagtgtgtgtgtgttctggcatctttcttaaagagcactgattccatcacagggctcagctctcatgatctcatctaaacttaatcaccacctccctaaggccctatctcctaaacaccatcacactaggggttaggacttcaatatatggattttggggagacacaaacatttagcccatagcatcatgcttcctgaatttgtctaaagaaagcaacaggtaggtaaataaccctattggaaaaaaaaaaaaacgcaaagacaaaacacactaaaagctgaagggaaggtcaggaatcaggatggtatcctaatccaacctggaggaacactccttctgagctgcaggcattcctgggcatcatctggtcccatatcccactccaggtggagaccccccgagatgtggcttccaagacttgactgtgctagggaatctgctggggagcattgtgcaagctactcaggtttccaggctcacctctgcctattgagtcagatttctgggggtagtgttcggagacctgtattataaacaagttttctggagaattctggagcaggtcctccacaaacaagacacgtatatgggaaacactgcatccctgacagtcattgctggaagaatcccccaaacagggagtacacagatcacaaggaagcctgatctattgtaagtcatgtttaattgccacaaagttctttatgttgaataatatttgatcctctgccaattctgcccaaagttttaactcttatccactagatcagaaaggatgtatgcgtttaatcaccaattgtctatctcttcttcaaatgattactctgcagcatatcccagcagaaaaggtctacttccaccaagctgacaacccagtgggagaatctaggtgtaccctgagagagatgctgcattcatatacattcatttggatgacaagagttcattcattcattgattctcactgagcacctattccctgcactgagaactggtggtacacagaggaatccgaggagagactctgccctcgaggagctgacggtagaagaaggaagccatgcacttatgtaactcttgcccacccacccaagcgatttgagtaaaggaccaaggagggagattgagatggggtggagctgattagggatggctgcctggcagaggtggtatttgagctgggcttgatggctgagtgcgagttggatgtaaagaggtggtgttaccagtggagggagcaaggtgaagtcgggtgtctatgggaagagcaaggagtacagcaggtggcacagaggagcttccttacatgctcaggtttagtcctcttggtgaggaaatagcccttcttctctggtcatagcatcaattcctagatactagtgttgagaaatgcacctggcgcagtcctttacccttaaacaggcatcactatctttatttcaaagtcagcttaaggttgtttacgcctaaagagatctctttggtaatgggcctgcctagtcctacttaatattcatccactgtgagacgacagggcccctcttctgggccaggcctgcacacagggatcaatgaaaaagcctgatcctggcagctctacttgccttaagtcagacagccctgtggccagcccccagtgtttacggggcatctgttggctgccggcagtgagaaagtctgggttctttcctgcaaaaactctgattgactaaaggagaaaagaattttctggaaagacaacaggtagctcaaaaggttcggggtgggggtgggggaagaaatggttagggaacaaaaggtggcacagctcagtaaagatcaagccagcaggacagtctgcttggaaccctgtgaccagtatggtcatcaccaccctctaccgaaaccttggctctgccacagccactgagaacgacccatggtttagcccctctagagcccaaatcttggctggaagaggcaggcattggattggccaggtgtaggtcacacctctcatcagaggtaccagaggagcacatggccaaccaggagggacaagggtcactcgcatccacagagttagattaaagcacaggtgaatgcccaggacaggggtccagctgtgagaatgaatgatggagagaggaagggtgaaaagaagtcggcaacggaagagaaagctcttgccaactggacaggagaggctgtgagtcatgtgctggggtgtgctggggcgggctgggtcagggccttcctactgagtcaggacaacttaacagacccctcaaattcagactgaaggaaggggtggtccctgagtaaaggggcaactggggagactaagggaatgatgcccacctgccacctcaagtagcctgaggattcaccttgaaggaggaagagattcaaatgcataaaggaggacagtattgctattcatggccatcattgcctcccaaggagaatggaacctgcttaaggaaaagtcctttggtttcactaagtgtcttaatgcatttggacgtgcaaactaggtttgggactaggacctagagaaataggaatactagagggagaggaatttggagggcaacatggagggaggaggagagtgtagggagaggggccagaatcttgaagtggccagtgactactcctcctggaggtgtggtgaagaatggggaattagatgcaagatggtctatagttccagctactcgggaggctgagatgggagaatcacctgagcctaggaagtcaaggctgcagtgagctgagatcacaccgctgcactgtagcctgggcaactggagtgagactgtctcaaaaaaaaaagtttgccacatgcaacctgcctctgtctctctacacctccagtgtagctgctgcatacctggatgcctggtaaggtgggctgttattttagaatatgtcctgtataggcatctgcacattgaaaaaggaacggtgtccctcatctggttatatgcatagcctcctaagggcagctccttgggaagatgagatgatctggacactgaactaattcaggggaatgggaacttccggccccagatgcccatggtgtgatatatgcacttccacatcatgtgggcagagtgcagccactccagaacttctagccctgggagacccgcactgtctgtgtgttttggatgtgtaacctgaagaggtgaaagcgtgagcagaaaagggagtgcacctggcgggtttagagggcaaggtggagatgaacctcgttggctgtgaccaggtcccaacctggaagtggtgaccaagaagggtgaactcagagatctggacattgaagaccgggttaaagtgtccaaacactctgttaggtttcttattccctatgttaaaagataaacttaggcacactgaaattgtaatgagtttatttgagcagacagtgattcatgaattgggcagcactggactccaagtgattgggcttcacctgggggacaggaagggaaacttttataaggtgttcacagaagcaagagaaagaaaatacattcaataggttaaagtggaaagcttctagttagaggttattttggtggtttctgattggttaagcttaagttttgttttactgtttacactgagttgggctttgttttgcttacctagcattgggacagtctcagcctcatgacttctattagttttttttagttttttttaaacacctacttggccacaaaccccaccctactttttgtgttagctgtaaatagtaataatagtagcaaaaatttctatagcacttcctaagttccaggcatcatccaaagcactttacaggtattaattcacttaatataatcatccctatagctctttgaggaggattctaacattatcttcattttgcagatatagaaactgaggcacagtgaggctcctttttcttatctctcctggcaaatgtggggcctccgttatggtactttgtatcttttctatgtgtgcatgcattacggtgcattagggtatatctctgatgatgacagccaagtacactggtgctgtacagcagagcatacatacatgctgttaccgttcatgcctcatctcccccttcaaggggaaaacactagcttttcatctttgcatccccaaagcaccttgcacagtgctgggtgtatttagcagaaagtgtccagtcaatttttgtagaatggtgaactaaagatttctaagcagggagtgatgtagtgaacagtatttttggagggtctgccaactagcagggtggattgaaagaggagaggctagaaacaggactccacaaagttctgaactgtgccccatggcaaggacagtgatctgtttggagaactactggccatctggggtttgcctctgccctgcaggtacacctctgtctgagctcttggcctgggcttttttgtcttcctgtttcccagctttgcccaaccatatttcctgcctgagagaaaccttccatataatttgtgaactggcgagacactcagcttttggcagactgtaaagctgctgtgaagttttagttctctatcctaacatttggttcatttaattaagggctgaggccattatgaacacctctcaactatcaaagggcattgaaacaactcgcaaacacaattaaccttggccccaaagattaaaaaaaaaaggcaggcacagtgtggtgtttcactatttataatcaccagttaacaaagtatgcaattaagtcaagtgctgatgtagcaacacaagcccagtgccaggggtttgcccttgcctggtctttgcatgtgaccatatggggctttggactagtggtctccaggtggagggccatgttagaatctctaggggcttggggatgggggaaaaggtttgaaaacaaccataaataaaataaccataaataaaataaaacatatatgtttgaaaacaaccataaataaaataaataattttattttatttgggggatattattaaaacctaatatcttttctttttcttttcttttcgtttttttttttttttttttgagacagagttttgctcttttgcccaggctggagtgaagtggcatgatctcggttcactgcaacctctgtccccccggttcaagtgattccactgcctcagcctcctgagtagctgggattacaggagcctgccaccatgactggctaatttttgtatttttagtagaaatggtgttcctccgtgttggtcaggctggtctcaaactcctgacctcaagtgatccacctgccttggcctcccaaagtgttgggattacaggcatgagccatcacgcccggctaaaacctaatttctaaaaatgtaaactacagaaattaatgcttgagaaaaatctttctgaatgatgggaaattgttgaagacagaaattcccagagaagatgcccttctcccccagggatcttataaaattctctggaggacacaggagaatgttaaagtatcaaaggagagatggatgaagaaaaggttgaaaaacataactattcccacaccttaatctcacactgcccttggagatggggcctctcccatggaggttgtcacagaaaccctttctagaagtaacaatattcttaataaacacatttaaccctccctcactccctccctcccttccttccttcctgcctacctcccttccttccttctttccttccttccatcccacttgcatatttataccctatcttattccagaaagaatatgagatggataaatccctttggataatttctaagaggaagctccccaggaaacactgggatccatcaacatcctggttaacaaattactttttactatgtattagtcagtcactgacctggatgtgaaaagtacaggatgaataaaacaagatatctgtcctcagggaacaaaactagcctaaacagaacaaaagcaggaagagggaccctacacagctgcctgtaatccaaactgcaaagtactaagtgatgtggatcttatcgatcagggtgcttttggttgcaagtaacagtaaacgtaactcaaagtggggatttataatctcccataatgggaagtcctgaggccaggcagctccaggcacagtgtgaacccacttttgtgctttttcttggccccctgccccccacccatgtgccagggttttgatgatcctcaaggctacagcagctccaggcatcacttcccagcaaagtccaggaaagaagcaggcacatcactgcctgccaggtggggcctctgtttatcagtgaggaaacctgcttcagaagtccccaagcgtggcttgttggcctgatatgggcatgtagggtcctgcatgcatccctgaaccagcttctaactgaagagaatgtaataagcagaactagcttagaccaaccaagacttacctctaagtcccaagggggaggagtgaccacctgaacaaaatagacatgtgcccagagaaggcagggagtatggatgaaatgctggaaagtaccagcaatgctgttccaccaacccacagagcaggaacatggaattctccctgccagggtcagtaggggaggtgatctgatttgacctgtccgagagcacatgttctgacttctttttgggggcagggaataggacatttcttctaagtggaggaaatagcacgaataaccctgtggggagctgctttgcacagaaacagaagctgctgtggctgtagcacaggtgtgcattgggtgggggcaaacaggagaaacctgaatgatgatcaggaccagtggagaaaggcctggctgccaggcaacaagcagccgttattttaacccagaggttcagacaaagcaaggtattattggcatagtttctcactcagttaatggaggcattactgtagaaagatcaggtccagaaaatgtttcaagatgccgtgaccaaaaatatgtccttgggggcctgctggagggatgtggctagcctcagagggacatctttggcaggggcattgagtgtgatgggtactggtggtttatcagaatccttaaaagcacagactctggggtcagactgcctggacacacggcctgtcttcgctttctgctgctcaccttgcctcagttctctcacctgtgaagtggggataataattgtaaatattccatagggttaaataagttattcatgctggcatgtggacagccctctgtaattgttagctgttattgttgttaagggctgagaagggagtggagatgcattatcatgaggattctaatgaggaagcaagtggcaatttcgttgtgtggatttaaatttttttcccataaactgtagctgacagttgcttctaaatagaaggcaaaaggcccacagcttccaattacctgaaaattagcccacataccatctttgcctcaactgccaagtgacattcatggaccttccttttacctacaaagttgagtttgtaggtaactctacagatctaattggtaatctactaatattaattagagaagctcattagtttaagtgattagagctatgacccctacagtaaatattattaaagactaaagacctgattaaccaagattaaagtaagagagttgcaaattttcacctgacctaagaaaaccttttgctctccttctttcctgccctttcagagcttctctgttttccagacactataaaaaaccctaatgcttgcttgcaaaattagatcagtgtgggggttatcaaaatttgaagtccttgtacaattagcatacacagaagggatacaaagggaagatttcaaagaaattgacaactgcatacaatttggaaatgttctcactgattttgatttgcttaatttctaattaggacaaaaatttcaaacacacaaactattgaaagaataatacaaagaatacgcctctgccctacacccagatacccagttccaacaactgttaacaggttaccatatttacttcctctctctctttctggtaatcatttgaaaacaagttgcagatatgttgacactatatagcttcaacctatatctcctgagaatgaagacattctcctacttaatcgtgagatcatcattatgcctaagaaaattaacaagaattccctagtatcatctaaaccaggccttatccagatttctctatttttagaagtatgatccaattatgggtctgctagtattgtttttaatggagagaagtgtgtgtatatctgtcactaagcttatgaaatgtgtgtgtgtatagtgctcatgtatgtttgtgtgtgacgtgtataagtatgaatgcatacatgcatatatgtgtgtgagcagtgttttgtgtccacatgtgtgatgtgtacatgtgcttgtatgtgtacatgcatgtgtgtgtgtgcatgtgtgtattgaggaaggagatgctagggatcctgtttgagcaaaacgaaccaagatgtgccagaaagaagatgctttattattatttttttgcctaatgcatgtgaagaaataagagccaaactccagcaactgttgagcagaatctgtcttggctagggaggctaaagatacgaatggttttgttccccttgatagattgattcaggtgtccctctctcctgtcatcttgggagagctctctctgaaagggaacagtcacaaaagttctttctctgctgaaaagtggcagcattatcttctattttcctcgccaggcctgcagctgacgcacaaagaaaggtgtaattacaatgtgacgtgctgctgatcgccagggtctggaaattctgaaccgcttactctgctcagaatacatttcaatttggtgctatgaattttacattgaaatgagttttttctttaaaaccctagagataacagcccctgcacagaagcattaacaaattgctttgcaaatctaggctaaagtgagcattcaatttgaggaggtcaaatcaagctcaagtcctgaagcccaaagcctggtcgcagcaagtccaagttggctctgggatggatttgaccatggatttagtcttgctttagtccttgccacctttcctgggcctccctctgggctgactttcttggggctcttgcaaatgctcaaatgtctctgtccaagcttccaagggtttagggctggaaactgctgagactagaagccctggggtgaacagcccttgcttggctgtgcagtcagatgggtgagaagaaggatccacagaagcaaagactcaggcaagcccaggctgtggaccacagagagcatctctttccactcattcactttacagagcggacactgggtaagggctcaatggtgtgaccaaaggccccccactggtcactgtaatcatcaaaatagtaacatttatggagtgtcagcaatctgccaagcatgattctgagtactttatgttttctcatagaagggtcctaggtaggctgggcatggtggctcacgcctgtaatcccagcactttgggaagggaggtgggtggattacttgaggtcaggagatcgagaccaacctggccaacatagtgaaaccccatgtctactaaatatacaaaaatcagcctcgtgtggcggtgcatgcctgtagtcccagctactcgagaggctgaggcaggagaatagcttgaatccaagaggcagaggttgcagtgagacaagattgtgccacagcactccagcctaggtgacggagtgagactctgtccaaaaaaaagaagggtccgaggtaatcctctgtggtaaggccattattaccctttttcactttatattattatttttattattaatacatatatgtttttgtagagacagggttttgccatgtttcccaggctggtcttaaactcctgggctcaagcaatcctcccccatcggcctcccaaagtgctgggattacaggtgtaagccaccgtgcccaccccccacccctacattttatagataagaactcagaggcacagagaggttcagttgctcgaattcgtgcagcccggacatgctcacctaggatatttattggtgaccagcactctgcactttggaccacactgtctgcccacacttctgagctgtcctagccacaccaccccaagcctggccattcctgtctagttagaaatggcttcttcaaagtctagggctggcatcatcttaacccgccagcctggagactctcctgcccttgtgtccacatctcggacgagggaagcccctcatactggatcttaactttagtgaagatgtgttccagagcctcacccaatgctttttagagctgtcctcttttctttgaagcccaggccaaggaaaccctcggggtgctcatttgtcatgtgtttgccttgttttcttaatatttagcggccctcttccctcaccttccacaccaccattcacgtcatactcatgccctagggacaggggatccagaaccacagtggatccactctatgacatatcttgtagtttattgcacactaggttacaggaggaaacaggaaggcctggtggggtggaaagagctgcatgatgcctgaggttctgactagccagcgttgtgtctgcctcttaaagccacttctcaggcagccaagcatggcaacatcagtggttcctggcggcatcctagctggagggaccttggcctgaggagggggtggggaactacccacctctcctgccacccacagcactgcttctccaaagccatggagatcaatctgccccaaatgagcatcgggagctgcagtaaactcagtccccagggctcttgccatggagcctggggcagcctggggacccggattaaaatgatacgttttcaatttggccttaaacgaattcaccaaatcggcatcttcgatgtcaagtggaagtgaattccacaaatctcaatttattttatggggaagcgttattgatttttttttttttttttatcgtctgcttctccttcttcttccctcccagctgccaagcctcttccacctggattgaattgtttgatttaagagtggcagttcagaaagaggaagagatgcctctccctttccttccacacatcccccaccctgcagtgccacgaacatcccttcaagccaggagaggcaggaagggacaggcccaagccaggattccctggctgggctagagcagccttgccccatgtctccagcttgtctgcatgtgcccacactcagccagtttggtgcctgtttagagactgcatatgttgtcatgtcttttttcctgtgttgtgccatttgtctccttaaggccctacaggggccgccccttgttcctgcctcatgcccacacctgatgacctagcacccaaggccttgtaaaccagaccccaacctgtctgtccaaccatgtctgcgtctggccttccatttccttctggaacatcttttatttatgaaggtatttgtatcttcaggcccagtgactatcaggggctcagtacttgcttatgtactgaggaggtatgcatggtgacccccatgagtgccactctcaggccccatctttgcttatgctcctctcttccctttggcaccagcatgaggccccccccaattactctgccctgtgccagcccaaacttagcacacttccagcagagcaattgattccctggctctccccacctcaccagcccactcctcctaaagggcttgctctctggagcaatggctccatccttcactcagtggctcaggtgagaaaccctgcagtcatccttggttcatttctttccctcacacccaaatccagtccaattcactctaatggttccaccttttcataggcagaattgtggcccccaaagatgtccacgctttgatctccatgaacctgtgaatatgttcctttacatggcaaaagggtctctgtagatgtgattaagatttgtgtatcttgagatggaaagattattctggattacttgggtgggcccgatgcaatcacataagtccttaaaagcaaggacttttctaggctgtggtcagacagagatgacagcatgagaaggattcaataccctttctggttctgtaagcaggaggttctgtgcaagagctggaaagaagcctctggaagctggagaggcaagaaaatggattctctcctggggcccccagaaaggagcacagctcgacatcgtgattttagcccagtgacacttgtgttggatttctagcctacagaactataagatgacaaatttgtgtttttgataaccaccatgtttgtggtaacttgttataggagcaatacaaaacaaacacaacttccttaaatatgacctggaaatgacctctctcttccatcttccccctagtccaagtcacctagactcctgcaagagcctcctcaggcgtccttcctcccccaatccctgcaatcagctgtccaccagaagcctaagtggtcttttgtttttcatcttcttattttgaaataatttcaaccaagtagaaaacctgcaagaaaaatacgagaattgtcacgccttcatcacccatatccatccatcatcaacactgtgccacatttgcttggtcactctctctctctcagatcatgtccacccctacttaagcctccagtgggttcccactgccttgccctcctcctcatagccagtaaaggtggatgttgccaggcccagcccaccttatcctgtgttccctgtgcttgcggtaccctgcccgtttccgggccctccctccgctgccctctggctgtcatctgtgtgcctcggctctaatgtcatcaccttccagaccctttctgtgatcattccactaaagcagcctcctactccaccgcagctgctctttatggcgttaccctattcatttttttaaaacagcatttaccaggctctgatgccatcccattcatttactgcctgcttgtttattgttcattcactccctggtgtgtagctctttgggcaggactctgtccgcctcctatcctgaacttctagaacagcacccagtacatagtagttgctcaacaaatatctatggactgactgattttctgtgacacatgactgaaccctttttgcagatccaattgtttacaggtgtgtatcttttcttaagggcaggcgggattctttcatttttaaattctcccctctcagggctgggcacacgacaggaccccatctggatattgggggattttctctgaaagtgcgagcttctcggtgtggagggccttcctgccttccccacacaccacgctaacatccagctgtgtaatcaaatgcacccccgagggaggcccagggtcataagaatgccttccttctccctcactgtttttcttttagatttgtctaagtgctgttaactttgccatcttgtctgttttcctcatgcctgttgtggggtaaacacacagagagcattagccccatttgatggacgatgaaactgaagcaaaggcaggttaagtggcttgcccaaggtcacacaagtaattaacagcaggacaactcccctggtccctagcctggtgccttctcctgcagaccacagagcagcagcctcttgccctcccctcagggactgaggagcccaaacctgatattatgggcacaaagcttttagcagatgagtggagggcaggaagctgtgtggttaggtgagctctgggtatgtgtgtgtctaattgctcttcatttcctttcctttcattcacagagtcattcattcactcaggcagacactcattcacgaggcattcactgagcacctcccacctccttggctttctgtttggcgtagaggaggatgctagagaaggaggcaggggcctcacaggagcctgttctcacacatgggagacccaactcacatatgagaggcgatgaggtaggattggagaccccattctggcaggagaggcattgactcctttcagatgaatggaggaactcagcacaaagctgtgcacagccacaaaacactcacactgggattgactccctccatgcaggtaactacccccaagctccctgctgctgtcttctctaataagagaaccccttcccataccccactccccggccctctggggatggactgagcttctctacctacagaacttcccccacagtggccagttcacagggagggactgaagattgacccaaacctgtgcaatcaggatcctttctcagatttaaaacccatatatgagacagggagctctgtttctgggctggggagtggctgtgctcactgaaaaggagggagcatgattacaaacctactatgctcagtctcctacctccatgcttcaatgacaacttaaattccacaactttctgatcactttcagtgaggacaatcctgttcagttcaaagtataacttcaagttcagtttgaacagcatctgtttgcttctccccagtgcagtctgagagggtccccaactctcttgagggttgtctggggcaaggatgataggggtatgggattggggaggaggctggccaggctctgagacaacccagatcccttccctcctcagtgtccagctcctccaggaaggtcccagggagggagacaagtgtcccttgggtactacaggtgctggggagtcctctctctgttggctctgctgtttctctgttgacccctggcaggccgataatgcctcagccacaaccttccagatgctgctctctcgtgggccctcatgtgagttcccatgggctcctgaggggtctctcactgcccatttctctgacctgggagtgtcagctggctctgagttccatgtcttccagcccctccagctcgttactcccagaggaaagagggggttcacctcccaacctcccactgctgggaccttacagttggagagacaagatacacccatgtgaaatgaaattattcccttcccttcccttccccttcccctttctccttccccttcctcttccccttccccttccccttctcctgtctcccctttttctcacttctctcttttctatccctcacccatctcgcccccttactttgtaaagctgaattcatcagagttgccttcaaggctgtccccaaacacttccctggcctgttctctgtgatcatgtggttcttcaccttcatttatctatttgagtattaataggagggttgacatcctcaagtttggagttttattggggaagtaaaaataacacagatacaacaatcacgtacccagataaggtgacaccgcatcgtgtgcttccctgcacatggcagatagacagacagtgcagatcacaaggtgggtgctagagccaggtggcctgagttcaagcctagcattgccacgagtgaactgtgcaagttgggtgagatcatctcacctgtgtgcctcagtcgccttcccagtaacaggggtgataacagcaagtccctcgcatctttttttgtgagcattaagttaggtaatgtatgaaaagcactgagaacagatcttggcacataacagctactcaatacatacatgatgatgatgtgcagtgaagggcaaatacggttagggttgtagttggttgattctgtgccgagtgaacttgccatgactgtctgtggggaggggagctgccatcagaagggagggacagagcccctgggtggctggggcagatgtgccaccctctccagagaagtggggatgccaggaacacctttccctgcaaaagggccatctggccgcagtagtccagttggggaaagtgcccagggagtgcaagcagcaggaagacactctggtggcagtggtagtggtggccagaagtgggcatgacagtgggggtgtcagctctgtctccatgcccaggatctgaggtgtggaggggtggggagcctcccacaaggactcaggacagcagctgcaggggacacagtgagaattccattggcagtggctaaggaccaccctgcccttgcaggactcctgggcgtagggagctgacatagcatggccctgtctggagaagcctggccttaggatatttcttgacattaaatattttctatgattacctgagtctcaaaaagacatccaccttacccacagtacatgggagggtgaggcagagccaggtctggaacctaaatcttcaagacaaagtgaaatctaagcctccttcacccccaggaggtaaagctgtcttgggtaacaaaaaacagaaggcagggatagcgccacaggctggggtggcaaactatgcaggcatcccagtgcccgccagccccccagagctgtggctctgcaactgcatgtgtttacggagtcaccactgctacccgggagcagctctggagaaagccagcccacaaagcttcccacagcatctgccaagaatacacccgacataataatttctttgacctccaccacatgagtttctgaaaagaacaaaacagcatcattccctggcatttacagtttaaacctttcctattcaagtttctaacaaaaaaagccaccaacccattctggccgtgattaaaattcataggcttgctgcagagaacagatgcagaagcaattttaggccagtcatatcccaggtctgcaaaattaatttgacaggtttgcattaaagcactgatcaatatccactttagagcggcagaggctaactgagaaaaaataagtgaccggagtgttaccagacgagaaaaaatgaatctttgagactttttttccctctaagcttgcacctacatcagaagtcctgacctcaatccattgatcggctgcagttaacatgacaaaaggcccagcagatagaccatctcagcctaccagggaacaatcacccggatacactaaatgtttgacggagtgactggactgcagaattagtcttggctttccgaggtcggccaccagcccggtcttactgaatcctccccctccctcccctaaagccatttgcagagactcaacttttcctaaattttctcccacggatggtgtagggatgtggtccggggaaggtgggaactggctcaattcagccaccaagaaaaggaggcaatgaagtccaaatctttcttcacgcagcactttaaaatggaagcaccaacgctggcatcagcagagtccttcaaagaatttgattcagtggaggccaactcaacaaaatagaaagccccagatggacagccattggctgcacctggtaagaaatgggctccagctggctattttagtatcttcaggtgtataagggatgtaattaaaattcagagcatctgtcctaggcctccttgctttcctgttctctctcccaccacacagccaggtcacattttggcaataattcaacaaatcaaagatgagcacccagtaagaatgggaccttggtcaggcactggatacacaggaaagagcatctccctgggacctgcaccaaactctcaccttctctgtgagtgtcttcctaagggaagttgaatatttcctttcccagctcactcatctgctgcgacccatgtcattcagcacttggctaataaaatgagctgcaaacacaactacagatgcaatttaaacttttctagtagccatattttaaaaagtaaaaagaagcaagtgaacttaattttaatagtatattttatttaacccaaagtattgaaaatactatcatttcaacatagaatacatatgaaaatttactaagtagatatttggcatgctttctgttttggttctagtcttactgcacatttcagtttggactggccacattccaagtactcaatagccacaggtgcctagtggctgtcctgctggaagggatagagacagagactaacagtgctcagtctgggtttcattgctgacatccatagataggtacctcatcctatccttccttactcccatcctcctaatccctgacattaaggttatttaactctcattcatactaccagttgttaaatactttgttgttaaaggagatgtcacagtaaatatttgacatggagagtccagtggaagatatggccatgatctcacatggacacaggcagtgggcaggttgtaggctccctggggtcagtggcatgtcctggccctccatttgccatggtaccagtacagtgcctggcctttacagcaggggtccccaacccctgggccatggactggtactggtctaggcctgtcaggaactgggccacaaagcaggaggtgaggggtgggcaagacagcattacagcctgagctctgcctcctggcagattggtggtggcaatagattctcatgggagtcctatgagaactgcacatgtgagggatctaggttgtgtgatccttatgagaatctaatgcctgatgatctgaggtggaacagcttcatcctgaaaccatcccctaccctctgtccatggaaaaactctcttccatgaaactggctcctggtgccaaaaggttggggatcgctgccttagagggtccatcattatttaacatttataaataacttaccacatgccaagaactgccctcagcatttaataagtattaactcacttaatcctcataacaactctatgaggtggatgttgtcacaacccctgtttcacaaataaggaaacagatgaggtttaagtgattgcccaaggccttacagctggtaggtggcaaagcaggctttgaatccagcagccaggcttagagtccgtgcccttcaccctgcttctgtctgcctcttgttcatgttcatttatgttcaagatacatgaaggcataggattgccctttttcgggtaaccccagcagagttcccctaggttcccttctgatctcatgtcggtgcccaggctttggcattttaccaggtgtgttactgaccagtgaacttcataaacgcccttgtcaggaagctagcttcctcccgctgcagccttgcactatggaaagaacagttggcagatctgttggcctgagatagctgatccagaggcatgaagcacagcggcctggggaaggagccatcattctgttcagaagggctgtgtgtgcagcagaaactcaggatgtccagtctccagccagatcccaaccatgtctccaccactgcccagtgtgtgaaccttgaatcggttgcttaacttctgcatgcggagtttcacaagctgtaaacccagtgctatggactgaatatttatgtccctccaaaattcacatgttgaaatctaagccccaaggtgatggaatttggagctggggcctttgggagggtaaagccttcatgaatgggattagtaccataaaagagactccagggtgctccctcaccccttctgccatgtgaagacacaaaaagatgacagccatctatgaaccaggaagcaggtcactgggcactcaatctgccaacaccttgatctggactacccagcctccagaagtgtgagcaataaattcccattgtttaaaagctacccaatctatggtattctgttacgggagcctgaatggactaagtcactcaggaaacagcacctattccacctttcatttggggaagtcaggatcaaataatgatgatgattgtggaagaaccttaaaattatacagcaatatgtaaaatgtgaagttttattgcatttgtactattattgactgtagaaacacatggctgtgggttatgatccaggggtcatagtgtttgtatctgagcaaatgtctccctgatttttcatcactacccaagagagtggagctaatattttaagcttttgactgaagacaactttacagaaattctgcatcgtgtcattctaaaagcccaaagaaaagaaaagaaaaggctacaggcatcatcaaattgaaagtacttggaaaatgaaaatggcagtagctggaagaaggtgtcaagacatcagcttcacaggggtggggaatccctgtttccctgtccacaaaacacctccatcacagcccttaccttgttgcctggtaactcaatggaaagagctcattatttttactttggtctctgttcccagcatctagaacagagcctaccctataggaagcaggtcctaaatgttgaacgaaggaaagaataaaaggatgatgctatccctaagttggaaggaggctgggcagagaacgggagttgtcagtgaatgggagatctgcaggattgcagtggggctctgcctgagccttcatctaaggctggagaaagctcagcccacacccaaagaagcagccagattctgtggagggtcctgatgggcagaggacagagggggtcatctctgttgtctgcattcagacatccttttccttcagctctttgccatggagctgtcctgcccagccttctctcttacatcaaatccatgagtcccaagggctcaccagctccctgttaccattctccactccatgcccgtacctcatgcacatactgcattgatgcttttactttctttcccaatcaggtgccctcttgttgccttttgatgcccaggacttacaaaatcttgtatttgaggcaaagcctcatgtcacacctgctacatgccaccttcttcttctccagagacccaccggggcccctgccccagctttatttcttcagggccatcttccactttccagaatctgagatcagccacatggggcactgcatgccagcttaactcaaggatgtattgggaggcttgttatgcagttccagaacatgagctctgaagtcagaccacatgagcttgaatcccacctttgccacttactagctgggtaaccttgggcaagtcaaatgaacttctagttattattgatgcatagcaaatcacctcaaaatttagcagcttgaaataactactgtattgtactcatgaattttgcaagttaggaatttgaacaggttgtggtaggtatggtttgtgtctactccatacatctgaggcctcactgggaagacttgaaacctgggaatatctcaaagactggggctggaatcatctaagctctttcactcacatgtctggctcctggactagaatgactcaaagactatgatctgtgactagagcatctgtctgtggcttctccatggggcttgggcttccttacaacatggcagcctcagagcagtggaacttcttacacagaggctcagttctccaagcccttgggttccagtgaacaaagtagaagttgcctggtcttttatagcccagcctcagaagtcacagagcatcactttttgccatactctattagtagatgcagtcagaagcccacccagattcgaagggagaggatgtagagccccacctgtcaatgagaggagcattaaagaatttagggtctatgttttaaaagcattgcaactcctctcaaactcagttttcttatctgtaaagtggagataatcatgcctatcttctaaggttattataaggcttacatgagataaggtatttcaagtgctcagtgcagtgcctggcaccactcaataaatctcaacttttattattagaagtaacattagcaactaatgtttgtcattaggagtaaaaagtattttctgcattctttgcatggtaggcatatgtgcccagcttcatgcttgggggtgtaagggaagcctagaacccattctctgttatcagactggggaaataagatgcatacataacatagttatcaaccaaaagtcaaatgatgtgacagagattcactattggcaagttcaggaaaaggagagaggagagtaagcttatctggtcagaggaggctttgcagaggaagtgggacttgaatcgaatcttgaaggatttaggatagacaggagggaaagaggcagaacttctgggtaacacagactgacctacaggaagacagagactgggatgaggtgacaagttcctgagacaataaggacaccagcaccttacaagagtgtttgacctctttttgcttcctaattgtaaaatagggatgcaaaaaagtgtcccaatagtggaaatccatctgtctatctgtccatctagccacccatcaacccatccatccatccatccatccatccacgcatgcaatattgccgagcccagttatagatacagaggatatgaaggtgaataagagaaccttaagcagtaaagagattcactgagtatcatctaaatgtcagttactttactaggcatttgatgttcattatttgatgtttatttattatttgggcttccttacaatgtggcagcctcagagcagtggaacttcttacacagaggctcagttctctgtgtaacataataatataatataaattattattatattttataatatatttaaattatatatttaaatttttaatatataaattgttattaaattattatgttattaaatcaaagaaggcatttttagccctgtttaatagatgggagaacacagacttagagtaagcaatctgaccaaggatattccgtagtcagtggtgaggctgctatttgaaaccaggtgggtctgtctccaaagtccaggctgtttcctgtgaaccatgtggtcccaggagccctctattgctaggttcacggcacgcacagacactttgattctttaaggtgactggaggatttcggctctgctgtcctatatagctatgatgcttgtgacctaccaacaggaaaacatgtctcatgtttggttgcatttcccctgaatgtgagcctcctgcagacagagactggtgtgcctaattctgtactaccaccaccctgtgcccctcatccccaccagagacagtggtactttgctgggtatattaatttcagttgaatttatcaatggtgaagctgcattttcgtgaaccatcctcattctcagcccatcttcactgtgaacagcaacttgtttgtaagatttacgtgcatggggctgtggagcagcagggagtcctaggctgtggacgaacaaggcttgagagcctctgggggaatgaacctctggcttcagttgattctcctgattgtccatagacttcaactgtgggtgaagggcataaagaattgtcagcccagagcattttctgtctttctcccttcctagaacccagggcacagtggattcctgtgttcaacatcctcattggtgggcaggagacttcctcagctgatccaactctctgggagtgcacaaaatatgtgtcctagtgtctcagtggatgtagatggctgcttttgagtacgcattgttacaatcattgcttaatattccagtggagccaccaattcaattattggttgtatttttctaagtgtagctacacatccctcagcctttcagtggaggcactaatctcacggggcttaaagagattcaggatgtgtgtagtgtcagtaacagggtcaaactgggtgggtgtctacctattaaccttccattttggcaaccaaatggccatatccagcacataaggtgggccctggaacctgtcactattaatattgtcactgatacaaggtgactgggctcatctaagctatttcaataacaatatcactattgttcaaccatagaagcagccaaataagatgtgaagactagggacctgttaggattgggaagcagagaggggatgggagagaggttagggtcaaaagtctgtgtagtgaaacgagttctgggctaagtagagtgggttaaagggctctgggaaaagcctcttgcatttatgttgtgcattcattccagcacacatcattcattcatccaacaagcatttatttgattcttaggatgttctaacccaattttagggattatgcagggatataaaaggaataatattgcttgatctgcaagtctagttggacaagagcacaaacagtcataacacaagggagaacatgttaagtgtcctaagagcagcatgcactgcagcgtggagagtgttccaagaagggacaaattgcttcagcaagaggaaatcatagaggacttttcagaggattctaaggaaaagatgtttgccttaaagagcaactgaaagtgctctacaaatagcgggtattatattttatcttccctgcccacaaaaatggtcataacaccatccccggttggagttgattctaccctttttaccagaagcactgacctcggtaactttggcaaatatcctagacacacatacacatacacagacacacacacacacacagagagagagagagagagagagaggtaagaaaacaccctggatgggaaagggctgtacatgtgaggatagatccctgagagaatgtagcctccaggctcaggcttagcagacagtcccagggctctgaggccatagtacctctgttcctggaccttccaggctctagccatggccagctgtgtcctagagtcaggctgtttggccattagagaaagtagggcaggagatgaccagtcagctgtgtctccatttttcaaatgagaagataagggcacagagaagtgaaggagcttgcctggggttttgggatttgaactagtttcaggttttaacaattttttttttgttggttttactccaaagtccagaaaaagattggccagtccagaaactggattttaaaatcctctccctgaaattcccagtccttctcctccttcagctgttgtgagtcctccctgtgatctcttccagcccccatcaacacccagccactggcacatactagggagggaagtcattgtgcttccctccccagtgcagggtgccatttacacccgttccacagtgtgcccacccctcgcagctcttgtcatgggccgtagctatgtgatttgtgtgtgattgttgacagcatctgtctcctgtgctagacagaaagttctgtgagggttgcctctgtttctccagcacaactgaatgaaaagtagtgtctcctggtcagtgacttttaggcctctccatacagaaattctgccacagaagcctatctctgcttgtctggggagacagtcctaccagagaatggggtgatataggatcaaccctcctcactgccagaaggataggtcctagcatgtacactattgatccagaatgacccatctgaatggtgggagctgggtagaagagaggcaggggaagtggaggaagccagggagatgaggcctgggatatggcagtgtgccaggctgatggcagagggcaaagcatcctgtgagtgtggggctagggtgaccatgtgctaaaattagggaaggtcccagggaatctggagggtggccatgctaagacaggaacgactcagtgcgactcagtttcaaaaacttacacgaaacacttccttgggtgactttgaatcacatgcttctgttattaatttttctgagaatgtgatttagctccaacagctttttaagtgcagggcctgttttattaaactaaaaaggtcatactggctcctactgtgtaccagacattggctttccacatatgttatctttttaatcttcacaactgcttgagtaagtaatattatcccatttttcagatgaggaaactaaggctcagaggggttaaatagcatcccaaggggctgggatttgaacccattttgccagactccaagacctacaaaagggtccaggacaggactggctgggtgagaatatgctatcaagtcatgcttatcagcaacagacacctctccactgtcaccctaaatccatcctcggtaataagtcttgcgcaaacttgcctggggtggcctggctggagcagatcccctggctggggtatactctgtggggttgcctctcagtgctgttccagctaggcttccatgccagccttcagttcaggaggcgccaagaccctcaaggaaggtccttgctggctcccggttctgctcagccagcctttccaagcgctccccattcatcagtctctcacttccagaagatgcatttggcagccgtttctccctaggtggggttgggtagaagtgagggtagatgtgaaggagagggtggttcttgccaaaatagtcaactgggctgctctggatgaggttacttgtaggaaaatctttgaaaaatattcttaatcagatttgaaatacatcactcctagaggaggactgggattctttggaccctggggaggcacatatctgggcttggggtcaggatccgggtaccctcttcccagaagggaaaactttctttgaaaagaaggtttcagctcatggaaccatgactgttaccaccggaagagacctcggttccctgctctgtggtgagtgtcattccatttcactctcattccatttcacagatgaacccactgaggtagggaggccagaccatcctgacctcagggaattgaggaaaacgtgcagcttcaaggaccacttctgggctagcggccagagcactggacagagacatagagaacaagccctgtttattcattaaattgcctggatttttgtcccagtaggatttggaggcagatacactgtaaaatatgaatggttccagcacattgttctcactgtttctgtaaataaaaaatacatgccaaataaccacatcaggcccagttgtttgatggcctctctcctgatacttaatttcatttcacgacataaaataaggagggcagtgaggtggggggaagcggacttttgtcaaagtacagtctcattggttaacacctgaggggaaatgactgaaaagaacttaattcaaaaaatgctttaggcacaaaggagcttcttccaaccagtaagagtcagacagctatggagagagagacatcaataaataatcagccagcttagacttttaaatgggaatcccagcctcagcacccaaaggtaaattacatcttttccaccagcctccaagcagggcttcatgcttgtgtggactgggaaactttgcttgttgcaaatgtagcctgacctttctttctaacaggagaaatatatcctattcatatatatcctatatatatgccacatgttccctttcatacatatatatggagaaaggaaaagtgtccatccttagaaaccccgaacagcacttttgccatccggtttcactgtggttttggtttaaggcacaagtctcctgtacaaacatcacctcttgtaaatagctagggcagggtaggatctggagcagggggaaggaggtgtccagatcctgcccctgagtccctgagtccccctgagtcccctgagatatgtgcctctccagggtccaaagagtcccagtcctcctctaggagtgatgtatttcaaatctgattaagaatatttttctgaccctgcccagaagaaaccagcctctcctggacttgatttcacttccaaggatatggatttgtcagcgtgacaagggagcaagccccttcctgggtgggatttgatctccaccttctgctccctggccagggccccctgcttcccagggccttggttggccagcaggtcccggggcatcaatcaccgtccaccagtgttttatgaggccacttctgaaccaaagagccagcaagggggtttatggagctggctctttctgtcacaaacactgtttcttattgcttgtcattttctcccagactgttaacacctcatccctctaacagcaaactgccctgtgggtcttccttggtggaaaaggcaaagcatcccatgagcaaaggctgtttctctgcctgcagaaagcatacactgcctggaatttggagacaatggcagctctacattcttcttccttggctctttgctgttggggtgggtggctcctccctgtgagttagggtccccatctcagagtagaaaggagagcccagatggggagaatgtgaggtttttctggggctatctttcataagtggtacagtaagagagcccagtgttctcagcccatggggcctgccagggaagggagtctggaacccaggggtttgcctgtcctagttcactggctagtcagaattgagatgtgcagcaaaggtaaaatacatatggagagtttccaagacttagtgcagaaaaagtaaaataataattttgaaatgttgattacatgttgaaatgacaataagttggatatattgggttaaataaaatacagtattaaaatctcatctgttttgttttgccttttaaaatgggactatgaagaaaatctaaaattacacatggctcaaattatatttctattgaacaccatatgggtcgtttcattattcaaggggagacaccaaactaagatcaatgtttctaccttgtcattctaacatggttttataatgaaatatataaatacaagaagtatatataacatatagtgcaatttaatatatagtgaagtgatcaccttccaccatccagtttaagcaacagaaaaacccaacatatttgaaggactgtgttcccctctctgaccacacctctctccatcccttaccagaggcaattgccatctgaatttgccctgcccttattaaattataatttttattttgagaaattataaaaattcagaaagtaccaagaattcctaacaaacacctgtgtacagttgtatagcattgatcattgttaacaagttgtcctgtttgtttctcattaaataaagtaatgagggcattacagataaagctagagctgtcttttaattgctggccagctcactccactcccaggtgctcagctgtatttctgcagcaaggtattagtgtatcctcaaatgacaactataaggtcagccacttagctgacaccaggccccagagggtatagcagagattctcatgagcacatacctccaagaaaaagcagatataaaaagtagctgcaggccgggcgcggtggctcacgcctgtaatcccagcactttgggaggccgagacgggcggatcacgaggtcaggagatcgagaccatcctggctaacacggtgaaaccccatctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgagactccgtctcaaaaaaaaaaaaaaaaaaaaaaagtagctgcaatctagcatggcccaattactttatggaatcattgaccttagttgtggaaaggccattagaaatcagttacaatggaggccagagaggctgagtgactgatatgaagtcaccagccaggtatgtcagagcctggactgcacctgggtctcccatcaagcactgaattcaaggtgagctcagttgccagccgtgtgaatcatctgaatcatgatacgcttcacgctagactttccaggataagtgagtggaactggggattgagcttcctaggagtggaaggtaaagcagaaagccctttcaggttgttaagaaacatttttcaaatatctgggtccacttcccttgacaggaagtccctactgcttgacatcacacgtctttcttggctaatgatggagcttctagccatttctctgaagacagcagtgctcactgtctaatctgtaactggaggtgaaggagcttcgactacatcggagccaagctttgtttacatcttcttttaaaaagaaattcttactaagtgtttgatgacattattttcttgtaatttgtttctgatctaaattgaagtgatgcaaatatatacgtatattttcctaaccatcaggaatattgttgagttctagtttgtagagtttctactggaatgatactcaccagtggtctgactcagccatggaaggaagccctacaaagacaggtgtgagaataaaaggaaactgtttgccatattcttttccaggagcagacaattgagaggcctggctcatggatgggtttgaaccacctcaggactgaagatgagcggctcagtttcactaacaacaagaacagtgacaaattccctgcccggcccaagctctgtggtccttatgcaggtagagtcctcatgctgaatgtttgcaagctgactcttcaataagaccgtgagctccttgagaaaggaattgggtctctgtgcagtgtatcacatctacctcaatgctctgcttagaggaagtgtttgaaaattttttgtgtgataaataataatactaatccagttaagatatactgccctcggtatgaaaaactctatcccaaggtggagcaggtgagttgtggtatgtgttttccttgttctggacaaagcaaagtactatgataccaaaagggccaaaatcaacatggggagttgtttgctcaggaggagcgggtgggctggggaggggaagacaggaggagagaaagaacgcacttgtgctgcagaaaccttgaaacaatcaaaggcacaaatgcctctttttataaacacacactgtgagacagatgtttacccaggacaatccagagagtaaaagccagccaaagccagagggattcatgctccgcaaacaagggatttcctgggggaaggagtggcaggtaatgggttctacaaatttcccctcctgataactacatcacagaccgagtccaaagagaccgttcttcctattgaaaccttatttaaatactgccgcctatcttgggcagaattgccatcgtattggctggcttaggctattctctcaaagctttatgaaataaacactcgaaaaagaaataaccatgtctctgtgggagcaggggacacacctctcagggaattttcttcccaaaatgcgtcagtagtcagcctgtcccagttctgatcagtggccttcaaacaagtaaagattgtagagaaaacaagagcagtacctctttaaaacagcaaaaataccatttgtgcagtgtggatgcttttcagcacgttcatcattatgtgactatttaaatgaaacaaccaccgtgataaaagagaccaacactgtggttgcctttgcaatgattgctatgttggtcccctcgtgcttatgttctctctctggattcttttcaggcatagcaaaggcctcaggaatgggatcagggatttcaaacgctggtccacacatggccacagttttctgtgtgactttggatgaatcaagcccccctttctgggtctcagttttcccacctctaaagagactgcattagattaaatgaaccctgatgctttgcctattttgaaatgccaagttctttctctaggagtgggcatacgtttgtgcccagctgtccattcctattcaccatcttaccaatacttttttttttttttttttttttccgggagggaggcaggtcagtatttcttgtatgaggtcttaaaaccaagcaaattctactggtccattttcctcaggtaactcagtaagccattcctgcgtcaaatgtgactgactgcgtgaaaccagcaaactccatatagttcaggcctcaaggcaagagctgctgctaagagctggagtactccttttcagatggctgagattggcttctagcatctccatggtgtctagccagccattcttgtccccacaaccagcctgcacatctcttggattcaactagcatttatcaggcagctactctatgccacacactgtactcaggactagaaatatagagaaaaacatcaggactccttgagcttacagcctcatgcaaaaacaaggttctaaaccagaaattcaccccaacacaaggtcacacaatgtgatagagccctgggatggtggctttcagaaaattttatgaaaagctaaaagtatttctctcccatacttatctcggaaagaggggttgtggttggcagaaatggcattaaggtcagtgagaggcaggactgagcctcttggagaatggccaaccttccctcctcactccatgggggccttttcactttcacaccatacctgaaagattcaggagcccctgcccttcaggtaggagggacctgggagaaatagcaatggcctctggacatttctggcatgttccatgtggtctgctgccaaatgtagtgtgtggtcggactgagtacagctagagaggtggcatctggagggcataaacagtgtttgcgcatggtctagagtggagaccaaggaggctggggaccggggagagaaggctgtgctttgggtggccctgggcaggctgggttgtctgggaggcagagcaggaaatggccccatggcagagccagatttattcactgtctgggcttggtcccagccggtcctttgctcaggcttggtaaatcctcagttctgaagtcatttttattagcgattgccttttttttttttttttttttttagctttgaaaatgtggttggacgaaaatgaaatttcagatgtgtgtgtctcagcattgatttttctatttgtaataacacaccctggcatatctcctttgatatcaagaggataaaatgtccctaacagcatgctcttcattctggggtaatggataaagcctgtttatgagatgtcatttattccacaatagacagtaaataaaagccatttcaagcttgggttaaatcaaagcttgttcaggatttcagcagatttgcaaatcacctcggggaccttcatcagtcgcagttgctgttttcctccttgctattgattctctccctctctctgccaagcctctttctaaccttagctgccctgagcacctgactgatttggaaaaagacaactggcctggctagagacctagcgtgacattaaaaattccttccctcaatttggggaataaaggctttgaaaggcagcaagaaattgaggttatatcaacaaaagccagagtggcaaagggaaggaaaaaagccttagcaggacaataagatgcaaacctgaattggagaaagtgcctgaaaggcggtggtggcagcagccgcagctcctttgagtcacgtgcagattgtatttctttcacttcctgggaccctgtgtactggagggagggggaagagaagggaaggggcaccacctgaggtgtccctgcactaacccaggcttttgtcttgcacattcaaattcccgccctctgatctgacctgtaactcctatgaatcctggcctttgggacccacttaagtcccaggaagccgtgtggcctgtcccgtttccctggtccctcacagcgtgttatttgggatctttgacacgtttaatctctccttactcctgcgtgttctggagagtgagtattggcctcacaattgaaacgcaggttcctttgaggtttgggacagacttttaaagctagaagagtcagtcctggggtctctagaccaattttctcttcactgctggaatcccctgcataacatccccaaagacagcagcccctgccttcaattcacccagagtaggtactgcagatatgggagtctctcagcctgggaaatgtcttcatctattaagctcaagttttccatcctggaaccccagctcctcttcggatgccagcctgccttccagagggagagtgagtgagccgagtcctagccccttacggcagcattttcctaggtgaccttgggcctgtctcatctgcctcaaccacactccagccagagggctgatttggtttcagtttatcacttagccatgaaaatcagtaccccaacatttcattggttagcgtagaccagaaaagtgtgttcaaatatttgtgtcttaggatatttgtctcatcattccgattgaatatttactgagtaacagttttgtagaaataatattctaggtctgcgataggttatattattgttcaaaatatttactgccgcccccctccccaccgttagtctgccttatgtgggaggattatacgtccttgtccccgtcgaccatgtgacctgctctggccacgaaatgtgagcagaagtggcaaagtgcagatcaatggctgagattccatgggcatctcacccacatgagtaagaaacctctgttattagaggtcaggtgtggtggctcatgcctgtaatcccagcactttgggaggctgagggaggtggatcacttgaggtcaggatttcaagaccagcctggctaacatgcaaaaccctgactctactaaaacaacaaaaattagctgggcgtggtggtgcggcctgtaatcgcagctactcaggaggcaggagaggcaggagaatcgcttgaacgcaggaggcggaggttgcaatgagctgtgatcacaccactgcactccagcctgggagacagagtgagactgtctcaaaaaacaaacaaatgaacaaaaaaaacctgttattagtgagttttagtagcagtgaaacctctgttactagaaacactcagatcatcataattagactaagctgatgaaagaaggttctccaggaaatttcaagaaattctgagcacactgtgtgacctcaggaagcttacagtctaattgaggagaacctgtccagtgccaaaaacatggtgaaaatagtaaatgcttcaggagctcaaaggagggagaggaggaggagctgggtgattcaggaagaacttttagagcattaactcaaactggatgagactcagaaacttcatccacctgcaggacaggcctgctgttgtgggctcagctcttcatgttgagggattaagagcttgggtattcctcaagctctttttttttttttgagagtctgtatcacccaggctggagtgcaatggcaacatcttggctcactgcaacctccgctacccaggttaaggcgattctcctgcctcagccttctgagtagctgggactacaggcgtgcaccatcaagcctggctaatttttgtatttttagtagagacggggttttgccatgttggccaggcttgtctcgaattcctggactcaagtgatctgcccacctcggcctcccaaagtgctgggattacaggtgtgagccaccgagccccgcctattcctcaagctcttaattctaattccctcatttatgggtgagctaatgagagagcacattccatgcacctagcattgtgccaggccttaaataacttttctttcagataacttgataatggtgaatcgatgacatcaattgtaatagatatttgaaatagatgatgtgcccttttcagtcttctgaaatcaaattgtgggagtaacggtctatggttctgtataaaaccagtctgattgggcgcagtggctcacacctgtaatcccagcactttgggaggccgaggcagacggatcactggagatcaggagttcgagaccagcctggtcaaatggtgaaactccgtctctactaaaaatacaaaaaaaaattaataaattagccaggtatggtgacgcatgcctgtaaccccagctactcaggaggctgaagcaggagaatcacttgaatccgggaggcagaggttgcagtgagccaagatcgcgtgagctagactctgtctcaaaaaacaaacaaacaaaaaccagtctggataggggctggctcctagaagtgaccggaaaggtcctcagcagctgaagccacaactgtccctttgttcccctctcctcccattccttacctatctcatttaatcctctcaatagccttttgagggaggtgctgttgttatccccattttacagttataaatactgagtcttagagaggttacaactctcacccaaaagcatgcataatcgatcagtaagtgtctgagccaggactaggacagtgtcctgcctgaatccagggcttcgcccttcaccatcctctgctgcctacagcagtgcaggctctgcccccttgccccctgagagggccaggaagggggcctccctgggggagctgtgatggcagagtctgcagcttggccatgaggctgagtcccaaagatgctgcggaataagccggtagttagagacgctataggaattatacagggaaaaagcagcaatgtgggagagaggaggaagaaaaggagaaggagagaaaaaagggagggggaaggccccctaggtgccctagtgcctggaatacttgctctgcgcctctaatttctctcgagtggtgcctgggtgcgctctgttacagttaaagttgtgtcagtggtttcattagaacccaggctttgatttataaccctccctgcaaaaatgtgctcctggctgaaaactggcatccgaggtcttgggccaacagagccatttctatagaagagttataaggcaggggccaggagggaggtccctttcttgagtccggttttccagctagaaataaaaagaagggggtggggagttgtttagaattcaaaaacatcagcctggatttcagaaggagttcttaaagggtcagtttcttcatcatatgcatgcagagacttttttgtgaaagtatctaaaaactgttcacagaaatggtgctttggagtaactccatcttgcaaacatcattatgaagaataattaacaataataatgaagataatgatcgtggtagtaagactttcttatgggatgatgctttaactttatcatgaagcacccacatacatggtcacactaatacagcagccctgagacagttgggaagaaattagtatccctgttttgtgacaaaactgagacccaatcagctgaatgctgtgcttagaggcaccagcctcagttcagtggccatcccgccctagcgtgccatctaaaccgggacttcaataaacaaaaaagcaaagtaggtctgtgtaccagccgcttgtttcgattttttttttacttttattttagaagaatacgcatcattggaaacaggtcccattttgagccacatgaggcttgagaaaaataaatgtgaaaataaaagcgccgtttaatatgggtatcattattactattattattgcaaagagcctatttggaactgcctgaaaaccttaagactgattaatatttttagagcatcagaaggtatgcttttttttccccagtataaattcttctttcccaaatggttgaaaaagcataatcatagtcattatcatcatcatcattccttccactaatgtattgcttctcacataatgtctcatgaattagcacattttctgctcaagcatccccatttaacagatgaggagatggaggctcaagtgcatatagcaaaatgagggggtcttgggactgaaatttggattttcaacaagcttgccaccttaccactctgcctcttatcacacatgctttgttgggcaaatgctttgaagcccaaaattgcaccaggtcagaaattaggaatagttcaccatcaggaatagagctaatgtggccaaggcagtcaccgtcaggacagacaccccaatgacaggctactcaatgtctcaccagcacattcactctgcatgggatcctcagccctgtctcagtccctcccgctggagccctgtcccacaaaggcctgccccaggggctgggagccaggcagagcttcatccctcccactgagcaagacttgggctgtcactgtgctgttatttatgagtcccccttgcccaatgagtggcctcgaaggggcccagcctgggcctgctgtctggccagacttgtcacacatcattagatgtttggttgccactgacccctctgccatctggctgagtggcctcggggtgaggagaggcaggcagcagctcctcatgcagcccccaagtctttgtggcattcaggacatggaagtgtttcagaactgttgtgctcatctactaaggggaagacagaactggaaaataatctcttcaagagattatttagggcttctctgtatttagggtttctcacccttggcactgctgccatttggggcgagataattctttgttgcctgaggctgtcctatgtatggtaagatgttgagcagcatccctggcctcctccctctagatgccagtggcacccctgtcccagatgtgacaaccaaaaatgatgtcagacattgctgaattgtcccctggaggaggagaaaaatcaacccctttgagaactgctgggcagctctaaaggtaagacaaattgggcagtgagttactgagctatgaccgtggcaggcatgcatgttccccgaacaaaaaccatttctgggacagcataaacagatggcaaatattttatgaacaccgtgttgcctaatcattgcaaccatttattgtatcgttggaattcctgaccccactttgcagatgaggaaactgaagtttagagagggaaagtgattttcttgaggcctgagaagtgagagttaagctgggtttaaaatccagtttttttttggaagcctcctgcacattgctgcagccttgtgtccttgttctcagtgtaagggcttggcaaacatggcatgtggggccctgaatgttctatgattgcatacttggcctgcggcagaggatgctcattttgtgtcctcgcgctgtttccactatgttacacagggcctctttttccccacagcccatctcccccagagctcccctttctgtgccctggagcaacccctttgcaccataacaacatttgacccacaggacccagggtggtgagagaaagttagaacccctcccagggatgcttacattgtaaaagatccctggggagaaaaaccaaagcagtgcactctgtgatatttcagtcactttactaggttggtgtagaactcacggggcagggtattgtagagccctttaaatcagtctataagctaggagattccatctctataaaaatgaaatatttgaattttagaatataggaaagtggtcaagtggttgctactgctattttaacaattgcatgtaagtctttaattacaacttgccttaaaccctctctagaagtaagtggcaaatttgtgaacatcttttgtgcttattaagtaaaacaaacctatttccagagtgcctgtccccagatttgttttatagaatctggagtaggcattaagttatatataagccagtaaagcggtccaaccacacatataaattgtacagcctgaactcttcttgacccctttccctgaattgcatgcccccttgctgtcttgcaggccaggaggtccccagttggttctggtctggtgcaagttgtggccaagggtctggccgatggactcacctagattgcttgggcttcttcccttcaacatgggtgatttatctgagtttcagggtccaccagcaactcttgcttccctgatgttgttaaacaaatcacttcctttgccaaataattaatttgatgacatttctaatttctgcttatcttcccttcaggacatgcaaacttcattttatgacccctgttccaaaggaacacacaggccagaaaggtcattagatgtacaggtagagtcaggaagggacagatgtttgcactggagggatactaggaagctggcggctggcagccttttctgctttttccaatccacattattcaagacaaggttttttgttgtggtaaatctatatttgaggtgaaaattattcagaaggaaggctgaatgcacttcctgaagccaaagaggagaaaggactattcgtggattcctggattgtatgagctatgtgatctgggcaggctgcaaggaggaggaggattgtaggctagtctgggggtggtgtgctcacacagatagaggggagagaaggtgcattcagggcgaagccacgggggtggacggtgttggtggggggcgtaggtactaatgggagtagaaacacagggcatgtttcagagatggtgtttggctgataggtttgattgtgatcagctggaaggctgtcacaagtccggaataccaggtgaggcagtgggaactctgtgttcctggcaggagaagcaaaaggcaaagcttccttcagctccttcccatcccataacttttgcttgccacaagaccccaagatgctgcagcaacaagaaaggctactggatcatcaaataaacatgtgatttaattaagtagaattttataattcataattgtgatgtttttaaaacagggatactagtagcatcatcttgtgctgttttgtatacaacttggtacacttcctcttcatttatttggatcccagccttgtgaaatgggaggagatgaacaagtatgtgtggatgaggcagaaagggtggaagtaaccaaagctcagagagatgacaccacctgcccaagaccacaaagccggtcacctgtgggtcttggggcctgtagcaattgtctgttacttgaatgtcaagcttatagggacagccccggatgttgctagaaggcagaatccaggaagcttcaggccgtggtagctgtcaccacctatagcctttggtccagctccctggtaaaacacacacctgtgggcacccacagcaccctgggtctgggagagggggtgcaggtggtcactcggagctgaaaccccatcagcggaaacactccacataaaagggagccagggatgccaatttccattttcattagagtggctggtgcttagtaatccagaagctttatttaagggctgacctctgaccgggcctgtcactccagtggcaggcgcctgatagtcactagaaatcaatagctggcatgaaggtcacttcctagaaaaactggggctatcaacgtgtcagttccaatgaaagattataaccaaccagcagagaagtttatctgtggctgagagcttatctgagctgggcttgttgtaggctgtacacatgcacatgtgagtagctatgtgtgagtgggcaagtgtgcatgcatgtagaaatgtgtgcatctgtgaaacaaagcacacatgtgcaggagagtgtgtgtgagtgcttttgtgcagatatgaatgtgcatgtgggtgcaatcagtgtggataggtgagcaagtgtgtttaagtgcagatgataatgtgtgtaagagagttgtgtatttgtgcttctgtgtgtacatgcattttcaggtaagtttatgtatgtgtgtcagtgcacatgtgaacatgttaagcacacacatgtgtgcgtatgtgtggttgggtgtgcagatgcccatgtttgtgtatatgggtgtaaaggtgcatttgatagtatgcatatatcttacctggcctagaaggcctgaaatactctggcccctgtctactcaaccagtctctcctcccctccctactccacgctggtccctcactgggttccttcctcttgcctgaggatacaaaccatgtcctctcaggacgctgatacttcagggcttgctgcttccaccaagcaatgtctctttctcgtctcctgtactgcccctttcctaccacttggttttcaaatgacatgctggcctctgagagttacattcccagccatcttgaaggtgttcctacatgtatttcctccatggaagttacaacaacgtgtggggatctcagtttagtgagttgtttgttgtctgccccctcacaggccccctatccatctctgcatggctgagccctcgctgaggtatctagggatctcgcaagtgtctgacacctcacaggtgctgactctttggcctcttttcagacaaggagaattctatctgctgaggaattctacactagtgctgtgaacttaacctctctgggcctcagtttcctcatgtgtaaaatggcaatacctgccctgtctatgccacagaatcaaatgaaataaatacgataaaaacctcttggaaagcatgaattgccaggggcctgtcacatattttcatgtggttaaaggctgttactactcagaaagagatgtgcagaaatgggtgtcaatgataagccaaggaattccaaacagattccagaatgtttttttccatgtcattaattctacttacaggcactggcgaatcctgagaccttctcaggcctatatcagccaggatcttcatttattgtctggatacctgtttctggaaggcatcctagtctcttcctttcataaatgaaaggaagggagagtgaagagtacacttcccctcaaagaaagagaaaagcaatataaagaattaatcaatgctacccaaagaagatggtttgttccacatagttgccatgggaacctggagctggataccagggctgcctgagctctgtgttaagtggctctagactatgatttgggagctggaatcttgtctccaccctaccactgctgagctgtgggacctcatgtcatcattgcctcacttcttgggcctcaatttcctcatgtctaatattaaggaatctaaaagatgatagagaatctctgctttgcataagtaaaattccaagtcatgtgtcctatctaggtctcagcttttctgtctattaagtgggagttgcctcttgtaaataattgaagggaaggggtagaaaatgagagcccgggtcaaatgtaagttgtgtcttttggcttccagaatgtcatcttcttattaagataaagccttatgaaattaattctcataggcacacattccattattttgttcatttattcaccaaacctgcaatgagcaactgcagcatcatggtgccaggcatgatgaaagaagctgagggtttggaggtgacaaaatgcagtctctgctttcaaaagctcagggtctcatgcaggagacagggagatagctaatttcagagcaaggagggactggctgtaaccaatgtcagtaatgagtgagtgacagcacttttgaatctctccttcaggtcatccctaagttcagggtgaggagatgacctacccttctgccccgcaacgccatcctacatctgaaattcttcttaagggcatggtggaaacccttacctttgagatgagcccagtaccagcactaacatatggaaccatagagttgacactggaggaacccccaggtttcatttgagaggacactggagttcagcgtggaagaaaggcctgcccaaagtcacacagcccagggctcctggcagggagccacggctgctttctctgctccatactggaattaaaggttgaattccaggcaattttccagttcctagtcccactggatggaaagtcaacacacctggttctctcagtgatctgaaatcacatgcagaaatccactccttagtcacaaagagaagttagtggaagtgtgttttgttcctagttatcctctccaaaggttcagccctttgcattcccttaggagaaaacagggcctgccctcctcatgtctgtcacctgtccaagatcattccttctatcattcacctcccattaaccaaaatccccttctctaggtacctgggtcttggacagctgtcaagtggaaagccttctgattaactaatactataatgtaaatgactgcaaagttccctcttgtgataactgagtcctggacagtggtcaaggaagaaatccttcttattaattcccagtaagatgtgaatcactgacaactagctctccaattgtatcgtcaaagagagtgcctggaggttcaaaatgttcgtaattcctttcatttgtttgacaattatagaagttttgctcaaatctgggtttagtcacttaggagctttgaccttattaaagttatttaacctccctgagcctcagttacctcactgggaaaatgaagatcataattagaccccaaaatatcaggtgagaattaactgggctcacagcatagcctctgactgattataggtgcttaataaatgttagttccttttgaaagatagaagttgccacccatggagattttaaaacttgctcaagagcactgctggtgagagctgggtcagaaacagcagttcagaagcttctagcagcgttgcaaagtccctcctggcaggacatcagcattggtctcattcattgacacatgtctgaggcccatgcctgggtactagggatatgggcaatgtggagaggctggtgggcagagtacttggagagtggtagttgcatgggagtagtcacagaaatcactgttttgggagtcttcagcagactccatcactgtggccaagctggggagatgagggtggcttgaggttgggttagacaggcagggcagaggtgtgtggcattgttgatgggccaggtcaacttggatgaggtctcttggcatgcacctctcctaggggatgtgagagctgacctctgtggggaaagacctgggctatccatcacctgtttgctcagggcattatgcccttgtgtgagaggcagctgagtggccacagggcctctgcagcctccaaacctgggagacaaagaggggaaggctgactccctcttggtgaggaaccaacttcttctaattcaaggaggctggggctgccaccacctgacatcagccatggggaccggtttgttctgtcatgtcttcagaggactggccttggaaagcagcactgctggaaatcctgctgtaaagcacagacttctgccatggagtccaagtttgtccaagttttcatgcaatgggtttgctaaaagtgggacctattgttttgttatagaaacctgggctaaggactcacagcagataaaaataaacttatttcattatcaaagtaaaacatgtccattgcaaaggatatagaaaatacaagaaaagtgaaatgttaaaatcatgcacagtgccatcccaaactcttactaagattctatgtgttatgttcgtgcaaaagtaactgcagttttaccattacttttaatggcaaattaaaagtttattccctttgatgcaatattgggactctaattaaaagttacggcaaactcgcaaaacctaatattttcttctaccattttttccacatacatttttgcagatgtcatcttagtttcctgccattttgtcacatgcataaacatattttaaattattataatatgcttatacatttcttttgtttactgtctttttcccccaacattttactttgaaaaattgtaaacatgcagcaatggtaaaagaattttacaggcgactgtcacggtggctcacgcctgtaatcccagcactttgggaggctgaggagggggtggatcatgaggtcaagagatcgagaccatcctggccaacatagtgaaaccttatctctactaaaaatacaaaaattagctgggcgtggtggtgcgcacctgtagtcccagctactcgggaggctgaggcaggagaaccacttgaacccaggcggcagaggttgcagtgagctgagatgacaccagtgcactccagcctggtgacagagtgagactctgtctcaaaaaaaaaaaaatggattttacaggcaacaccatgtatccaccatgtagactcagccattatcacctcttctttctatagatatttattaagggttcaatttaagctggtctcttgttaactatagggattcagttgttgataaaacagagtccccaccctcattaatcagagtatctagtggggaggcagacagacagaccgtatactcattattacagaggaaacgtatccaaagtgggtagggcctgggagaagggccacctcaggctgactggtgttcagaatgacacctgagcacctttttgccggtagataagttttctctgtttccctctataatatgtggtcttgattcaacttcttagagtcccaatattgcatcaaagggaatgaactttttaaaaaccaggatacatgctactttttgccagggtgttttccaaaaaaacttgcgctgaagtgttgcattctgtctgaaaggtgaaggagttcgtgtcttccctttgggctctgtgttggagccaggctgcccaggtttgaacctgagttttgctgccttattccctaggtgaccgtgggaaagttacaggagttctgaactataacaactttcctcatgtgtaaaatgggcattcaccaacactcactgtatggttgggatgtttatctcctccaaatttcatgttgaaatgtgacctccagtgttggaggtggggcctggtaggaggtgtttggatcatggggatggatcccttatgaatggcttagagccattcccttggtgatgagtgagttcttgctcaattagctcaagagagatctggttaagagtctggggcctccccccctgctctcctgctccgtttctcaccatttaatgcgctggctcccccttcacctcctgccataatcttaagcttcctgaggcctcaccagaagccaagcagatgctggcaccatgcttcctgtacagcctgcagaactgtgagccaatcaaacatcttttctttataaattacccagcctcaggtatttctttatagtgtcacaaaacagactaatacattcaacttttagagttgttgtgaggttgaaatgagttcagattaagcaacacccaccttgcagacttgtcgtgaggatgaaatgagttattttataagtagggcttagaacaaagcccggcgcacaggagtgctctatcaccattgttacctgcaggatgaaatctccaagaggacaggggtttgtgctcaaccttccatttccatggtcatggagcctgcttagatgataaacactcaagggcaggatatgatagccccttgacttgggagagcccctggtgccacttcctgtgaaatagaaattgaacccatgtgtattaaaagcgaagatcctatgttattttctccagcagtgttcagagtccaccacatccatgcagagcccacggccctgtcctaggaggacactgagcacacatagaattagactgtgatggcagaaggcattagagcaaccccagccctgccccacattaacccttcagcccacttcctgccccagccctgctgtggtggaagggagagaaggaagcagggtggaggcagggaggacttgctgagtgctttctttgtgccagtcccttcacatgtgttttctgctactgaattatctccaagatcttacgaggatgcagtgacagatgagaaaactgaggctcagggtggtgaaataacagcaagccttaatatgtcagtaagtgctcccctacggcagacaggagagagaaggaaagagaaaatggcttgtctggcccacagcaggacaccagaaaccaaagggagaggtgggggacctgctgcctgctggaggagagaccctgccagaggtggagcagagacctgcactactgaagaagcccacaggagaggatgtggcagctctatctgccctggaaactcaaggcatggacaagcaccagagaaataggcatgagaggccacctggggaaccttggcacttaaaaccctcagtttctctggaggtgtacacaggtgagcggcaggtacaataccttattccacctagatctttgagcaaggaaagtctggtagggatgagcaaccactgcatcagaggcccacttagctcctcctgacaaactcacacaaatgcaacccttgagcaggcgccacccttgggcagggttggcaaaactttctggactgcgcctcagtttaagacacacttctcacactgtgaccaacctcacatatgtatgtgtgcatgtgtgtgtgtgcatgtgtgtgttatgtgtgtacacagacataactgaaatgagtttcctgacacaatccttcaccttaccaagcgtgatgcatcccagtattttccaccatttgcttctattcctctcctccccactcctcctcatcctcctggtctcagcctactaaattgatttcagaaccctgaagttatagaaaatgggcacagccaggatagaatagagaatgtcgtgatgctttgcagattgtgtgagctacatggaactcagagaagagagagattagaacaggctgcagcaacccaggaaggctttcggcagaggaagcaactagagcttgacccagaaaagtggttggctctgttcagtttaacacacttttctagatctatgtgccaggctctgtacttttacagacaggtcaaggttgagtgggggaggggaaagaaagacattgaacacataactacataaataatttagttacagttgtggtaagtaatgaagacaaaaagtatacgatgccatgaaatagaataaaaggggtcctaatataatcttggagatcagggaaggcttcctgaaggaggcaacatttatgctgacatccaaaggatgaagaggagtgagccagaatccagaggaaaacaatagctttttaagcaaggcccggcgcattcaggaggctatctggggagattagcgacatttagacaaccatttaccttccttctggtagagcagtcggatcaaaatgccagaaaccttgtcttctcattcttatgtctctattacctagctgggtgctcactcagtgtttgtggaatccatcactttctggatttgggtaaagatgccctgtagctcatatacatcactgcaatgtgcaacacagggaatgtctgtaaactcagggtagatccagctggtgggactccctctaagtattatcatcagagtaagtccggtctgaagacacgctatctgcacagcatttacacattctcattacctgggtcgggtgaccatacgacccagcttgctccggacagtcccagttcactcctgtggctccagcatgatcctgcctcatttcactttcagacatgtcccagtttggacgataaattatacgtgcatctgtaataactctgggccacacagaaatatcctggtagcatgacagatgtatccaaacgtgccacattgaaaacggatgttctatttaatgagttcccagttccttgggggtttttagcccctcagccactaccggaaagtctcctccctttccagaattgtcccggtccctttaaagccaacttactctatttccaccttgggacacttgagttcagtgacaggacaatattcttaagtcttcccttgggcagcaggatggcatgggaagaggacaggtgtcttgggttatctggatgcaagtcctggttctgacattcctggttcattgacccgagtaagtcccttcacctgcccggacttgctatttccctttgttaaatggggataataaacaccccgcccagttcccgatgtcacaagggtgaggtgctctgtattaaggcaaagaggaaacattggatgtcacagaatgggacctctggctatgatttggagatactgataagagggataggtggcataccaatcaggctaataataatgttttaaaacaccaggaccttcccctaggatactgttctctgtgcaggagcctgagcctttctgccacccgacagtgactgccacagccaggattaagccaactgtcagcaaagaaggaggaagataaaccctgtgtgcagacagaacgggggctgtgtgggctgagggcacagaatgtttctccagccaccgcaggaagcagcaagaataccgaatcctggttgcctctgacaatttttcctcttttttttttttttttttcctttttggaagctggagatccctatgccaagccctcaaagcagccccgactttccgtgcaataaagcagcagtgagaaaggctcagagtaattaagtggctgacgcacagaagaagccgttacaaagaattgactaaattgcccattcattagcagctcggcatggaaggagaattacaaatagacggcggagcccgcagtaattcaatctaaccttgtacttacagaaaacaatgagataatgaacagaaaaattaccaggcacatattgtattttgttaaaggggcgggtgggggggccagggggaggtggggggagcgcagggacggactggcacatgcaatgctaatggcctcactcaagctgagcaaacgtttctccaacacaatcatagttctcagtctaagggcctctggggagctgagatgaggcaagatcgcgaacaaaaaaatgtaatttataaggcgtctgtggactggaatttatcatcggatccgctcgccgccgctcaattgatatgtagttgatttcaaacaacaccccccaggcgcccagagggaacattttttagattttacgcttggatatatctgtttaactcgccatttaccaaaacaacggctgatgacagcacaaaccagtcactctggagaaaacacgcacgcatgctctcatacacacgctctcgcccgcgtgtgcgcgcacacacacatgcacacacacacgggcatccaagagcagcagcagccatagtaacagcagcagacaaacctgctcagcccagagaagattgctgtgaatccggaaagggagaagggaggaagaaaaaaaatactgccaaaagactgagcctttctctgccgcttcgcaggactaagtgcttgttgttgggtttttagcgctcactggttggttttcattcctgacacctcctacccttcttggctgggcagcttagaaggattcagcactatcccaactcacctcctccaggctgtcggcactgccagtccccctctagcctcacctgggatccacaagacccctggcctcagcaggtggaaaagaatgggggtcttcatagagtgtgagaaggggtaaatgggcagaaggttgaaacattactgtccccttacccacggccagcagggcctccagatgtgggtgttggcaaaagcagttttagaaggatgtgaataaattccctatcaactcaagggctgaggcttcatagctggagtgacaaatcattccgttttcagggcaattttgaggacaccaatataactacccattggtacccagaaaaaggaataccttggcacagaaagaggaacctcaagtatattcttagtgttagaaataataataataattcactggacatgtgttaaaagcggcaaaacattttattcaggactattgcaataggagagagattgaactcaactccccatacacagggaccagtggagatttacagccagcgggcagggtgagagaggatgaaaaattactaagagggacttggttgagtgtcaagggtgagggggaagaggaacctgattagagaacaaggatggaggaagaagagtttgattggatatcaagggtaggggaattcttgataaactggcttagcaggattctttgctaaagctggctctgcaggccaagaataaagcttagtggagaaaaggactcaaaggagcctgactccagtttggtctggaaaagccatgtgggtggtggcactgtcttccctgcagagtgctgccagcacagtgcttactgattgcagagggacagatgggatagtttccaactgaagaatctgagaaagtgagaattcattcttcaattcacaccttccaccaaaagaaacagatgcctcacaagcaccaggcaccagaagacactcatgacactgaactgcaagggcagccttgcagcctgtcaccagcctaagtttgggggggattagaggggtagttagtgaccacgattgaccggccagtagggggcagtccagcccaatgggaaaggaggctgaaatggatgtccagaaaaatcctggttttattaccacttgactattgattcactgtgaggtcctccagtcctcatcacttccagtctttgggccttagtctgtatagttatagaatatccctaagactgcctgacttctgctcatttcacagacatactatgagatatcttggaagtaatcaagacatgaaaagtcaatataaatattaaatgcatcaaagaattcgaccattagttctcagagtatagccctagagccatcatgaacagcagcatcacctgggaacttagaaatgcaaattcctgggacccacacccaacctactgaatcagaaactctgaggatgggaaccagcaatctgttctcaacaagctctccagaatctgatgcacgttcgagtttgagaaccactgatatagctaatacagactgtgtgacttgctgggtgtagaaaaagcagctgaagaaaatcattttggagactggtaaatcttttgcagtcaaccaaaaaactaccccagagattaaattcagagtattaatcaactgttgatgtctgcatttgaaaagtgttgtgcacacagtttcatttgattctttaattcattctggaaggtagataaagcacaaaatcttgtcccaacaagcacaaggattcaacaaaggttactcagtaacagttgagggtggcaatgatgaggcaaatgaactcagtcttactgcaatacctgcccccatactccccttccaacgcagcattgtaggtctttaaatctagaagggacctgataattgatccatcttcctatagaagcttttccttcctacagaagcatctttctgtagaagcttttctcattgttcccctctcttcagcacactcccattcatgaccatatttcagctcactatcaagaatccatgggtaccaatgggtagttatgttggtgtcctcactatcaagaatccacactgttccttcatccctatgagaatctggagaagtggggaagcaagcggcctttgtccctaacctcaagaggaccataagcccagcaatctagccaacactaaaggtaccattgtctccattttaaagatgagcaagccaaggatccaggggtgaagaaatttgtttaaggttatgtgattattagagatagaacagagattagaagtcaggtgcccagacttttggaaagcagggtggaaactgatatcttcaaatgtttgttgttaaataacagacattaagtgtccagtgggctttaagtattgactcaatctctatctaattttctatctctcagatacttatagatatgtatttttgtgatgtattacgagggtcatgaagtcttcaaggtcatgtattcagtggtccatatagcatagaaaatctcactgtacatagctggtgggtcattccacttcttcttaaatacctgctgtgatggagatctcaccccggccaaggcatttgagaggtgctacaccaagtcatcaatatgtctcagaaaaggctttgtagtggtctggtgccactcattcccatccctcgcctctgctttgatgtgtttcccattcccagaagctcatttgagggtgcagagttcctgggaagtgtcaaattgagtcatcattggctaaattcttgcccacccttcatgagggaatccaggaatttcatgtctagaattagcaagttgtgtgaaaagaagactcttggtcagggtcaatggaaccttccatgactctcagctagcatatcccaagtctatacacaactctccttttcccatccctacagctgtcaatgaggaaaatggtttcaggagcctgagggagtcaatgaagaggctcaaagaaatcacttggaatgtgcctaggaagacacagatgctcatctttctaagtgctttcatgttagtatttcaatcaactttgcaatcccccttgccagtcctcgggatggaaccacacacacactcaatttaacagctcaccctgggtgacgggccagcaatgtgtgtgaccattcccacatcaccttgcccatgaaaagtcaaaaccagcccagttctgagtcagaaaagcatacatacaaaattaattgaaattgtatttttaatgaagctctctcatctcatacaaggattgatgagttacccttgatagggagttaaaaacacctttttaccaagggaagaaaaatggtctcactctgaccccttcaacaggaggcatatttgcacttcttccatgtcccaggttgacttactgtgtggaggcccagagacaggaggaagggagctttagagccagctcttcctgcatgatctgtgtgccttcagcccctggctctggaggtctgggaagggttggctcacggaaggatgatgcggggacaactgaatataccagccagcccaactgcatcattttccagagtgaaggtgcctggactgtatgtggggctgggccccagtcatacagcaatgcctcaggtgcacaaatgagttttctcaaggactgatatttcaactctgatatattttccaataatcattgataaaaagtcttttcaaaatttattacgcattcctttgtcatacaaataacatttgccaagcataatttaaccttttttttaactacaattatcatcaatttgattgtgcattaatgtgctgggtcagaaaaaaattatattgaggtatttgaagctatttatccacatactgaatagccccagactgctaacattctagtgttcttgggtctgatctaaataatcctatttctttacctactgccacactttcacttgttactttttgctgttatgaagtacagtgacattaaaaaaaagaatagaatccttaggaatccccagaccagaaagaccatgaacccaggtcacatcttttcttgcttttggtattattcagtgcctaccatggtgcctgggacagagcaggtgagcattaattcgctggtgaataaataaatataccatttagtgtgtaattctggctttactacttactatctgcatcaccatgggcaagcccagagtctcaatttccaagtctgcaaaatgggaaatataataataccttattttcgggactcttgcaaaaattaaattaattgaatcaaagcattggtaagaaagtgcctatgaactgtggagtgcaatacaaagcccctgtttgtagtgtgtaacaagattgtgattattattatgtattgctggtttctggggggtggtctgcctgctcttctggaggaggttctgatatcaaaggccttggctaattaaggcagcaaggtaaggaaatcaaagcagacgaaataggccaggaggcttcatcctggacactgtgtgtgtgtagtccagcagtctcccagttggctcaccttggcaggtgacgtgtctacaggacctactcctctcctgccctgtcttcacctcatctctcctccctgtccccagcacccctatgtgtcctatcttcctaatctcaccagatgtgaggaatccatccatgtaaaggagggcaggacttaatccgctgccccctctgagagatatggatcaggattgctccagttaggggcttttcctaatcagaattgacacagactttgatcaggaacagagaatttgctaggagcctcccaggatcatcaatccccctaaagaattttcaaaagtaggaaattcacacttcaaacagggaaaatgaaatgcttaagcacctaaaatgagaagctaacagtggatttccaggaagccttagcagatagacaacacttgggtcctgggtaaggccagactcaggaggtagggtctcgcctatcacttctcaagtccctcagtgaaagatgccatctgcttggccagaccttgctcacaaagctctgagaacccctgagtggcactgcagatgaccacatcccaaatgcccagactcccagttcacctggattccaaaacaagctcaggtctcctgactcccttccagtgcatgatgagttccctgctctccccttaaaggccaggtgcaagggctaaagctaacagtctgggaattttacaacaaactactttaaagttcttattgttttctccagaagcattcagataatcactacaaccactatcagtaccggcacaagcaccaaaaccaccatcaccacaaccacccttatcaccacgaccaccaacaccaccactgccactgtcaccacaaccatcaccagcaccactttcactaccaccaccaatgacaacataatcaccaccaccgaacccaggactgggtttgaattagagtccagtcagttattagccctacgactatctaaaacttatttaaattctctgaatcttagattcatgataataacattcctagagatgtgtggattagaaacaatatatgtacaaaagcacagagcagctcccacatctatggtagctactattaaaagggtacatttgtcaagagaaggttaaattaattgatcaacagttagtcatttcagggaaaagaggaaaattctcaccccagagtcctggggactctctgccaccttgagaaaagagtgtgaagttggtgtgtcaggaggtctggagcttcagccgcaccctgtcctagagtgtgccaactgctttgtttactctctggttctgttttctccaaccctgggagacacactgttaagaaagtggtgaatctgctagaggagatgcctctattcttcttgcatcacttgttgtagcaaatgtgcataaaatgacagccagatctaccctgccaaattcctggatcccaggtcatttagaataaagagatgccaaaagttagaatcccatctagcttcctctaactcttgtaccatcttgggaacttgctgactgacattgacctaggagtggccaggcccagtcaagcactattgttgggagacattctgcctccctccctctattcctccctcctcccttccctttctcttcccatcccttgtcattagtccctaaaccactgctgtgtccacaagggcctaggactcgagggtaccctccctgtctacacgctctgaggcatgcacaatggcacctctgcccctttgcctatgctctgtcctttgggagggcacagctcttggcagacaattggttgtgacctgccagaggcaccactccacgtgtgtgccaaataccatctcctctccctcccagcatgccaggctcctctgacaaggaagggtaaagaccctccagggttctcaagaacatcaatatgttttgtatttaatgtgctggctctgttacagcaaattaaagcaagggggcctggtggaagggaacacagcccgcagttccccgtcccttgtcgagcaggaggctctggaaacagcactccagtgtggagaaggagtgcacattacacccccctgcaggaacagagcagacattagacaaagccccaagtcttaatgggacgcatcctgcaaacatctgagcttgggccttcaatcacaaacgctgcaggatttaaaaatgaataaacttcacattgtgtttctcttatttatcctttatgcaaattgtccctgggaggacccattatgcacactgcatggggacagcagaggccggctttgaggcttggaggaccacttgcaagccattcctggaatgccaggcccgtcctggtgctttacagagagagagaaagtgatcataaaagggaaataaacagattctgagtggttggctcatgcagaaagcataggcacgcgcgtgcacaatgacacaccacatacacacgagccacacacgggcgacattggagtagccttgctgctaggatgcaaaagcctctgcaaggagagcaggagtcatctccccaattattttctcccattactaatgggaggaaacgggccatttgtgaggctgagcaggcatgggcaggacagtggggcaccatcacatggtaggaattcctggcctcggtctgattttggagcagcccctgtgggccagaccctgggctggtgctgccgcatcccctgccaaggccttctggctccctgggagcttcctggttcagggtggagtcagggagcagtgggtcaggaagtcggggctatgaacttggcctgagggagccaacagtcattggagtcaggccagggcaccccagacccaagaagtgcagggccaaatccagggacacagtgggacttacagaaggagggcagtaccacggcaaatgaaggaagctgagacggaagcagtaggcagggccccgttctaatgggtgtggtgccctgttcactccacctcgggcacctgtgcagtaagaggtcatcccctgcagctcctgacttggaaagatggtggcctatgcctggccacagggtgcatcctgtgcacgttgggtctcaagggcccagcagcgggggctgtgctcaagacaaacacagtctttggggggcacagactggaaaatcggtgattccaacataatgtgatctttcaaattttccagatggagttggggagaattgagagaggtaggtggagggaaaaatggctcctaggcaaatatatctttaagataatgtcttttaggttatcaatgtgtattttttggaaaaggtatgccatgattgtctttgacaggggtgaacactcatggagactaagatgagcacagatgagaagggggaacaggattaaattctttaagtcacctgcctatgacagacaccacactgagtactttacctttataatttcatttaaatggtataaaattccaggaagctgatgctgaaaaaggacttttaattattctgagcaattattacaggatggggcagggcaggcagtgttataattgacatcctgagctctggcaccagattgcctggaattaagtgtggctctgccccctgttagctgtgtgactgttagaaagttacttaacctctctgttctgtttcctcctctgttaaatggggatagcaattacacctatctcttcgggttgtggtgaggcttaaatgagtgattatagacaaagtacatagaacagtgccaggcatagagctagtgctagccattattactgtcctaagtcactttagatgtatgaatttatttaatccccactgtaaccttttgatataggtatataccgatttcacagatgaggaaactgagggacagacaggttaattaacctttgcaagaacacacagatgataaatggagggactacaatttgaacccacgaatcctgccttcaaattctactactaagttctcacgtagccaggggacacctgcagaggttcctagggggctgcaggggacataggcatcactgtctaagaagagctgtggctttctaaaacaaaacaaaaatcatttattgaaaaaaacatggaagtgttgcttaaaaaggatgtggaaaccactgatttagtctatcctacagtttagagaggaagaagcagaggtggaatgacaggaaggaatccattccaggtgggagacttagtgtgtggccatgacctgggtctccttgcagacactctggtctttctttgatgccatctcaccctgatcgaaagatcttaaacagattaaaaacctacctaaatgagcagaaagaccacaaacattagggccatgatgggcaagtagctcgtgatgccagctgggaactaggcctccctcagagcagccaagaaggagaatgaacgtgggcttggcatgagcctgcggaggctgccaaggcctttgggcctccaccagctcctctatgcaaatgcaagggagcaatttgcatagggaaaatacaattacccaaattggaactgggccaggacctcatcgcctgcattggggaagtgctagaggatccttcagaacagaaaagccgcctcctttttgtctccctgcacccctaaccctccagggttagatcagaggaggcttggaaatgagactgttcctactgagagccctgcagagagatcctggtggcttcccccttcctatagcctcagggctgggaaggcaggacttctggagtcactggtataggtgaggggagcttggatttctaagtcctcacactcctgccaatgttatttcacagtga

SEQ ID NO: 408 - DNA, 55691 bp, Homo sapiens
caatacctaatttattgagagtttttagcatgaagcgctgttgaattttgtcaaaggccttttctgcatctgttgagataatcatgtggtttttgtctttggttctgattatatgctcgattacatttattgattttcgtatgttgaaccagccttgcatcccagggatgaagcccacttgatcatggtggataagctttttgatgtgctgctggattcggtttgccagtattttattgaggatttttgcatggatgttcatcatggatattggtctaaaattatctttttttgttgtgtctctgcaaggctttggtatcaggacgatgctggcctcataaaatgagttagggaggattccctctttttctattgattggaatagtttcagaaggaaaggtaccagctcctccttgtacctctggtagaattcggctgtgaatccgtctggtcctggactttttggttggtaagctattattgcctcagtttcagagcctgttattggtcattaagagattcaactgcttcctggtttagtcttgggagggtgtatgtgtcgaggaatttatccattttttctagattttctagtttatttgcgtagaggtgtttatactattctctgatggtagtttgtatttctgtgggattggtggtgatatcccctttgtcattttttattgcacctatttgattcttctctcttttcttctttattagtcttgctagtggtctgtcaattttgttgatattttcaaaaaaccagctcctgggttcattgttttttttgaagggttttttgtgtctctatctccttcagttctgctctgatcttagttatttcttgccttctgctagcttttgaatgtgtttgctcttgcttctctaattcttttaattgtgaaattagggtctcaattttagttctttcctgctttctcttgtgggcatttagtgctataaatttccctctacacacttctttaaatgtatcccagagattctggtatgttgtgtctttgttcttgttggtttcaaagaacgtctttacttctgccttcatttcattatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagtgctttacttccaattatgtggtcaattttggaataggtgcagtgtgatgctgggaacaatgcatattctgttgatttggggtggagagttctgtagatgtctattaggtctgcttggtgcagagctgaattcaattcctggatatccttgttaactgtctgtctcattgatctgtctaatgttgacagtggggagttaaagtctcccattattattgtgtgggagtctaagtctctttgtatgtctctaaggacttgctttatgaatctgggtgctcctgtattaggtgcatatatattaggatagttagctcttcttgttgaattgatccctttaccattatgtaatggccttctttgtctcttttgatctttgttggtttaaagtcagttttatcagagactaggattgcaacccctgctttttttgttttccatttgcttggtagatattccttcatccctttattttgagcctatgtgtgtctctgcaagtgagatgggtttcctgaatacagcacattggtgggtcttgactctttatccaatttgccagtctgtgtcttttacttggaacatttagcccatttccatttaaggtcaatactgttatgtgtgaatttgatcctgtcattatgttagctggttattttgctcgttagttgatgcagattcttcctagcatcgatggtctttacaatttggcatgtttttgcagtggctggtaccagttgttcctttccatgtctagtgcttccttcaggagctcttgtagggcaggcctggtgtgacaaactctctcagcatttgcctgtctgtaaagtattttatttctccttcacttttgaagcttagtttggctggatatgaaattctgtccgttctcagatctcaaactccatgctgggagaaccactactctcttcaaagctgtcagacagggacatttaagtctgcagaggtttctgctgccttttgtttggctatgccctgcccccagaggtggagtctacagaggcaggcaggcctccttgagctccagtgggctccacctagtttgagcttcccggccactttgtttacctactcaagcctcagcaatggcggattctcctccccgagcctcactgccaccttgcagttcgatctcagactgctgtgctagcaatgagcaaggctccgtgggcatgggaccctccgagccatgcgtgggatataatctcctggtgtgccatttgctaacaccattggaaaagcgcagtattagggagggagtgacccgaatttccaggtgccatctgtcacagctttgcttggctatgaaagggaattccctgaccccttgcgcttcctgggtgaggcgatgcctcaccttgctttggctcacacttggtgggctgcactcactgtcctgcacccactgtccaacaagcccagtgagatgaacccggtacctcagctggaaatgcagaaatcacctgtcttctgcatcgctcacgctggaagctgtagactggagctgttcctattcggccatcttggaactgctcccccagcctggctgcttctaacaacctatgctcacatgattgatcagagaaatgacctgaaactggaacttatatttaaaagggaagcagagtgtaaaagtttggaaaatttgcagcctggctatgtggtagaaaagaaaaacccattttcaggggaggagttcaagcaggctacagaaatttgcataggtaaagaggagccaattgctaatagccaagacaatggggaaagggcctcaaaggcatttcagagacctttgaggcagcccctcctatcacagtcccagaggcctaggaagacagaatggtttaatgggctaggcccagggctcccgctgccctgcacagcctcaggatactactccctgcattccagtcactccagctcccgctgtggctcaagggagcccaggtgcagcttgggttgctgcttcagaggttgtaagccataagccttggtggcttccaagtggtattaagcctgtatgtgtgtagagtgcaagagttgaggcttgggagcctctgcctaaatttcagaggaggtatggaaaagcctggatgtccaggcaaaaggctgctgcaggcagtgtggaggggaaatgtggggttggggtcccttgagcactaatacactgcccattggagaaaaggaaatacccagagcttttagggattactggatactggctatgaattgatgacaaatcctgaggacccaacataccactgtggtccatgaatcaaaatgtggattacaatggccagcagatggatggagccttatttcaaattcatctcacaaaaggtcaagtcagttatttcctttgtttctgaaagcccaattggaatagacatacagagaagctggtggaattcccacttaggctctctgacccatgaggtgatgatactatggtaggaagggctaggtagatggccctggaactttccctccctagaaagatagtaaacttgaagtgattatacttccctggggggaagagggattgtgaagattaataccactgcaaactggaaagaagcagggatgcttctcaatagaggcattattaatccaattgacttgctcagaagttagatgggtcttagagaatgactgtggaaggttgtaaacttaatcaggtggttactccaattgcagctacttttctagatatattctttttgctgaagcaaatatgtatggcctctggcagttggaatgcaactactgacctgcttaatgccttttctctataccaattttgtaagaaccactagaagtgtttctttttttttttttttaacctggcaagaccaatagtgcactgtcagaatcttgcctaaggactaaggggagaattcctccctaagtggggctgacagctctcctgctatctctcattgcatagtctgatgagatcttggctgttttgacattccacaaaacatcactacattggtctactacattgatgacattatgctgatttgatctgatgagaaggataactaaggataagaagtaaatcctaccaaaatccagtagttggctacctcagtgaagtttctggggctttaatggtctgaagtatgttgagatatctccttctggcagaaagacaagtccctgcaccttacattacctgtcacgaaaaaagaggcacaatgcttcctaggccttttggatcttggaggcaacatataccatattcgaatgtgcaactttgatccaacaacagggtcaatcaccaattctaagtggaaaatataggaagggaagtctctgtagcaattctaggctgcagtgcaaactgttttacccctttggccttatgagataacagttccaacaacactcaaagcatctgtggccaaaaaggatgctgtttggagcctctggccagcaccagttggagaatcacactgcagatttccaggattttgtggcaaatctacgcccagtgcctgaggtggcctctcctgactccctgctgtgtggcactaccctgcaggtgtaggtgcaaagggcagggccagggaacttgtgctgttggggcagagcagcctactggttaggactactgagtttcagatggctggtggagagttcgagttccaactctgtcactcactagctgtgtgtccttatacaagttactttacctgtctgtgccatgtttttccatctgtagagtaggggctaggagcttcacactgtagggctattgcagagattgtccttgtagagccacactttaagcaggctttgttctaggtgctctgtttaatcaactcaatattcctcaagggccattatgaaggaggcactattattcttcttctcagttttagataggtacactgggcacagagctgttaggtaactccccctggatccaaaggtgtgagtggaggagctggtcctggaacccagaccagatggatccagaatctttgatctcaaatactgggctataaaatgcacatagggacttcatatggggcctggaccaccctaagccaatttcttcaagaatggtctgccagaattacctaggttgacgagggtattttctgtttaaaatacaaattccttgcccccactgcatactaagtcagaatctctgggtggagcctgggagcctgcattttgatccccctcaccccacagcaggtgatttttcagcaaactaaagacagagaaccaaggaccaagggtgcaatgaaatagattatgttttcatctcatgcatttccagctacaaagctgaagctctgggctctagaataagccctgctgcaaacaacctgcagtattgacttagatgggttacctgcattgccttgtctcagttttcctatctgtgcagtgtggatcttggtccccactctgcccaccttgcaggaggtgatgatggatgaatggagagtttgagtcccagctttgttactcactagctatgtgtcttttcttttttattttttttgagatggagtctcactctgtcgcccaggctggggtgcagtggcacgatctccgctcactgcaagctccgccgcccaggtttatgccattctcctgcctcagcctcctgagtagctgggactacagatgcccgccaccacgcccggctaattttttgtatttttagtagagatggggtttcaccattttaaccaggatggtctcgatctcctgacctcatgatctggccgcctcggcctcccaaagtgctgggattacaggcatgagctactgtgcctggccaactcactagctatgtgtctttatgcagtcactttacttttctgtgacacatttcctcatctgaagagtggggctaggagctctacattgtagggctgttgcaaagcttgtcattacaaagccacattttgtgcaggcgttattgtcagatgtccttgggtaacagggcaggcaccagagtcactctgactggagactggatgccagtgctgttgtagctgacgccactgaccatgtcacgtgccctctgagcctcagtttcctcatccataagatggatatcataatccctaccctacattggttatgatgatatttaataaggcagcagatatgagagcccagggaacacaaatccctgtccctccataaaatataatttattatgtattttatctgttctagtttccaaaacttccaaggacatccaacacccacaggtaactctcattccagagttttgctgaggctaagattgaatcagaaaggtatctttctccctctcttttcccaactcagtgagagcaggatgaggagctgaaataaccgcccaggcactgctgggatagaaaccacagctgaacagaaacagcagccttagattttcttaaagttgagtggtgtctgatgagctgcaattagcctcattttccaggtgtgtcctacaataacctaaaggcataaactctgtcccttccctctacttcacccctcccaagcctgaccctggccctgggccctgagggccagcaagcccagtgatctgcctcctcccacattttctgctcgctcggtcatggaggagggagggacagagttcactagaagtggcaggaccccagctctgctctctgggtttgttacaaaagaggtgaccgagggtcatcccaaaatgcctcagtttccccaagtttgtctttggaagggcaaagagggaacagcttagagatgccttggctggaaaggcagtctaggcttactgactgaccagctgtcctcagagatgtccccatcccagccctgcctcctttggcccctggagtcattggcacagccaggagcacagtgtccttaccctctctatacccctctttcacataagccgggaggagtcttggtcggccggattctgggctctccgcctgcaaaggccgagtctgagtggtcacctggagaggagggaggggccaggctttggagcagggcccctgagatctaaccctgggcagctccaggattccagcacaggagatcctgggggatgcctgggggaagccagagctcttgtcttgaagctatgttttaccttaggcaatgaatttatttaagaaggcttgtggggggagaatgatgaaggttattggggtgttctgaggcttatatcaggccttggggcccactggttggcatcctgactctaccatgtcccagctgcgtaacctcagttctgtaactccacctgtctgatatttgacttcttctgtcaaatgggactggcaatggccactgcacaggactggggtagatgcaatgagatgtctgccaaaggccaggtaaagagccaggcccatggtggtcaccagagggtggccggtcacagtcatcatggtctgtggctgcagtgactcctggaccccaaccagagttctctggacagaaaaagtggagtttatgtgcaaaatttatgtgcaaaggggctgacaggctgtgaagatgcaggtaacatctgcctttctggaaaattcctgacctgggcaacaatctcaatactgaccagtcctgacatctccacagtgaggagggcacacctgttcgcagttacctggctggggtggggctggggcggtcggtcagggggagagcatgtgactcagcggaggaaaacacaaaccacagagcagccttttagctcgtactgtttgctttgagatgattctgaaagtaatgcataaagaggaaagtatcagttgcccgaaatcctactccttagagatgaccattgtttatattatggccattgtgaatatattttaagttttcttctatgcacatgactataaatcaagttcctgtttgtctgtgatcccagcaggtgaaaatggctctgtaggttttcatcaaatttggaggcttcatttggatgatctgacttgaaagcagtgaggcctcctcaaaattcactggtgtggggcatggggcatcacaaagaattaacagccaccaagaagtgcaactgaaactagggaccagagaagcctgtgaggctggtctcgacctgccatccatatcagatgcaatggatggagagaacagatggaaagatggaagcttcacctgccacctgccatgagtcacaggggcaggtgcactgacttatgatcaagcggcttcttgcccaggcaactccacgcaaataggcagcagcagggagatatttatccaggcacagttgattaagctcctgagcaatgcaggggcagccacctgctgccaatgtgtgtgcgtgagtgtgcacatacccgtgtaagtacgatttttaattggggtcatcctgcacatacaactttaagtcctttcccccttctccttttgtcataagtgtttgctccacattattcaatgtgggcaggaattgagttttgcatcctaggcactggccgcaagtaggaggttgggaacctggtgtctgctgagtgccacaccatcatcaatgacagtgagcacatgtcacacgcactgtataccaggccctgtctcagatgctttacattggtgtatcagcctcatccctattctacagctgaggaaattcaggcccagggggttaaatagcttccccagggccacacagccagggagtagcagagccaggatctgaatccagctgtctggctgcagggctcctatagactgcacacctgctgcacgctggaatctttcgataaacagcatcctcttagtctttacagacttactgcaaagtagatggcaggtgaaaaaacataaaaatcttaacacttccagtatttttttttttttttacaaatcaagagggaatagggaaagattatgacataagaaccccgggaagcacgtgctagtgctattatgatctactcagcatggtggctcctctgggtccagctctctttggcttcctcctgtgagcctgaagctggaattgtcctttaaaacccaatctggtggttgggaggagaaatcagcacagcctttggagggtgatttgacctcatgaattaagaaacttaaaaacacgtgcactctgtggccagaaactcagcccccttgataggtttatcccatgggaacaaattaagaagcgcactaattagggccaggcatggtggctcacacctgtaatcccagcattttgggaggccgaggcgggcggatcacgaggtcaggagatcgagaccatcctggctaacaagtatctactaaaaaaaaatttaaaaaaattagctgggcttggtggcgggcgcctgtagtcccagctactcaggaggctgaggcaggagaatggcgtgactctgggaggcagaggttgcagtgagccgagatcgtgcctctgcactccagcctgggcaacacagcaagactccgtctcaaaaaaaaaaaaaaaaaaaaaaaagaaaaaggcacaaattaaggtggtcacacatggatttcctcccagtgtgctttataaacacttaacagtttagacaacaaaggcccaacagacaggaccatgaacacctgagggcagagctgacacctgccccactctctgttctgctctcacctagtggagggtacagcacacagcaggtcttcagttagaattgcagaagaataaacaaagatatgtgtaaatctatatattgtgatatggaaaatacagggttcaaaacaatatatatagcatggtcccttatttttgttaaaaaaggagatagtaggtatgttgatatgcacagaaaaagacaggcaggatatggccccaaatgtgggtgtaacagtagccatctctagacggtagtgagagaattttactttcttttctttattctgttctgtagagacaaaattattttcaccacttataatcaatatttcttggatattctaagcatattaattcatttaatcctcgcaacaaccctgtaacataggtactattattatcgtatcattttatagataagcaaactgtgggctgaagaatgcgtgacagtaattggtggtgccaggatttggacccaggcagcagtccctgagctgctccatttccgggtgcacaagctggggaggcaggtcctgagtgttcatcccttcctccaggacccctctgacagcgttgagagtttggttttatgtcaagtgggtgtggctggtgtaatgagaatggtaacagtgggggatttccattttgagaaaagaccaggagagagagagccctggcacccggtgggtgggctctgtgccaggggcagctttggagaggtcaggcagtggggacgtgcttcccagctcagccccaaaggctgctgccctcaccaggcctgtggagctgttggctattgctacgttaggggagattctgtcctctagactctcctcttcatcaaaacctccttcatcaggtctctttaccgactgctgcctccagcgctcacctaggcttacctgtggccaatacctggcatagcagctcttaccttggaggctccaggcccagcatctcccaggaggactggctgtgccttagggctgtagagaaggcaccactgtggagggaactgtgggtagcctgggcatctgtggggaccagcgtggtgctctgggccctattcctcaaaggggagagtgaacattaaggacagagagtcacccatctgagcctgtgagtggcagagctgggttctctacagacatgtcccctgggcagagcgaaacaaccataggaggttctgagcagccaagtgggcgctccttgggcaaatttccctgcaaacgcactccctgggaggtctgcttcatcccgggcccgccatgctcactaccattggtgtgctgggcacaggttctcataaattctcccaggaatctttggaggtgaggaccatgacctccaatgacagaggaggaaactgaggcccaaagaggggaggtgactcctccaagaaggcacagcaagtagaaagggagccaggatttgaccctgggcctgctggattatagggactgtgtcctcccttgagccctggctgggatgcactgggcaggtggtccagctggcattggtcatttgcaggacaaatgggggtggggagaggagggaactcacagcatctgagcacccaccaggtcttcgctcagctgtcacctcctcagggaagccctggtgaccttggctataatgccatgcctcggcatcactcttttgttcaaccctccttcgtgtgccttcatagcacacacatccccatgtcacagccccggcactgcatggcgttgtctgtctccctctactctgagatccacgaggctcattttgctcagggttgtgtccccaggttcgtgtccccagggcctggaaccgtgcctggctcagaatagatgctcaatgaatttgaatgaataaagaaccagaaacattcctcgccatctctccttggatcctgtcaccaaccctgccgggtaatccccatgttacagatgaggaaagagagaccagggaagtaacctgacttgcccaaggctaccgtttgcattgtgtgctggagccaggattcaaactcccaaaccagggctccttcccctccttctggaaatcaggaccaccacatgaggggataccctgggcaggagggcagaatgaagcatctggggctggtaggactcctgagaacctagccccgggcagaagcaggagctccagagccgcttcccaggctgctgagaagtccctcctgccctagtgttttcaaaatagaaggttccttggcagcactgttcaaaggggatgggggagttcaaagcaaacagatcccagattgcagagtcctgagctctgtttgcaaagacactgcacaccttggggactcagtcagagggagggagtgatcagcacagccagcggccgagtcagcctgccaagcagggccaggctgagcatgacaggagatgttagactcctgcagggcagggatagagttagggttggaggacactgaggctgtgggtgcagaatgaacagtagggctgatctcatgtggagctgggtttaaatccccattctgccacccaccaggtttgtgttgctgggtaggtttcttcatatctccaagcctcagtttctctatctgtaaaatggggaatcttcctgagactgtcataagaagtaagggaatgtaggttaaagagcctggtatgtaggagtctctcagtaaatctgagttaccctcccctccagcaaaggagaaataggaggtacgttctgttcagttcaaaacagtgcaagcagaagctggaggatgtggctttgtacgggtgcacaggaagcaagatgagtcctcttggactcaatttacagatggggaaattgaggctggcataatgacttgcccaatggcacaggggcagggacacagggcaggatgagagtctagacctcctgacctcccgtccaggctcatccactcttcagaggcaggaaaggcagagggagaaaaacaaactattgtgtggcctggggtttcccttgccctttctgggcctccccttgccctttctgggcctcaatttccttacaggtaccatggtgggcacacaagggtttcccaaaggcctggctggcctggacagtctggaagtctgaagagggtgatgtgctcagtgcccctggcccactctcatgcccagaccagtgccaggtgagggagatgtcaggaaggggaggaggttgggagaaggctagagcctgagtctcctgtgcaggttgacggcagcccttcaccccatatcctggcacagggcgggttgaagacccagcaggggagcagaatgtttcctgcgggctaacgcggccccatccgtgacctggcctggctccaggccctgctcttcagcctctttcttactctgggcattacttagacttagtacctccctgaaccccccagctccatcagctatgcagctgttctcagcttggccacacactccccttcctctcccttgggtgcattcctttgacactcattctcctccacccaattgtgtccctggtcctaaaaccgcctacttggctgtcccctcccacctggagctgcaaacaccttctaccactgacccccagtggcaatgaggaaggtgacatccactccctgagctccagcacgggtccgaagaggacctcacatttctggtgggtgatgatgatgatagtgaccaccagccaatggtcattcattcaataaatatttattgagcacctactatgtgcaggcaccattttaggtgctagggatgcaccagaggacaaataatcacaacaatgtcttcactgacctggagtttacattcctctgtcttgtgtttattatgtacacacaatacacaagtaaattgtattgcatgtttgaaggggataagagcaagataagggggattggaggagctgggggagccactgcagctttaagaggggtggccaggaggggccgtacctaggggggcttttgagggaagacaggaagggacagagggagtgcttttcacatgcagtggctgttcactgccctgtgctgatcgcctctgggtggtgcgtgcatctttgtgctgggaattttacatacttgaattcaggctgccatcacctctcacctgaaggatgcagatgctccagtctgtcctctccatgtcctgtgctgctctccaccaaaccattctccccatagcagctacagtgaagatttgacacaaatctaatcatgtcactctaccaactaaagccatccagtgattctccattgccctcagaacaaagtccaaaatcctgacaacttgctcctcgaggcctccattagctggcccagacttggccaggctcactggtcttcaaagtgctgagctcagcctcctccaggaagtcctcctgtcttctcccgtccttttggactattcctccagggccctgtgcttcccccagcacagcactttatcctgagtggtaactgctcattcctgccagttggtggatcccagaggaagggctggcgtttgttctgttcattcttagattcttagcaccaagcgcagagctggacacacagtaggaccacagtgaatctctgctgactgcagagatgcacggatgatcagagtgaccagtgagtgaacaaacacacagtaagctcgttcatcgtcccttccctagggacaggcggaaggcatccatggaggggggagaaactactcagcatccagaaactcatttgatttaatttcacgattgtttaggtcttttttcttccttgacagctatggattgggacataatctgaaaatcaatctttctctctctctccaagttcacccaggcctcctgcttggctccagtaacagtctatgggagctagcggactgttcacaccatcctgttggtggtgacagacagatgtttttctggatagtgaagcaggggctccttttcctcccctggcctggagctcctggtgagagctcagaggcggcctggacacaacacagggggagcagcagggagcttcgagatgccctgggtgccaggaggtaggagatgtcatgcctgtccttatggtcacggtgatatcaccccaggatataggtgggtactcccagggcctctgctcctttgagacccttcggagaagggccacctgtgaacaggcacgtatgggttggtgagaacaccccagatgcaggcgggcagtctctgacacacagactgaaggcagaatctaggttggaactcatgttgggaacattctggcctggatacttctgactcatagatgtgtcttgccaaaatctttctcctgttgggctgggaagtagccctggaagtgcaggggtcacaaactagtggctggcgggtgggggtgggcaggtcatctaaatgagtgaggggtgaaggcagtgcggataacacgcagaggaggggaccgcggccagtgggagagggcaggtcccatcggaggaggacaggagggagtccagggacgctcttgctgtgagctgcctcactctaaggacttcccctgtgttaaacccatttattgctcaggacacccctgtgtggtaggagctggtgatatacccatcatacagatgacgccactggggcccaggggttgtcacttgcccaaggtcacccaggcgtttggctccgaagcctgagatgctcttgaagatgagcttggctcttggtaattgttgccatgtgggactgttagaatgcagggccccaatttcctgattttcaagagagaaattggagatcttgattttttgaaatttctaggtgtttattacatggtgggcgtcaaacgagtttcatcttgggagcagtattctgctcaaggctgccaattgacaatttctgtaagaatggaaagatccttagacttcttatcaaagggctgtgacttagagacaatcagacctgagttcagatttcaaacctggacttcctttatctgagcctcagtttccccacgtgtgacccttgcttcatggggctgctgtgagcagcggatgaggtcacggtctacacatgacaagtgctggacccacactgggccatgttgatatcttcattgattccttggctgctcctagcccctccctgccgagctcaagagaaatgcttttcctgcctgctgggcccctctgcccatagtaccaagaagtttttattccctgcccagtgtgcttcggggcctggctcagattcagcttcctccatgaagctttcctgaaccccagccagaggagccctcacacccacctgcctcatctcactctgttctcaccatacacaattgtcccagtttcagagctggtgagaccgaggctcagagaggttgatagagacctattcaaggtcacacagcaaaaagatggccaaggaagggcctgaggagccagcctttctcccctcccctacctcccagttctgatccctgaattcctggagaatagagcccctaactgcccacctttggtcagcatcaccaaggccaccaaggcccaggacttggcctgggagttgagggaagcagccagcctccatgcactgggctcatggagaaaagattcctggactgcacacaaggagaaccgattctggcctggagtcagctaccacttctctgggagaataagctgcccagaacagcaggttccaaggaatgctgcattctgagagatgctaacaggtgttttccagaagatgattctatggtcaagtcagtttgcataactttattagttttttcctccataattagccttctcaaaatccaatggattcaatagccaacgtgtatttttcttgctcatggttggttccccagggcgggtgaagcagctttgctccagggtacaggaggttctaggtctgtcctcagttctctccttgaatcagcagctcttcatacacaacgaatgacaggagcaccagaggggtgaagaggaacattcaatgactccttttcaaacattattttgtctttaaaaacattttaaatttacatacaaaatccacctttttcagcgtgcatgtctatgaggttttttgtttttttttttttaattttactttaagttccaggatacaagtgcagaatgtgtaggttttttacataggtatacatgtgccatggtggtttgctacacctatcaacccgtaatctaggttttaagccctgcatgcattaactgtttgtcctaatgctcctcctcccctagctccctacctgctggtctatgagttttaacacatgcatgcattcctgtaactgccactagaatcaggacacagaacggtgctatcaccccccaggtttcccatgctgcccctttctggttacactgtttccctgccgctaagccttgtcaatcactgatctgttctctatgcctatagttttgccttttccggaatgtcataaaagtggaatcatatagtatggggtgttatgagtctagcttctttcactcagcacatttatttatttatttatattgattgatacaaaatattttacatttttatagtatacctgtgagtatttgttacatgcatagaatgtgtaatgatcaagtcagggtatttgctgtatccattatcttgagtatttatcatttctatgtgttggtaacatttcaaatcctttcttccagctcctttgaaatatacaatacattgttgctaactgtagccaccctattctgcttttgaatgttggggattatttcttctataattatatgtttgtactcaccaatcaacctctcgttatcgccccctcccacccacacacaccttccattctcgtatctatcattctactctctatatccatgagaacaactttttttagctcccacatatgagtgagaacatgtggtatctgcctttctgtgcctggcttatttcacttaacataatgacctccagttccatccatgttgctgcaaatgataggatttcattcttttttatggttgactagtattccattctgttatctataccacattttctttattcaactgtctgtcaatggacacttaggttgagtccatatctttgctactgtgaataatgctgccataaacatgcaagtgcaggtatccctttgacatacagatttctttccctttggataaatatccagtagtggcattgctggattatgtagtagttctatttttagctttttgagaaatatccatgttgttttccatagtggttgtactaattaacacttccaccaatgctgtacaagagttcccttttctccacatcctcatcaacatctgttattttttgtcttttggtagttgccattctaactgggataagatgatatctcattgtggttttgatttgcatttccctgatgactagtgctgttgagcatttttaaatattcacgttggccatttgtatgtcttattttgagaaatatctgctcatgtccttcacccactttttaatggaattatttgctttttttttattgttgagttgttcgagttctttgtaaattctagatattagtcttttgttgggtgaataatttgcaaatattttcttcaacgggttagctcttcagtctgtcaattgtttcctttgctgtgaagaagctttttagtttaatatagtctcatttgtttatttttgttatagttgtctgtgcttttgaggtcttaataagaaatctttgactaaaacaatgtcttgaagtgttttccacatgttttcttttctagcagttgaatagcttcgggtcttacatttaagtctttaatctatcttaagttgacttttgtatatggggagagatagggaatctagtctcattcttttgcatatggatatccaatttccctgtaacatttattaaagagggcgtcctttccccagtgtatgttcttggcacctttattaaaaatcagttgcctgcaaatatgtggatttatttctgaactattttgttccattggtctgtgtgtctattttcataccaataccatgctgttttggttactatagccttgtaatgtgttttgaagtcaggtagtgtggtagctccagatttttccccttttgctcaggattgctttggctagtgggctctttttttggttccatttgaatttcaagattatttcttctaattctgtgaaaaatgaccttgatattttgatagggattgcattgaatctgtagattgctttgaacagtatggcttttttttttttttttaggtggagtctcgctctgttgccaggctggagtgcagtggcatgatcttggctcactgcaacctctgactccctggttcaagtgattctcctgcctcagcctcccgagtagctgggattacaggcatgcgccaccacacctggctaatttttgtagttttagtagagatggggtttcaccatgttggccaggatggcctcaatctcctgacatcatgatctgcccgccacagcctcccaaagtgctgggattataggcatgagccaccacacctggcctgtgtggcctttttaatgatattaattcttctgattcctaagcgtgagatatctttccgtttgtttgtgtcttctttaatttcttgcatcagtgttttgtagttttccttgtagaaatcttttacctctttggtaaagtttatttctaggtattttatttttttggtagctattgtaaatgggattgcattctagatttctctcctatctagttcatcattggtatatagaaacactactgatttttgtatgttgattttgtatcctacagctttactgaatttattgatcaaatgtaggatgtcttttagtggagtttaggtttttctcaacataagatcatattatcagcaaaagggaacaatttgacttcttcttttccaacttggatgccttttatttctttctcttgcctgattgctctggctaggacttccagtattatgttgaataggaatggcgaaagcaggcatccttttcttgttccagatcccagaggaaaggctttcagcttttcccctttcaatatcatactctgttcatagttcattgagagtttttatatgaagagatgttaaatttcatcaaatgctttttctgcatctattgagatgatcatatgatttttgtccttcgttctgttgatgtgatatattatgtttattgatttgtgtacgttgaataatccttgcattcctgggataaatcccacttgatcatgttctattatctttttgatgtgctgttggatttgacttgctggtattttattgaggagtttgtttctatgttcatcaaagatattggcctgtcattttcttttgttgtgttcttgtctggttttggtatcagggtaatgctggccttgtagaatgagttaggaagagttatctccaattcaacttttttgtaatagtttccagaggattggtatttgttctgctttatatgtttggtacaatttgactttaaattagtctaatcatgggcatttctttgttgagaggcttttattactgattcaacctcactactcataattggtctctttaggttttctatttcttctgggtttaatcctggtaggttgtatattccatgaatttatttatttcctctaggttccagtttgccaatgtatagttttttgtaatactctctggtggtcttttgaatttcatggtatcagttgcaatgtctcctttttcattcttgattttgtttatttggttcttttttgattagtctagctagcggtttatcaattttgtttatctttttgaataaccagttttttgttttgctgatcctttgtattgtttcttagtctctattttatttagctctactctgatctttattattcatttccttctgctaattttgggtttgatttgttcttgcttttctagttccttgaggagcattgttaggttgtttatttgaaatatttctacttttttgatgttggtgttgcctgctatgaacaggcagcagtctctcttagtactgcttttgctgaatcccacaggttttggcatgttgtgttcccatttctatttgtttcaagaatttttttgatttccatcttaatttcttcattgacccaatggagcatgttgtttaatttccatgtatttgtatagtttccaaagttcctatttacattgattttgatattctgtagttggatcaaatgttctgtaaatatctgttaggtctatttggtctgaattccagtataaatccagtgattctctgttgatttttttgtttcaatggtctgtctaatgctgagcgtgggatattgaagtcccccactgtgattgtattggagtgtatctctcgctttagatctaggaatatttgctttatgaatcagagtgctttttcatgtttcccatatccttacattaatacacatatctgttcatctggtggaacagttgctttttccaattttttgaatttacttttgtaggggaggactttttcctgaagctgtatatatgttgtatatgttgttggttggatagggcactttggcatttttttaaagcatactgtcaaccttataaggcccagggcacaaggactgatctactttagtgggctgtggtttcaacttcagtttagtttttaaagacttttcaatactattgggatattccctgtttgtgtctcccaggacacactacattctagttcagttctcagagcctttatttagtgagctgttttgggtcagttccatacgtgcataacttgcgggtggatccagtcttcatgcacaactttattggatggttttctcaagctcccccttccctgtgcttttctccaacattcttgactcccaagggcccccttacttcttaaggtctcagtttggagccgtaactgccacttctatcagtgttacactgagcaaagcaagtccaagatcagggacaggcaaccgtaccttgcctgttccagtgctctgcaagggcatatgggagaggcaggaagggaatgaagagttgggaacaaaaacccagcctaccattgtaacactgcagacgcacaaccaaattacagaacaccaaggcctcagatgtctccagctgaggtgtcccaagtcctctggattcctggtgtcactgtctttttcatgtcttataaactggcttgagccccatctcaggcactgtgcaatgtccaggggactctctatggggtctacaaattccctagggctgggtctcctgatcactcttaccctggttttcttttcctgctaaatttttccatctccttcctgtgactgtacttccctccccacctccatacacctcacactaagctctgagccaaaaaccccgccttgcttgactgagcaaaaaaccatctattttgagcttctactctttagatgcttgtgtgtgggctcccctctccccagctaactcaattacattctgaggcgggtaaactacttgtctgggtaagaaaataaatgaaagggaaatagtatgaagatttattccccaatgaactccttctttctggagttgtggtatcaggggagtatcttttctttattcttgttgctcgtactaacattttaaggcatggagaaagtctgtagcaaggaaaccagtttgccagttaattgttgtttaatccaatctttccaaaatgtacttggccatggcatgtctttgtcatggagcatccattaacacctgaaagcccagggcgtgggaaaaaacacctaagacgagggttgttgtgaggatcaaatggaagaaggtgagctttaggtattttctgctgacaagttagtggagcttccccttccactccagagaccactcctgcccaccccaaaccccctgttatcctggaaaaattgtccaaatgaggccacttttgagagcaaaaggagtacaattaatgcctacactaggataatagtaggcataaactagactgtcctgggcaaagtggatcatatggtcaccctacacactttctttacagctggtggtggctgttgcaaaatccagactacaaatgaactgagttttctgttgacctctgtttccccacctgtgaagtgaggtcttctcaatttttttttcatttattcaatcatcaaaaaccacgtaacatgcctctcctagttgccagcactgtgtaggccttgaggagccacagtgaatgagatatttcccaccttcaatgtcttcaatgagacatttctggatcatgtagaaggagagacagatgataggatcattagggatcatggcctctgcttcaccttgacctttttaccctcaatccatgtgcaaagatcaatctagaagggccttttggtggtggatcctggctgtcatcacaggaggatctcctagtacctggaggcctccccacatctgcactagttcgaacaatttccaggtcagagtcctaactagggagttggtggagacttcttccccaggccacttcttctccagctggcagcgctaatcacgactcacctgctgctttggagcaggattacctgtcaaggttcatttgagctgcgggcttcccagagaatccccgctccccaccaaacagctctgatggcagctgaggggctgctccccaggaagtgagagggaggaaaattacctttcatatgttgttgcctgtttggccaggcagttgcagcaacagcttgtgtcctgccaagcctgataacaggagtgtcatggtctggggacagactggccctgggaggtgagcaatgaggattccaggaaactgtggagattgcctgcaatttggacctctcaaattagatggcctcagtgagtcatttcagactatacaaattgcaccttgggcagggtctgttatatggcttccttgagccctattagctcttagagttttcctcaaagaccatcaccattagagacagcagaatttgagcttacgtgcctgtgtgtgaccaggtatgtgacgatcaatatgttacttcatggaaaccataatttatggggataataactgtatcaattaggaccctttttattataagggaaagaaatgcagaagcagaactataggcttattaagtaaaaagtccagaggaatttcaggtatggctgaatccaggtgctcaaatgaggccttcaggaatccacctgtctctgtaacttgtctctgcttttctcctcacttgtctaccggcaggcctgctcttcctggtggcctctaggaattgcaggagaaggtagagcttcactagcccagtaattccaaaagtcttagaatagaatttcactggttagtgctaagtcatgtacccatgcctaagctaagtactaaggccagaggaataggatgctctaattggccaggctgaggccttcagcccacctcttggaactcaaaccacaaggacctaggagggggtgacgttccccaaatggaggagccataactccagagaaaggagaagtgggtgtcaagtcgacaaaaatagcctttttagtaggcatgagatttaacatttttatcaagcagtagatcaaatgcactaaccagtcagaagggaggctgccagagcagggtgggaaataaattctctgggtgctggactgtgaggagctggggagggcaccaggagaggggctggggcagtatgggagcatctggagctcagggtggcaaccactactagcccatatggacatttttgccctggccgttccagtgagtcctggtgaacatgccctgacggctgctgctttgcctagaccagccctcgttttcttgggtcctcacttgcactccactttgggaggttgctcaggcttgtctgtgcacactttgtctccagacctcttgttaacaggtgtgtgtcattgttcagaacagcctggccaccccaggccaccagcctgggagataggcattagcagatggcatggcgccagtctcctgaagtgtctgtgctgctgctgcgtttaagagtctcgggcctcaggcttatctgtatcaacctcaaaatagtgacatttacatggcactcagtggtattagttcctgcctgggcatctaagggagtcattctgaaagatggaggatggaagacatggtcaggaatagctagagagccacttgggcgcaattgtgaaacaaatgtcatggggactcgaacccagcagccatcctgcactgagcgtttggtgtgctggcccctgtgctgagtgtttcccatgctcttcctcaactgaacatcacatgaagcaggtgcaatgtcaccccagaggatgaggaaactgaggcacagagggtggaaatcacttgttcacctcactccttattcacccttctgggtcacctcacccttccaggtcacctcactacagatgagatctaaggcctctcctggggcctttccaaggccttggcctgatctgatccccatctctctgacctcctgtctaactatgtcctcctcactctgctccagcctcacaggcctcctggccatcctgggccaggctccacacattcccaccccagggacttggcacatactcttccctctgcctgggatgcttgtccatctcagacccacatgactcatccataaattctactcagatgcttcctcctcaggggctgccctccctctgcaccctgcagcctcccatggctccctcattccctctgcctcattcctgtcctggcacatgtcctgctccaggattgtgtcatatatgcgtttgttgatctggtttttatccacaccctgcactaactaaagtgtaagctcaataagaacaaggctttggttagttttgctcattgctatttccctggcatctagggcacagcttggcacacaatagatgatccataactatttgtgtgcaaatcaatttgtaaaatgggggaccacctgccccataaatttcttgtgatgtttaaattagacaaggtgggtatgctttgtatatatgcacattacttatgtatatgtaaaattctgcatggatacttggctgcatgttacgtatgcatatgtagggcccacaggcagcaatttttcaatacggggcattatctctctctatcccttcaactgtgcttctcctccatggttctgggacttgcccaaaggtgccatcatcctctccatcacctgtgctggaaagctggatggggaggcctttagcatcacttgcccactgctccagctcacacttcttcctggcacaaggcaggatcgacttcccggtccctgtggttgtggggagagaagtggaacaaataattctggcctatttgttgtgagtgaaagtgatgcctgccggttccgagctggatattgttgtgactgagaccactcagagttctcattcatctgccacagtgactggcaaggcaccagacagtggccactcattggccaagtccctgagtgaggaccacatggacagagcctcatctgggcttcaatggacaggaagcctgagtaacagacctttgttgatttggggctgtttgttacgtggcagagccagcctgttctgactgatgcagttacagggggctggtaaggctaccctttaatcacatagcagaacaatatctggtaaggacagagcagggcttgctgacactgactgacttcagtccacttgtcatttctcctctgttcctggagagggatggcaatgtgaaagctagcagagaccacactcactgctccatgcaccagttgtgtgaccttagaccaggcagtacactccctgtagctcagttttctctcctgacacttggggttaacaagaatgttctctcctcttctccaacacacacacaggtccctggggtaattaagacaggtaatgaatgtgagagctttgcaggagcatgggccatttttaagttgtggaaactgctctggggtcctgtccaggcccatggctttgtgcccttcagtttcctggttgctgaagcctcctggggaggtggccctggtcactcagagatgttaacacccctcaggtgaggagatgtgatgggctggccatgtctcctcgtttgcttgctgtcacatttaatgcaggctccaagcctggccacttagtcactcatccaacacctcactcaaacctaacacccgcttcttcccactaatgaggttttgcttggagatgccggctctcaccccaaacttgtttctcttttctgttcctgtcacatcgaggggaaaggtggtgttcaaattatctgtcccccagggcaatagttaatacttttgaggtgaaattctttaaggggttgtctttctggctggaccctttctgggctccagaatcctgactgtggccctgagggactatccctctccatttggcttcatgttgtgtgacctgtaagagttcttggacccagagctttaggcactgactgaatggcttcttgagaaaggtggaatcaacctgtgagaagagggcagttgacaattcaccatacaggaaattgcagactaattaaatacaactttgaaagatagtcagtggagcctttggccaagacattatttgccaaatagtccacatgctgccctgcagttcccagtctgttttgcacttatgttcatgccatgtgactagttctgaccaatggactgtgagcagaagcaatatgcgtgtgttagttcatttgcattgctataaaggaatacccaaggctgggaaacttataaagaaaagaggtttatttggctcacagttctgcaggctgtatatcaagtatagtgctgacatctagtaaggacttcacaattatggcagaaggcgaaggggagcccacatgtcacatggtgagagagggagtgagaaagagagggaggagatgccagcctcttttaaacaaccatagaatgggtgaactcacagaatgagaactcactcattactgtaaggacagcagcaagtggttcatgaaggatccactcccatgacccaaacacctcccaatggacccactttcaacattggcggtcacatttcaacataaaatttggaagcaacaagacattcaaaacatatcagtatgtcatttccaggctgaggtggccaagagctaatgtgactcctccatccctgtcttcccataaagaggtgacccaggcgactgcctgttccagacagcatagctacaagacagagaagagataaatgtttattgtgttaagccattgaggtttgagggtttgtttacagtggtggccaacattaataatcctgactgatacagggtgctgtgagaatgtaatttccatgtggacagggaccatgtctgttttgtccaccactgaggcaccaatacataacaaagcatgtagaagctgctaaataaatatacatgaatgatggaatgaagtttgtgtacaaattttcaaagtttcctctccaggcaaccagtgaaaactcctccattgaagtgtcacagggatggtggtttctgttctcttctttcttgcctggtcccatggtcctcaggttccatgggtccttgcttctgagggtctctactcctcctgctcctgctgctctgtctcctgatgtcacttccttgtgacataggccttttctagcatttgcccgaagtctgagtcttcatcaacagcactcctgagacgcacatttgtcctctgggaagtatcggcccctaatcacttgcttgggggcttcctacgctactttccccagtagttttgatctaagtcaacacaggaatttgacacattgctatttgaatcaagagaggttgccatactaatgttgtgcagctaagcatgacctggtagatgtggtcaaggctaccgcatcattcttcactggactctagtcacttgcttctaaacctatcacctatcacctatcaccaggctcaagttttatgttccaaatcgactttctggactggtgttgtggtttgaataaggtttgtcccctctgaaactcatgctgaaatttgattgcattgtggtggtgttggaaggtgggccctaatgggaggtgcttgtgtcataggagcagatcctccatgaatagattaatgctgtcttgtgggagtgagttctcaccatcacaggactgaattagttacggtgagaggaggttgttataaagtgagattcctcctcatgtttgctttttctttgcacatgcctttctgtttctccaccacgtcttgacatagcacttggccctcaccagaagctgagcagatgccagtgccatgctcttggactttccagccactagaatcacgagctgaataaagcttttttctttataaattgacccactctcaggtattctgttatagccacacaaaatggaccaagacagctgtcatgagaggactctttctaaaataaaatctgactttatccctcccttgctgaagaacagtgtagtagctaggaacatgggtttcagaccctcagcaccctggttcgactcccttctctgtcacttacgctgtgtggtttttggtaatttccctaaattccctctgcctcagtttccacaactgttaatggagatgataatgaacatccccaggattcttgtaggattcaatcagttaatacacatcaagtgattaggttcaggaaaaaaatagctcaagaatctcaggctaaagtctttcaggcctggaatttgaggctgtttaccatggggcttctgttgatctctgatctcttctcccgtcactccctgacttgagcctccagctcaggctgcctagctggtttctgacacacatggtcttgctattacctctgcctggactctcttctctctgtctcattttgaagattcagctcagagccatctctcccaggaagccctttgtattaaacagcttgggcttccataacaaaataccacaggctgggaagcttatacatagaaacttattttctcatagttctggaagctggaagtccacaatcaaggtgtcagcagatttggtgtcttctgaggtctttctccttgacttgcagaccgctgccttcatgcagtgtcctcatctggcgtttcctctgtgctgtgtgtgtctgtttaaatttcttcttcttataaggaagagtttcctggttaccctaaagacctccttttaacttaattacctctttaaggaacttatcttcaaatacagttacattatgaggtactgggagttagacttcaatacatacattttgtgggtgacacaattcagctcatagacccctctatgactcttacacttcacactctgcctcccacctccactgggaccccacagccctctgtgcatatccctgtcatggcccttaacactgtatggcagcaaaattcattcagcaatctttattgagcacctgctatgtgccaggcactgtgctgggaactggggcaagacagtggagaagaagggcgccctgctccctgcagtgttggagcagatgtcctggaggtggaggtagacatggagcaaggtaatgagccttagaaaagaggcagaagacagctctataaacatacaggacaagaggacctgaactaggtcaagaggtcagagaggactctgtcaaattgccatggtaggtgactactgatgtccactcactaatgaataaaagtagcagccaacgtttatggagctgctgctgtgtgttgggctctgggatttgcatgtgccaccttatttactactccctaagccctgttttctctattttccagtcaaggaaagtggagtttaggaaggctaaatgatgtactgatggctgcatggctaggaagggggaggccaggacttcattcaggtctccgtgatggtaaagttgtggccttattatatccaggcccccatcccaccccttcagcttcacatttgcccctcaacccttctcctctgctgatcttgatcctcaaactcacatacccagttgtgtggttgctcagtctgccaatgccaccctctctgggtgcatgcctggcccccaggccaacagcagggattggtgcagcctgtccatccttctcctcatgtctttccatgggcttggacttctctcctctgaacataggtgagatgttggccgagctttcagcccttgtggcaataacattgaggtttgggggctcattaaaggcactggtttcccttcctcagtccaattgacagggtcaagggcatgttgaatagaaatgaaccctctttatcacccataaggctgatgctggaggacggtgcttacccctgagggaatgtggcccccgccctcgaccccacagacctcaggaccagacagggaggagccacccatcagaggtgcattgacccctctcatcagggttcagactcctgcatggttgggtgtgaggtgggccagcacagctgtcaccatcttactcaagggggaaccaaggcttacaaaagcgagctcttgcctgaatccccaggaaagtgggcagtgaggaaatgaacccaggtctgacccaaagccattgcacttcattggcccccacattgaccaccccaggcctgggccctgccagcctcaccccagtctcttgggatggctcactccatgctgagcagctctgactgtcagaaaatgcttcttccctttgaattccaagctgctttctggtggattctatgaaccagtccttgctttgccctctggagttgtacagtgagtttcatctcctcagtaactgcaaaataaatttaataaacgccactaaagtgtgtaatctcataggcaggatgcagaatttctgtgcttcagccttttccctgtaattactagcaccatggaaattgcagggattagaaactcaactggaaatgaggatggattgcgtcaccaagaaagttgaaatgaacagaaactccagcacaataaggcaggcttggatttgcattaaattaggaggcaagtccaggcccattgattttatggggacagtgaccttctaggatttgtttaggaaacttggaggggtaagagaaagttgggatggggtgtgtcaggtgatgtgagttggtggcagcctctcttcgaaaaattaattcatcgtatacctcagagttcatgtggactaacctcactttcaaggttggatggcattcctcttccatcacctctttccttccacccccccattcccaggaagtgagagacttgtctaaggtcacacagctggtccatggggacctaggactagaatataggccttctcatgctatgttcactgaccttcacaatgcacgtgttaatcctaatccccatcagttttggtgaaaaaatgtgggccactagactgtcatcaggttgtaagaaaatgtaagatccttcttcccctatacctctgtggtccaccagaaacagcggggagtgtgtgagggagcagaacctggctcttctaagctctgacctcattgcccactccttccccagcaatgcacttattgcctcctcgcattgcatacccagggcagacagtgtcaattggcttcggcaccattcccgatcagcgtggatctcacaatcttaacctggagttaactcacaagatgaagcctatttgcatactccgtcttcatcaaccaagagaacgccatcaaccaagagaaaaactagacaatttgggatttaaaaatttttctaaaacctactattgagtttcaatcatggccattagtgtgaaatactatgttagactcactgcaaaagtggctacaattctccacctgctgtgatttggatgtggtttgtttcccaccctcaaaactcatgttaaaatttgatccccaggctgggtgtggtggctcacgcctgtaatcccagcactttgggaggctgaggtgggcagatcacgaggtcagtagatggagaccatcttggccaacatgatgaaaccccatctctactaaaaatacaaaaaaattagccaggcctggtggtgggcgcctgtagtcccagctacttgggaggctgaggcagaagaatggtgtgaacccgggaggcagagcttgcagtgagccgagattgcaccactgtgctccagcctgggcaacagagggaaacttggtctcaaaaaaaaaaaaaaaaaaaaaaaagattcccagtgtggcagtgttgggaggtggggcctagcaggaggtatttgggttatgggggtacattccttatgaagagattaattctcacccacctgggtgagtgagttctccctcttttgggagcgagctgttaaaaagaatctggcttcctcagtttctctctcttgcttcctctttgccatgcgatttcatttatttatttatttgtttttgaggtggagtcttgctctgtcacccaggttggagtgtagtggtgcgatcttggctcactgcaacctccatctcctgggttcaagcgatcctcctgcctcagcctctcaagtagctgggattacaggtgtgtgccaccacacccggctaattttgtatttttagtagagatggtgtttcaccacattggtcaggctggtctcaaactcctgacctcaggtgatccatccaccttggtctctcaaagtgctgggattataggcgtgagccacctcacctggcctgccatgtgacttctttgcacatgctggctccccttccactttctgccatgagtagaagcagaaaggagaccctgaccagatgcagttgttcagtcttggaattttcagccaccggaattgtgagccaaatgaacttcttttctttataaattacacagcctcaggtattctgttatggcaatacagaatggactattggtaccaggtgttgctgtgcaggtacttgaaaatgtggaagcagctttggaactgcataatgagtagaggttggaagaagaataggctagaaaaagactgtattgctgggaatggagcattaagagtgatgttggcagaggcttagaagatgagccggaacttcttaaagattggttaagtggttgtggccaaaatgttgattaaaaatatggacagtaaaggccatactgatgaagtttcagatgggaatgaggaatatcttattggaaattggagtaaaggccgtccttattacactgtaacaaagaacttggatgcattgtgtcctgccctagggccttggaaggacatatttaagagtgatgaatatttggcagaagaaatttctcagcagcaaagcattcaggcagctgtgtggttatgtctaactgcttatggtgaactgccagggaaaagggaagcagggtgaaaagatttggaaactttgcagccccgccatgtggtaaagaatgaaagcattttcaggaggaatccaagggtgtagccaagagaccctttgctaaatagataagcgaggttaaaagggagccaggtgctaacagccagaacaatgggaaaagggccccaaaggcatctgaaagatcttcaaagccatgccttccatcaccagcccagaggcttggacaaactgatttctggggacgggcccagagcactgctaccctgtgctgccccatatcctggctgctctggctggagcagccatggctcaagaagccccaggtgcaacttatgtcacagttctggagatcctaagtggtaagccttggtggtatctgcatccacgtggtactaattttgcaggcatgcagaatgcaagggtgatggaggcatggcagcttccacctggatttcaggggatgtatcgacctggaggcagaaacctgctacagggcagagaccctgcagagagcctctactgaaagcctctactcaggcagtgccatggggaaatgtgaggttagagccctcacatggaatccccacccaggctctgactactggagctgtgggaccagggccactactctccagactccagcatgttagagccactggcagcttgcaccccgagcctggaaaagccacaggcactcagctccaacccatgagagcagccacataggctgcacccagaaaagccatagaagtgtggctgtagaggctttgggagcccaccgctcacacaaatgtgcccgggatgcaggacctggagtcaagagagattattttggcactgtaagatttaatatctgccctgccgggtttcagacttgtgtgaggccttttgcccctttcttttggccaatttttcttttttggaatggaaatgtttacccaatgcctgtaccaccattatatcttggaagtgaataacttatttttgatcttacaggctcataaatgggaaggagcttgccttgagtctcaggcaagagactttgagcttttaaattgatgccaggacaagttaagacttttgggactattgggatcaggaatgattatattttgcatgtgacaaagacataagttttggtgggggggcaggggtggaatgctatagtttgaatgtagtttgtcctcgctaaaactcatgttgaaatttgatccgtaatgtggcagtgttaaaaagagtctggcttcctcagtctctcccttgcttcctctcttgccatctgatctctttgaacatgccgggtccttttccaatatccaccatgagttgaagcagcccaaggccctcaccagatgcagctgcccaatcttggacttttcagccaccagaagcatgagccaaataaaacatttttctttataaattactcattctcaggtgttctgttatagtaacacaaaatggactaatcaaacccttcacaatgtgactttgcagcacctcccatctcgtggcagagtctctttctccaccccttgtacctgggtcagcctgtgacttgctttgtgcaatcgaatgggatggaaatgacagagtgtcatttcagagcctggactccaagaggccttgcattcttccacccagtctcttggaattctactgctgccgtggaaacaagcctgggagagcctgctagaggacaagagacccaagggcctaatcacccccattgccccagatgaaagccaactaaccacccatccatttgagtagggccatctgagactgccagctcaagctgacttgcccgctgaccacagacagaagagcaagtccagctgagatgagatgagtctgtccagagcaaagaaacctcctgctgtgctgtagactcatgagctaaataaggcttattgttttgttttgttttgtttcgttttgttttgttttgagacacagtttccctctgtcgcccaggctggagtctggatgcagtgatgtgatctcagctcactgcaacctctgtttcttgggttcaagtgattctccttcctcagcctccagagtagctggaactacaggcatgtgctaccacacccagctaatttttatctttttagtagagacggggtttcgccatgtcggccaggctgatctcggactcctgacctcaggtgatccgcccgcctcagcctcccaaagtgctggggttacaggtgtgagctactgccccttgcccaggtttattgttttaagcccctaggttttgaagtagtttttatgtagtcatgactcatgcattatctcatgtattccctctaataactttatgtgatgacatgattcccattttacaaatagtaaagttgaggcttagagaaaaaaagacttgcctggatcattctggtaatcacagaactaaaattcaacccaggtctttctgactcctctgtcaatgctcgatgtagctaaagaatctctgatactggagtggcacataggttgcatttcaattgccaatgtcagttagttggtaatgtcctcctgtaatgtagtcttgaaaagatgcagcgggataagtaagagtactgtgattgattagcgatgtctgccattgcctggtgcccacagaggcaacagtgtgagtgctatgtacttgccacacaagtctcaaatatacccaaacccaaagcgtgagagaattttggctgatgtatcaggatttttccctgcggcggggcagggtgcctgtgaggacacctgctcttatctaaggcaaccatgcagttttgctccatgctcaggccgtgggtcttccagttgtcagccctgctgtcatccagcccagggtgacactgtcttgctcgcttaccagggttggtgttaggattaaaagagacgtggatgagaaagcatttaatttccaggtgaaaatgatggcgtcgaacatttaaactccactcgtctctcgaaatcaaccaaagacaataaaacaaaaatctgattataggggaaatatgtttccttaatttttattgaaaccagaaatcaccacagctccaaaccacaaaccctggagcctttcttccaaatactgcgaaatctagaccagaacacagaggaaactgacaatccatgtggaccccctagtatgttgtagataggaaagccacatcccagacccaaaaacttcatccaagagtccttggcttaaagcactgagacccagacacagaaccctagcggcttggctggggccaccctgactgctgggatgtcaaacacggaattctgctcccacggcagaagaaacaactgatgtagtgagagacagttcagaccatgagcccaaatgggagctgcagaccgcctgaggccatcctgcccacaccttcccacgctatcctcccacaaagactggtcctatccagagtgaggtaaaaagtaaccaacacaggaactatgcctagctgctgcaaaaagagagatggaacgtaaacaaaggcagatgaagaaaatagcccgcaagaggaattgcccaaagaaacaggggaaaacaattgttcttcagagtctcaatcagtctcagatgacacgatgtctctttaaaaagacttgagaaatatgaggattgaaaaaagcgattataaaataacagcatgagatgtaaatcaagctggctgttcttaggcataaaattaagtctatctatctctatatctaaatttatggatatatttataggcacagatatagatagagagatagtgagagaggtggggaacaaaagagataaaaaccacattagaagcacttacaaataaagtgaggatgattacactatagtagggaatattgtggataagctatagaaagtcacacagcattaaatagaaaataactttgtttcgtttcggtgaaagattagagagatgagaggcataaaagacaggcaaacattatccaatgaatacacattctgtgggacaagaggtataaaaatactcaaagatacactaaaaatgaaaatcttgaaataaagacatgaatctgcaggcccaaagtatatacaatcttccaggaaatattgctgaagaactatcagttccaagacaaatctgcataaaataattgagcttcaaaaataaagttactacatctggtcatcaaggtagagaagtcaaatcacaacgcagcggggaaattaggttgatagaaacatctccttcccaacgctggaaggcagtggaatgatgcctatagagttccaagggaaagaaaaggcagcccccaagttttacacccaaccagtatgtctttcaagtaaaaggcgttggagacatttcgaagtatgaggagctcatgaaatacaacattcatgagttttcccagaaaaaaaaatctattaacaaaaatgtgaaattaagaaagaacaaaggaaaggtaaagatatactcaaaaattaaagaggaagaaagaaagaaggatggaaacaaggaagaaaggaagcaagaagggaatgttttgggctgagaattagtcctatttaaatgcagaatcctgccaggtgcggtggctcacacacctgtaatcccagcactttgggaggctgaggcgggaggatcgcttgtagccaggagttcaagatcagcctaggcaacatagtgaaaccccaactttacaaaaaataaaaattaaaaaaatcagccaggtgtggcggtgtgtgcctgtagtcctagctacttgggaagctgaggattgcttgagtccaggagttcgaggctacagcgagctgtgattgtgtcatggcactccagcctgggtgacagagtgaagccctgtctcaaaaaaaaagaaaaaaaaaaagaacccaccctaaattgccatgagatttgtttgtgcctcccaaatatcatgaaatgttataaaccctggcaaggtaataataatgttataagaaacaatataagtgtgctaacttcctaactttcattcccaaggggtcaatacaatcagtttaaaatcaaaacataaagttattttttaaaaagcatgaccacagtatcttaatattttacaagtttttctcctttattgtaaaagtatttttaggaaaaaaaaattcttgtgaagcaacatttatctgaagttaatatttatttcagttttaccccaatttccaattctcctggtaaattaagtaaaattatacctaatattcttttattaaagatagcatatataatataatttcatttttccttgtctatctgtgtctcctattctatgtaggtacacagagaagtgcctgggacgagattcaccaaatagaaaacattttttggggggtgatatttatttactattgcttgaatgttttactgtacgcatttgtcatttttataacatcaaatttgtttctcgtttattattttggttagattgtgttttgcacaatggaaccaaagctggtgttttgacaaaaatggagttttgggagagatctttgcacaaaatacaagaagatatcagggggctgcaggaaggaggcagccagatgaaacctcctatgtgagcagcacatgtttgattttgtggagaggatggcgagggcagtttgcagtgctgcctgactcatgcagcatccacctccgctttgccatcctggcttgggacgaggagggatgggaccaacagactctggctcagctgatgctcctgcagaccctctctgtaagagcctactagggtctggactattgctgcagatggcaactgggtttctcacacccaacctggctccttccaatcccttcccctgcaaactcagttatatcacccggttcctacctgctgaaacttctccaggttcctctacccctcagcccaacagagagactgagtcacttgcccaaggttgcacagcttgtaactggaaggggaattggaacccagttcagtctggctccagagcctgcgggcttggctgtagcaacccagctccctagcatgccccctccctgtctgtctggcagccctcgcctcgcctcttacaccagagaagcctgggctgagggggctgtcgcttagggagggataaatagatttggtgttggccaggcatggtggctcacgcctgtaatcccagtactttgggagggcgaggcaggtggatcacttgaggtcaggagtttgagatgagcctggccaacatggttaaatcctgtctctactaaaatacaaaaattagctgggcatggttgtgtgcacctgtaatcccagctgcccgggaggctgaggcaggagaattgcttgaacccaggagtaggaggttgcagtgagccgagatcatgccactgcactccagcctgggcaacagagcgagactctgtctcaaaaaaaaaaaaaaaaaaatggatctagtgtttctgctttggctcctcctctcctctcttcccagacactccccaccaccctaccctcagctttcacagtgaaattaggagcagtgtgtggtaagaggaacgtctgagtcccagtcccagtcctgagatctccggtaagtccctctctgtaaaatatgattgctctagtgcatcagttagttaattcattccttcactcacaggctaaatatttatccaacacctactaggctgtgttgcgggcactggatattcagagctgaatattcaggcagtgtccctgtcctcccagggtgctgctccagccggggaggtgcagaactggcggaaggatgcagagcacatgggggctgaccccatgtttcagctgagaatttcgatttgaggaagtccactgggcagagagtgggggaactgcattccagagaggggaaccagagagtgcgcagggcggggtggctgggggagggggtcaaagatagggcgtggaggagagccctacaggaagctagtcatacagggacgtggacagaagtttggattttgttccaagggcattgggaagccactggagggttttaagctagggaaggacatgatctaacttatttttaagattttgccctggttgcctagtggaagaaggaggtgggaggtgggaggggaacctggagcccaggcaggaggtggttgtcgaggtgggggtgttttaacacaccccgatgtctcctttctgcttgcaggcagcctggggtcctggtctcttttccaacccaggcatttgtgggtggaaactggggctgccttgcactgggaagcaggggttgggggaacccaagaaacgcaatgcctagttttcacccagcctcacaggatcaccgcctcaatagccaagtgacgtttgcacagacacaggggtgctagatggcaagttgcatgaaaatctttggtatttgcaaattctcttgacttcagctttgcctcccctgctctagagggagggataggactaaatgtggtaggaagccccccaggccccacatttcatgctccatcttccggtgccttatcctggcattcagggctctgcaaacctgacttcagcttccctctggcgctgctgctcttcctgccgctttggttacatccagaatcctcaaatcctccttctcagctttgcgcatgctgctctaccccatgcccttccctgtctcaccatctctctagtccaccccctcaagtgtgtttgatctgtttcctcgcatctaacccccagagtcccatgagaggcagataatgtggctttccctattgcacaggtgaggactgcatctcctagaggccatgtgacttgcccaaggtgtcacagctcctgaccatggagcacgcctgcccccgggacacaagggccagaaccctcagccacacagggttgaagcagccacagtctccacgtggctctcacattttcccattcaaccatgtacttgtttgatctgcatcacaatcctgggagctcctcaggcaggatggtcacgcccacttgttggatgaagaaattgaggtcccgggagaagaagcaacttcactggatccaaacaggggttgggggttactagtagaggcaggactaggggcctggctgcagtgctcatgagcactggagagaagctgaaggcagggatgcaggctggggggcgaatcagggagggctgcctgaaagaggtgggctgaaaggctggcttgggaggactgaaataatgaggcctgctgagaaaggagctcagaactgaagggcaaggtgagttcagatacaaatgccaagaggaaagaaggctgctttccgtgtggatgatgcagataatctgagatcctccaggggcctgagtcagggccaaggtttagatgacagctgagaccctcgaggtacttatctatcctggagtgtgtcctgtctgcaaataggttattcagacaccctcacatagcactcgctgtgtgcctggcacccccgaacagctctgtagcacctcaggctgtgagatagggattcttgttagtgtctgccttacaggtgagcttaggtcactggccccaggacccacagccctgaatgttgcagctagggtctgtgtggccacaatgctaccttgctgctgcgtgcaacggccactcccctgcccttcccctcccctcccctcctgggaggtcacatagtgacagctgacagcaggaagattccacccaggcagccatgtgtggtcatccagaagtgtccaacatcagctcagccaccacacctgaccacacttgagtcaggggtacagggctgtctggggacattggagatcgagcatgtggagatgggttcaagccctgggttagccctgtaatggctgtgtgacctcaggtgagccacttaatttctctgggctgccctttcctcctgggtcctgtttcctgcctggggccatgggatgtttaagtggataaggatgcattttacaaaaccaagatagattattgtgaacccgtgggcatcactctcaccacaagggcctcctgatctcgagcaatccccggcgcagcaagaagctcttcttccctcccctggcacaatttttcgtgaactaaatctcccagcagacaagtaagtgagagctatgattgactcatcgttgtcaatattcctcccactgtttgctgtctcagcatccctggggaacctggggaatcggcaagaaaaattcctgcctgactctgagagccccaagccttgccagggtctcagggtgcttagaatcctagtatgtcagagctggattcttgatgccataaggttcaatccttttactggacagatggggaagctgaggcctgaaggtacataatgatgacaataataataatgacagcaacacaacaacgtttgtgtcaatgctttcagctgcagatggtgagaagaaaatccacatcagactggcttcagcacaaaggtgggaggcattagcataggtgacagaaaaatcagagtaggacttcaggaatggcttgatcaagagctcaaaaaatgtcacctggtcccacttttactctgtcccagagtctgctgtggttctgccccattggcttcatcctcaggcacagtgtggtggcaaatggccgcggcagcctgtctgtcccccgaggttcaatatcagagacaaagagcttgtgcctcagtcccagcattcccaaccagtgttttgttgcactccgttggctcttatgggccatgtgatcatccttgagccaatttagtataataccctgactagctggggcctggggtgaagccccactcagaaccacagactgaatgtggaaagggaggatctcccccaaatcaagggctgttgctgaaataagaggacatggttactggggagacaaaaagctggcgcccattagcacacactcctggaaggagcacacaccatacccaggtgctgtgctaggcacttggcatttgtttccacaactctccccagcaagcagccaggtgggcatccttaccaaggaggaaactgaagtcagaaagtgagagacccacccaacacacagtgagaaaggttcagggtcatcactcagagcacatgacagaacaggtactcctgggggcaacgggggatgagtccactgggaactctaagagttatagagcttgcctctgagccacccacctgtggagtggggccctggggtgcatgtcctccaagtcctcacccacccttggctgaagactatctgcccggcacgcaggctcagggaagccctcagatggagtcacaggcacttgtctgtatattccagtggtttggtccagggtggggagtgttgagggatgcagatgggacgcggacagcatcgctaaggtctatgtccaacagggggtggtgatctgccccctcctttccagtcatgcccaccccaccatagagctgctaatctgattcatcggggtccatgtgctaattgggcccaggtaatggaagggcagggccactgtgctgcaaggccagggccccacagagctttctcttccactttcggcactgccacatggcgggcagataaaggccagaccctactcttctttcccaccttgtccaaaaaagcactgagtggttaagttaggccagaggctgcacgctcagccctggggtctcctcttcctgaacttcctttctctttgtggtcagccagagatgaacctatctcaaaactcatataggggccaggcacagtggctcacacctgtaatctcagcactttgggaggctgaggtgggtggatcacctgaggtcaggagttcgagaccagcctggccaacatggtgaaaccccgtctctactaaaaatacaaaaattagccgagtgtggtcgcgggtgcctgtaatcccagctactcgggaggctgaggcaggcgaatcacttgaacccaggaggcggaagttgcagtgagccgagatcgcaccactgtactccagcctgggtgatagagcaagactctgtctcaaaacaaacaaacaaaaaaacaaactcatataagaatgaggtaggaggccccatctaaactttgagcctcagctagaaacttctgtatctgagtatggagacagaagtgactttatcttggatgtgaatctgccatgttgatttctgattagccccaggactgtgaatgtctcctgattccttttttttttttttttactatccctggggcaagagcatgtctatcttgatgtcattgcacaaatcataggctatgctgcacgtagtgctctggcctattctggagggctgcctttgactgtcttgctagaacacttagcctttccctatggtttacaagctttgggtcttgggggtaaaagtgtggaggtctgctgtctagtcatagataagctttgggtgttgggggtaacagtgtggcggtctgcctgtctggtggctgttcaagaccatgcttctgtctgtaaatttgctaataaaacactctttactgacaaaccggatttgtctgacaaggatttgactgtctccttctgtggtttctcagctccttcagcatttgggggccactttttatataaaacccgttcacggaacaatgagtatatagaagagggcacggggtggggtgggggtgggagtggggatggtggggagactcccagagagaagagggcaaggaaatagtgaggacctgtggacactgcaaatgctgtggtgctgtgaacacaatcctgccatcaccgtggctgtgtcgttgtggctggagtgttttgtgtcatattgaatctttttttttttttttttttgagacagagtctcactcattatctcagctcactgcaacctccacctcccaggttcaagcgattctcctgcttagccatctgagtacctgggactacaagcgcaccaccatgcctagctaatttttttttaagtagagatggggttttgccatgttggccagcctggtcttgaactcctgacttcaggtgatccacctgctttggcctcccaaagtgctgggattacaggtgtgagccaccgtgcccagtccatgttgaatctttgaataccttccagtgtgttgccaaaaattccagggtgctgtgaaccccaaaatattgagaaccactatgactttggcagggttggcagccacttcagctcctgcactccaggctgcagcacccagggctggaggcagcagggggtcagcaagggttaggcggccttgtgtgtgccctgagctgtgcaccctccccggcccccgcccagcctcccccttctctgcctctcaggtcagggctctgggtggcgcaaggttaatggaaacctggaggaggtgagcgggaagggaaattgctgttaagtgtttctctttcttttcctttctgctgcctcagtcatctcattctcatccatggatcaggccagggcttgagactcataatttcaaagtccttttaacttttctaaggcagaattgtattgcttttggccaaaggccactctgggatttacagagcaaagagcagtcacaactctctctttagtttaagacacagggctcaaaacaggacacgcggggctgatttggtggctccacctgggatgacccccctgagcctcacagagccaggacccacgtggcagacacggccgcatgggctgctggactgatttctcttctaggtttgctcttggtgcagtctcggccgtgatcactgccaaggagccccgaggtggctgcagggccttggcagagcgtgaggtgccccagggcagtgccgcagggtgggggggctcagagcccaccacccgccttgcaggccaagagccaaatctctccctgcctcagtttcctcactgacaacatggggagagagtaacataccctgtgtgactgcttcgagggtgaaatgaggtgacgcaggtgaagtgtatgcctggcacagtcagctttcaataaacatgattgttattcaggttccttgaactcaggggttccagaactttccatcagactccaatctcctaggagtggaaggttataaagtaaatattgggagttaattttctgtctcccactgaatcacaaacaggaggacttggggcccaaaggtgaggtccaggcaactgtaatgaaagaaaaatggagtcacctgcctgagcctgagtgaccggggctcccccaggtcagctggtcctgtggctggatcggagcctggtgagaatggagtgaggggctgtggatggggcggtgaatccctgttggggtcagagagttacaaacagtgggagggcttctggctctcttcctgccactgcagaacctcaaagctcaaggcttgaggctgggggctctaaggccagtgcctcagccttcctgggcagctggtgtaagaaattcagcaggctccccccaaccaggacccctccagagtctgtgctcattgtggcctcagggtccctggggtgggggagggacaggcagtgacaggccaggagcccagcgcagagcctgacacatccattctgctgggagcctcgctggacctccccatagactggtggtggcagtggctcagggctgcagtgtggccattgcaggggcagtggaggtggaggtcagccctggcctggcacagacaggcaaggtttgggagaggagggaattaacagtggtgcccagatattgagcaggtcagactcacccaggggagtggccccctccagaggttctggtttctgggaatggagaggtcctgggagtcggcctgctaacaagcccctcctccatctggggcatgtggtgcttacagccttacaaaactggtggcttccctttcttgtcccttggaatgctccctctgggggagcccagcccagggtcagacatccaagtgggtggatgtggcccaggagccaccgggtgagtggggaaggcatcttggacattatggcctggcagagtgatggggagaagagccaaggagccagccaacatccagaactgaggcccagacatacggccccagcccagacactgcagccacccacagccctgcaagccacctggctgagaccgatcaccgcacagcagacacagctgtgctccaggtgccaaattcctgacccagaaaattgtaagcaaaatataatggtggctgttctaagctgccaagttttggagaggtttgcgtcacagtgaaagaaaaccagtatgccccatctgagcctcagtttccatgtataaaatccagatggaaacgcagtgtggtgaggctgaggcagactctagagtgtccagggggtgctgccgggttctggctcggctctgccactctgcggccctgtggtccttgtcaagaggcatgagtcatttgtgaaatgggagttaatgatggtgcccgcctcacaggctccgtgagggtcaagcaaggcaagccatttgaagcactcagaacattgctggcgcacagctaggactaatggacaccagcgaggacttttacctcattagcacccacaggactggtgtgaaggttagatgagagccgtggaaggctcatgctggtaccgaggaagcagtggatgctatcattaagagcaggctcattttaaagccccctactgtgtgcctggcactgtttcaggagcttgggtcacatcagggacaaaagagaccaagatccatgtgtgatgggcacagggggccggaggaatgggagtgtgtgggattgcaagctgatgaagtcccttacccagttatgtgacttcacagatgctgagaaaaacaggccagaggttagttgccaaggtgaattgccctgaggtctgggagaactaggtcctcagtagatgctctctgagctctgggtgagacagacctggttcccagccatctcttagctctggcaccatcaagaccctccaggagggagtacgggtggggccaagcgcccaccagcccaccccagacagtgtcttcgaagataaaccgttttcccagtggcccaaatgaaaaccgtattgcctggaaagtgcagttcaaacagaattaccggaatcctttgtcaccagagtgggcgtcacatggccagcatctgcgaaggtgtcaataatcataattaatgagaccttccccagactcctgacgcgatgatatgtcagctgcgccttcgagtctgcaaggatgagaggagggggagggattgtcccacaccccctcgtctggcaccttccccctccccacccccagtgggggctcagggtgctccgtccctctcaacagcccaggtggggcagctccattagtggaggtggtgctcaccctgcacactccacggtgaagcttctgagacttggaagcaggaggtgagtgggaacacgtgtgcattcaggatcatcatcatcatgtggaataataaggataataaaatagtaatgacaatagcagctctcacatactgagcacctactgtatgccaggccctgagttaagatgttatgcccatgagctcatttgaccccattatccatggtgaccacagaattcatcctccgactgggatgcttgggagactggaagatggcactgggagtaatgacacccaccccggcccctggacagcctggctcccctacttcaggtctcagctcagacgtcctcatctgcgcgctcctcctgactgcgtctcacgtgtcactgtcccactccctcccatcatgcgctgccccttcacctgtcctgtgtccctgacctcatcgccacccacatgccccacagctggtcagtcctttatgtgtctgtcatctctccccattaccatgtgggctccccgaggggagggatggggcctcttctgtccactgtggtgtcccagggcctcagccagtgcctgggccacggtagctactcagccaatgatgggtgggtggagggatagacaggtgggtgggtgaatgaattaataaaaagtcccagaatagagagaactgagatgtgagttcatttctcctttctaaaggcttcgctgggatgacagatgtcctggggaatcttctgtcatcctcagccactttgaaggatggggagcagggaatctgggtctgggcctgagccgcagtctgagaggcagactggcgttgaggtggagctcctgcaagggttgcagggagggtggaaaacactcacggactgtggaagccgaagctgtgtccaaccacctgacagagctcagtctagctccaccaccaacagctgtgtggccttgagccctctcctcccggggcctcttcttcatgtgggagacagcagcctgctccagggctgctttcaagaagaagagaggtgagggatgtggcggtgctttgaatcagagcacggggatgcaggaggggaagggtgtccttttgactctccccagagtgcacaggcctcctgagagggtccctgagacggtccccacccctgcttacccttacagggctcagtcaaccaggtaggtcctgcagaggtcttgggctgcaacttgggctgttaactccttctgagccaggcagccagtcacttagcaggggcagatatgtgtgcatggggatggggaggcagtgccagcaggagctgggaatcggggcttgccctgctgctggggctggggccagggtcagtgctttttggaagactcactctttctaaggacttctttatctatttgcctcatcttctgccctacttacgccaccagcacttactgagcacctcctctgttccaggcactgtgctgggtgctgtgttcccacgggcagtgaaacagacatgaccaccacactcctggaggtcggagtccagcaggggatagacattaataaaataatcactccagtagacattcacccatctgggcaagtgctatgagacagaattagaggggctgggatgggagtggattaccaaaggagggagggagtgatcaggaaagatttccctgggaaagttttccctgggaaagtgacatctgacctgggctctgacagacaaaggcgttagtgagacagaaaggagggaggagggcactctggggagacggaactgtaggtgcaaaggccctgggtgggacagagtgtgcctgagggaccaaacacacttgttagacgctcctgctagtgattgttgttgttactgttaatctgggcccaggggaagattggctctgcccctggagaggggaggggctcttaaaacaccacttgcttccaagtttactcccccttccggcggttagcattaaatacaagtgtattgttgtcatacttgctctcctccccggcttcctcctcctcctattcatctcctcctcctcctcctccccccctccttctcctcctcctcctcctccttcttctcttctcagttacacctgtagtcagggacagttgaggtcaactttagctgtggttggactgatcaatgaatggccttggcagggaggggcaatgccttggttgtggtacaggggtgggaagtttcccccaggtccctccaagacccctgtgggcccagaccctgtgatcatcagatgcccccaccctcacacctgcaggagccccatcccatatgtggcctggacaatgccaaaccctgggtagtctcatcttatgttctggatgtggatgagccccctgtcctgatggggcacatgaccttgaacaagactcttcctcggaacaaggctcttcctccgaacgcccacaggagggaggctgcaaagggtgagggggtctgggattaggtgaccccaatgatggctgagtggcgtcttctgggaggcctggagcctctgtcctgctgatgggtgcctgggtgaggatggaagtgttaatgctgggatgttctgcccaggctcctggagcctgtgtgtgcccctccttgccgtgattaattcagtttggtaacgtggtatttttgctggaaatctaatcgtcatttctgatggtagaggaattgaaaaataaattgaaagtgtcagacgatgcatcagggtgggcgatggagtggaagcgggggctgcccacccagtctccccactgggcaatttgcaggcccaagaaattagccaagtttctgtttctacaattataggatcaagaacacaggtgatagggtgaagcagggggaagcaggtgtgaggtgaagagagcagagagatcccagcctggaggcagcatcagagccacagatgaggagatggtctcagagtggacagggacccgtccatgataccacaggaggctgtgggcaccgcgaggctgggatccgggctccctccttccaccaccagtccagggagcacactgacagggtctgggcctccgtggagatggatgctcttggcagttcagccccagggtccaccatctgggagccccacctccccaagctgcccctctgcctcagggagggggctggccacctgggagttggggccaccttgcgtgcctgtttctgaataatgtaagtgcaggtctctgagtctacagggactggagtctacagggactggggtctccctggcagtgtctggcctcccgcaagggctcctgcccctggtgaggtctaggtctccccagcagactggactctctactggcaaggctgcctccccccgctagtcagagcggcctccttgggcaggtgtctgacttcaccccctagaggctcctgagagcaggcgcgtgtcttctccagactgagggctcctgaagtcaggactgtccccccgacctgaggcctccttgaaggtggtggactagcttcccactggacctcagctcttcagacctcctcgagggcctgggcagctggtgtctgttgaggttctggtggtcaggctggctctgtccagacctggcacatggaagggagaggggaaggtgtaagcagagagctggaaagaaggggaggtgcatgctaacttcacaccccttggatatgggggacagtccttgtcaggaggactaggggaccagggatcctggggacaggccctactgtgtcctgcagccactgaccgtcctgaaaacccctccttcccaatgactgtggaactgggagagcccagcactggagggaggaggtctggggtcctgcccacctcattcattcattcattcattcaacaagtgtctctcagctccctactttgtgcttggcaccatgcaaggcactggagatgcagcagggcacaaaatggacgaggtcctgcccctacggagcttgcatgcttgtagggcggagactgataataaacacaccaatgaatgaatgaacaagatcatttcagaatgtgttgagtgccatgaaggaaataaagcaggatgttgtggaaaagagtggctggagcagaggtccttttgggaaggcttctaggaggaggtgactttaggcttaggtctgtgcatgagcaggtgccgccttgcctggagctgagggaagggtatcctgagatcagggccagaatacgaagacatagcagtggcaccatctagcagtgttgtgaaggtcagggtggccaagcggcagtgcatgagggctgtgggaggagatggggctgtaagggccagctggagatggtcgatggctcaggcacaatgccatggccatcacgaggactctgaagtttgttctgggagcagctgaagtccctggagggttttaagcaggagagagtgacacagttgtgaattttcaaaacatcacgctcacattgtggataatggagtgtggaggggcaagaaggaacaggggacctggctggagctgctgcaggtgtccaggtgagagctggggcagcctggaccagggcaggaacagcctgaaccaaaggtagaagaagcccatggaactcagatacatcatggaggctgaatcaacaggactgaataatggatttgatgtgggtggtgggaaaaggggagagtcgaggatgactctgaggttcccagtttgactaactgggtgagtgaaggtgccatctgcagggacagagaaggcttgaggcaggtaggtttgagggagaagaagttctcttttgaatttgctaagtttgagctgcctcctgaatggacaactgaggatacaccccatgctgttgatgcaccaaattttcctcttctcccagccacatggtgggattgcacttttctgccaacttgaacttgaataaggtcatgtgacttgcttaatgaaatgtgagtggaagcagcatgtacagatgggagcttaagaggcatgattccccttgctcctgttttcatctaggcctgaatgactggcaggccctgttctgacctatcagcctgtcctggggagaggataaggggggtcggaggccccagccaaccaataagcacaggtagcacgaatgaggaagaagcctttgtggatttaagccactgagatgtgggggatgtttgttaccacagcacaatctagtccaagctgactgatacaaacctcacacttctacataattgtgggagttattagtgattgatcaaaaccatttcttttttttccagattaggagagcctgagagtgagagtagggagagaaacgctcattgctttcaccacctcatattacacatctatgcaatgggctcactttcttcttcccaagtctaggctccatcccaatctccggtccaaagctcaaactccccaggctgattctgccactctcattcaactgtgtcacctccctcccctgtcagtttgtcctctcagatctctggagaagtatccctcctccccacccttactgctggagtcccagacctgtcagtcctgtgtggagcaggcagtgcttggttcaaacctgaagtctgccacttaatagaggtatgactctcagtgagtaacttcatctctctgaacttcagtttcctgataaaaaagagactattaataggacagttttgaagattaaataagatgaagcacatgagcccatgttcaatgtaaggtcactggtattacatgatgattatggtcatgtctcatcactgcctccctggatcaatgtcccagcctcctcaccagttgccttgtctccagcctcatcatctccagttatgcccccatgctgcttccagatacagctctttaaagcaagctctgatcctgtcactatcctgctcaagaaccatccatggctccctcttgcccatagaataaattccaacctcctcaccctggaattaggggcctcccttctcagccctgtcttccacacagcagcaaactgatcagtgtgttctgccttaaacaagtcttttaatcctcttatcagagtggtttaaagagtcctggcttgagagacaggtggcctgagtactagtccctgctttgccactgatttatagtataaccttggggacgtttcttgccctcagagcctcagtttcccaatctgaaaaatggag

SEQ ID NO: 409 - DNA, 20001 bp, Homo sapiens
gataaggcccacacctataatcccagcactttgggaggccaaggtaggtggatcacttgaggtcaggagttcaagaccagcctggccaacatggagaaaccctgtctctactaaaattatacagattagccgggcatagcggtgcacgtgtaatcgtagctactcaggaggctgaggcaggagaatcgcttgaacccgggaggcggagcttgcagtgaaccgagatcacgccactgcactccagcctgggctacagagcaagattccctctcaaaaaaaaaaaaaagaaaaaaaaagaatttcaagatgatgacagcagatcattaaaccaagagcagggcccttctgagggctctgtttgaccgcacaggttggtttcacaccaatgatgctagctagctctgctcctaacacattccagccattcccttggagactcacagtcccacagacaccatcctgctagagagacacactcatccagggacaaacattcacacccctagacccatcaccactgagggcacacccacctctccaccccagacacatacagtcacatcagccccagtatcacagagcctcacctacagccagagttcctcccagctgggtgggtccaggcatcccaccagggcacagggccattacactcacccctctctcgggctgccagggtctcctccaccctcttgctccacacagtccctcccccaaatgcacactagcctacctgctgggctggccatggaggatagaggagagggcaatgccagctcttccacccactccgcagccagcctgcagggacccagctggggataagatgccaataataatacctggctgggcgcggtggctcacgcctgtaatcccaacactttgggaggccgaggtgggcggatcacctgaggtcgggaatttgagaccagcctgatcaacatggtgaaaccccgtctctactgaaaacacaaaaattagctgggagtggtggtgcatgcctgtaatcccagctactcaggaggctgaggcaggagaatcgcttgaactcgggaggcagggaggttgcagtgagccgaaatcgagccattgcactccagcttgggcaataagagcgaaactccgtctcaaaaacaaaaacaaaaacaaaaacaaaaaaacaaaaaacctaacacttgttgaacatttacctgtgccaggcactgttccaacactttataaatactaactcatttaatcccacaaccctatgaagtagataattttttttgttttttgttttttgtttttgaggcagagttttgctcttgttgcccaggctggagtgcagtggcgcgatcttggctcactgcaacctctgcctctcaggttcaagcgattctcctgcctcagcctccagaatagctggaattacaggcacccgccaccacacccaggtaattttttgtatttttagtagagacagggtttcactatgttggccaggctggtctcgaactcctgacctcaggcgatccaccctcctcggcttcccaaagtgctgggattacaggcgtgaaccatcgcgcccggccctgaagtaggtaatatttttttatccccattttataggtaaggaagctgagacacagaaaagttaagtcacttgagcaagatcacagctagtaggagaggaagccggaattttaacctgctgtagacagcatggtctgtcagttgttgatgtgactgtactgggcatgccaggcactgtgaacccagtggttccagggtctgcccctgaggagctcaggtcctctgtgaaatgatgaaaaaaggtgattatgatgcagcgtctttttgactggggtccgtggtcagtcccaggagtccccaggatggtcacttggctggtggaacagatgattttctttcactacagtcacaatatttggaagatgtctgcatgagagatagtcctttttacctttttacagacaaaattgtcaaatatgtaataaaggcattttcactgatagcatacactgtcagataatggacagtccacacggcagctggttacccagcctagatagagggctttctcaatggtgagaatgcaaggaaacctgctctgccggtgtgtgttctgggcacgcagcgggcctcatttatgacttagttcaacattacaaaccttcgggagccccaccctccttctctgagagttgccgctccctactaggtatggcccctgaggccatgtttgtatgctttgactcctgcccctccagcttcccggaggggataccccaaaatgaaggcctcagaagcaactgagactgactgatccaggaatgcctatctgatccaagtaggccaatcaggtcctttgtctggggcttgggaatctgcattccactggctgggactggcccctgaactgagaacaggtaatcttgggaactgtaaagcagccaccttcacattcactgcggtttacacagaagaaaagaagcagaaagctctctacaggagtagagaagaatgaggcagtgaagagggggaaagtgctgagctccagaagccatccagctccacaaggggccacaattgctcccccaatccttatgataacgcctgatttttctttccgttagcctgagacagtttctgttccttgtagtcaaagggccttatttaaggcacttgaattagaaaacatcaaagagaagagagtgccgcaaatctcctaaatgtgttggttttatggtcatttttgaatatgacagactccaaagccgtggagcttacatgtgtcctggagtatccccagtggaagcttgaggttgtttgtctctgtgtacatcccctagtggagtggagatggctttcctgataagaaatgtgctttgaaaggactttattaagcttggaattgcccagtggtttgctggacaataaatatttgaaaactagtttctcaaaaatccaaatgtataggttatatatggacatatatttattataaattttactgatataaaggctgtgtaggccaggcacagtggctcgtgcctgtaatcctagccctttgggaggccaatgcgggcagatggcttgaggtcaggagttcgagaccagctggccaacatgataaaacccagtctctactaaaaaaacaaaaattagctgggcattatggcacacacctgtaatcccagctactcaggaggctgaggcaggagaatctcttgaacccgggagatggagattgcaatgagctgagatcgtgccactgcattccagcctgggtgacagagtgagaccctgtctcaaaaaaataaataaaggctgtgtagcacacagcttaacttacaaatgacacaatatgcaaactcctttttttttttttttttgagacagggtctcaccctgtcacccaggctggtatgcagtagggcgatcatggctcactgcagccttgaactcctgggctcaagtgatcctcctgcctcagcctcttgagtgctgggactataggctcgtaccatgacacccagatcatttaaacagtttttttgtttgtttgttttgttttgttttgttttttagacaaggtcttgctatgttgcccaggctgtcctcaaactcctaaccccaagcaaacctctcacatgggtctccaaagcactagcattatggatgggaggcaccatgctggtccatatacaaacacttgatagtaaattccatacagccaattgattctggcagaatggtttcattaatttttgccaaactcatatctgtagccatcctatggttgcaattcaaccaaaatttgaaattgaattgcatagataccaatctgctaattattttcctaataaatttattgtcattaaatgtgctacaggatctactgttaaaatatttttctttttttttttgagacggagtctcgctctgtcacccaggcggcaatggcttgatctcggctcactgcaacctccacctcccgggttcaagtgattctcatgcctcagcctcccgagtagctgggattataggcgtgcatcaccacccccagctaattttttttgtatttttagtagagacagggtttcaccatcttggctaggctgctctcgaactcctgacctcaagtgatctacccgccttgtcctcccaaaatgctgggattacaggcgtgagccactgcacccaacctactgttataatatttttcacccttctacagatatattcattaaacagaaacttctttcagctttagcaccagacttgacaaactattaagtttaatttgcacttttaacattttgtctatcactttctttagtcttgaaagtcaacaaaacaacaaatcagttccttatttgtacctatcaggactcagacaacaataccccaaaatgaaggcctcagaagcaaaagtttttctttgaccttctcctgtcctcttgtctttctgttccattctcccctgaggctagccatagaaactagaatctctcttccccaaggctagcatcccttttccccaagacatttcacggaaaacaaaccccttttcccccgaagccagccgtaaaacctaaaagcattactctggattttcctccacctttctgtgtgaaaagaagttatcttacctaccttgactctaggtcataagatcctcattctagagtgggtcctgccccatattcagaaggaaggaatgaatgctcagagaggccaggaagaatccaggcagaagtccttgctgggcttcctcactcagtctattagcatttgatcatagccttttcatccagtcatatttctacatggctgtccatactttgttgaacctaagcataaaaacgaatagttttctgtttttcttcaggtcttcatgctgaaggctcccatgtacatgttaataataacttttgtatgctttgtctccaattttctgccttttgtgagttgatttttccatgaaccttcagagggcaaaagggaaaattttccctggcccccatatgctgtttaccaatttctgtggtgtaaatacccccactcggctgattcaagctgctgccacgatgttatggagccaagagttaggaagagatgtgcagaagcacatcattatgtcataattccactacacagataacaacagatgtagggctgggtgcgggggctcacgcctgtaatcccagcactttaggaggccgaggtgggtggatcacttgaggtcaggagttcgacaccagcctggccaacatggtgaaaccctgtctctactaaaattacaaaaattagcccagcatggtggtgtgcgcctgtaatcccagctactcgggaggctgaggtaggggaattgcttgaacctgggaggcagaggttgtagtgagctgagatggtgccagtcagctccatgtagtgagctgagatggtgccactcaggcaatagcaagactctgtctcaaaaataaataaataaataaaaatgaaaaaaaaataaatgtaggtaaactcaagagaatagataatagtgaaatatagtaaaataattaggaagtgatgatttttaatatctttgttttaatataatttatttaattgtaaatgtatacaatttaattttaaaatttttattatgatgatatatattttttggggacagggtctcactctgtcatccaggctggagtgcagtggcatgatcacagctcactgcagccttgacctcctgggctcaagcaatcctcccacctcagcctcctgagtagctgagaatataggcatgcgccaccgcaccccgttaatgtttaaaattttttgtagagacagggtctcactatgttgcccagcctgatattatgattttttaagagatggaagtctcactattttgcccaggctgatctggaactcctggcctcaagtgatcctcctctcacctcagcctcccaaagtgctgggattactggtgtgagctgctgtgcccagtatacaatttaatttttagcaatgactgttaaacagccctcttgcaaaatgcctgaaactttagcaatttgctcttgctagctggtgtgagcggctcttatacactgatggacttgtccccagccaaaggcatcccacagggcattgtcaacaaaagaggccccatgatataatatttataattataaatattaatactttttgacccagtcaaaatcatctcccagacctcaagaaactcttcttggggtcacttgcacctcctcttaattctcctaaacacattgttgccatttagactactgaatgtcagagccagaagggtcctgaggccatttggtgccttcaacttgtgaagatggggaaactgaggcccagggtagggcagggacttgcttaagctcattaacattgaaaaccaagtcttatggctcccaggtcaggactcatcctattaactcctttcttagggatagggaagctggcccagagagaggaaggtgagtgcaaattcacacagcaaacaagcgtcagagccagagcctggggattctcctcgcccgcccagatctcctcggaaccttcaccttcctcttgggccctggaaatgaggcatgtgcgcgcctcctccgtgcacccagggccaggcgttgaagacggaaggggcgattcctgcgggtgttcttctcggagctgaggttggcacgcaccagtttgtccaccggggggcactacggagccgagctaggagagcgcgcgggctcccggagcctcccagccctgattgatccgcacttgagcccggcgggaaaacaggtgtcccgagaggagaggaactagccagacgtcaccctgagaactagagacagagctggcacttgacgcggacctcctgacaccagtcaggtgcactctcccggcgtctaagcgcgtccctccccctcttccgggggccgggctgctacttcttttcctgtcaactggggtcagcgaaggccctcctgggccaggctgtgcagaaccacagctctgtctggcatggcattgcacctccactggacagtggccggtgctgagcgacacatgcctcattccctctctgtccagggccgctccccaccccgccttcttcttcttcttcttctttttttttttggaaacggagtcttgctctgtcacccaggctggagtgcagtggcgcgacctcggctcactgcaatctctgcctcctgggtccaagccattctcctgcctcagcctcccaagagtacctgggattacaggcgcccgccaccacacccagctaatttttgtatttttagtagagacggggtttcaccatgttggccaggctggtcttgaactcctgaccttgggtgatccgcccatctcggcctcccaaagtgctgggattacaggcgtgagccaccgcgcccgccccgccttctgtcatcccgtatcagcgcaagtctttgccgtttaccaaacattgtcacaccctctgattaccttctttttctgagtagagaggaagggtggcgggggctggggttagacctgagcttcagtcttggaccagctactcaaactcacctcgttacacaatcactttgtgccttggtttccttattttaaagcagagatcatagttcttatctcacagggttgttgagaggattaaaagaggtaacacagcaagtccttgggaacttttctttttgagacagggtcttgctttgtatcccaggctgaagtgcaataccgcgatcgtggctcactgcagcctccacttcctggcctcaagcaatcctcctgcctcagcctccatgtagctgggaccacatgcggctccaccatggctaattttttattgttttgtagaggcagggttttactttgttgcccaggctggtctccaactcctgggctcaagcgatcctcccatctcttcctcccgaagtgctgggattacaggtgtaagccacctcacctggcccttgggaactttttatcatgattgaaacctgcacaagcatcgtaggagagatggaactgccttcaccttacactggcagaactgaggctctgagaggctctcagtgaggagtcataagggaactttttatttgagcgccaggtgtgattgacttaggggtataagaagtagaactttctttctcttcaatccggagctgtgtctaagctgggatgggagataaatgtacgtgcagctaaggcttggtaggtccatgtgtgtgtgttcccaggcatgttttctacatggatcaccttgcaacacccattgtcctttttgctctgagtggcccttctggggctgacatctctctctctctgcttcttctgggcattactagaaaggcaagaattgttctgcggagttgggttcacagtgcggctcggggtcatttggtcactgggctctggccaccatctgcagagccagaggtgtctctgcagttaccattcactccatctttcctcccctgccagcctcggaagcctgttgtctgcctaaccaacaatctgcttgaattgggagagagagaatagcaaaagggaaaatacccagagagaaacaaatgaatcaatgatttagatacctatttctggagtgccttttatgtagcactgttttaggccctggggtaacagctctgtgcaggctgacacagtctcttctcccaaagtgacctccagggggcagacagtgattgtcataatgcttaatatgcatggagccctactatgtgcagggccctgtgtcaactcatttactacttccgacagtgtaatgatataaatgcttctgttatcttcattgtataggcgaggaaacagaggcacagggaggctctgtatcttgcccaagctagtagctaatggaggtaggattccaattcagacagtctgaaaattaagcaaggccatggggtgcagaagggttgacttcctcagggaggaagtggtcttctagctgagacctgcctaatgagaagcagctgtgcctagatctgggggatgagtgttgcaagcagtaagattactacagcaagtgcaaaggctgagacaagaatgaacttgatgtggtcaagagctggaaaggaagcctctatgactaggagggcaggaatgaagaggagagaatggaaggaggtgaggggaagggtggatggacccaggttggcaatataaaaccctttaaggggtttgcagccattgggcttcttcccttgctcgggcaaggccaagccctatgcccataaaccccaaaaggtcattatctttctgtctccatgggtggctagggcatccattgaggggctgcccctaatctcccactggtcccactggtcctgggagcctgatgaccatccactttctggaatgttggggaggatgccaagggagggcctagggcccagagaaaccctttaaactaaatgcggggtgggcaggaggtgttgacccgtgagtcagaggccaggtagtgcaaaggcactttaattggggtcattaagatcaccaagctttgatgccccaaccctgagtcaagccgtcccgttgacccccctcaacttcctggcctcactgcttgctacccccagtgacaggagaagtccctttgagggcactaattagaacttcctcttctagattccagggctttctccctgactggggtcagggaaacagctccttccagagatcagccatggccccacccctcccacttcctccagattcaggagtttccactgaggctggtacaaccacaatcccagggcctcccagccctgcccacagtgaattcttgcccatgggggtcattccctctacttggaatgcctttttgacttttgtttacattgataattccatctaccttactcttcaaggaataacagactccttcctttaattcatgccatcattctttctttgttttcatccattcattcatttcattcataaaatttaggcattcatttggttcctgccaggcactggggatacaagagggggtgggactgaccctgaggtcaaggggtgtctcatcatctgtgggaagcacaaggtaaaccagcaggacctgctacatatttggcaggtcccagtgcagatgaaaatgcagagccccttgtccaaaatgtactatgaatttcaaaacagcgacagcagagcatcaaaccagtctaggggcccttcttaaccgtagggtccctctgcagaggtcatacacccatacaagctggccatacaagctggccctgtaagcaagtgatttcatgagagatgtgtgatggaggtgagcctgaaagtcatcagagaggaggtgatgtctgtaactgccagagccaggaggagagaagccacatggctgtttctagaaactgcaagttgtccaaacaaaagggccaggagcagctggagtcaggctatgtggggctttgtggaccagttagggagctgggtctttattcccaggcagtagggaagcattattagatttttttaaaaatctaataatttttaaccaagagcattattagatttcttttaaaaaatttatttatttatttatttatttatttatttattttttgagacagagttcccctctgttgcccagactggagtggagtggcgcgatttaggctcactgcaacctccaccttcagggttcaagcagttcttctgcctcagcctcccgagtagctgggactacaggcgtgtgccaccatgcccggctaatttttgtatttttagtagagatggggtttcaccatgaaaccagccaggctggtttcaaacttctgacctcaagtgatccactctcctcggcctcccagagtgctgggagtacacatgtgagccgctgcgcccggccagattttttttaaaaatatcattctggcaccagatatgaaatacaaataataaacatatgaaaaatacaaataataatatatatgaataatacaacaaatacaatggaaagaagttcaacttcattagcaattaaaaaaaattaaagattaacgtggcaaaaagaaaaaaaagaacaacgtaggcaaggccaggtgccatggctcacgcctgtaattccagcactctgggaggccaaggtgggtggatcacttgaggtcaggagtttgagaccagcctgttcaacatggtgaaactctgtctctaccaaaaatataaaaattagctgggcacggtggtgtgtgcctgtaatcccagctactcggcaggccgaggcaggagaatcacttgaacctgggaggcggaggttgcagtgagctgagatcatgccactgcactccagcctggagaacaagagagagactttgtctcaaaagaaaaaaaaaagaacaatgtaggcaaaatggtgaaaagaaaactttcccactagcagtgggtctatcaatgagtgcaaatttctggtggcaatttgtttggaaacctcaaaaatgtgcaccctaagatgttttgggaaggatacttaagaaactggtgccagtggttgtttctggggaggggacctgagggcaggggaagaaagaaactttacttttctctgtacaccctttgaaattttgtgccacgtgtttacattttcaatgtgtatcccttaaccaaattgttccatccctatgcatttttcctaaggaaaaaaaataatagaggtgcacaaatctgtacaaggctggttatcacagtgtcatttataatatcacaacattacaaatgactttaatccacatgctacaggctggcacccttgccctcagaggtactgagttgtgtgttagggtgctctaagcaatatggtagacatggtgcacattcaaagggggttggttttacttgatagcgactaatttagaacaaaaactttatattaaaaccaatatagcaggtcacaccactaggatgactaaaatcaaaaagacagatgatgacaagtatagctaaggatgtggagaaattgaagccctcttacattgctagtaagaagtaaaatggtgtggtcactttggaaaaccgtttggcagttcctcaaaaagttaaacattgagctaccatatgacccagtaattcaactccaaggtatatacccaagagaaatgaaaacatatgttcatataaaaacttgcatatgagtgttcatagcagcattattcataagagtcaaaaagtggaagcaacctaaacgtctaacaattgatgagtggataaacaaagtatggtttatatttgtacaatggaatcttgtctgggaagtaaaaagaatgaggcactgatacagtgatacctgctacaacatggatgagccttgaaaacattatattaagtgaaagaagacagtcataaaagaaatggctagaataggcaaatccgtagagacaggaagtagatgagtggttgctgggacctaggagaagtgtgaatgaggggtgactgctaaacgagcatggggtttccttctagggtgatgaaaatgttctggaattagtggtggtgattgcacaaccttgtgaatgtactaaaaaccactgaatggtttcttaacataggcggattttatggtatgtgaaatatatttcaataaaggtggttttttttaaatggatatgatatggcatagaattagggtgaccaattgttctagtttgcccagtacaaaaagttttcccagaggctgggcgcaatggctcatgcatgtaatcccagcattttgggatgccgaggcggccggatcacctgaggtcaggggttcaagaccgacatggcaaaaccccatctctactaaaaatacaaaattagccgggcatggtggtgcatgcctgcagtcccagctacttgggaggctgaggcaggagaatcacctgaacctgggaggcagaggccaacatggtgaaatcctgtctctactaaaaatacaaaattagctgggtgtagtggtgcatgcctgcagtcccagctactcaggaggctgaggcaggagaatcacctgaacctgggaggcagaggttgcagtgagcccaggctggagtgcaatggcgcgatctcggctcactgcaggtactgcctcccaggctgcgcaacaagaatgaaactttgtttcaaaaaaaaagtttttccaggacatgagactttcagtacgcaaaccagaaaggtcccaggcaaagcaggatgagttggccagcccacatagaatgcagactttacattcatattaataataacatataagactttaaagggattttctgcttgcagttcactagtgctactgcagagggaacgtttaagaagcactgacttcaatgtccaaccacaggaagtagtttcattggttcattcattcatttactccccattagagtgcaagctctatgaaagcaagggcttttgtctgtttgattcactgctgtcctcccagggcctagaattgtgcctggcacctcagatgttctgtagatgtttgttgagggggactgtgtgctggaagccagcaatacattgttctcttttgccccatcctgagtggtcccagaagtctggctgagaagatggcttctgggtggaggacatccactgacagcgagtatggggccatctcagtgctgttaagaaaatattttaatggcaaggaaaaatgctcatgatggaatgttatgtgaaaaagatgggacacaaaattatgtaggtagtgtgagtccagattgtttaacagtgtttaagtggtcagccatggtggctctcacctgtaatcccggcatgttaggaggccgaggtgggtggatcacttgaggtcaggagttcaacaccagcctttccaacatggtgaaacccctgtctctactaaaaatacaaaaagtagcttgaggtggtggtgcatgcctgtaatcccagctactcaggcggctgaggcaggagaatcgcttgaaccccgggaggcggaggttgcagtgagcctagatcacatcactgtactctggcctgggtgacagagcaagattctgtctcaaaaattttttttaattaattttaaaaaagcgtttaagcattagaatagatgagaatgggacataaagtatgtcgaaggtgggaatccattggtgaattcttttgaatttttaaattcttcttttttttttttttttttttttttgagatgcagtctcgctttgttgcccaggctggagtgcaatggcatgatctcagatcactgcaacctccgcctcctgggttcaagtgattctctcacctcagcttcccaaggagctgggattataggtgtgcgccaccatgcccggctaatttttccatttttagtagaggcagggtttcaccatgttggccaggctggtctggaactcctgacctcaagtgattcacccacctcagcctcccaaactgctgggattacaggcatgagccaccgcacctggcctaaaattcatttttcattttttattcagcctctgcgatgccctgccagatgtaactctgggagttgagatcctgtggtgaaccaggcagataagatccctgctatcgtgggacaggtaggattttataattggagggaatgaaacccagagtaaaggagcaaagttattttttttaaagactgatgaaattccggatgtgctgaagaaccagctggaagcttgtagttagggggctgttccagcagtagggcagactcgggagtgggggtgagggcttgtttagaaagaagcaggaagccagagaatgcctctcaacccacacccattgtgtgtactctggtaagtcccttcttcggtcttggcctcagtttctccatctgttaactgagagaaggcactagatgtgtgtgtttatctctctattattcaaatcagagaacttaaaaaatttaattgacaaatacaaatttatacatttatagtgtgcaatataatgttttgaaatatgtatatattggccaggcacggcggtgcatgcctgtaatcccagcactttgtgaggctgaggtgggcagatcacataagcccaggagttcgagaccagcatgggcaacatgatgcgaccctctgtctacaaaaaatacaaaaattatctggatgtggtgttgcacacctgtagtcccagctactcgggaggctgaggtgggaggatggcttgagcccgggaggtggaggttgaagtgagctgggatcacaccactgcactctagcctgggtgacagagtaagaccctgtcaaaaaataaaaaataaataaataaataaatatgtatacattgtggaatggctaattgggctaagtatgcattacctcacatactaatttttttgcaatgagaacagttaaaatttacttagcgattttgaagtatacaatacattgttaataactatagtgactgtgttgtacaataaatctcttgaatttattcctcctgtctaactgaaattttgtatccgttgaccaacatctcctcaatcccttctcctgggcctggccccagcccctgttaaccactgttgtgctctctgcttctatgagtccgacttaaaatttcacataagtgagatcatgcagtgttaatctttctgtgcctggcttacttcagttaacgtaatgttctctaggttcatctacgttgttgcaaatgacaggatgtccttctttttaaaggctgtatagtattctattgtgtatatatcacaatttttttgtgttgttgtttgtttgagatagagttttgctcttgttccccaggctagagtgcaatggtgcagtcttggctcactgcaacctccacttcccagattaaagcagtccttctgtctcagcctcccaagtagctgggattacagacacccgccgccatgcctggctaatttttgtgtttttagtagagagagcgtttcaccacgttggccaggctggtctcgaactcctgatctgaggtgatccacctgccttggcctcccagagtgctgggattacaggcgtaagccactgtgcctggccatcacaatttctttatccattcattccgtgatggacagttaggttgtttccatatcttggctattgtgaataatactgcagtgaacatgggagtgtagatatctctctgacttactgatttcatttcttttggatatataaccaaaagtgggattgctggatcgtgtggtagttctatttttagtttttcaggaacctccatattgttttccataatggttgtaccagtttacattcccaccagaagtgtacaagtgttctcttttctctacatcctcaccaatacttgtaaaaagtataaacacttacaaaaagtaaaaaaattactttttatgaggctgggtgtggtcgctcatgcctgtaatcccagcattttgggaggctgaggcgggcagatcacctcaggtcaggagttcgagaccagcctggccaacatggtgaaaccctgtctctactaaaaatacaaaaattgaccgggcatgatggcgggtgcttgtaatcccagctactcaggaagctgaggcaggagaatcgcttgaacctgggaggtggaggttgcagtgagccgcgatcgtgccattgcactccagcctgggcgacaagagcgaaactccatctcaaaaaaaaaaaaaaaaaaaaaagatttaaatgttttgtagaaatggaggcctcgccatgttgtccaggctggtcttgaactcctgggctcaagcagtcctcttgcctcagcctcccaaagtgctggggttacaggcatgagccactgcacccagccaacacttgtctttcatctttttttgttgttgttgagacggagtttcactcttgttgcccaggctggagtgcaatggcgagatctcaattcactgcaacctctgcctctcgggttcaagcaattctcctgcctcagcctcctgagtagctgggattacaggcatgagccactgtacccggcccatcttgtgttttttaataactctccattctgctctcttcccagcccctggcaactaccattgtactttctgtctctacaaattagagtactctgggtaccttgtgtaagtgaaatcatacagtttttgtccttttgtgtctggcttatttacttagcataacatcctcaaagttcagccatgttgcagcatgtgtcagaatttcttgtctttttaaggctgaatggtattgtattgtatatatatacatgagatggctttagagctttcttcaactttgaggttgtaggagtctcaatgccaggtctccgttgttcctcagtgtggactgctgcctgtagggtgagtggaggccctggcttcagaaagactttccttcctgcttatgtcaccagaaccttccctgagcccagaggtcctgggagaccctggggagggatccgaggaatgaaaggctttggctaaacacctgctgccttctctctgaggcttcagcagctgggtcagggttgggtgctgagcaagggtgggggagttaatgatggcctgccagggacttggttgtccagatgaaacgggccttgctctgaggcctggcctgattacagggagccctgcgcttgccctccccagggcccaggcctggccttgcagcagcccctgcatgcccagctgttctggagcagctgcagaggtaggtggagctgaggaatttgggatagcagctgccaaaatgcactggctttgggatctggcacaagagatacaactcatggtgaagccagcaagttcatgccggttctcatctgagggctaactagtagtaacagtcactgttgcttcaagttttaatatgttcaccgcataccaaacactgggcatgaattatctcagttaattgtcacacagctgtaggaggttggtatcgttgcccccattttacagatgagcaagctgaggcttggagagccttgcctaggtctatgcagttggtaaatggcccagctggaattgggccctggttatgtgctgaaggctggtttcttgtccactgcttctgtgactcggtgggacattctttggccagcttcttagtggagagtgggtgaggggccaagatccacctgccttccccacatgggccaggagagctcctcttgtagctacttagggattctgcttcaaaacattatttgaaagccactgttaatagttcaacctatttattttaatttatgtattttttttttttttgagatagggtctcactgtatgcccaggctggagtgcagtggtgcaatcttggctcactgcaacctttactccccaggctcaagtgatcctcccacctcagcctcccgagtagccgagaccacaggtgtgcaccaccatgcctggctatttgtatttttagtagagatgggggtcttgccatgttgcccaggctggtgtcgaactcctgagctcaagcgatctgcctacctaggcctcccaaagtgctgggatttcaggtgagagccactgctcctggcctcaacccatttattttacagatagagaaacaggcccagaaaggggcagagagctgtctagggtcattctaacagggttggtggctgagccaggccctgcctctcagccacctgctgtttctggtgcccacctgtcttcctggattttgtatgtgacctccctaggcaggagggcactctggggcctcccctgctgggtctgctgggcctggagcccattctgtaggacccctgcaggccttggctggtggacaaatgactgaaggagggagatgcagggctggcaggcagtaggggcagagattagaacccaggctggatctcaggctggctctgggctgacttgttgtgtggcctgagtggctgcattctctccaggcctccatttctccatctgtccaacgatggggtattgaccacttgggcccacaggcactgagcaggggaggatgaatggtcccgacaggagatataaatgtatggggaggaagaaaggagccgctgggcccaggagggctgtggacatcctgcctttgccccatcctcctccaggaaacagcctcccacactctcgctgctggccggatgacgccgcttggcctgagcgtgtccaagcctcaggtgacagagttcctggtcccttatgctgccctggggctggtggctgcccttcctcgatcctaagacatcctcctcacctcagagtggtgctggcctcagcggggcttggaggaggctgagctctctgtgtgggcactcacatgggtgtcagcctgacccacccacgtgtgctcacatccctgacacgtgcacatacatgcaaacccatacacgcaccctgcatagtaggggctcacagacggaaagagccaggccacttcttttttttttttttgagacggagtttcgttcttgttgcccaggctggagtgcaatggtctgatctcagctcactgcaacctccacctcccgggttcaagcgattctcctgcctcggcctcccaagtagctgggattacaggcatgcgccaccatacccggctaattttgtattttttagtagaggtggggtttctccatgttggtcaggctggtctcaaactcccgacctcaggtgatccgcccgccttggcctcccaaagtgttgggattacaggcgcgagccaccgcgcccggctgagccagaccacttctgtcttttaaggctcctgctaatttaaaaatgaagaaagtcctaaataggatgttcacaactgtggtatgtttttatttaacaaattaatgttttttaacacacacatgcacccacacacatccaatgcagtgcaactgagagactcacaagatcgtcacaagaattataaaaaatgtgatttcacattgctgtgtggtccagtgatgggatgtaagtttcaaatggcatgaagagcattctgttcttcccat

SEQ ID NO: 410 - DNA, 41867 bp, Homo sapiens
gttaagagcataggtttaataggcaaaaaaaagcgaaaggaaaacagctctctctcctatgagacagaggggtgcctgagtgggacttcaggcctgcatcagtgcaccggattttatagacaggcttgaggaggcagtgtctgatttacacaggggccaaagattggttggaccaggtgcgcacatttatttacatagcgcatggggaagctggcccccaccctaatcttattatgctaatggggtctttactttattatgcaaatggcgccacgttgtctgttccttgctgtagacatggttgataaggaaaggggaagatggagccaccatgttggacatgcctagccctcaggtagccttttcctaatggcacagctgccagcattcactcatgcaagcttccagcttgcttgtctatgtctgcagctccattttacaggctgctctttgttagaaaagaagattattttggatctgcttttcattaaaaggaaaaccttaccaaagactctcttaccctcgctttctgcctaaataatttcttcttaactcctatatcgtcgctttcttgaattctggttctattagcagtgaagttgtcacatggacacattcaaaacctctggttacccaagatgttgcaggcagtggaattaggtgttgtcttctcctttctgggatcagggttattctgtcatgagttgctgtaataacctgagttggttggcctccagccaataggtggcacttccaagagaacaccagctatgatagtggtagggagctctaaacttgccctaagatggccagggtaagtattttggtttctcaggtaatgggtggggccataaagctccaaagaatgattatgttttgtgttcagctaccaaggtgaatagggaaataccatcaggtggggacagggttagacaggtctgcactcagattctccttgggtagggcttgctactacccaaggccactgtggtgggtgggtggtggttctcaggccaatgggactacgttccagaggggattatggctgcctctgctgtgtccagggaagtggtggatagctggtagtgagaggcttcatccagctcccatgcacttggagagattggtcttccactacagtgccctgctcagaccttgccccaggccatgagctacccagctgagaatcagcacagcttccagacctcatccctccccatctgctcactccattggtggtaggtcctgtgctcactcataccagcagcacctgatcatcccccagactccactcaagaaatttgtgcccagtccactaccaatttcagttgggacctttcttcatcccacaacaccttcccaattccactgactgcctttcccaagggccccagtgagatatagtcagggatggcttccctgggctcaagctggatactgggaatatgtgcaaggtacttcccactgccacttccacttttatatttcatgcaaccccctaaatctgtttcatctctaggtaaagttaaatccttctcatgtgatctggattttcagattccccagtggggatatgtgtttggaggtaggtttgcctcctctcacactttgggaactcacagtttttttttgcctgtttcatggaatttgcagcagtgtgcaacttctttcaaaaaatctgtgaattcctttggttttcccggtacgttcctgtggtagttcttggagcaaaagatcatggtgtgagtctgcacacactgttctgtccatccatgtgggagctgcacattagccctgtctcctattcatcatcttcccccgttcttgtcctgattatccaattttgagtgctgttgaggttgatctgtgggttcaggtgtttcagctgtaatgatggtattataaagttactcatcaattttcacctaatgatttttttgcagtcactgatgattgctgactacatccactatttcattaaagatttgcaaaatagtgattttctaattctacccttcattctgcacctattagctgggtttttcaataaagaagaactttccctcatcaaccaaaaagcttcttgcaaggttttctttttggtttactgtgggttcattaagatgtgacagatacgactagatgcagggacttcagaatgctttccaccgttgctccctcacatatatactcttgtcatcatgtacttttattctacatattattattgttgttttcatttcaatgtttcactccaatgttcatttatacaatcagtgaaaaatattccccataaattaatatttctttcttttctttctttctttcctcttctttttttttttttttttgacagggtctcactctgccatccaggctggagtgcagtggcatactcatgactcaatgcagccttgatctcctgggttcaagcgatcttcccacttctcacctcaacctccacaagtagcttggaccagaggtgcattctaccatgtttggctaatttttttttattttttgcagaaatagtgtctccctgtattgcccatgccctgtattacctcaaactcttgggctcaagtgatactcccacctaggcctcccaaagtgctgggattgcaggcatgagtcactgtgcctggccaaattaatctttttcttttctgcattcttttctgtgtctcttcattcttttctgcatctctgacttccaatctggaatctggtttccagccctaaatttcctggcttcagcactggcaaattctattttcccagggaggggaaaaaaagtacctgaccaggcccaaagacttcatttattttcttcattattttatttacctctataggggctttttccaagtcaccctcaatgggatttcctttactctatcttctgtaacagccagagcacatcaaatacatagaagctggcattctaggccatagtaattgttcagtaggtactttatcttgtttactttgttggatagcctttcttaacaaactttctctgatatctcagtctcagatacaagtctccctgcctttaaccattgtatcagttaggacttgcattaactgcaaacaagtaaaaactcaaccacattttacagttaggcattacacatatgcacacatgtatgtgtacacacacacacacacacagagagagagagagcgagagagagagaactctagaacttctagtcccatggcttaaaagtgtcaggaccactgactccacatttttccaggcaccttcctaatgcctgtgagtcagctagtattgcttcagccatgacatctatattccagacaaaaagtagaaggaagaagaagaaaggaaatgtctctacctgtatcaggtatatcaaccagactgagaaatccccactagtccgttgcttacacctcattggtcacaactcagtcaaatggctacctcaatctgaatgagaggctagaaaatgtgtatatatgtgttagttgtgcacttcgctatcctaaacaaaactgcagttctggcaaggaaacattgactttgggttgacaatcaacagtttgccctctccctactcttcccttggcataggatgcccttccctcctccccacctactgaaatcttattagaatatcacctcttccaggaagtcttttcaggttatctcagtaggaattttcttttaattcttcagtttaataagcaatatcttgtttgcctagtaactgcaaggcgctactaagatactatagatggagataagtaaaatagcgttactgtcctgatagagctcagtttacttttagtatctaaaaatcagactccaattattatttaatgattacagagtttctatttgaggtgatgaaaaggttttggaagcagatcatgaggatggtagcacaacagtgtgaatgtacaactgacccttaagcaacatgggtttgaattgcatgggtctatttacagaaagattttttccaaccaaatgcagattgaaaacacagtatttgcagaatgtgaacccaagtgtaaagagggctaacttttcatgtatataggttccacagggcttgactacaggacttgagtatacaggatttggatatatgttgggggcagaggagttctagaattaatcccacttgtatactgaggggtgtctataattaacaccactgaattgtacacttcaaaatgattacaatagcaaattctgtgttatatatattttatcacagacaggcaaatcggactccaaatccaaaaatgccagcatggtgtgaaaatacagacagaaaggaggtatgggtgttggggtgcatagaaaagtcatttaaattacctaggcattggatcctgttctgatgctgtctattagttcatcttcacactgccataaagacatattcaagactgggtaatttatgaagaaaagaggttttattgactcacagttctgcatggctggggaggcctcaggaaacttacaatcatggtggaagggaaagaggcatgtcctacatggaagcagatgagagagagtgagcaagagcagggaaaactgccctataaaaccatcagatctcttgagaactcactcattatcatgagaacagcatggggggaagtgcccccatgattcaatcacctcccaccttgtccctcccttgacacatggggattgtggggattacaattcaagatgagatttgggtggggacacagagccaaaccacatcacactgctagttctgtctactgagaagcagatgcggagatgcagttaggacaaacaggcatatttgggtaaacttgtgaaaggaatttcttctactttcacaagaaacttcttttcttagaagcaggactggtcagaggaagccattaaaccgtgaagtagatcaagtagaaaaagcctctctgcctaaaggggagctctagaggaaagagcccattacaggaatcctgctttgggtggaagtgcctaaaccttgctcagtcattggctggggctgcactgggaagaactgaaggagaccagaaagaacaagtggaagctgtcagcccaccaccttctcacagctaggcaaggcatcctttcttgcaagggaataagtacagcccacctctgtctgccacagctgctactagctatgtgatcttgtggcatttgagctttctgtgcctcagttttttcatttgcaaaataaatataataataaaaatagcaacccaatctggttattggaacaactatatgagctaatgaatgaatagtgcttagaatagtgtctgtttaattataggtgctcattaaatgtgggctatcattatcaatattgccaagcagaatgtacattatgaaataaacacaaaactaaattacatatatatgatacagtaaatataaatcaaagttctgatatcttctggaccttgattggttttgttctatttttagacttctggtttgggcaagaaatgacagtgactgcaggtaagatggtggcagtagatctagtaagatgtgaacagattcaaaatgcaatttaaagttttagaatatgcagtgaagtggtcaaggggagtgaagtagaatcaagcctgactctcaggcttttggcttgatcagctgtgtggatgctgctgtcaataaggtgagaaagactggaggacaaagggcagatgggggccagtcaagactttcatttgaacccatgaagcctgagttatctgtgaggtagtggaagccaacaaggcaggtggccatgagaactaagagatgcaatctgagctggaaatagaagtttgggagtaattaccataaggatggtatttaagtccacaggaatggacaagataactgcgagagtgaagaaaaccagtctctacctgcttcctcaccctccaaatccaatcaagctttggctctacctcactgtattttggctccacccctcttttttatcctctgttttgctgcacctgttcagtcaatactgctcatgacactgtccttataaaccatataaaattaatcagggaggaagggaggaggagaagcaaaaataagccaatcttgcagcacatttagtgttaatcactaggccagtttgctctctgacctgcttcctcatagttgtttagtgcctattgcctcagaatcacgtagaccctgttacaggttatagttccccctaactgctctatacataacaacttgaacattatacaatgttacgttttctatatgagatcatcttttaagtcctgcatgccagtgaaactatggacaccagctggtctgaaggactccacaagaagctgactcacaatgcaatttccacatccttatgattttataccccttactccaaccacttaatgaccccaattttccagtctcccaccctccatgatccccttgtggatccagaagtccttgtggagatgtatttgagagtctccttccatctccttgctcagcttcctgagatcattaaactctttctctgctgcaaactttgctgtcacagtgtattggactattactgtgccatgggactacaaacctgttggtccggtaaaaaattttggtgagtcaagcctagagccccttgtgggcatttgtccatggctcagtgcccctgcacaattgggacaggcccagagacaagcccacgtagccactaggttctattgtactaggagctgttgacagggcagtgccaaccttcagcacataagttgcttgcaccaaaggaacagtttccagatttgaaagacatctttagtgagttttctctgtgcaactggcacatttaattggctgaaactcttttggctctaagtcccttggccatagggtcccactgagggacaagatggacccaaggcaggtagccataccacttcggcaacaacatgggacagaataaaagcttggccatcaatgcagcttctggcatatcttgaccaaaaaagggaatgtaaattaaaaataaaattctaagcccctaccaactgaacagactctgcttatagccaatggaaacccacaaagaccttataacctgagttcctagccatgatggaatgggtggtcagacatgtctcattatactgtctccctctcagcatctagacacagcaactggccagcattaatgttaaaatggaggtcataacactgacagaacagactctttgtgtcagtaagatttcatgagtattccagagttttcagtcttattttgcaaggacttttgaaatttgagctcacagctctgataataattaattgcacaccagattataagataataatttatagataaatataaatttatttataaatatgcatttatctaagacgtatagataattgaattatctataagttgtatgcgttgaactaccagctgtttaggcttctgtatacctgtccttgatttgaaaggtctgaattaattttatcccttggaactggcccttacgatcttatgtgcccacatcttttgtcatggtccctgggcctagagagaggatgtttgatattgcataattttagcagcagtgcgttggcaatggaaaacagattgtcccagtgagattgaatagtttcagattctggccctgtgtttcatgaaatattatcagagactaaaagataaattattatcttatagtctggtgtgcaattaaatgctgtgctaagacagtggattggagcactaaggtgtttgtactgcacccctgagatccccaactgagcacttgtaaatacttacaggttactccaaggcagtttcattcctctaatcctgactcttacctcaactgtgccccttgccaacaggaagaagctagggtcatcttcccccagttcccaccatattagctctcacttcaggattgaagtatgaccaagcccacagagggacagaaaccatccttataaatagtataaaattaatcaaggaagaagggaggaggtgaaataaaaataagccaatcttgcagcacattcagcattaagcactaggtcagcttgctctcagacctgcttcctcatagctgtttggtgcctattgcctcggaatcacgtagaccctgttacaggtcatagttccccttaacttctccttaacaacttaacttctccccttaacaacttgaacattgtacaatgttacgttttctatttgagatcatctttcaagtcctgcatgccaatgaaactatggacatcagttggtctgaaggaccccatgagaagctgactcacaaaagaatgcaattttgacatccttatgattttatacccctcaatctaaccaatcaatgaccccaattttccagcccctcaccctccaggatctccttaaaaaccccagccaagagcttcctggggaggatttgagagtgtctttccatctcattgtgggtgccctgtgatcattaagctctttactgcaaaccctgctatctcagtgcattggactattactgtgcagcaggcattcggaccagtccatcctgtaacagtcacctggatgaggacaccatcttgcctgattggtttcccatgcccttattttgcttcctctctcatatcctatttccttattcttctaatccgtcttccaaaatggccacaaatcatttttccaaaaccccaatctgctcatgtcaattgaatacttgtttccttaaaatctttcagttacttccattgcactcagaataaatctcaactttctcagtttagagctctttcttggctaggcctttcatgttcagcctccagcttgcttttctactgatttttctatgatctctagtgtgaacttcacaggaaaatcatatcggactatttgtacgtttctcaatgcttccaattatctcatgccttgccacctcaatggcctcaaggcatcctcagactcacaataaaatccagactcctaatcatggcttgcaaggctctgtctaaactggataccacgtcaacctcattccctacctctctttccctccctccctgctgtagccattgacctcctagatattccttctcttttttcttttctttctttctttctttttttttttttttttttttttttttgacagattctgactttgtcacccaggctggagtgcagtagcatgatctcggctaactgcaacctctgcctccagggttcaagcgattctcctgcctcagtctcccgagtagctgggaccacaggtgcgcactaccacgcccggctacattttttgtatttttagtagagatgtggttttgccatgttggccaggctggtcttgaactcctgacatcaagtgattagcccacttgggcctcccaaagtgctgggattataggcatgagccaccgtgctcggccttctcttttcttttgacttaattttttttagggcagttttaggttcacagtaaaattgggaggaaagtattgaaattgcccatatactccctgccctaacacatgcgcaacctcccctattaccaatatcccctgtcagagtggtatatttgttacaattgatgaatctatattgacacatctatcacccaaagtccacaatttacattggggtttactcttggtgttgtattttctataggcttggacaaatgtaaaatgacatgtatccaccattacagtatcatacagattattgtaagaataatcctaaaaattctctgtgctccaacatcctagctgtttcttgaacttgccaaaaaaattccagactcagagattttacatttgctgttccctttatcttgaatgctgttcctctagatggtcaaatgtgttagtctctcatttcaaatgaatttccacttatatcttgcctcatcaacacctcccctctccactctatgcataacaactatggcccctttcgtacctccccctattatctcctgtatctccttcatcaacttcatttcacttttccctatctgatgttatattacatatttcttctgttgtttgcttactatctctctcctcattctagaatacaaaatgcacaaaggcagagatttttcttttgttcactgctgtatccccattgcttatatcaatttctgtatttatttataggttatttatttatttctgtatttatagtaggtatctaacaaatactagttaagtgaattaatgaatgaataaacacaggaataaatgccaccacttctgactgtctttttccacttggttaactcctactcatcctaaagactcagggtaggcaccaactcctccagcaagtcttccctgaccgtccgcccaggctgggatgagggccctttgttgttcctctgggctctctcagccacctggactggcacctctattgcaacacttcttatcttgtgcctcctaacccaatctctaagcttctctagggcagaaaaatcttatgcatctccccctctctccagtgcctggaagaaagtaagtgctctgtaaatgttcatgaaatgaatggaagaatgaataagtgaaagaattatagcagaatttaaaatgtgcaaactctgatgtgcaaaataacacaattttctttgtcattaactgatctactttgctcttgcatctccattcctcctgatggtgaaaaataatccttaaatttgccaattaaaggcaattcagtttgctttgcaactgaattcagtctgcaactgaattcagtctgaattcagtcatgttggcgttgattattgaaaaaatatcaataccatttctcccctcattcaaaagactcctccttttcttctttgccaagattgtatctgggtacaagtgtgtatttctgcatctccatggtcaagaaggtggtggggaagagagtacaggtgaaggtggaacccctggtctgagttcccttagttctcagtgaattccagagggttggcgggtttaacatggtccctgggcactctgagtggatgtctactgagagattcataatacccgtggtcttctgggtgtcatccatctatccatagcccctgatgctgaagacttcaccctactttaccctctagttgtgaggttcctgctgtctgtggcttctagctcctgttcccaggactggagcttgcaggaatgttctgtttctctgcccaaactagtgtgcagcctctacgctgttgcctctaagcacctccttactatgtctgtactgtgttggacatgatgccatgctgaacctgagagttgggatttttttcagagctagatcctaagaaataagaaacagatgattctgccctgttatccccacatctcactcataaaacctcctgcttcagagagctcagccctcaggttgggctttcttctccctctgtctccactgccctaaaccccagtacaaaaggagctttctgttacccattcctgtctgatagatgcccctttatttcttaccttccttcttttgtgctctgtagatttctatgttccaggtggtttcctctgttatcacacttgggcaataagcaccatatggtgtagagatgctagagattcaagaaaaaggaaactaccctggagatagtctattcagatgagaggcaggtgggtggatggatggatggttattagatgacttgtcccatatcatcaggtccttatgtaaagagcccaggactccaagccagatcttctgatcactctttccattgtatcttttggattgaaaatccagttctccaacttcccaactttcccaaatgccattcatcctggaaagctttctcagagggtaattatgtgcttgaggactctgagctgttcagatgtgaggacatgcgtcccaagatgcgcacagcagtaatttgccttgtgggtttcccagtgcccggtgctctgtagagccagctaattaaaggccttatcacaattatggaaaatcacaaggcagcagtttaattagattttcatgtggaactctgtttcattcccctcatttttgcctaagatgtctgagagtagaattgagtctaatggccattaaagtagtgtttgtttttatatttaatttcttcttctccaaaatcttgatgcctgaaccctaaatgcccaagcaacgcttagatgtctattcagcatttcaaacttagtgtccaaaatgaactcctgatttcaaccctatctctgttctttccctatcttccccatctggcaacacattctactaaatcttggaattaactctcctctttttctaattcctcacattcattccgtcagacttcatcacttgtctcttcgcaatattttcagaacctgagcttctcatcacctccaaagctactaccttttttcaagccaccatcatctttgcctgcactatttcaaaagcttctgactggttcctctgctgccacttttgtccacagaattaaatggtctgtgtgtgcctgtgagtgcacacatatagcttagtcactctaacagagacccaaataaacagtggcttaaacaagacaggaatttgtttctcactcatgtagcaacccgtgtggaagcagtccaggacttgtgtgtcaggcaccctgttttcatggttccgccctccttagggtatttcccctgctcataggatccagtattactcacccccatgtctgctttccatccagtagggaggaagccctggagaagaggaaggcatgcccacttcctttaactgcctggcccacaaattgtgcccaccacttccacttgtctgccaatggtcagaattttggctaacagccacatctagctacctgggaggctggaaaatgcaggctatttctgggcatctaggagtccagctaagaatcacagctctgttgctacagaaaatgtcttgaatggatattgaggtttctgtcctactcattccccctggtctgttttccctacagtggccaaagagaatagcatagagatcaggacatgtcactcagtaaatgacaggatggcactcaacaattatttttctagtgccccatttaataaattccaagtcacaagaatcaggcctcaattctagtctgcactagctggaagagaccccagagaatatttagcgcatggttttcaaaatgattttaggctatatatgtatatatatttagagaaactttaataaggaagcctactatgttaaatggggaacaagctggctgctatttttgaaatcaagggcaagatggattcatttgctttttcttttctgctttaactcaaagctggtttagattcaaagtcccacttccagaggtgttcggaccacagattgaaacaatgaactccagcagaacatcttcattttccctatggggaaactgatgcccagggaacaacaggagttgtagcttaccgagctcagtgcctcacatgcttgagctaactttcccaaagcggggatcccggccatggaagaaagcctgcctcatgactggccactctcccagaagcaccaggctatgtgcccaccagagggaatcccagcagattgattcctgcaataacttcatgctctctgaaaaaaaaaagtaccatactcatgtttcagtacctccaaactggcagtggggtttcctttgtgggggaggggtaaggaaggaaacactgggaggagcccttcacttcagctaaaccagctctgaaaacttggccaagtctctcatttactttggtaaccatatctgcttggaagtgttgctgtaaagatcagaaagagatgaggtctacaggcaacaatagagagatgaaagggattgttttttctgtgtgggccgtacaatatcccacactctcatacccttgaggggcttaccagctgaagtggagacaggagaagaagggaagccaagaatctcaggtgcctggcacagaatcaaaggagcagtgggaattgtgcatgctgcaggagggaccagggctaaagtggtgaggacagggacacactccagtgctgggtggaagagaacctgagggataacatagaggtggtgaaggacagggctccccacctggggatcttgttaaaatgaagattctggccaagaggactggggagaagcctgagattattcatttttaacaaactttctggggacgctgaagctgctgctcctggtaacacctttagtaacaacatagaaaaagagaccccactggtgcagggatcaggccagcctgaattccagcctctcttctaccacccaacagttgtggacctcaggcagcctcgggccttttaccttataagtgggcacactattagcaactttacaccagaaccgccagctttcagaatccacttctctcctgtgcggacagaggtgcagacacatctagtgtaaaatgggccatctgcagtgactctctcactctgtttctagtcctccgccagccctcaatcctacacacttcctcccaccgcctgtttgttttgttttgtttgatttcattatcttcacttctctgaaaaacagaggtaatactggcctttcaggtttgctgggaggattaggtgagctcttgtgttctcagaagcaattagacccgcccccaaccgctcccattgccctgcccctccccagcctaaggtttgtccttcactttctatcacacgaccccagtgtcatccctaaggcagggaacctctgcatcctttccagtcttagacatgggcaagacacctgggagcagcctcgctagaccaaaactaacacccagagaggaacccaccctccaggggaacaagaggatctcttgcttcctgcctgagactctgagacctgagaggtcaacccaccaaatcctttaacctcttcaagtggtgtttttgtttgttttttgagatggagtctcactctgtcacccaggcctggagtgcagtggcatgatctcggctcactgcaacctccgcctcctgagtagctgggattacaggcatgtgccacaatgcctggctaatttttgtagttttagtaggaaaggggtctcaccatgttggccaggctggtctcaaactcctgacctcaggcgacctgcctgcctcagcctcccaaagtgttgagattacaggcatgagccaccacgcccagcctcctcaagtgatttttagtgaagaagcacattcgctcattttcctgtcagtcaatctctgtgagggaactgttatttccccttggtaggtgagtaaacagaggactcactcttctgaatcccacagctgacaagtgacaagattcaagcccaggctttggagattttatctctgttctagaaatgagctttttgtcttagaggatccaaagatgtccagtggttgggcgtagtttgttcatttgctgatgctttagccgaggcagggatgataagagaatcaggaggcaagggggaggtgtttgaaaatccaggctgtggagaggatagatcctccctgagctgtgcgagcttggcctaaattgccccatctccaaaatgaaataataataaccacgacctacctcatagggttgttgtgaggattaaatgtggtaatgttatccccatgcctagcacacagtaagcacctaaatacatctcaaccataattatttccacccccaccgccgaccacaatccttggcttaggattaactataattattaatgacacaactgaaccaggctctaccacttcctcaatttgtaatctcagaaaagttccttacccattgtgaaccttggcttcctcttctgtagaatgggaatgatactcacctctctctgctttaggaaagattaagcaatctgatatggagtctagcacagtgcttggcacaacacagtcaataatagggaacatttcttgctgatgcctgatgtttctgttctgtgaaggaaccatcttgctcttgggggtaagcctgcccatggggagtgtacactgctgattctccctcccagtgtcccctcacctgggtgggtgtctgcttaatgccatggttccctggcagacccacttggccttcaaactaagctacatcctctgacatagcgtctatcagtagtaaaagtgctatgtggcttgcgtcttcatcgacttatttctcaaattattcagaagtgttattcatgggtaccctcctcggaaggacttaataaagaaaatgtattcaattagtcttttatttagcttttatttaatccactatgtactaggaaccaagctagggattaaggcataaataagacaatcctgcccctcaggggcccaccatttacggtggggaagacaggtgtgtaaacagatggtaatgcagtatgcagggtgttctgggacagacatgtcaggatgtgaatggaatacacaggagagtacatagcccagcatggagaatctggagagacttcctggagggaggtgacgtctaaattgaattttaaaaatgattattcaagtctgtaaaatatataacccagcatcacagtttagtgtcatgtccacctgttccctgctttgagccaagtgcctgatccatagtaggcacttaataaatcatgaaattacaaataggagagggtatggagtaaaaggagcaagaagagagagctggagagtaattagagggagtgggcgctgccatcgggtctgggatttgctgctcccacccctgctgcaagttcccgaaagacatggaaggtggattaagagatacatggcaatggggagctgtgatctttccaggcccaggacagaatagaggttgaaaagagagctgcaggcttcagaggaattcatgacatcaatgtggcgagagggcggaagacatgagcgagtctccaaagggagcacaaatcgttgaggaggcagctgagggtgagccccttgacagcagggcgtgatgggtctcctacttatccttattcagcctctacaagaggagagctttgcacttgatatgacatcagagttgagcatgaataggatttctctggttttgttcatatttgaaaattccattaaattttcttaacaaaaagttaaaaatcttttggaaaaaagatttttttttttttgagacagagtctcactctgtcacccagtctagagtgcagtggccgatcttggctcactgcaatctccaccttccaagttcaagtgattctcctgcctcagcctccagagtagctgggattacaggtgcttgccaccatgcctggctaattttcgtgtttttagtagagacgggatttcaccattttggccaggctggtctcgaactcctgacctcaggtgatctgccttcctcgacctcccaaagtgctggtgagaggtgacagcatgctggcagtcctcacagccctcgctcgctctgggcgcctcctctgcctgggctcccactttggcggcacttgaggagcccttcagcccgctgctgtactgtgggggcccctttctgggctggccaaggccggagccggctccctcagcttgcggggaggtgtagagggagaggcgcgggtgggaaccgaggctgcacggggcgctcgccggccagctggagttccgggtgggcgtcggcttggcgggcccgcactgggagcagccggccggctctgccggcccagggcaatgaggggcttagcacccaggccagcggctgcggagggtgtactgggtcccccagcagtgccagcccaccagcgctgagctcgatttctcaccaggccttagctgcctttccgcggggcagggctcgagacctgcagcccgccatgcctgagcctcccaccccctccatgggctcctgtgcggcccaagcctccccgatgagcgccgccccctgctccacggcgcccagtcccatcgaccacccaagggctgaggaatgcgggcgcacggcgcgggactggcaggcagctccacctgcagcccagtgccgcatccactgggtgaagccagctgggctcctgagtctggtggggacgtggagaacctttatgtctagctcagggattgtaaatacaccaatcggcactctgtatctagctcaaagtttgtaaacacaccaatcagcaccctgtgtctagctcagggtttgtgaatgcaccaatcgacactgtatctagctactctggtgggaccttggagaacctttatgtctagctcagggattgtaaatacaccaatcagcactctgtatctagctcaaggtttgtaaacacaccaatcagcaccctgtgtctagctcagggtttgtgaatgcaccaatcgacactctgtatctagctactctggtggggccttggagaacctttgtgtccacactctgtatctagctaatctggtggggacgaggagaacctttgtgtctagctcagggattgtaaatgcaccaatctgcgccctgtcaaaacagaccactcggctctaccaatcagcaggatgtgggtggtgccagataagagaataaaagcagcctgcctcagccagcagtggcaacccgctggggtccccttcctcatcgtgggagctttgttcttttgctctttgcaataaatcttgctactgctcactctttgggtccacactgcttttatgagctgtaacactcaccgtgaagatctgcagcttcactcctgaagccagcgagaccatgagcccaccgggaggaacgaacaactccagacgcagtgcattaagagctgtaacactcaccgcgaaggtctgcagcttcactcctgagccagcgagaccacgaacccaccggaagaaagaaactccgaacacatccgaacatcaaaaggaacaaactccagacgcgccaccttaagagctgtagcactcaccgcgagggtccgcagcttcattcttgaagtcagtgagaccaagaacccaccaattccggacacactgggattacaggcgtaagccactgtgcccggcaggaaaaatattcttttaaataaacaaaattaaggttttaaaaataattagattatactattaactaaaagttgttgaaaattaagtaatctagccaagatgccgttaagggagccactacccagtgggagaagaacatcataacagcatagtttggaagcaactcctaggaaaaaaaaaaaaaaattcatgtttatgcccgactaactggactccccctaaaacagttacacatggagtttctatgagatgagaaataaagaagcaaagaaaaaagattggtaaatagaaatataaaataagatgttagaaagaagtccaaatacctcagtattcacaagaaatgtaatagatttaaatactctgttaaaaggagtagcacttggcacagtattataaaatactttcttttcttggttctcgctccctaccctctcctggttttctcctacctcactggccgctactcctcaatctccttctgtggatgtgtctcctcttccaggaggagctacaagcattagaagaggatgcatttcttcttccaggaggaactacagtcattagcagaggaagacgcacatcctctcctaaggattgtagctcccctatgtctcaatcctctcatgtcttctcaccataccttctccagcctcatggctttaaataacatttgataactccaaattcacatcttcagcctgcagcttcttccttgagcttcagcttacttatccaacatcctacttgatgcctgtactaggttatctaataaacccatcaaaattggtggaagtagaactcttaaaaatgtgcatcctgttcccattcttcctgaatcttccccacccaatagacggcaccaccgttttgttaattgctcagtccaaaacgcatgtagtcatccttaatatcttctttttctcatataatcttgttacaggcctacattttaaactcctctcctgggattctttcccttgctcaacctgttttagtcacatttgtctttgtttgttattcgtagaacacaccaaggttgtcaggaccttggcgtctgcttttttctctgttaaaatggtattctgcctggtcttcccccttatttcatcaattcctactagaatagtacccctcaaaggcttcttgcctgaccccacttaaaaaaatggagctgtccctcaggccactctctattcctttacccaacttcatttctctgaatagcactttctactgcctcagattatatttcctatgtgtttgttggccagttttttagtcatctcccccaactacaatgtaagttttgtaaaagcaggggtgttgtcttgttcaccgccacatccccagtcactagaaatatgcctggcgcagaggatgctttattaaatgaatttcaaattgatgaatgaatgaatgcatgaatatattaatgaataaaaggaggtagacctcttaggagctgaagaaatagtccaggtgagaaataatgaaagactgaactagatgtcatggttaatttaatgtgtcaacttggctaggccacagtgcccagacatttggttaaacattactctagatgtttctgtaacaggactgttggatgagactgacatttacattggtagactttgagtaaggagattcacctccataatttgggtgagcctcatttgatcagttgaaggcctgagtagaaccaaagactgaccttccctgagcaagggagaattctccagcatgtagcctttggacttgaactgatatattagcatttctctgtgtctccagcatactggcccactctgtagattttgggcttgccagccactataatcatgaatcaattccttaaataaatctctctgtatatacacatcctattggttttgtatgtctagagaaccccaactagtacactaggccaggtagatgggatggagaagtgaaataagatatgggaaattaagaagacctgggaggaatcatcaaattaaggcatttggcttgggagactgggaacctgtggaagccatgcaccaacacagaaaaggcaaaaaacaggtaaccccagcaataatcttgcaagcagctgggttaattcatttgttcgtttggaggaatcatcaaattaaggtatcttaattatcttagtctctcctaggcttgagagaccaagaacttgtgggtgccatacaccaagacaaaaaacaagtatccccagcaatggtcttgcaagcaattgtgttcattcatttacttgtttatatattcatcgggtccaagtacctgctccacatgtaaggttcctaaaagccagggagattacaggattttcatagattgcacaacaagtttctttggtttgagagttctttttattattgttattattacatctctgatagggagtccagttttcttgattttgcgatagccaataataattgagggagttttataatgattcagcatgggaaaatcagagttaagaaactgcccagaggttccctgcaattcctggttgtggcctttcattgttactgttcacagactcaatctttgtcatcctgctggaagtgaggccaccccttctccctcagggtttgctgctgctgcctgagctgtttcctccctagcagccaatgggctagtgaggctgtgggtatggtatgatgcagatctaagtaatgatggcccggaactttaaaaaagcaaaaagctcagtgaattattattattagtccttcttcagaagtacagagaaagggatcctatcgcattggagaagtgtgggctgcaccagttagattgtcagaaatgatgaggcaagccctatatggaagagatcattaatgaataaaaattctaacatttctttactatgaagtttatgaaatgttttaagatgtattgtgcattggagcttcacggctatactttgaagcagatatttttattactccaaatttccaaaaatagaaactatcagagatattaaatgactttctaaaattccatacttagtaatttacaaagtagaattcaagcccatgtcttttggtttccaatcttcggaatttttctagaggttagctggttttaggcatcagagatgggctaactaaattggaataaatcacttgcagtttgttaaaaatgcagatttctgggctccacccccaaaagattctgattcaataggttttgaagcccccagatctatatatttataaaatgcactataaaaatctcctgagcagccaggatgttaactaagctcctgctatgcttagcaaaatatgctcaatataaaagctctaacaaaggacaaaataatagtttttattttatcattcaaaaaaattgacatagtttctatccttatagaaattttagtctcttaggtgagataaacacatacaatgatcatacaaataaatagatattttgaaatagataaacagagaaggagtaagaggggatgacttgaaatttaaaatatctgatttagataagggcaacagggaaacttaagcagagacctgaaagaatgagatgggttagctagaccaagggggaggctggggttgttcaaggcagagagaagagcatgcacccatggcctgaggtaggaagaacttagtgtgttccagaaattgaggaaggcccatgtcactgaaggctgatgagcaaagaggataaaacaaggcaattatgacgggtggtggcccggtgatctggggcctatggaccgtggtaagagatttagattttaagtacaaccggaatcctctttcatgaaagaaaaagaaaagtcaacaagatttgcatttttttaaagatttggatgaagaaccagaaatggatgaagagtaataggggattcagggaggcttcttaggtggttatagcacaaatcgaggtgagagatgatggtttagaccagtgtggttaaagtggaggtagaaggaagtggataaaattaagaagtattttgatgggagaatgaatgtggtttgggcaagaaatgaggaattctcaaaaatggccctgagtttctgtcgtaagtaattgcagtacctgagtgaaataagagacatttgttgatctgagtcagtgtggagaaggaacttatttagggacataaaaagattaagagtttagttgctgacatactaactttgagatgtccattagacattcaagtagatgtgtcagatcttggctggagataaaatttttggaattttcagcatagccacagaagtggatgagattccttgaggagagagtgcatgttgataacaggagcactatgagagagccctgaggaatgggactgatgcataaggtcaataagtggctcctcagattggggtgcattatttcttgatctataggaggtcactgtaaagagaagagcacttgtcaccctgcagttaggtatctgcttatttgtcttaattgctcaataggttgtaagtccttcaaaggtgaaggataagagtgtaactcaattatcctgaaaaccacagcacctaacacactgggcatctaaatgaatcatgcacactgttaaaagctttacatttatcacataatgtagtgctccaaaattatattattctcattttacagaagaggaaacctaaattcagagatgttaaattctttgaccaaggtcacatatttagtaaatgggaaggttacatttagaatcaaaatctatcagattgacaaatatggctttcaaattccagtggatgagaaattttagacaacatcctatgataggtaagtgttgccatggtttgaatgtgttccctcgaaggttcatctgttggaaacttaatccctaaagcaatagtggtgtgtgcatgtgtgctggggtggcggggtgggggcactactaaaaggtgattgggtcatgagggcagagccttcttgagtggattaattttgttactgtgggagtggcttagttatcataagcaagttgttataaagcaagtcctaacccttgtgcctctcttacggtctttttttttttttcttcaaattttaacatattttattgatttaggggccaaacaaggcagcatttggtcagttaagaaaggcacctcattgaaaataatacatcacagtgctgttgagtgatcccagtcacaggatttgagaatggaaaggacaatctttggatgacatagcttaggacacttgctcatttatttaaaagagtcccttcacacattgcagataaaagaaggcaagagcataggattgtggcatgtgctgggtagctgtgagaggttactcatgagattacgtagcctagtaaattagtggtaagtcaggggaagggaatcagcctccctttccatttcattcccttctccctccccttgattccagtttgtttgatttgttgagccaccatccctatgaatacaccttacatctctttcagatgtggaaatggttttttgatcttacagtgtgtggaaccggggtcagtaatcaaagcctccctgttccaagctatagacagacaggacaacaatttgatttcctgtactcttggtctggaacccatggggttctgagataaaagctgaggtcttagagcactggctttaaaaaatattttcaccagtccagagtaaatgaaaacccgattccttagaaataatattgtgtctctctatttctacccccaccctccaagcatggtgttttttaaaaaattaatttttcccttacactttaaaaactctcacctatgtataaaataaactgccacattacaataacactgctgttgtttcaagtattcctctcagcccctcaccagccctccctcaccatcctcaccctgaccaccctttccctctgcccagcacctaagagcagggatcacgccaccgggtgatgagcagtgttgcagtttcgcctggccttctgatactaggatgtggctttggagaaggctgctaggatgcttgcgaacacgacatcaggggtctgggatgcattgatggcagagtggatcccccgtttcctgtagtactctatgagtggggtggtttgagtgtggtaggcttgccggcagattttcaaggccttttcattatcatctgatcaacggatcaagggttccccggtgatgtcatctttcatgggctcttttggagggttgaactcctcgtggtaggaacggccactcttggggtgatcagccttcctgtgattcttcggatcagcagagagtctgggatgctgaattcaatcacagaatcaagcttctctttcctcttctccatgaggtcatcgagcatttctgcctgcctcacagtccgagggaagccatccagaagaaaaccatttttgcacaagggggtctccaaattcttctcaatgagctccactaccatttcatcactcaccagtttcccagcatccatagttgccttcagcttttttcctagctctgagccagaagccaccatggccctcagcatgtccccagtagctaaatggcagacacagaagttttcagccaatctgggtgcctgggtgcctttaccggccctgggaggccccagcagcacagcctttaggacactcgggttctgccgctggcacgctgggagccatgtccgccgaagtctctcactgccaccagttcgcacacctcacaggtccctctcttttggtcttatgttctcacttccacctttgtccttctcaccatgggatgacccttgccaaatgttggcgccatgctcttggacttcccagcctcaagaaccatgcactaaataaatttctgttcattataaattactcagtctcagttgtccttttgtagcaacacacaatgaatcaagagaggcaatgtgtaccaagaaggggggattgttgctataaaaatatctgaaattgtgaaagcagcttggtactgggtaattggtagaggctggaagaatttggaagagtaggttagtaaaagcttgtattgctataaacagagcattaagggtgattctggtgagggctcagaagagctgacttgggaaagtctgaatcttcttagagattacttaagtagttgtgaccaaaatgttgatgcaactatggacagtaaaggccattctgatgaggtcttcaatggaactgaggaacaaggtattggaagatagatcaaagggcatccttgttatagaatagcaaagaacttgcctgaactgtgtccatgcgcaagggctttatggaagatggcatttaagaacaatgaattagatcatttggcagaagaagtatctaaacagcaaagcactcaggctactgcccagctacttttaaccacttatagtaagatactacaagaaaggaatggtttaaagacagaatttatcattaaaagggaaggagagcagaaagatttggaaaatttgcagcctggtcatgtaaagaacaaaaaaagtatgcaagggtgaaatcaaacaaccttttgctaaagagattagcatggatagaaggaagacagctctgttcatcaagacaatggtagaaagacccagaaggcattttagaaatcttcaagggttcctctcctatcacaagccaagagttctaggacggcagaatggttctgggggatgggcctagggttcccttcatgggcttactgcccatggctgccttgggtctctgcatcctgcatcttgcttgggcagtgctcttggctgccccaactatggctcaaacaactacaggtgtggcttgacccactgctctggaaggtagaagtggcaaatcttggcaatgtccacatactgctaggtctgcaggcatgcagaatgcaagagtggtgggggcatggcttcctataccaagattttaaagtatatcacagagaactgggggcccaggcagggacttgtcacagtgatggagctactatagaagagcccccactaggacaagccaaatggagccatggaagcaaagccaccacacagtcaccactaggataatgcctagtgaagccatgggtgcaggactacctgagaactgtagagctaccagtgtaagcccagaaatgccatggggctggggttgccataggtcttgggggtttaacccctattctagtgtgcctaggatgcaggacacgaagtcaaaggagattattctccatctttaagccttaatgttatttcaggttgggttttggacttacttggggactttcgcttttttgttcttgcctattttacccttttagaatgggaatatctgttctatgcctgtcccatcattatagtttggaaacagataatttgtttaatttcacaggcaaacagctagaaggaattaacctcagggtgaatcatgccttgagtttcacccatatctgatttagatgagactttggacttttgagttgatgctggaatgagctaaggcttttgagatcatgaggatggaataaatgtatttttcattctgagaatataaatttgtgttgggggggaggggtggaatgctatggtttcatgtatcccctaaaagttaatatgttagaaaaaatccataatgccacagtgctgggaggtaggacctaataagaggtgatttggtcataaatggtttaatgttgtcatcgtgggaccaggttagttatcatgagactgggttgttataaagcgagtctggcccctggtgcctctctctctgtcctttgtgctcacttgtaccttctgcccttctaccatgggatgacccttgccagatgctggcactatgctcctggacttcccagcctcccaaactgtgagctaaataaatttttgttcattaaaaattacccagtgtcaggtattctgttatagtaacaaaaaatggactaagacaagtatctttggtgtcttgtaccaaattttgcatttgatagttttattttatcaatctttatgatttatgcattatgtcctattttagtaatcttttcctactctaatctcataaatatattgtcttcaaaaagttttataggttattttctttactctatttgtaatttatttttacaaatgaggtaaagtagagaattaattttgtttatttacttgtatgtgtatgaataatacactgtcctaggaccatttattaatgttttcccccactgatttataataccacatctgaccttcattcattcaataactatgtattaaagagccaactatatgccaggctcggttcaagtcactggagaaagtattgacactcagaagattaggaagatctaggcacagctgctggccctgaaaagattttcttatgtgataagcattttgcaacatatcttagattcatgttgtaacaagataatatataaataaataagcagtttcattctttaggcccaacttaggccgtcacaattctaggaagtcttctatgagctcctcaagctgagttaagtcctttttttggtgctctttcattatcttataaagttttcactataacattgaccacattatatcaattcctgtttacatatttttttcccagcaacaataaaaattttgagaacagagactctcccttatttatttcagaatcttgtacagggccttggttccaatcatatttgataaataaataaattactatgtaacactttggttataactgtttgacttcaggagtgtgaagtacattaccaagaagaaagcaatgttgctattggccaattgcaaacatatatgaaatccagaggataattcaaacagaaaacacacacacacacacacacacacacgcacacacacacacacacacacaatgatatggtttggctctgtgtccccacccaagtctcatctggaattgtactcccataattcccatgtgttgtgtgagggaccggtgggagataatttgaatcatgggggcagtttcccccatactgttctcctggtagtgaataattctcacaagatctgatggttttatcaagagtttccgcttttgcatccttctcattttctcttgccttcaccatgtaagaagtgccttttgcctcctgccatgattctgaggcctccccagccacgtggaactgtaagtccaattaaacctctttatcttcccagtctcgggcatgtctttatcagcagcatgaaaatggactaatacagtaaattggtactggtagagtggggcattgctgaaaagatacccaaaaatgtggaagtgattttggaactgggtaacaggcagagattagaacagtttgaaggactcagaagaagacaggaaagtgtgggaaagtttggaacttcctagagacttgttgagtggctttacccaaaatgctgatagcaatatgaataagaaggtccaggctgaggtggtctcagatagagatgaggaaccagttgggaaggtgactcttgttatgttttagtaaagagactggcggcattttgcccctgccctagagatttgtggaactttgaacttgagagagatgatttagagtatctggtggaagaaatttctaagcatcaaagcattcaagaggtgacttgggtgctgttaaaggcatctagttttataagggaagcagagcataaaagtttggaaaatttgcagcctgactatgcaatagaaaagaaaaccccattctctggggagaaatacaagtcagctacagaaacttgcataagtagcaaggagcctaatgttaatccccaagaccatggggaaaatgtcaccaggccatgtcagagaccttcacggcagcccctcccatcacaggtctggaggcccaggaggaaaaagtggttttgtgggccgggcccagggtccccctgctgtgtgcagtctaagggcttggtgcactgtgtcccagatgctccagccatggctgaaaggggcaaatgtacagctcaggctatgacttcagagagtgcaagccacaaaccttggcagcttccacatggtgttgagcctgagagtgcacagaagtcaacaattgaggtttgggaacctctgcctagatttcagaagatgtgtggaaatgcctggatgcccaggcaaaagtttgctgcaggggtgaggccctcatggagaaaatctgctagggcagtgctgaagggaaatatgggttcagagccccacacagagtccctactggggcactgcctagtagacttgtgagaagaggatcaccgtcctccagaccccagaaaggtagatccaccaacagcttgcaccatgcacctgggaaagccacagacactcaatgccagcccatgaaagcagacagaagggggctataccctgcaaagccacaagggtggaactgccccaagactatgggaacctacctcttgcatcagcgtgacctggatgtgagacatggaatcaaaggagatcattttggagcattaaaatttgactgctcctctgaatttcggacttgcatgggccctataacccctttgttttggccaatttctcccctttggaatggctgtatttacccaatacctgtaccccattgtatctaggaagtaactagcttgcttttgattttacaggctcataggcagaagggacttgccttgtctcagatgaggctttggactgtggacttgtgggttaatgctaaaatgagttaagactttgggggactgtttggaaggtatgattggttttgaaatgtgaggacatgagatttggaggggccaggggtggagtgatatggtttggctctgtgtccccacccaaatctcatcttaaattgtactcccataattcccatgtgttgtgggagggacccagtgggagataatttaaatcctgatggtggtttactccatactattctcgtggtagtgaataagtctcacgagatctgatggtttttatcaggggtttccacttttgcatccttctcattttctcttgccaccaccatgtaagaagtgcctgttgcctcctgccatgattctgaggcctccctagccatgtggaactgtaagtccaattaaacctctttgtcttcccagtcttggggatgtatttatcagcagtatgaaaaaggactaacacacagtcccatcttctttttaaagggtatactccagcaaaactagggaaagaaaaagacatgaaatccaggcaatagaggatgctacccaggagggtaataaagagaattccccaaatggcatctgtgcaataggcatagagagcagcctgcctcgtctatagcaggtggacagagctcctggagagatgtctccatgttgaaacaaaaagagaaggtaatgagacaaatagagtctgatatgagagttttggaaaacaataatcaaagcataggtagatggcagatctgatgagcagtctgagcaaaattgaataactatatttacatagtcattataatataaaccctaatttccaattaaatttaacaaatgatatggggcaggtgggggatgggagattgtgtaagaatgctaaaggcatggattatcacagaaatataatagatgacatctaattttgacaaaataggaaatattaaaagaagcacatttgtttagaaatatgagataactggtgagacagctcaaggagtgaactgaggtttcctttagagtgtgaaactgggtttcattataagtctcatgacatttttttttaagctatgtgtatgtataaattgatgaaaaaatttttttaacttttaagttcaggggtactaatgcaggttttgtgtcatgggggtttgttgtaaagactatttcatcacccaggtattaagccttgtgccaattggttatttttcctgatccttgcccttctcccactctttgaaaggccccaatgtgtgttgttcccctctatgtttccatgtgttcttatcattttgcttccacttgtaagtaagaacatgtggtatttggttttctgttcctgtgataatttgctaaggataatggcctccagctccatccatgtccctgcaaaggacatgatctcattcttttttatagctgcgtagtattccatcatgtatatatacattttctttatctagtctatcactgatgggcatttaggttgatctacatctttgctattgtgaatagtgcttcaatgaatatatgtgtgcatgtgtctttaaaacagaatgatttatattcctttggatatatatccagtaatgggattgcttggtcaaatggttctgtctttaggtctttgaataattgccacactgtcttccacaatggctgaactaatttatactctcaccaacagtgtattaactgttctttttccctacaacgttgccagcatctgttattttttgactttttataatgaaaaatgttgaaaaactaagtgaaccactgttttaccaggagttctaggtgaatcgactgctcctctatctatgtggaagcatacagaaatcttgctcatttggagagttgattcatcctggagtgtttatgttgagccagggaagctgttcttctgactccttgctccttgttgagaaggggaagaaatgccaagtggccccttagggctaatgacagtgtcccctgtgaacatgtgtcagaagcaatcatatctaatcttgacagcaggtctttaaagtgagtattatcatgccccatttaaacgataaagaaactgggattcagagacattgacttgcccaagctgctccactaaatggagctattatatatttagtggtggaggaggggtctgaactcatgtatgctgactccagaacacaagcaagcctggatagcaaattatctctgaagtcctgcccaaacttgttttctgtactgccatgcactgctcacatctgctgcaaccccttctatgcccatcttctcccgtccgacaagcctagttccaaccctacctctactccagctctgcctgcctctcccagccccccagctaactcctgcacccatagtcaacactggtttatgtctttccatttatctttttatatagatacaaatagatctcttttaaagataaatgccatcatagggtacatagtgttgtattcttcatttttctcatatgtcttgtctttccacatcacttcaggttaagatcatttttttccatacatgatctgtactattctgcagtacatatttccttaattcatttatctcctttatttttctctagggtcatttgtcaacattttatcattctgaccctcctagcaacccttttgacagaggtattattattctagcatgtaaagatggagagtggaggcttagacagttaattctttggcactagctaacaactctacaataaaggcttgacagggactatccaccatccagaaacaactccaaagacttcaaaacgtgttccttactgggcactgcctttggccagagggagctgtctcactctctcccagcaacggcgagggatcaccacctggctgatgcccggatataaagaccctgccgtttctgcctcaatttggacagctctgaaggttcctctcaactgcaggggccactgtaggatgggctgagggctcagttgcaattatattgcagttcagcttctccctctgtccaatcctgctctcttcacttccttagagttaaatatcccgagagcacctcccaataaacctgcatgcaatctcaggctcagagcgtgtctccaaggtacctagtctgagatatttagttacatagctatatatctattcttttttttttttcttttttttgagccggagtctcactctgccacccaggctggagtgccgtggcgtgatctcagctcactgcaacctccgcctcccaggttcatgcaattctcctgccccagcctccagagtagctgggattacaggcatgcactctttgtatttttgtattttacaggcccggctaatctttgtatttttggtagacacagggtttcaccatgttggccaggctggtctcgaactcctgacctgatctgcctgcctcgacctcccaaaatgctgggattacaggcatgagccaccgcacccagcctgtatatctactctttaaatagtgctgtctgtcatactctctacctttgttcatagcactttccagtacctgatacatgatatatttattagtttattcgttatctgttttcctgtcttcagaatgtatgctccgtgcaaacagggactttattttattctctattgtatccccagcacctaaaatagtgcctgacactaattaacaataagaaaattgttaaattgattgaataaatgaatcctttgaaaattgtggaggcagcagagacaagtggataaaatcatgctccttgatagcagacaggtctgagatagagttctagttcagccccattcccaggggtgagcaagtttcttaatccatttgagcctcagtatcctcacctatagaataaggtaaataacaggacctacctcatgggggttttgtgataactaaaggaggtaatgcatacaaagccttcagaatacagcatacccattgtaagctctcaaaactgttagatgatgatgattataataccgaacagatcccttggaaaaggtaattataaaaactacatttcaaaattatttttctaaaccattgggttaaaatactggagaaaatgcaattagacagtgattatctcttcaacctgctgcaggaatattttctctaattgcaatgaagatttcattagctgggtctgcaacatacagtccaggacacaaaaagcctacttgacaaattacctcctgtactcactgggcatggagccttccatctgagcaactggggctttagggcatgtagctattacctgtagcagcctgcaatggcaggtgtaatttggtaaactagggaggctggagaactgattttaaagctaggtgatccagaattaagagtatggaaagaaggcttgcctttgggtccttgtcactccatctgctggccatggtatcctaaacagatcacccatcaatccatccatgtatccatccatccatatatccattcattcatgtatccatccatccatccatccatccatccatccatccatccatccatccatccaacatttactatgcatttactatatgacagatgctgtgctagaccctggagatagagatgagccatttcagccctcaaggagcacccccttttgcgaaaaagggaaaaaaaaccaatttcatatttaagaagtaagcagtggcaacaagtccaatgttgctggggcttagtcctgtgctgggaaatgggaagtcaggggaaacttgttggagaagttgatgataactgagtcagtcaggaagacagagcagggataaaatgccagacagagcaaacaacacataaatagagatgaagtcttgagtgccatgctttttgtatttttatgatttctgttgattttgctgtttaaagtgacccccaaatagaggctgaagtgctgcctagtgttcctaaatacaagaaggctgtgatgtgccttatggaaaaaatatgcatgttaaatatgtttcgtgaaagcatgagttatattgttgttgaccatgagtttaatgttaatgaattaacaatatatattaaataaggtgcctttaaacaaaaacacacataagattaggttatgtattgatagactgagaaaaattttgtgactagaggctcacaggagcctaattctgtatatcctgtaggagcaaattttcataattctgtgttcatagtgattttatagaatggaagtactgtgaataatgagaatcacctatatctgttatcttccacaagacataaaccaagtccctttcctcaatttctttccctggagagaagctctcacgtgtgaggcagtgtataagtgggtagcaatgttttcccagattccctgaaggtctaagtgaaccaaaccacacatgtatttcttgccttttaaatatgggcctcatccttatttctctaagcctccctctatgttgcccccttgtctacttcccactagacaaggtttatagtgttctgcacaagtattgagactctatgacaccagggagttttgcctcctaagactgccacctccacatccctactctccattcctgatctactttgctccatgttccaagtaagttagaatgagaggttctcactatatgtgtgggagcacgtgcctgtcctttgcttcacaaggcccatctacattagagtatgtatttgaatgtccttctatggacattagactcattttataaagcacctccattccctttgccccattccccttaggggatgcctagctggttcttcctgatgtctagctgcttctctctactggctgagtctggtgtctttacaggcacagcatgagagctgggcagcctgtaggtagttttggaaaagtcaacatttgattggtaagaggacattattcagaaagaacaaatcgggagagagtgggcacacagggatggaagttctcactttgggctgcaggtttcaggtgagacttgtcaagctgattctaaaattaacatgatttattagagggccaatattagcaaagacaagtttgaaaaaaaaaaaaaggaggagaacttgctgcatcacctatcaggacttatcataaagctctagaaactaaagtggtaaggaattgtcacagaaattgacagactaagggaacagaatagtgagccccaaacagccaggcatctattggaatttgacacttgctagaggtggcattaaaaatcagtgaaaaaaggataggctattcaacaaatgaaatgagacaattagtacacacatggggaaaaaataatacataaaaataacattatgggccttagtataggaaattagaccttcccacctaaaatcccatatgtcataatataaataataaaaatattttcagctttctcaaaatttaaaagttatatatgtaaaataaagtctgagaaaattaacagagaagctgcagacagggagataattttgtaatgcatatgaacaaccaaagatctgtaactcaaatataaaaaactgctgcaaatctatgagaaaagccaaacaacctaatataatgagcaagaaaaatgaacaattcccaggagaggaatacaccatcaccctccacaaaaatgaaaagatgcccaagctccccaatcacccaagaagttagaattaaaacaataatctaataccatttccctcccatcagactggcaagcatttaaaagtctgacgataccaagtgacattctgatgcaagggtaacaggagtgtctatgaataatacaacttcaaagagaaatttggcaatcttggtaaacttggagttgcagataccttttggcttcgcagttccatctctaggtatacatctcagagaaactcacacacatgctcatggagagatgcaaaaacgtattaacagcagcacagtttgtgacatcacaaatattggaaatgacctacattttcatcgaaagggaagaataactaaactgtagtatgtttatataatgggatgccattaagatgaatgaaacaaattgacacatatcactatggaaaaaatctataaaccatcaacagtagagtttcatagttcaggttcccagacagactctgatactctggtgagatttgcaagagttttttgggaagtactcttggcaacaacacttgtctggggtgagggaggcaggattgtttggacacaggaaaagctgaacagaggccatcgccaatcccatgagcatctctggagctggcatgtctctactgagttgtcctattgaggcaaggactccaggtatttgtactcctatagttaccagtcattggataactaatcattggataccagcttctttctgtagaggtacaagactcagctgccttggcagctggagagactggccccctgaccctgaaggacaatctggccatgcacctcagtatccaccacagagagaaaatcaggcaacgcatcaagaagatacattactaagagggttaagatattaatagagggtttccaggtaggctagagtggaaatgctcttgacagaagatagagcacgtacaacacaccagtctatggaaaagcatgtaggtgacctgctgccattgaatgtttcaatcttgttgtctttaaggggttctttatgtattatggattttaattgtttaatttttttttaccatgaagggaaaaatatttttcccttgtggcttctgatttttgtgcattgcttgaaaggcaagtattataagaatattctccagtatattcttaagtgatatatttctactcacaacataggcccaacttcacggtgaaggccaagacagctattagagccccctgtctgttgttatctgatctaagacacccttcccttccccagagaacctaaatcaggaacgattcctccttcaggtactctactgtcctctgtctatagagggtacgccttccacctagcaggaccttcgcatgcagctgcctcctttggactgtgtggatcgactctccacctgtattccaggtccttcctctagctggaatggttagaaaactaaccatttcaagtcccagaatatcagagttctgcatgctgattgggttctgccatttagatgttcaggagatgtaaaagggcagcgagggggacgctagcaagtgggactgtggagatgtgaattttctggagaactgctttgtagggccccttcattcactggtggcaagggctgcttgcttggcttcctgatccctgggtggtcagagccacagcttcccagtgttcagaggcagcagaaatagtagtggtcactgcagcagtggtaaattcttaattctagcaggccctaattgtggcctcagaggttctagttccctcagttggacagtaagaatcatctggtggtcatttctggcagccttgagtagaacccagagctgcacccctttccaacagttttataagcatccaatttcctgtgttaaatcccctcttgtataaaatatttacatggtttctatttcccacactgaaactttgctgatatgatatccaaataagaagagtggccgggcgcggtggctcacgcctgtaatcccagaactttgggaggccaaggcaggcagatcacttgaggtcaggaattcaagaccagcctggccaacatggcaaaaccctgaatctactaaaaatacaaaaattagccagggatggtggcacgggcctgtaattccagctacttgggaggctgaggcatgagaattgcttgaatccaggaggtagaggttgcagtgaaccgagatcacgccactgcactccagcctgggtgacagagtaagactctatctctgaaaaataataaataaataaataaatatataaataagaatataaacaacaccactagtaataataataataaatgcaacactaatagtagctaacatttattgagtacttgctccattccaggcactgttctatatatttccatgtatgaactcatttaatccttgcaacaaccttgcaagttaggtactattagtgaccccgtatacatatgaagaaactgagaaactgaaagatttcccaaggtcacacatctagcagtcgcagaggtggattaaacctgggcaatcctgacgtaaataccataagaataacaatggccaagaaggtgtctttcttacatgtcttctctgtttctcccactagactcaggactccctagtccctcatcactttaacattataaaagtgctttattaattattcatacagaaccaatataggtgggacacagtggctcacacctgtaatcccagcactctgaaaggccgagacaggaagatcgcttcagcccaggagttcgagaccagcctgggcaacatggcaaaaccccatctctacagaaagtgcaaaaattagtcaggcatagtggcatatgcctgtagtcccagctacttggggagctaaggcaggaggatcccttgagtccaggaggttgaggctgcagtgagccgtgattgtgccactgtactccagcctgagtgacagagggagaccctgtctcaaaaaacaaaacaaaacaaaacaaatatgattagagaaaatgcaatcttatttattatggctgatattcaatctcttctcagaatctacattgcaaaaccagctcagcaagctctagactatgccttccctaaatcagatctaaatcggtgacagaaaactatatctattgacataaggaagaaatcatcaggcttttatgtgctccagagagctccagaaagacaggtcagatctgggcttaaccttcaggttgaaattcatttaggagtaattctggagcagtcgtctccagtaagaaatgtttccttctcttacccctgagtcatccccccaggtcttccagggtgaagtgaagatgatgttggctattctaactgcctttgttgatcatgaatgtgcctggataaagcaggactttggctctggatgcgcagggctctggagaaacttgacaaggcctgttagagaggattggcaacaggtcacagggaagagcttgggttctggcttagatttcaggtcctggtgggaggccccaggggcaggaaacaacatgtggacttagagatgtgtttggtagacaggtgctagaattggggtttaggtggggccttatccaccagatggttattaggattggggtgggagttctagaacagtccccaacctttttggcactaaggactggtttcgtggaaggtaatttttccatggaccggggattaggggacggttttgggttgaaactgttctaccttagatcatcaggcattagattctcataaggagtgcacaaccttgcatgcatacttcacaatgcgctcctgagaatctgatgccaccactgatgtgataggaggtggaactcaggcagtaatgctcaccgctgctcacttcctgctgtgtagcccagctcctaacaggccacggactggtaccagtccacagcctggggtttgggagaacccctgttttagaggaatctgcggctgggatgactagatactaaagactccagagcccaagatgttctatgtctcactccttccctactaaagtcaaaatggatcccagaatatccagaagggctgagtctgagtaggagggtgaaaggtgccaagtggttccagttttcaaggccagcgggcatttggtcattgggtcaggccctcagttatactgcatgcccacttggacactctggaaagttggtctttccccacgtgccctgtgttcatggcttgaagacgaatcccttcccccaagagcagagcaacttccactctggctgatcaccccctggcctgtttctggaatctgactccacatctctgctaatggcacctcatctcccatctctctgagtcttgtcaattcctgcctggctgtcgctcctgcttgcaggcaggatccagggtctttccagtccacctccaaaatctctatctgtctccctctcattgctttttcttttctgattataaaaataatgtggccaggcacagtggctgatgcctataatctcaacactttgggatgctgaggcaagatgatcactttaggaattcaagaccagtctgggccacatagtgacatcctgtcctacaaaaaaatta

SEQ ID NO: 411 - DNA, 20001 bp, Homo sapiens
gaaaacatggctattatcattgaatgtgcctccaaaacctatcaaagttggcagatgtccatgtgtttggcttggaccaatttataaaacgttcacatgcttatgaaaattgttatctctgctattcagaatagttgagtataaaattgagcagaaaagcataataagagaagaagctctgctatgacttgcagtatttttcttttgatcactgaatactacaagaaggatcttttgtttgcgtgtttgtttcaaacttttccatgtatagaggtgtcttaggtgaagtgacaactaatgacatgtggaagtcactctctctggtgttctgtttcttctataactaccctcccttcctgtctaaagagagagggaatagctcctgaattaggtgaaacaaatagtttttaatgtatggtaaaaataagtcattcttcctctgttggcaaaattcattgtaggtgcctttcagtgtagttctgcaaatgttttttccattagttggagtagaaaagagatgaaggattatcagttgtcaggtatattttgcttctaccaaagatgatacataaatatgaaatatttgcagaacaagctgcaaaaccactaggtcctagaaataaaattctgatggttaatgcatttactttataatatgaccactttttccttttaacattttccccagtatgtccttagtgcctttcctggaaataccaaaaggcaaacatcccactttaatagaagtgataattgtagtacacattcttaagagaatgcctccttatgcctacatttttattgagggctttgtctacatacatccagagtcaacttaacttttggacccaattaactgattggcctgatgaatttaattaaaataggggaagtgcttgtacagagaggaacagcattagtataatgtggtggttaagattaacaagattgatttgacttgataattaattaatttgattaacaagataatttagtgtcaggcggagacctaggttcaaatccttactatagatgaccttggttttaaactctttaagtctcattttttccccatccattaagatgtcataaaaacactgaccccagaaggtagtgagaactggggagataagttagggaagtgctcagcacaacacttgggccagtcactgatggacggtagtaccttttgttattttctagtatttttaaagtatgtgttgtctgaaagacaccatgtctcagatcgctgtcagatttctttgagtgaacagagtcacttctttttctgaagacatcagtagtgcaagcatcatgtctttgccttgtattttgttcatctttttgcagttggaacgtttctccttcccttatttatatcaactttaggtcgtgttaactgtccctatattttaaaaaataacattttataatttccatgcaaacttaattaattttcacaaaacccctgtaaggtaggcaaggtagatattaggttatagagataaagaattgtaaaactggaaagaaatatggccttgacttcaccctatcattttgctggtaaagaagcaccatgttcaaggtcctgtatgtaggaactggcaaagataacaaagtagatctgaactcagtgcccttcccactatcccatgctgatcacttttctttttaattaaactgccctgttcctggccttccattgacaggttgcttacagctcttaatttctagggttctcaaaactgtttaatgagtgtgtctggattaaatccagatactctgactatatagagctcttttcattttcaaagatatctaagtaaacacagcatagaattcttcacaagttcctatcaatttccccttttgaaaattatggctcttttctgtagctttctgagacatcaattctgtgaacctttgcttctttctctcaccacctcttgttgtatgttattctgacttcaactgccacattttaagtcatggtaaccaggaatctatactgaaatattttcattaattcttatttattcggcagcatgaacagttgcagggattcttggtgtacatttgtaagttttcctttcctgttgtattttatggaatgttaattttgctcaattgggattcctttgtcaaaactgctgtgatgacagggtcttacggcatcatgaatgtgttcccctattaattaatattatcttagccatataagaaaatgacaggcacatgcagcttgtaagtgaaatgcaacccaaggagccggaagtctttcacctaaaccttaattttgttcaatcgtttgtatttcaaggtctagtctgtaatttattcccataaacaatgttgttctcctgacctttcttgtgtaccctcctctgtctgtatattatcattttccttatttttgtctatattgtgtcactaagagttaagacattttaaaatgtaatttggctacctcatccattttatctgcatttaaattgtgtttgaaaattttacttttgcagatttataaatttttttatccccttacagttttagcctattcaaaggggatacttattttttgtaaatgttttataataaatttaccattttgtgaaaaacagtgaaaatttacatactttttagaaccacaagaaatatctcttttaaaagctactttttaataatgtcattttggaggctagaaattcaatttcactttttattaacttagttcttgtgtgagaaagaaatgtgacgtataaagaaagcagagtaaaatactataaccgttttaaatcagtctggattttcttacagagtaactgaatttttctgtaccatagatttgatctttttagtcagactttgctttatttctctacagatgaattcagaatccactaatgttgtttgcaaagtatattttaaactctgtaattaacatgtttacaagtttttaattttacaaagaaaattaaaagtcagtttgctttgtaggtatgtttgttcttgtcttatgtgtaggtgctttatatgtgttttaaacagagtttaatggtatcttctgagaaaattatagctttagtgtgctactgaaaacctcaagtagggaatcaatacctaaaatttgatttggataagaaatttgtataaactttataaaggatttttgcagggcaaaaatttgcatcctcatgcccaatattctgccttacttagtaaattcctaggtcatggctatggagctcctaattaagttaaagaaatcttcacttgaaccagctaaaagctggtttaagataaatttggaaaatgtctagaattgataatatattttcttttagttttctctgctactcttaagggtacatgtaaatacatttcttagcgtagagcaaatgttgcatgcaatatgactggccagtggcattttatttcaaagatctcatgctaatatataggagactatatattatttttttttgtatcagcatgtttaatttttttaaggttaactgtgtgcaaatgcatatttgctgtccaaactagttaatgggcttacaactgaagggtgtaaattctagtatctgtattctccagcttgaagcagtgttgtctgaagcctgaaacggctgatgttaatcttcagcttattttgttgatatccaaaaattaacttgaagtagaataaaatgtgatgtaaatcgacttctctgcatactcataacagtgtcaatagttaaaaaataaagtctatataggtcacactgtttaaaaccttaaaggagtgtgtgtgtgtgtgtgtgtgtgtgtgtgtgtgtgtgtgtgtgcgcgcgcgcgctgtgtgtgtgtgatgcatatgtatttgtgtttaattaaacagagggaattgctggcttttaatcaagttgatgaattttgaatttccacttcagtgatggctctaccttaaattcatttggctgatgtgatagcagtattcggaatgcaacgaagagataagagtttggaccccatatttataatattccagaagaatttcattatgtaatggctagaaactcagatttcccacagagttgtagagtgtgcagtttggcatgcttatttactactctggttcttttttttttttttttttttttgagacggagtctctctgtgtcacgcaggctggtgtgcagtggcgtgatctcggctcactgcaacctttgcctcctgggttcaagcgattcttctgcctcagcctcctgagtagctgggattacaggcgcctgccaccacatccagcttatttttctatttttagtagagatgggatttcactgagttggccaggctggtttcgaactcctgaccttgcgatccacttacctctgcctcccaaagtgctgggattacaagcgtgagccaccgcacccggccactactctggttcttaatagtgaaagatttatacctcaaaaacactctgtagataaagaaggattcaaatatgattctcttaatattgcatggtttggctaagaaaccttgttattattcaagttactgtgagtcaagggcttgcttagaaacagcagacgtaggcatggcgcggtggctcatgcctgtaatcccagcactttgggaggctgaggcaggcagatcaccaggtcaggagttcaagaccagcctagccaatatagtgaaaccccatctctactaaaaatacaaaaaattagccgggcttggtggtgggtgccagtaattccagctactcgggaggctgaggcaggagaatcgcttgaacccgagaggcggaggttgcagtgagccaagatcgtgccattgcactccagcctgggtgacaagaatgaaactatgcaagaaagaaagaaagagagaaagaagaaagaaagaaagagaaagaacgaacagacatagatagtctattcccacttcaagtagagtaaacaggcaaagtggggcaaggaagagcggatgaaaaagccacaaggcaattcattaacccattttaagacattttcaggcaacttgtgaagcttcaaaggtcaaactgaccaacatttaattcatcacagaaaaaaaattctgggagaagaaaaaagaaaacttgaccttcacggtttaacaagttttcttaaaatgtctttatacaatcttgatagagttctttgctaacatgattcatcttccaatctatgcaaatcagacttttaaatcatacttggttttatataagggcttccttctgattgactttggagcaggtaacacagagctcttgatggcagtgccttgctgtgtgttctgttatggtgacagagagagcaccccctgcaagggtgatttagtgtgaaagtactagggtctttgactgagaagtcaccaaaaatcaatggctgtattgttttgaatgttatctgggcttgcaactgagaataggacctgggggttttactctttttattccttttcattcgttcttcactctctatctgaattgcagtcgtggtcctctggcaggcagcgtctgtatgcgaccggaaggcagtgctgaatagtggggtgatgttggcagagcactttccaggcatgctagcacctagcgcacaagcagagaactttgcttctgccaactgtgacttcagaacccaggtctgttcctgaacctggatgcccagctgtcagtgtgtcgccatatgtcaccagcacatggcaccctaattaaaatttcaaattgcatgcatttgtgtttgctggctggcttgcttaaaaggcagagacctcaccaccccggcttgcccccctccttcatcactctgaagtattatgtttgccatccttaggaatgagttggaaaacggcctttgcccactaaaaaatcatcactctccaattctctcacctcccattttgaaataggaatagtccttattttaagggagaaggagtggtgtgaagaaacgtggctggtacccttcagtagaattctaaagaccagaaatgtggttctcgtgtttccagtggttcatacagatcactcttcaatgctgtcctctctttgtgaatatgtttagctctttttatgtttacatttgaaattttaaaataggattagatggagcattcttggaaaacagtaacaacaaaatttaatgaagtaggtcccttcgtgcaaagcaaaaaagacatactgctggttgaggatatctgttaatagctaccatttattgatcatttacaaaatgctaaggaaaaatgcaagtcgatttacctgtgttgcctcatttgattctcacaccacttctattctgtggcaactgctaacactctcattttagagatgagcataccatggcttatgtagcatttccaatcttatgtaccgtatctcgtgagtagtagacatgaaatttgaactcagatccgtttgacttgagattgtatatactacattgcttccttcctgggaagaaaatggaagttttttctggttccttctaatcgtagcttcatagatatgtggtgtgcttccaagtgtgtatacttttccatgtatgctaagttttggtgatgtattaaaaaaaggttgaatggccaagtacagtggctcatgcctgcaatcccagcactttgggaggccgaggtaggtgggtcacttgaggtcaggagttcgagaccagcctgggcaacacggtgaaatcccatctctactaaaaatacaaaaattagccgggcgtggttgtgcgtgcctgtaatcgcagctactctggaggctgaggcaggagaatcacttgaaaccaggaggcggaggctgcagttagctgaaattgcatcactgcactccagcctgcacgacagagcgagactccaactcacaaaatatatatatgtatatatatatatatatatatatatatatatatatatatatatatatatatatatatgtatgtatgttgagctagaattatgcaattccctattgacccttagtcaccatttgcagtgatgacaaactggggtattttaaatgacagcaggaggcagtgcagtcattagcagcatggactctggagcccagttgctgctttagatctcagctcccctttgactagcgtcatgatcttgtgcaaatcacttgaccgctcagtgcctcagtttcctcatctgtatgggataataatattatgagttaatccatgtaaaacacttagaatcttcctcctggactattgaaagtacccattagaggttagctaaaattaatcaacacatttttagacttcacacagaaaaaaaaagaaattaaggaagattaattgatccattctttagaaaattctgatactaaacactggcctttatatagcatctgattaattaaaatgagtcaccctcttgatttgatctgccagtcaacaattgctgatggagcttctgctataaaatgatgtatacattctccaaaataaaaaacagtatcataaaccttaaaaaggtaccagtcatgttgggtagacaagacatatctacttaggttccacaagtgctctagagttgtttacctattcagtccagtgaattatcacaaccacataattaaatgtgtattcatccccaagtaatgacagaaaagatgaagaaaacctaaacaaaccaaaaaacctccagaaattttaacaatgtgtataatgctaataatatttctaactgtgataatagcagtaatagaaggtagtagtactcatttaagtggcttctgttatggctgtagacaagttatttacacatttagcaaagttatgaaattctgtcatctataatcttttcatgtatgaatgattcctttcttataaaactcccatttattctgtagggttgctgaaacacagcaaagtgtaaaagggaaaacaacgactccctctacgttttattttaaaatagaaaattctgatgggaatctgcaatataagccaagatatgtagtaagatctcacatactttctcagatttggcttttttgttgttgttaccttaagtatcacataccctgatagcgtaaagaatcagtatcttttatcctatctatggaaaatataatgattgttgataattttatgagccattgtactaattttaatcgacacatccgctcctctatagcacacttccttgagataaaactggctaatagtatcaactgacctgttttctgttttttcattgaactttaaaatgtaattctttttctttttctggtgctcaaagagatacatttgtttgagtccttgtgtattttatgtatcacattaagaaaattataaagaacttaaaagcttaaggcaaactttaaaaagtgtcttgtcaggttagatttctctttcctttcaactaaaaaacaaaaaaaaaaaaggaaaaaggaaataagggaaggaggaaggggtgggggccatcaggtggtaaaagcctgtttaatgtaacatcagttgtggagaaaatattaggttcaattacataaggattgtgtgagagggagcaccttgagaagcataatttaattagaatgaatttatgagcgagaggtcctgagctattagacaaagcgaaggcagtggtgtgctctcctttcacgagagcattttaatgagtttccatacaaagtatttcaggtaaaagatttgtagcaagtgtgaatagaaatgtagctccaaataaaaactgtcaaatagctctagtagcaatttctgggctaagagtatttaataaagtatgctgacattgttatttcttgatgattttattgaacaactatcgtgtaagaaaatcttaaaaaaaaaacactcagattccaatgtgttctttaatttgccattaaaaattgaactgcagggctggccttgcttgacttccaatttgggcaggtgttagattgtgacttacataacattgcaaactcatccattgccctgatattccagaaggataggtgccaatggtaacttaagattgagatttcacctttatggcttgcttcctatttctggtaagagggaattaaagcgttatctccctatagtgtaattatggtcataaacttgattagagttctttaaataaaatccaactaggaaaaaggcaggaaaacactgtggtcaattttggggaaggaggatggaatacaggcatgaccttcaccttggtcaaaatatgttccctaagactctgggaagtcttgtatatataagattcatatggcagggtttttaaaaagttgacaggagagtacatccttgtttaaggatttatttgtgtatgatcctcacaaggtacatttttgagatttattgcaaataattctgttaatcctttcctagatattctgacatgccaggtggttaaagaaggatgatacataccaggtctatagaaatatcataaattattacacagtaatataagtatttttgtcatccatgactaacttttaaaatggcaaaattataaatatctgtaaagtctatgcgcagttgttactgattattgtggcaataatacataaagaacatgttttttgttttattttccacccttatgttttatttataaaacaaaaatttatatttgcacaggaggagaattagcaggatgtaaaataaaaatgaaagaccccaatggggagaatattttaaatgtcttgcagggagtggaagaaagctttgcttaaaaatgtcaccatatgctaactatatacagcacttcaagtttatttattgttaaagcctcatgtaaatcacgtcattctgaaaatcatggaaactgcacatttgtgcattaaactatgtaaacaacaaaaactggtcatccgtccaattgttgcttcacttattttgaattatagtgcaattttgtggagggtgaaatggggattacacaatatagcgatttcctgttaacacctacatttttgctgatcaagcaaggtctgttggtgcgagagcttaacctttattttatttccaaatgtgttttttattccgagtcccgttggtgtctatggtttcacttttctccatgagccacatgttaaagcctgccctgactaaatgaaggagtgtaagcagtgggatagacattgcaggcaggcgaaactgggataagccccagaatcttttgaacctatcagtaatattactaacagggagaaagtataaaagtgagcgcttcaagtgctctagtgtacatgtcaaaattaaagcacgagttccacgggatggctcaccaccctcccttatttataaaacagaagtatcttttgagcccgctgtgccctcctcccccttttctatgcctgtttttctgcctgggttgcctggtttttgctctgcttgttgaaaccctgctcatccttcaggctgcctcaaaacttttgtggaagaaggtagggaacacatatctcttcttttgtccagccttccttgattagccttcttcctctcccttctacccattgtacatggtttctgttgccatgtagtggttaaatctggtttacgttgtagttgtttgtgtgtaaggaggtctcctacaccgggccatgttttcttaaacactgggatggtgttttcttagtgcttgtgatgttctttgtaacagtgggtgccctataacttttgtttggactgaattaaagaaaaaaaagaaatcgactttagtaggagccggcctttgagtgataaagatacattgagggaactctgtacatccccaagatcgtggccagttgccaggctccatttggattatgggagagcttaaccccatatttcagggcagatatttaggtgtgtgtatgagctgtagttggtgaatactcatttttgaccaaagaagatactggtttgttttccaggtgttgctgtgacttccgtttctgtaaattccgtgggatgtattttgccaccaactgcctagcagtttatgaaatggtgaactggacgggggcctttctgcatccacattgctctcattaaagtgacccctgctttcctctggccctcttgaagtgtatctagtttagaacttcttattagtctgtggtcttaagatctttgtcatcttaggcataggctcaaaggaattaaacttgggttttgattagtgaacttgagccagttagctggtggactggatgttattcaggcataaacttactcctatgtagtttctagaaggttggcctgggccacagaactttctatagaatatctcatccatgcatctatttggatttagagcatggatgtaaatgaccctaaaggtagtacctaatgtgagatgcagcaggagggacctttatatttttttattttttattttattttttttaagaaacagccttttctatgcaatcctggatggttacgtaagttccattttatttgtatctatattccttataaagacaaagcagcaaaaatgcactaaaattagatttaatttccagctgtgggtatttgtattatgtctgccttagtccaccttctgccccccccacccttgggttgatgtggttactgaagatagtgaggctatctggagattggacattgaccttcactatagaacaaactcaactgttcttatctaccagggatggtgagttgaagacacctgtagtctatgattagtttattgtgtgagcatttttctgacatatgctgagtgatattgaaaacatttaggtagagcttttttctctaaaaacctgctcattcattcactccatgactttttacttggcacccaccattctaggcactgggattgtattctgttggcccaaacatacttcactttgttgagaaggtttagcataggactaggaacatgctagtatacactgatggatttaaagcccattgccaattataaattcattttcactatcaattaggtacttaatggctatcctataaggtaatactattattatctatctccattttacaaatgaggaaactgaagcacaaagaagtggatcagtttatcgaaggccatactgctaggatattttatagaaatgcgttttgaaccgaggttgtcttaattcccaagtctgtactcttaatattatactaagttgcctgagaattttagcaagacttagcctaaatgatgtagagcatctcaatttctgtgcaggtccatttaacagattttcttgattcaagaggtgtttcatcataactcaattgtcttagcagttgtataaaaagctagctctcagagatggggctttctcataggcatagcagtaattatgtcaacatagagaaacttctagaatcgagcaaatctggtgctcctggctgtggcctagcactcggtccagtgtcttcatattaacccatttatgctggaggttgcaattttttgaatttttgcaatcagaccttggcgatgatcttgagcagtaggatataaataacttccacatccttagtgttccaataatggaacactaggcataaatatgttaaaaagtgaaagtaggaagtcagaaagttgtgagactgggcagagttcaaacacttggttatccaacgagacaggaccagagaggtttgttgaattgagcggacgagaacttcaacaggctcacgtttagtccagtcagtgtttcagcactgacacaggttaccatgttttaccttgattcacagtttcacagtagtcagcaaatgccctacactgaggttttactctttttattttgcagccctttttttttttttttttttttttttttttgagacagggtcttgcttgctgtgtcacccatgctggagtgcagtgatgcaatcatggctcactacaccctgacctccctggctcaactgatcctccctcctcagcctcccgagtagctgggaccacaggtgtgcatcaattaacttttttatgcccaactaatgtttttaaaattattttttgtctccctttattgctcaggcttattttgcagacatttttaagacaaaatttttgttatgtaagactttttgttataaaaattgttatataagactttataagacataaaattttgtaatatgaggcttttcctggttgaaaagtgtttcatttttcaatgttttgtatttgtatgaaatcagtctttttgccagcacactgaatcttgtcagattggatgcagagtttctttctgcaacacttttactgtttggtaacaaccttttcttaggaggagaagctacagatactaccttggctgctaacaagttttcagattagaccaatttcacagtgttgactagggaagaaaactgattgaacttccatgggctttagactgaaaccaatgactagcattttatctcttttggatgtgagcatgattagaagtcagtctgaagattttctttcaccagcattgataattcttgtcagtgcgacctcagacacatattgccttcttttctgtgcatcctctgaccagatagaatttcttctattttggatgacatgctgcattttaaagatgcaaggtgtaatctagataaatataaattcattggatgctacctttggaaaagagctgaggattatcttagagctgttcttttcctctttttctttcagaattgttattttctgctcaagattgccctcccaagcctacctcatggcagcacacacacacatacagtcacattcaaacacaccattgtactgttacttgcaaaattttgcatatttgggaccaacatacctgttattctgaagtgctgtcgtatgaaagaataagtaaaggtactgtttatatctttcgatgtatgtctagcactaatgggagttaggggacagatagatgtcaactccatgcaaagaaagtcattatgacaatgaagaaggccaacagtggacttgtggaggagctggggaccctacatctgggagggaatggttctgctgaggtggttcagagattttgtagctgtgatgggttagaaaattagatgagaagattgtcaaaattttgtacaatgtacagaattttgaaacaaaaatttaatgaatggtttggggaataaatggcattttacgttgactgttttatttctctcaaatttagaccctcactgggaaattatttttgagtcataaacaatagacccatttcacatctattcatattttctctctctccatgatttttagatttaaaacaagaccacaagccaactttaaacagttcatctttcttcctttttttattgttttttaacttcatggttttatctcagataatttgctaattctagctacgggtgccttcctcccagctcccccagtgtggtagctgtcattcttaacaaactgggatactcacgagacatctagagttcagttgatgatagtccagagtgtgtgagcagtgcagggaaatctgtagctgtgagcactcatctttgaccacagaagcgctgttcagatgtggccagatggaattcctatgaatctctcttctgtgaagtgggatttttgtggcaccaacagcaaagcgattcatgagtgaaaagccttctctggtgctgccatttccatcactgtttctgcctccttttgcttttgttaggcgtaggccctttatttattcagacaaaagtttttaaaagattagagcatacttccatattaataacatcccatgagttaccattttgagggaaatgtgcacatttgtgtaggggttttgctgaggaaaaggaatgaggagtgaaaggagtctcacccagttggatagtggtatgccttggaaatgcactgaacctttttttttttttttttttttttgatgcagctcttcacagatggataaggtaaggcactgtctgcaatgcgtgaagcactttttaaaaagtgagaactcccagtagacctgtggtgttgcaggagcaggtcaagtgctttctttctttaatatttagctaagagagatcacttaggtgaaccgttccctataactagatcatcctttgctttttcctgttcacattatgattgaactcttgtttttgtacaccagtaaaatcttgcatctgaaaatcttattgcaagcaagtctgcccagttttatcattttttctgccatattccttctgagagcagctagtttggaaaagtatggtccatgccaggcagagtgagctcagaagaggaagggaaatatgtagtgttttaagagcatgaagaggaaaagactactctggtagcttttctatctgtatgtttgttttggcttttagtcttgaaaagactcaaattctctttcccatcctttatttctaaattcaaagggaagcagtttgacatattagaagccctgtctttggagtcaggaagacctgagtttgaaactgtgtgttgtgaccttagacaaactacttaatctttctgagatccagtttgctgtctgtacaataggaataatagaagtctatcataggattgttataagggttaaataagacattgcttatgaaccttatacgtagtggcttgctattattcttgtattaacaaggttgtcctggcatttcttcctactgttaattttcacaaaatatgatatgtcttaagctttattattgaaaataataaagctttaaacttttaataaacatgtctggagtctaagatggaagatgttaaaaagggctcagacgtgattggtttcttgatgattaagtagtgggcagtcaaagatacttgttttatgacacatttaggagaaagtactgaatgaagctcttaacagtaacagcccctttaattaggggaccagagtagaggagtcattcccagcgctgcctgggaggaggatgaatttcctgctgtactggagtagccctgggcaaaggacccaaaagaactgctgtattaaggaaacctggaaactaaaaaacacaagagttttgttttttttttcccctgtcagatattggtcttttgtattccagtggtattaaatggaaatgggttttttcagaggaaaagtaatacttgagagaactccattatctatcagatttatatattttgccttagagaaatgcaacctgttcattgtgtaaaaagccgtcgtgtgtatacagatttgctcttctggaagccatcaatagccagctagggttaaacaggtttcccttcccctaaatggttttgttattatttatttattttgtgttcttttaaaatttatttttccatataatctctgtgagggcagggatcatacagctctcaaggtacacatcacagtatgcagataggcccaaaataaacaaacatctttatttttaaagttttttaattataaaaagtaatacgaggccaggcacagtggctcatacctgatacctgtaatcccagcactttgggaggctgaggcgggtggatcacctgaggtcaggagtttgagaccaatctggccaacatggtgataccccatctctatgaaaaatacaacaacaacaacaacaacaacaacaacaacaaattagccaggaatggtggtgtgtgcctgtagttccagctactcggaagggtgaggcaggagaatcacttgaacccaggagatggaagttacagtaagcagagattgcggccactgcactccagcctgggcaacagagcaagactctgtctcaaaaaaaaaattaaaaagtaatatgggattattatagtttggaaaatacagaaaaatggaagagaagtcaggtacagtttcactgtccaaaaataattaacattaacatcttggtatacttccttccagcctttttctgttagtacagagctttatgctagctatttatgattatgaatacagatatatcctaaaagatcttctcatgctgagcccaggtgttgtaggatagaaactgatggtagccaggcaaagtgtatagacataaaaactgggatgacagaatcacggggaagggtataatacctttgggttccttagctcagggctgtctcatttctgcagcaggcaatgtggttttcctcaagtggaataagattgcaaaaggaaggttggtaagctcaaaagaaatcttcacattgcccctgtgataggtagcaaaggtgatgaaacaacccaattttgctgtgttatggtattcctgttttcagaaaaattaaaaaaacacaaaaaccatttctttgaataaattcaggctttaatgtacttttttcccccagaacatttctcctaagggcttaaattattatcacatatggagaaggagacttaaatatgagaggatgtaagatccttaagcatgtacaaattttcgtggcatctatcacagtcctgaatcctgaaagactattttctgttgagttagatctttccttataaatgctttctgggatggcccatgcatctctgacagttctcatgctgagtcataccttgttctgttaaatttatccattattggacaaagactggaagaatggatatgacattgggaagtgtgcaagacttccacagatcacttgtagagagggatgatttcattgtaatcctacctcactggacacctcaaacctgccagtctcatctgtaaagtgagcatttttatcccctttccttggctctcttggctccatctacaggcaacactcaggtggacttctttactgaagagaagagcgtaatattcttctagtttgcctagctctttggcatttagaaaactagagaaatgcataaatttagcaaaggatcagggccaatgtgatggctgaactggcatcatttcacatttttcatgctctgtatttatagcaataaatttcaagtaagaaaatagattgcaaggagtatgctgtattaggaaggaagtttgtacactttcgtggcttatgggtatcttagtataaccttttctggttgagtgaactgtgtcatttcaaaagcctgaagacattgtgatgactgctgcctccataatggctacattctaggggctttgccctgaatcgcatatattaactcaaaaaacaaacagtacccagtttttattgggaaaattacagtaccagaagttatgtttctcagtcattgagaccttatgaagccttaataatatttagaagattctggttccttgtcttccttttttgagtcagcagttggtcacagttcagaaatgaattacaaattacaatttattagtaatgataatatttaagtagtaatgatgatgataaatagtaacagcttattttttaaaaagataccaagctaaatgctttcatggattatctcatttaattgtctcaacaaccttttaagtcttatatttttatcattgccgttttatagatgaagaaagtcaattttcagagaacttaaataacttctcatagatgtctagagcaaataagagacaccaggaaatattacacccaattaaacatgttttctcccacatattccgtcaattagagacttgtagagaagggtgctatttttcttttcatttttatttttttcgagacaaagtctggctctgtcacccaggctggagttcagtggtgcagtcttggctcactgcaacctctgcctcatgggctcgagccatccttgcacctcagcccccaagtagctgggactacaggcatgcaccaccacacctggataatttttgtattttttgtagacactgggttttgccatgttgcccaggctggtctcgaacttgtgaactcaaaccatctgcccgcctggcctcccaaagtgctgggattggttgctatttttcaaatgtgagaaaactcctttagaagttttagtcttcatgagtcttatgcgcttagggtgtggatttaaattagcaaattgggttgttggatttgtagttgcagcagaaaggggttgtttgtggatttttaagtaggggtgatagcataggggcctgcttttaaaagagggataagcaagcaaggaactttcagtgcttaagggcacaggtggggcagaacatcaaagacagattccatctgtgctaacatttcacctttactccactgaaaattttctaagatgtcacctttgagacacactaaagcttatttttctagacaattaacaaataaattacatttactccaaggacagtgtaatattaatctataaggatattttagattttagaaagcatgagttttgaattctagtttattatgcagtatggtctgtgagccatgaattgtcttcatctttatgtccagcagataatgtggtaaggacttcttaaagctttttgaataattgaattaatgaataaaatttataaagttttctatcatctactaaacatctgcttgtgaattttaaagaagctcattttctataacattaaaaagaggctgtaaaacatcgtttttactaacaatttcattttatacattgcagttgtccttattgataaaagagaactttgtggtttgatgcataaaagaaaatttactattcagtatagttgggactgtatcttcaggcacagacactgcattcagacctgcagacccccaccctgctcagtgtctgggttgcagcccagactgaggttgagccagaggaagaaggaggccgtgtggttaaaccacttgtggataatcgaaagtagaccatacttattttcaatttggcagctgcattagttttttactaaagtgtgcagctttgcctggttctgctaatgttgccttcacactgtggcctggtcaccattagtggtctggcagagatatctgaggaggctcaccattgctcctcttgactgttccactgcccatcccagtattttccctgacttttcctatgttctgtggtatcaggcagttggatcaattgcagtgactgcatcgaaagaaaaagacaaaaatcgg

SEQ ID NO: 412 - DNA, 150124 bp, Homo sapiens
gaagacaagctttgcatatggaagtgaactattttatttcgaagatatgaatcataagctacttagtatttaaatatagttatcctgttgtgaagatctaataataatgctgtttaaaaagaggaactggaactcctttacaagtattaccatttccaggatctctcggaaagttgccaagacataaatatagttgtagtaatgattgttgttttaggagtggaattaacagtagatatgttcatcaacgttattttgaaaaagtaacgttatcttggatttgtactaacctttatgccgtatacttaaaatgcaactcttgataatcatttactatgacagtgtgggttgatagaagctaggtattatggttctctttaggcagaaagagaaacagaacccctgcatgacttcagatgcagtatattaatcttttgggggcatcagtttcctcttctgaaaaatgaagggattagactaaaacaatgtctcagattccttccaactcttaaaaaaaaaatctggaagcaactatctttgcgttattgtccataatatccccttcaaaggtgggatgactgatttatggaggacacattgtaaatcactaggctaatatctcttattaattattgcaatcagaagtataatcattgttaacgtgtaccgagtacttactcctagacatcacctgctgggctcctgatgtgaaattggctcactggttcgtctgtagttctttattagtagccttagtatcttagcatattagtgattttattaagttgactaagcattgtatgactttttacaggccagtgtcttggatgctcaagaatcctgaactcattccctttacctgtaaatgttgaccgtgaaccaaaatgagctctgtcagtctcttaaccattttacttttttgaccgtttgtctcatgataagttttgtaagcattaagtaattttcatacatcatctgtttttgcattcattcttccagccatctgccatgtacttggcttttgggcactgggaagagctagatggggtagaaatgcatcttctcttaaaaggagcttacaactcccaaagttacaactctatcacaaaaagagtgtcaagacacaacccaagttcatcacctgaatgccattgataaggatttccagatggacaaaacattaagctgacaccaagtgaaacgtgtacttcacagactttcatgtttcatttcgtgatatgcagtggcactctgaagaactgggctttcagaatgtatgtgtttggtccggttcttcgtatagggagcagtatctttggaacagtcacagcatacaccacaccacactaggttctatctgtggcagggtcagctcattaaagctactttctgggtcctcgttaatgtcatgcaggccttgtgacaggtgttacagctccccacctggcacggtccattgggggtgtgctgtaattgctcttgatgccacacttaatgggtgggggaagaaagtagcattatgtgtgaggggaggtgagagggatgccctcgggccgttgctgacatctggtcaccactcctgttttgctggcttgtctgtttggtgcctacaaatattgggcctttgagttgagtttgctgccaccattgggttccttgcagccatcattatttcacagctgggccatggttttaacttggaaaaagggcattcatctcagggccagaaatggtctactgccaacatgatcctgagaactttcttagtttaataaatgagagaataagtattctcatgagctcctgtatcaagtgtttcctggttttgagcttttttgttttttggtgagaatgttatctttcattgttatttctgaacccttaaaggactaaatttccttttcaagagtttcaagtagttcttgtacatgtgtgcggtgataagcaaacattagtctgagaaagttctgaaaaatctaattgagccagcatttaccaagcccttctatgtcagctactgaactaggtgcagggaaaaaaataaaggtcctcaactagctcaccctcaactagctgtccctccagctagagaaccaaacctctgcataattaaccataataatgggcagatagattcaagggagaatgcagtaaaatatgtaatatcatgagtgcagtttttatctgtgtgcacaattacgcaagccttttaactaaaaggcttcggtgagatggatttcgtaaaaatgcacagaacttcctgaagcacaaattagacagttccctaatattaaaacacagccctgagaggtagggtttcaggctttctggaacccccaaacttgaattggtccacagaactaaattagaagtaacaacctttccttatgatgtgtgatttctcaaatggtggcatcttcccagagctgtgtgttcttttgtttggagcacagctgcttcctattgttaagttgcaccggagagctctgagacaattaatgaaggggatttaaatgttatttaaaggtaatcccaaaacgtttctttgtgaaagatgccccttactgcagtcccaacttaaataccaacttaaataagaaacttccactctaggcatgctcaataaatattcagtgaccatttctggtttctggggcataactaaaactaaataactaaaaaattgccaattaaatcttccccagccccaattccacataacgcctatgcacaaccacttctgaatgctcatggagaaatagcattaaggctctgatctgacctcagtaattttacaaatgtaaaggtagcatctcatggtccctgtagggatatattattagaagaacatgcatacaattttgttttaattgattctcactcttaagtatgcaaccaatctgtgtatatctccttttaattatttatctgagttgtgagagaaaagtaggtaattatttggtgatccattcaaatgtcttgaaaggaaggcatccaacttttatgacatacatcctgaaagacataaaacaatacatttttattttataatttcatcagtatcaagtgtagtgtaaactattttaaaacaatttataaaaggtgcttacatacttactgattgaaaaaatggccacaagaattaagtttatggaattgaaaaaatttagaccacaacaacatggtaaacattgatttttttcagaaggaaataatttctacaaatcaaaaactttactaaccagatgttatagttaggacaaacaatgaaataatcttactgtaagaaaaataattcagccaacacgttttttaagtgtcttctttacgcttaacatgggtatttgctattagatgggggaggtggaaggaatgtatcaaaaatgaataatggccagatgcggtggctcacgcctataatccaagcactttcagaggccaaggcaggtggatcccagcactttcggaggccgaggcgggtagatcacttgaggtcaggagtttgacactagcctggcctcaaactctggtgaaaccccatctctactaaaaatacaaaaattagctgggcgcggtggcagtcgccggtagtcccagttgctcaggaggctgaggcacaagaattgcttgaacccgggaggcggaggttgcagtgagccagtgagccaagatcatgccacagcattccagcctaggcaacagagtgagacttgatctcaaaaaaaagaaaaaaagaataatattcgttaccatgttcctgctgacagtttgagtacacaagatacactgtgacatagtgaattcaaggaagcaaacatggtatgggttggaataatcatggatggatacttactgcaagaggcagaaaaacacatgcagttccttttctaggaaaatattggtaaattatgcttggttagtaaaagtgcacagaaagcatatggaagtttcaaatctattttccataaatttttccccaaagtatttctgagatgctgggtgcaaggtacggttcattgtcctagtcctctatgctgaaaatgatcattttaattggattgcttctttggaaacaagacaaagcgtacattgctaaaagcttctggaggccattttcaatatttgtaataatataagtgctagaaatgtgctttcatttatattcaaaggcaataatgccttctgtaagcatggcgtctctgtaagacttttataatgtctacttaaatgcaagcagacaaaattagttttcactttagattggaagacctttctccattgcaactttttggcctctctttttgttctgctccccaagagcaatgtaaatgttgctctttgttttgctaaaagaggaatgtttatttttacaagtaccatgccacttccatatgatctacatggtatgtgtcatgaatataatttctgtatgattggccaaatttttcacttttaattaagatgaccagacaaaaatttgaattgtaagaaaattatgggccaatttagtgcctgttgaaatgtacactggatattgaaatgttctacagagcataatgaatgaaagtaaaaaggctctatctcttttctgaagcctacttgaaaattttgctttcataacatgacattgaaaaagatactataaaaatatttattaaaatcatagctcgagttttttcttagaagtaagaaattatgtttaatatcaaggactttactacaggataacatgattgtgtttcacatagaaaaactttgttgaaaaatcagtgtggagttgagttcatctgggccctagctgaaactaattttacttttggatattccataaactgcatacatctctttcttactgttttgtttttctatgtatgagaaatccatagacacagaaaaaagatggagagccttcatttctcttattttcacttttgtcccatccctctgtgcttgttctttgtttaaataaacttttgttgtatgtctttcacacatcatcactctctgcttcaaaggcttcttttaataacttagccctggctcacttttcttttgcatatgaaattgatttaactaaagtgtatgtgtgtgtttgtgtgcgcatatgcctacatacacatgcatccgtacaaataaaaatttcactggaaagggaactccgtgatctctttactacgtacatacacacaccttgtcgaagtgggaaaacttaagtttggagttaatttggttttgagttccagctttttctcttagtgctgtctgtttcctcaccctgaaatgaagatggtaatgtttactttgcaaaagttgctgggaaagttatgtatatataaatcactttatttttattgctagacattcaataaatgctagctgttactgtgaccatcattattgtcatatatgtaacacaattatgtcatacatttattttgaagctgataataagtaaactgataaaaagcagaaggttgagattaaggcttcttattgctaaaagattgatcttaagtacaatcacgtgaaaactgatagttacataacctgaaaaatcataaaatactgaaaaattatgactgttatgtgattgttttcagttgtcagactacgtgatgttaaaatggcagttgattttttgtattaacacagtgcctctaattttaaaaactgcttcagcaatcatgtatttaatgaaaacagaagtaacgatacaaaataacaaaaatataaatagagttcagaatttgaaaatactgtattaggaggtaagctgactatttttcgtgttctttaaatatatttagatcaacttgaatattaagcctcctacagcaggtagatagaggtatcaattcagttaccatttaaaatacagtaactccaatgaggagtttcttataattatttctaattactttttgatattagaaattagagctataccagaatgctgggaaagatgtctttttcaacattgtatcacagcatcaagcattatgcatcaaacatcaattcctactcacaatatccattcaatgtatatttggattatattttctttggatagaccctcatagtagaaactctgtattaaccagcttgcaagatgaaccaagactttttgttttctttgtaatatactgattcctttggcatgttgaattttcatggccaacagttacctactaccacatcctagcactattgtttttaccagttgtgtgcttaccacgtcagttgtgttattccggacctgtttatactagtcttatttgtatcaccattgtgtaatttaattaaatttatgtgaaccaatggcatgcaagttcaaaatggaaaagttttatttctatgaaactaacccagtgccttggaaagaatcagtaaaggcaagctacaaaaatttctgtcagattacatgtcagtgagataactacagaagatgagagaaggttgtaaaaataagagttttgttagattattttagaaatatctttaaattctcccactacttaaagtaaatggaactggaaatcttttatgatgcattatagatacgcattatataagaaagatgctgtggagctccaattattaacagacattattaaatttaaatttttgcctctgcataaaaagattggccaaagaatgtacatacacatgctcaaagttaaaatgtttaaggtgcatatgtctcattaatgagtatcttcttcatccattttttcaaattaaccaatcaacaactggccctaacagtactggataaggtaacttctattctattttgtattcctactctttacagagttttagagatgttttgtttcctacctaccaagggaaaaaaagggaattggcagatagagtttatatcttgggatgagatgtgtaaagggccaggacctgaaattacgtgaaggttgatattctgggattggtagttttgaagttccataaagaagttcagtccagccatgttccaaatgctctgagtataggcactggctggtaagcttagtggagtgttatacaacatggaagtctaactggcagttcaatgtcccaaaagttggacagaaccaagaaatagagaacataagcagatgacagtaatccaggcagaaggttagtgtcagagaagtctgtcagtgggtcatagggctccacgtgctagcctgggtttccgtgccagaattttgttcttgggaggcaggtagggaaaagcaagtcaacatctccagttccagatgagctagggcacttgaccaaatacaggtacagaagttagtccttgaggtagagcttacctgttggagaacatggcagaaatcattgtaccaaaattggagcacaggtcagaggctaaagcatggcttactgctgtggctcatggtgaacttgagcttctcatggcccctcctatctcctgaggatggctgagctcacagatggggactgttatgtaatcagaggtcaagtggtttagctggggtggcagagagccaggtgaagactgaaagtgttcaaataaggaagagaacagaattgctttatgtctgccttcatgaagacaaaccctaatagccaaaggactgaaagtttgcccaaagagacctcaatttttgaaaggaaaatgcatcttctccttatgttagaatgaccacgtctaaataaaataaactcttttgccttttgttgttacttgtcttggtatctaccattgtttgacactaaaaaaaaataaagcagtgactaattattggctaatttaatctgtcatgatggcatttgtaattcaggtacatccttcattaaagcaagtataggcattattatttttaaaactttttttttctatttggatttcttctattttgtttgattatttattttgttgttactggtggtggtggtgttttacagtgagacatactggttagctcagctaaggtgtttgagtaagacttcataaacataaagtactttgtgtgggtttgttttgtgtgttccatcttacgtcatttgtggcactgaaaatgagattgcaattcccagagtactgggatagttcattcagaggttagcccacctaagtttatagcagttgtctgtaatagaattgtaactaatttccactgttgtttttggagaaaactgtagactataattatgtgttagcactttttaaacagctccctgcattgtcatatcattttaaatgggctctgttttaaaatgacctttcatgttttgattgcaaaaatatagcttacacaggtctgtagttagcaaaatacaaggatccagtaaatgatagagcattgacacaactctagaagcatgtgttaaacatcactggcactgccctaggtttaaaggggaagaaatagggaagtagaaattcactgttcttcaacactccttctgttggataggcaagattagtacatagaacagttatggagccatgtgaaaaaaaatagtagttatacaaatgtaaaatgctacacatgaagtatattgcattacctttttgtggcctatggaaagaagtctcagagcacagtaagattcaagtaccatctcccagaattggggtcagcaacaccattttatattttggcaaatgctacccactgtctcccaaacggcagatatctgcatatagttagtcatgtggacacacccttcctctgctacattgcattgccatattagtagtagaattttagtgttgatttaaaagacagtctgccttaaagcagattgcatagtttgcacactgtgaattgtaattaaagtgtaaggggggcttattatgtcaacaactggcatgagaacccccgagcagcaggtgaccctgaccatgtgacgtttgtgacagctaggatccccttttcactggcttagcgatctgaaagtccaaattgaaagaagcccagaggctgtatatttcattagatcccaggggaagtacaggatacagcttccttctgttttcctgggaggtcgccagaaagtttgtagagctctgtttctgtcagagactcaaaagagaaaagaaaaagcacacacaaaacaaaacaaaacaccatacacaccacaaaaccatccaccaatcacccccaggaccataaatttgacatttcccacagtctgagaccacagtgttgctgtgtcagcaatacgctccttgtttgaattgtctgaaaggaaggctcagtgttctagcttttaaaaaatgtgtaatcttcaatatgcagtgattctcttggtgtaaaaccatgagaaattatcaagtacagatatcatatgatttgcttgaaatacttttgcattatgcgttactttctcctgaccttctaaaatggggcataagtccgaatttagaaagaggaaaccacatgtgtaataagggaaacagactaaggagacatgccatgtgtatttcagatcttattgtgatgggtaaactgtttgaaatgtggtcacattaaaagtatgttactttgtgggagactcaaaatcttttacgagtagatttttattgtgttccatagtggaaatagaactagggtttggttttggtgggaagttttggtcttcaagtcaccttggcacctgactggcagttgtgaaactaagtagaaaagatacctcttttttcttggcacctcacacgggatcataggattcttactatcatacaatttatatatcacagaaatgaaaacttcggtactttgttgtataatacagatcttgtgcttgttgatttttaatttggggctcaagcttcccatgtcaactaatgtggccgctgctaggctgccctcgggtagaccaaatgtaagctcactaggaagtatttctagctctgtaaatacctagcatatcgtttagtccaggcatgtccaatcttttggcttccctcgaccacattggaagaagaagaattgccttgggtcacacataaagtacactaacattaacgatagctgatgagcttaaaacaaaaatcgcaaaaaaatcttagcatgttggccaggcatggtggctcacgcctgtaatcccagcacttggggaggccaaggcgggtggatcatttgaggtgaggtcaggagttcaagaccagcctggccaacatggtgaaaccccatctctactaaaaatacaaaaaaaattatctgggtgtggtggtgcgtgcctgtaatcccagctactcaggaggctgaggcaggagaatcgcttgaaccgaggagacagaggttgcagtgagccaagatcgcacctctgcactccagcctgggtgagaaagtgagactccatctaaaaaaaaaaaaaaaaaaaaaaaatctcataatgttgtaagaaagtttacgaatttgtgttgggccgtgttcaaagctgtcctgggctgcatgtggcccctgggccgtgggttggacgagcttggtttagtccctaagtgttgttcattttaaaccagaaagtgagaattttctgagcccagattctacctttatactgctatttgttatgttttggtcaaaagggaaatacagaaagaggaaagttaacagtcatggtttgtgtgcttgtatgttgtatactttcatgttttgattgcaagaatatggtttacacaggtctgtagttagcaaaatacaaggatccagtaaatgatccttgtatcatttatttaggaccctctgttgtaagggcccaaaaagactcactcacagtgccatacacatggcactgcatgtgtgtgtgcttgtgccagcctgggacgagaacttcaaggcttgagagaaagatgtaccattttcataaatttggtaaataaattaaaacctttcaacttagagctgcatttaagtgttataattaaaggactaccagttgggttttttgttttgttttgttttgttgttttacagtccatctattttagcaaattcgcaaataattagtttcttttatttatgtttttcaagatcggttcctctattcagccagaggaaaacccaatatccttagctgcgttttacctcaggtacccagagaattgaggcaagaataggttgtgggaatgtgagagaagtgtgtctgtgctgtctcagctcagttaactagtcctctgtagcaggataagcatgtttgtgcagaggtagagaattgtctccagtcatgattttgttttttatattttttactgcgttgttttttttttttttttttttttttttgagacagagtctccctctgtcacccaggctggagtgcagtggcatgatcttggctcattgcaacctctgcctcccggattcaagcaattctcctgactcaggctcccgagtagctgggattacaggcacacatcaccatgtccagctaatttttgtatttttttagtagagacggggtttcaccatgttagccaggatggtctcgaactcctgacctcatgatctgcctactttggcctcccaaagtgctgggattataggcgtgagccaccacacccagctctactgagttcgtaagtgaagctttttcccctctcatgttatttgaatattgtttccttcatctttgtttatttattatttatttttcaaaccagggtctcactctgttgccagaactggagtgcagtggcacacaatcatagctcagcatagcctcaaactcctggacttaggtgatcctctcatctcagcctcctgagtaactaggactacatgcttagctgtttttttttttttttctttttttcttttttttttttcctgagacagggttttgctaagtttcccaggctggtcttaaatgatgctctcatcttggcctcctaaagtgctgggattacagggatgtaatcctggacccttaatctttattattagttcatcatcttttatcatgtatactatgtgccttgaaagtgtgtattattttattatctgcacaattccacatcactttattgatattctgaatatacctgtagtatgttaataaatagcatctaataaaatgtagatacataaaaataagccattttcataacttttggctaattttggaaacagcattctcaactgcaggtcagatttttaaaagaatttaattttatctgtgattgtgtatacatcatgccaaagataaaagcaattcagttgagtgagatagggtgtggaaacaggctacatgttggagtttgttgccagcctgacattttcaacacagtttctagacccatctttttaaatgcgtgctacaatgaaaaccaaaaggactttttcatattgtatttgcagtcatctatagatgtaacttctgatgtctttatttttgttgctcttctcttctcattaacagcagacctgtagacacactagtcccaacatggttgttttacttcctcatatgtgtactgaagtgttctttgctgtctgatgtatattaaggggtcttcagcaattatgaaaccattgctgcagaagcccagagtcacatactatagaaatattctatagtaaggacctaacaggattcacattaaacagaacttgactataaactaatggattcctactacagataataggaaatgtggttttttttttatttttttgaaacagggtctcactttgccacccaggctggagtggggtgacatgatcatggctcactgcagtctcgactcctgggctgaagtgatcttcccacctcagccttctaagtagctgggattacaggcacacatcaccacacccagctaatttttttgtagagacggggttttgccacattgcccaggctggtctcgaactcctgagctcaagcgatccacctgccttggcctcccaaagtgctgggattacaggcataagccaccatgcctggccaggaaatgtttttaaagactctggttcctacaaaatttgcaaagaattgtgaaaactgtctatccacttctttaaattttaatttttgttggtttatatttcaaatattacattgtcaattaggattattatgaccatagatgacacattttgcccatccctgataaagagaagaaatttgctccctaatgtgtagccagtttaggaattttagccttaattgaaaaatgtatacttttttgtaactggactttgtttctgctaggagatagaaaagtctataagccatctctgagatagatttctactcttcctttaaaatcttgcccggactggcccttcccctctctgttcttccattcaaggctcacttattgaacatatattatgtgcaagcacttcatttaggcaagtacgagctgtgtgccctcaagggcttataacttgttgggaaggcacgtgggagttatatacacagagaaatgaattaggatctgagtcccattctcagtaaccagggtgtagggagccagaggaaggaatgatgagttctgccaagaggaagggaaaggattctgacgttatcttctacactggttagaatagaaggatggaatcctaaatttaagacggagatctgtgctgtatacatgtgactaacagagattgggaaagagtgtaattacctcctgtgcctaagaaggttgttggcgtaaacaaggtagaagcaaagccaatttttgggacagtttaaccgaaatcttttcaaatatttggtagaaagcattggatgaagtgttacaattttaattaatgtttttaaatgacaattgagggttaataaagccattgttgccgtgcagttgagaagagtagaatgggtttgtttttgcaatcccagtggggtaattaaacttgcagtgcctgtcactcattccttaggctgagggacttttgagattgcaatagctcatcttgtgttgcagctttgtttttaaatttagctaagttaaagcctatggaaaaaaaatcaagggaatggaagagatgagttttgaactagtgaatgtgttcactcaaggcacagggcctctttgaggaatttaggtcgcagacgtctttcacagaaaagctgtgtccaaactgtcacagttactgcctcagtgtcctgttttgttctgaaggacatgacacctattttccatgcactttttcagaaaatagtatttgtacccatttgttttgtcttcttaaggaacgttcatgcagacttttcgagcagtgagcaggcgccagagactatgtcactgttctgttctgcacagtgtagcgatttgcagttggcgaatgaattcatcagcggatgaatgtcagctcactaggtgacaagcttcctgtgatatagactgggtgaggacagagcttggtgagccttttttgttcacgacttcatctctagcactcacagtagtgcttggcacatagtacatgctcaataaatatttgtagttttatttgtggaatgatatgctgagtaaatgattagagtatattatcaagaaattactatttttttttgagacggagtctcgctctgtcgcccaggctggagtgcagtggcctgatctcggctcactgcaagctccgcctcccgggttcatgccattctcctgcctcaacctctggagtaactgggactacaggcgcccaccaccaggcccggctaattttttgtatttttagtagagacggggtttcaccgtgttagccaggatggtctcgatctcctgacctcatgatctgcccacctcggcctcccgaggtgctgggattacaggcgtgagcccctgcgcccggccaagaaattttcatagagtttccacttccttggttgctgaatgatttgtaatattgtaatcagtatatctatgacacaatttctaaagttatttagtgtttgtcagtgatgtctgaagctccatttgctcttttgaagtcatttgtttcttaggacctacaattcttaggaaaaaatgacttacagtcaaataatttaggaattttaggggaaatctggagcccattttatttagtggccttaaagatgaggtacataagacccaggctaacccagcttctaacagttgattctgaatcccaggtttcctgattctgaacttgatgtccattttgaggggttgttaagccaaataccttcaagcttttcccctctgttgcactcacatttatgaatacagatggtctctaacttaggatggttcaacttaagaatccacattccataaaaatgggactttgattacccatacaatactggttttcactttcagtacagtattcaataaattacatgagatatttaacactttaatataaaagaggctgtgtgttagatgattttgcccaactgcaggataacgttaagtgttctgagcacatttaaggtagactagcctaagctgtaatgtttggtagtttaggtgtatcaaatgcattttcaactgatgatactttcaacttccaatggatttatcaggatgcaacccccatcataagtcgaagtgcatctgtacttactttagactaaacaggaataataaagtactctaggagaagagaactcagtaagaggttaactttacgtggaaatgttacaggcctaatgtaaggtacagccaacaacaacaaaaaaagcaagctggcgatctgccttccatgcaaaggttatttttcttattacaacaaaactaattagtggattttctaatgtaagaaaatgttgctgttagtaaaagtttcctcagtgtgccagaaagcagatggtggcagtgaatagtgttttcttttgccaggttttgtatatgctttctaaacctgcaagagattttgcttttccagattcagatttctgatcttttttattttaaaacagaaatagaaacttatatttaaatgtacttgcatcatgtggtctgtttgacatattatggttacttgaaaatgttgagtaacatttgatgttctgcatgaatttcttctctaagagtcttgggacttttaatgttgttctatactctctctctttatggaaataaagagtttctgccttgagagtgctacaatggggagttttgagtgatttatgaaaagcaatgggtaagatttttttatgtgaaaatttgtattttgtttcactcccaattactgtgcaagtaccagcttttcacagtgaggtttcttacagcatgactttgttcattatgacttcagtgtttgtatacagttttgaataatttatttctgtctactactggtgagatgttactttctgctaatttaaaatgttttgcctaacgtttttaatgaaagtccttataaatatgtttgtttaaagtctgaaatctaaacatgtccttaacagtaccaacgaggcagcattaaaacaaaaggcatgttgattttaaggccaactggaagaatgtatatctacaatggtgtagacgtgaggctgtaatgagcatgagtgtagtcaagacttatggctttgttgactaaaacttaagagatgctttcctttctataggacctccatttagaggagaaaaggaaatcattaagtcaatagatgagttattaaagtataaagtaaaaatggaaaatgaaaacacactcagtgatttttttggaaatcatttgggcaaaagtatcaagaaagaattgtctcaaagttactaaatggaatagtctccttatggaattatgtgctattttgggaggtgatagccagaatcaaaggaaatgaaagaaggactttcatcccttctttcacctcattcccatgtagctctgctgtgttgttccatccatccccaacactaacctgataattcggagacaccttgccgcatattgtttcacctttaattcttgaataaactctgattcttacttataacttttcccatgtttgttgccaataaaatttcccatctcatttgaagagttgctatttctgtcacctgttcaaaggatagcacttcttttattactacctctttctttttccttttccaactatttctcctttgactttgtttttcccaataatgatttgtttttatcttctttcctagtaaccaaaaattaaaacaggacagagtttccaaaggaaatgtctgtagatgttaaccaaactgattgaatcactggttattctttgcttactttaaggctgtaaatctgcaaaaagacagaggtgatactggtatcactcacagccacaggttagtgccttggctgtgctgatgctgccagggtttaaacattgctgtgaggagcccagcacaggcaggagtgtggggtgaggatgtgtgataacagggcatgacgggcaggtagaactgctcgcttgtgttttacacacaggcgccccagccttcctataggctctttcttgtgaataggcttccaccatgaccaaaatgtttgaaaaaccgtaaagccaagagataagtaatttttgttgaatataaaatagataagccattacctattcataggaatatttacctcctgatagactttggcaagggttctaacacagagacactccatgttctcaccaccagtgaagacgagggaagtagctactctcaaaaaacaaatagcattggctgggcacggtggctcacgcctgtaatcccagcactttgggaggctgaggcagctggatcacttgaggccaggaagtcaagacaagcctggccaacgtagccctgtctctactaaaaatacaaaaattagctgggcatggcaacatgcacctggagtcccagctactcacgaggctgaggcaggagaatcgcttgaacccgggaggcagaggttgcagtgagcagagatcacaccactgcactccagcctgggtggcagagtgagactctgacttaaaaaaaaaaaagtgtaaacttttataaatgatacagagttgaatgaatggaattcttggtgaacatgatgagctatctcaagactgaataatgctttgcacacagtaggtgataacaaatgtttgaggccctgacataaacaagcttcctcctcctaagaaaggttaatcaatagtcattctttagagtgagggatccatgctgatttttgaaaagtgaatcagagtaaaagttccaatcgccctcttggactttttgatgatcagctattgaaatagcacgtatgttagagacagtcctcccagcaaacatgattttctattaaaatacatccaggtgacaaaaaagaagcttttagaaaaaaagaatttgactgagcgtggtgactcacgcctataatcccagcgcttcaggaggctgaggcgggtggattgcttgagctcaggagttcaggaccagcctagccaacatggtgaaaccctgtctctactaaaaaatacaaaaaagaaaaagagctgggcatggaggtgggcgcctgtaatcccagctactcaggaggctgagacgggagaattgccagaacccggaaggcgaaggttgcagtgagccgagatcgcaccattgcactccagcctgggcgataagagcaaaactccaccttacaaaaaaaaaaaaaaaaaaaaaaaaaaaggatttcccgaaggtagtttatttggcaaatcccacacaaactattagtagtccttatacgaagacaatttaattttgggattattactaagcaaattactcacaaatactgagttactgaaatggaaaatatttttatctccccccagtgtaactacagacaagaatgtagatagtgtacttaggtgtaaatgacagatggaatgaactttgggtgaaggcgagagcacagaagctcagtggtactgagctgggtttgagtgggtgggaccccatgactggttactgatctttgaaagcgtttcaggatttcaaagctacataagcgaattcacgtgttttagttatctaggtttgttttttccttgttatataggatgtttgcagttttcccatttgtatcaactcatacatctttgaagttttgtaattcagtatagctttggttatagattaaagttcactggaaaatcactgactaatccttttagcatgttccactgttccatagtataaagatacacagaacttgatggcttccaagtgtggttcaaacatccaaagcactcgagattagcaccatgtgaagaaattttaaaatattgtactgcaattaattttaaataacttagcactgcatatgtcagggagaaagccatggtagaattcaaacagaagctcctataagtgaaatgattcacttacatcatttaaataattttatctctcataaagacatagaagcaaaatatatgcctatttccacttaggaaaggcttgggtgaatttctgaagaatcagatattacctgaggtttattataatatgggaagtctgtggagcatttattggttaccaaatgattaactccctatattcatgtgtatttgttataggttcaaaaaccaagttattacagaaaagttattgtcaatgtggaaattgaaaacacattattttaataatataacgtagagaaggtatatctaaaatacatatttttaagtattatcctaaattctaggatctagattaaattctttgaggatatctttttagtagctcctgaaacacaaagttttctggaagacccgatgggtcaagatataaaggaaaaaacttagtttatggccttctgtggtcaggggttagccaagtcactgaaaataaacatttgcaactgttagtgggctatttgcggtcatttataaagtataataagacacagtttatgacttgtagtgattattgcactcatgttatttctaattgcacttatgatcagcagcaaataagcaaatatcactcagtgccttttgatgaaatgagagtcttagccttgaatgcagccgaagaccaacagctcaattgctagtgatgtgtttcaaatgtagaaaggctggaaagaacctttgctgaacacctaaccctcaccttcatctatagatattctggcctggagaggtaagaatttacatatccaagggaaaatgggtgatttacgaccagaaagtagacctcctgactcccatagagacccttcttaccacatgaaacataccatcttccagtcatagagtctcctccaaaccagaaagaacaccccaaacacctattgacctttcccaagagagaccctattgtattttatggctctgaaagagctaattttttttctttctttctttattttttattttattttatttttatttttgagacggagtttcactctgtgtcccaggctggagtgcagtggcacgatctcagctcactgcaacctctgtctcctgggtttaagccatcctcccggttcaagcaattctcctgcctcagcctcccaagtagctgggattacaggcatgctccaccacgcccagctaatttttgtatttttagtagagacggggtttctccatattggccaggctggtctcaaactctcctgacctcaggtgatctgcccacctcggcctcccaaagtgctgggattacaggcatgagccactgtacctggcctgaaagagctattttttcatctttgtatttaaattccatttcaacaaacatgtgttagtatctgtatgttccaggcatggtgctatctgccagtaaaaatgagacagaaaattaaatagcatgatgctttaaccagtctatatgctttagaaaacctgcttccaagcagtgaacagttagagaattatagccactcataatttacaaggcactgtaaatcatgccattcagtcctggtactctctagagtcaggtatttggaatgagtcagttgaggttcagggaggtaaaggggcttgcccaattcctcaaagctaatataaatagccaagaagggactcaaacccaggttttcttttatcatgccttttgccttttttcactataccatagctacttctggtagaactgtcatttctattaaagggaggataccaggcctaattcagaataacattctgtactatgtatgcaattgtttctaaggagaaaagtctgatttaaaaaaaaatatttttatacttttaggctgggtgccgtggctcatgcctgtaatcccagcactttgggaagctgaggtgggtggatcacctgaggtcagtagttcgagagcagcctggccaacatggtgaaaccctgtctctaccaaaaaacacaaaaattagctgggcgtggtggcagcacctgtaatcccagctacttgggaggctgaggcaggagaatcacttgaactcaggaggcggaggttgcagtgagccgagattgcaccattgcactccagcctgggcaacaaagggagacttcgtctcaagaaaaaaaaaaattggatactttacaccatttccagcaatgctagttatgcagtaatagcttaatatttcacttaaaaaaagattctgcctaaacctctctttatctcactagaagagctaaccctaaccactaccaccgccagttagtatcagggctgctgtaaattgttccaagggtacatttagtggtattgattgctgctaatagtaaaagaataaaagcaattatgaatgtacacaacaacttgttgctctaccccagtttcaccaggagataggatttagtcaagaggggatgtcacagaatctttatcctgattaggagctttttgaggggagggaccttgccttttttcattttgtatctccaggtatacagggtgaaaggcaccatagtagatgccaagcgaatgaatgaatgaacgagatggataggcccaaagacaactaaatcaaaaaacctgtgttgtttcagaggagaatgatccagtatcatttcccctttgggtaggagtagtggtatgaatattgctatgactgcagaatcccagacttgtctagaatctctagttatagctttcctcagcagtgggattcaccaacacactgaaataacctgtctgtggcaaaactccatacacaatcctgttttctcaaatgcttcaaggggaaaagaaattcctgatttacccaaccacagaatcttcaaccttctcattaaggcttctgcattttttaggcaaattgttactgtgccattcttactcctatcctttcacagaattattttctgattatggatatgacaagacccagttgattttttcagagtttagtcatttattctgtggtttcaaatctcttctaccatgttatcttcctgcccctctactcccctgcccccaccccccgacaccaattcttaattccctttcttccttttattctcaccaggaagggatatgtcacagtaaaccctaccaccttgtcatccaaaatttctagggagccttagttctgagggtcttcttcttgaggccttaaccttacttttagacagttgtcattatctttgtctaaaggtcatagctaaattgaataaaaggaaagctgtgttttcctgttgatgcacaaaggcagtattgacttccctaatccagtttgctgaggggtgagagaattaaattagatatctaagcacagaaattgagagcctttgaaaacaaagataaggagacaagactgtattttcccttttcctgggagctctgggctcaagattttgcaggtgtgtcatctgatccatggcttgcatcgatcaaaactgtgccaatgcatatttaattagcaaggggaccctggatgcattatagccatcatccctatattgaatggactgtcagactctccgcacacttctccacccccaccgtcccctgaacccgtgctccctcccttgcctcgttgtttgggaagcttctgcattttgtctgagcagctaaaaagtttctttgtttttagctgctgatgcatacagcgccactgaggagaatacaaacaagtagagtcctaaagtgtttattttgtctaggaagacaagctaaaccaatttgattccttcggtaagattttcaaaccctgtagaaaaccgacaagaaaagcaaaaagaaaatgaatacactgttcaactcttcacgtatagaatttaaaaaaaaaaaaaagaattggttatattaggaataaagaagacttcggacaaatattttaataatagaattaaagaatactttctattatgatagaaggtattttattttaaaagctctgttttgatacttaaataagacatttgttgttggcaaatattttattgatcagtctaatttgcttgatgcaattcaccattctgacatgaatctgtcattaccattaggaaatccaatgcctgtacaaaagttatttatgatagaaggtgacaaagagttagagctggatgtatttttttttaaagtttctaaggttttgtgggtgtttctgttggtgagaattcttaaagtgcaggaggtttggagttttgccacagacaggttatttcatgggattatggtcactgttcattttcacacaggttccaaagcttgaatatccagacagtgttgtctgataaacagatgtaatgcaccaagtctgcttagaataaagagcaacagactgtgagcacatgtttaggactcatttaaactcatcagcatagtctagctcatagttctctgtctctagtctacttttgaggtagcttcttgctggtaaagtaacaaggaattattttttctctgctacaatttgctgcagagactcatgggaaattcatttgcatacatcttgttacaaagactgactacttcctggcttagacaaagtgttgcctgataaacagacttaacacacaaatgtctgtctggaataaacaacggcaagctgagatttacatttcattatcaaagataatctctttcccagtatatgagaattaagaacctgttctttaaaaccaggtctgtgctcctgatgttttatactagaatcacatcatgtgtcggttggggttgattttcacaaagaaacgaaaaacttgttgggatgtgaagatctgtagggcagaggtaaatgtacattttggggggcctttatgagtttcaaaaccaggttttcttgctttattttatttgaaccacacaacatcctgttaagttaggcaaaatcatcagtagtgtctccattttacagatgaagaaactgagatccagcacagttaaattatatagctgaggtttctaggacaccatctttttaccatttcatactcttttcaatggtggaatatgaatgcaagaaaattagtactttaaggtgctacctggacttaaatagcatgtttacacttgatagagggcattttattatttcaataaaagtttgtgcagacatccaggtacatgaaaataatgcatgtagattataactcaattatccttcattttcatttgaagcatgtattttatagtaggaaagaatacagggacattttctacattaagtagtatagatggctgtatgagtaatcttcaagtatatatcatcctgttgaagaactccaagaacctagtgttaagattaattttgattgtgaaaaaagtgactaaatggggaaattaagcacaattctgctatgcaataatgttgcagggatggctttttaagcaggtctttgtttacatgggagtgggtaggtgatcgggtagactcaataacttgagttctgaattaatcagcaggcaccgctgtgaacacagcgcctcttatggggaaaacaaaattcaaaatgattacctagacattttagtttagtttagtcaaagcgtcttctcaaagaaaatgtgagaagttacaaacttagtcaaagtatcatgtttgcctgtcttttataatcaccagcttcttaccattgacttcatttataacatcactgaaaaagctgatcattacttgaaattcagcctcatgcgaagattgaaggtttaatgattgagtcattttgtcattactttcagagtgactgaatttgtcatttttaaagcttagaaatgatcctcccctcactgtcataacacaacaatagttatgccatttcatttttttctcaacgtgttagaactgtgtatcattctgcaacctccttgtgcatgtagaaaaataacacattgatgagtaggtgataaggcagttgactcactcttcaacttaaacagtcttatcatcgtacacagtaccgactaaacagatgggccctggaataccaacattaatgaaataccagaaaagttgaatttctgtaaatttaatatttcacaaacttgtggccagaaaggcattacaaaaagaaaagttttgagaaagaaaatggtagtaacctagattatgtaacagtcttaagtaggccttgacaatgcggtacaggggagtgactaaggggtggatctccagagcagctggcagcccccagggtggtctggtggagggagcccttccaagtggctgctgcaggaacacagaccttgctccctgtctgaatcaggagtagaggagatgaggaccaatgcgtgcaaactagcctggtccttttggagctaggagttcccctgcaccccgccacagctccccatctcccttcgataaaggacttactctgcatacattaattactgcagttaccgtgtacatatatctagacaaacactcaattctagcttgctgggaaagttataaagatgaaattttgtatttaaaatccagtaatgataagatttcccatttaaagaaccacagagtgtttccatttttaaagcttaagaaaacttttatggtatgactcacctcatcttttatctgttttaggaactcggttattgtacgttaattttcattaagcgggccacagttgtgtacattaattgaccttaaatattagtttggttattcactgagcttaaaagattttattcattctctgtaaatgctaatcataattgcatattttcggtggtccggatttagtaatggtgttacagatttctgtttgttcttaaccagaccatgatggataatattatatttagctgatggtgttgtattcatcaatgtttacccttaagctacaaattgtatatacatgtgtacacctgtacgctgacattctacattctcaaataaggtttttccaatattttcttcacacgtcagtctttaaggtcacggtcatactggaaaaaatagataattttcctaaatattacaaagtattacaataataatttcttttataactgcagctgtgagactaataagcaaaatgtgactattatagttatttgattttctggatttcgttaatgtaataaacttatggtactggctgatcaaaacagagtaattttaaaaattatgttactcataagaacagaattatttctctattacaaccttatagatgtagaaaaatgaattccttggcctcttctgcagagtacttatcttcccaaaccctcagaaactaaaacttatctaaattttgaacatctttaaggtctacagttgtagagggtaactgcttattacactcagagtgtaatcacccttactccttactttcttttacctcagaaatgttcctaactcttcatttatttgcaggaaagtattcactcctgtctttgccttttagtttttatactacaaacaactctagctcatgagagtggaattttcgctttatttctttcactaatatttttgggtttggatgccttctggtttcttcataccgtcttttaatttgggagatttaaaactggacataaaattctaacaaaggctcttcagacttcatctttagccaaatcattatgcatgtagggaggctgaaacttaggctatattatttttctagtggaaccagaatttgtgcttttatggtccatagactttggttgctatcgtgttgatggaccaggaatgacatcggtttgttttagggtgggaagggttcctcaccagtgtgtctgcttttcctttatcaagaaattcacaacagcagttgtgaggattttgaggcagtctacaggcaccagaatatggtgggtttctctaatcattgtaatttttaaatgtgtgaaatattcctccatcattcatcattttaacctgtatacatttctggagggcctcctatgtgtcagatacggcttcagctcagcctctgtgctgcttgggccagtggatcataggaggtgattgtctgcaatttctaaacactgtgtaagatttccaaaccactcacaaaccagagggatatgccctatattcccttgccaggtctcaagaagcaaggcatcaagcagagatagaggactttttgcgctcctttctcatcttagaagtcccactcccctttcaggtgtaagcttagcatatttttcagtcactgacagtggttcagtatcagaaagctgaacaacaattgaaatttcgtctcttcagttcagcagttattgaactccttggctgggccaggcaccctgtggaaagtaccggggataagagaagagtaggaaggaactcctttctttagaagctgacattctcagatggtttgaactcaccttactacagcataatattaatcacactgtaagagatacatttgcaatgaaagagggactggagaggacaaagtgtttaattctaggtgaaagggaagatttagcaatattctatctttgtttattgcctaaagaacataaaatacatggaagggatatttatatttttgcctcactcattttaccatactaacatgtttttgtcattcctcaccttccccaaaggaatactgaagtttcattctgaaggggagtagacctgaggtttgaggagccgaatatgtgtacatgtagcaaatccagtacaaggtttccgttcttgcattgtacaagcgtttggaagcagagacaaatatgtaggcatcaggatttattttattcctttccctagtgattacgttgacagtgaactatctttgtctgagtactccagcaatatagctgtaggcgccataaaactgcataggtggatggctaccagttcaattaagagttcttaacctagcctcccatatgcaaaccctgtctattttaggtttaaatttctgctcataaattttttaaaaatccaaagaaacattgcttttcaaggttaggttgaagtctaagtttccttaaacaaaaagcaaatccctagatagggaaaaaaaattgataaccctaatgtacttccttacaagagcatttccaaccccatcctttaaacacagtgtaagtaaaattctcttcattgtaatatacagatcttctggctttcaaccagtaagccagagaaactcactggtatgggagactcagatacaagaagaacatccagttctatgcagttgggtttgttttctgaggttcctaattatttaaggtggtagaaatcaatcaaccacgtgatatttgtccgaaagagtaagacacaaagttaccttggcttctgacaggtgtctatggagtatataaaggagaaaagtgaattaattgttaaccttcttgatagtgttttaatgcaaatgtttgagaaagagatctttcatttgtatcaattatacctgggtagaaattaatttataattttggtcatctggttggctccacacttaacagcatcagtgaccttttgcaataccagaaagagtgtccatgcatcctcagcagagaatagcactaagactgggtagttttgctccttcttggctgaaaaagaaaatggtattgaacggccgagggtagaaaataattattgaagttttgagatcatatgcattttcttgtagatctttggctttgcttgccccttagcaggatggtgcattttagtatgcagtcctcagatggatagcggtgtctccagcttttgaataaaactagaaaaattaaattccgttttcagtttggctggatgccttctccagtgtttgtatctgagctttcacgagaatgcggcggccccttgcagaccaactctgagcattttcttgccactcactcctttgctgttggtttgcttatttttctgtggcttggaattttaaactttctttggacatacctaatattcatcttttattgttgttcatgttttctattattatgctatgtatctgtaaaggtaggtgacaaatttaaacaaaaagtgaaaagaagaaagaagtctgctttcagattaaataaaaaaaatttagggtctttcctgatccctttttgctttaatattcatggataaatatcggaaaagtaattggctattgtatatctaataattgagataaaactattttccatttattcatagagaagtgattaattataaagatattacacatagaagtagtacatggatagagatgtatgtttgctagtattattccaaagaaaatattatgtttggcaaaattttatgtatctgtttcgggacatgatcaagaattttaattttccctaaaacaaaattagatattttgctttcattttagttatagaaattaatggtttaagattttccagaacaaaaacaatggaggcatgtctttctcctaaaatacattgaattactactcaaaatatttaatgtgtaatttctaatggcaaaattataggcttgtttcctagaagaaaaagaaggtagtcatgctgtattttttaattgtttgtgatatatataatattaatttatgtagttaaaattttaaatatgggtcaatgtaaatttgtttgcatttctaatttttagtctaggttttgtatttttgtagtttattctgaaggatttctttaaaggtttttggcatataataatacattttgtttgtgtcttctctgtggcaattgttacagaacgataaaagctgtcactttgccagactcaaataaaaattcactttttagcatcttctgttatttaaacctttgaatcaacatagaatttttgctatagtcaccaggttaagattatctgaaaattttaaaatggatattttttgctatagcactttcttataagtaaaatcttcgtttgcttaaaagcagggagtcttttaaagtaataaattagcatttctagacctaaggtcactagtagtgccacttctttctgcagcatctccaagaaagagaagggtgatgctataactcagttgctatagaagtaatattttctgtttaatcacagttaagtgtcatgaccttttgaccttacattaaacttgcagaaatgtggttaaatttcaggcagctaattcaaaacctgtgaagtcaagttgaagttaggatgcaagctctccgcagatacagaggttttgttgaaaaaaaatttttgtgtttgcttttgaacaatgttgtaaacgacttcaagtctcagaaaacgctttatttttaaatcaaaatttttccccttgaaacattttgcctgttttttctctcctctccccaaaaactgtaccataaatatgcttgtttctaattttgtgaaattcttttgatctaagttaattttatctaatttaaaaattaagttactttgattttcccttatttcatttagaaattaagttaatcaaattccttttttagtttgaaaatatgattatattttttaaattaaaaaatgtttaattctatagaggtgtacaaaaatctgtttttgcaaacaagtccttttaggatctcccaaatgcatcagtacaagaaaaaaataattcttataaagcaggggaaacttgtaccttcagaaagacttctttgagttatgcagttatttcaagaaaatgtgatggaatattaggactctagtatttaatggtgttagtctgcgtagtctgttgctggaatgcagagctaaatatcaacagaacttgttactgttgtttgggttgcttttatataccagcttcaaaatatgttttgacactttattatgttctgaatcaagcttcagatgtgtgtaatgaaggatgaagtctttatcagactcgagtgtataaatagtggagaagagcagtttggaaatggtctctctaagagaatggttgctgaagagcttcaagttgtgatctggcaaaagccaatgccaccgtaggtgtccgcaaaccggagcgtcctctctaaaggcacaggctgctgctgcatttccctctctttcttttctctttccatcttttctttttttcatgtctcatgtcatttctgtaatgttccctttcttagtttataggttgaaccttttgagaaagtctggcacctctgatgcactttcccttgcagaccctgtaatttttggctgtatttttatgtttttcagattcaagtcaatctgaaagtcccagccagccaagtgacgctgacattaaggaccagccagaaaatggtaagtttagcttgggactctagctgctgctttcagagtccacagcagccagcaggccgactaagtgtgaggatttgggggcctaccctataagtagcccacagtaggaacaactccaaagactcggaaaaactcaagtagattacttttaatagggcagcttcttgttctcgggatcaccccagcagcctcaggacccccggccctaaacactattagggtgcccatgagaacctgaattcccaagaacgttgattacccaattaaactatgagaagtggggttaatttaccaaatcagatttttttttaatagcattaagtgaggagtcatggctttttcatttcattttagttctttaatgtggcaaatgccccatgatcatcttcactagtgatttaagatcattcattcacaagcagttttaagccttttgggagctcaacactttgccaattcctttaagaaaaaaaaaaatatctatgctttgaaggatttttctaccttaaattgtctaaaataaaatagtgaggatacagggcagcattaaattccactgctgcataaatatctaaattttctgttgcagatgctttattaaaatagaacatacattatatatgaatatcatagtatctggtaaaatttgaattcgtggcaggcactacaagtatgaaaaatactgtcatgggttggagttttatattgaataaaactatcggtttcaataaaaacagagacttcagtgaactagcagtgcctatcatataacaaacattgtgttacatactttcacagatatcatctcataaaattccaaaatgttcttctttgctgatagcactgaggactctggtggaatgctttaccttgaagggcctgtggggagaatatgccattgtgattaaaagctcaggctgtgggctgggcgtggtggctttcacctgtaatcccagcactttgggaggctgaggctggcagatcacgaggtcaggagttcaagaccagcctggccaacatggtgaaatcatgtctttactaaaaatagaaaaattattcggtcgtagtggcatgtgcctgctgtaatcccagctacttgggaggcttaggcaggagaattgcttgaacctgggaggcagaggttgcagtgagctgagattgcgccactgcactctagctctgggcaacagagcagaacatctcaggggaggcggggcggcggaagctcaggctgtgacctgcattcaaattctgcctctcctatttcttacctgtgtgatactgaataggttatttaacctctcagagtattgatttattcctctaaaacagggtaataatattacctgtttgttgaagagttaaataagataatatgtgtaatgtgtttaccatagtatctttcatagagtttatgctttaaaaatgtcagctgtggttcattatgacttttattatttttcttgtcaatataattctgtcatactttgtttttcacccactttgaatgaccccattgcttgagtctcttccttttgttgttctgtacattgttccatgttgatctccatccaatcttttggaaaagataggcaaacggaattatgttggtattgtggggtgaaggatcaagtttaccacattagctatcctatcactgatttttcagaatatgtttcatttcctacccatgagaaatttgattacattgctggattctagcattaaatatggactgcctggcaattcctctcctcatcctggtattttggtgatattttctttatcaaagttgtctttttaaagcaggcagttaaaaaaaaaaaaagagagaactctggaggtttgtttttagtgtcatatacagctacatcttattttttgttgacattttaaagagtggtatttatagactagtttcgttctttattttccacttgacttgtaggtgatgtcttcaaagtttcacttttttctacatattgtatttgtgcataatctccctaaagatgtctccagaggtataattttattttcatcttcaaaaatgtgtggactgtacgggtgtgtagttcgcgtatttaggtctggccgcccctctagcaggcctgtgattcatctgtcttcataaaatggccaacaagctgttcacatgcaaatataaattgagagcatgagaggcctggcatgcctttctggagctgcctgcaatcccaatattgtgtgtttcccattccagaaagcaaccaggattgagcctggattttttggccaaaggcagagagatactagccaagttcacttttaacctcagatcacttgatgctactacctcaaggatttacactatcattttggggaaatcatgtgagttcaaagaaagaaagtattaatatctaggagataaagtaataaattcctatctttcagttttctatttgtttcaaagaaaaagtagtagaagctggcttatcttagccccagttgaagaattatcagcctactcagttttctgcctcttgtcaatctcagatgaagttagtggaggaaaaatgatttttctcttttccttaaagacacgtaatcccaaaaggaataaatgaagattcagggctgggtatttacatgcattagataaggttctactctctggtgttgcgttgatcaagagaatgtttcctctttttcattacctcaggatatgaagatgaagtgtgtgtttcgtttttgttttgaaagagggaactctcataggtgtatcaacaaagctctaagaaattttggaatcttgctgattgaagaagtaacagacttgattcttcaaataaaatgggaattcattacttcacatatatgtatgtgtgtgtatatatatatgtatgtttgtatgtatgcgaaaaaataatattctttttatcctagctcttgagaaaggtaatgggaaacgaatggtatttccctagtaaaccatggagaatgaatagacaaatggtaacacgctgtttcatcccaaaccgtaaactgggccatgtaactttacataaagtggatgcagctgtttcttccctgtccaactagtctgctttttctgtggaatttttgctttcttttcttgtactcccttaagactcaactgtaaaagaaaacaaatctttgtccaattagagcattagatgggaattttgaaggaattatctgaagcccagcgataaaatatcagaagctctgaaactcaaaattggtataatataatgggtaaaaactctgcctctggagtcaaaaagacctgagttcaaattaaataatagctgagtgactgagtaaggtacaccccaatctcagttttcttaccagtaaaacagaaatactaaaaggaggccaggtgcagtggctcacgcctataatcccagcactttgggaggctgaggtgagtcgatcacttgaggtcaggagttcgaaaccagcctggccaacatggtgcccgtctctactaaaaatacaaaaattagccaggcatagtggcacatgcctgtaataccactactcgggaggctgaggcagcagactatcttgaatccgggcagcagatgttgtagtgagccaagatggcaccacttcatccagcctgggtgacagagcaagactccatctcaaaaaaaaaaaagaaaagaaaagaaataaaatactaaaaggacgtatctcatgagtggtaaactgagaatatgcatacaaaatagcattctgcctggttcacagtaaggactcaaaggaaggttaccattactaccttccagttaaagcttgtcgtatttacaacgagtacgtatattcaagaggtccaaagctgggagccttggagtggaaggggatggcgtcagaaatataccaagacttttagagacatctttagtgggtacttaccctgctctgaaatgtcagacatgggtttcccaaatccccacaatccccatggtgccacgtctgttttcccattttgttttatcctcacaatctgttcatctcccatgagtttgagaaccagggaattgcaaaaaggattcagagttgctggaaccttcagaatgagtgctcaagaaggtgattctggaaagaagagacttctcctagatgtctttaattttagctgagtttttccttggcacaaaccaaatagaatctggcttattaaaaactataagctgattaagggtaggatttatgacaaattccttttaaaaaaaatcctgcacagcccgtagatctgtgccttgaacttaatgggtacctagtacttatttgcttaatgaataaaattaataagtagatgaatatattgtcattactcccaaatatttttggagtatctgttcactcttgatttacctagagattttaagaaaaacaaacaaacaaaaaaaacaaaaacgctctggagaagctgaaaacctaatttgggtgtgggggaaggctgtcctcagacacatggacagagattaacagatataactagtaggtctaggaagccaaagctgagggctaggtactaatgggaataggacatcaagttgtccctctccccttcctgcccgcccccacccccacttcaatgagcaggtgtggtcagatgtttgaaacatcaccatttcagtttatgcatgatgcttgattaccgtagggaatgcagttcagacaaagttcctagctctgattggtatcatttaatcctttgttatatcactgaatctggcttttccagagctcctgaaggttttaagccttatttgttggactttgacttagaacatcgatttaaacaacttttgtgaactcccatgacatactttggttactttaaacatatttatgggacagagcatttaaaatgcctgcctgatatttacagggcctgtgaacagtcctccaaagcttgcattctgtggtgtatcaggtcagtcattaatgaggataaagctcatgtgatagccttcttacttaattcaaggcacacttctgtagggctgcactgagtcagtgtctgaggcaacagtataggccagcgttggcactctgaaaacacacccccactggctctcactgttatccgtgaaagcatccttaactaaaaaaagaaaatgtggggctcccttgccagaaagtaatgctatcttcacctggttatttttcccttctatttgccatttctcatcacctgcacagactgctagtaataactttatcatagtggtttttaaaatgtgatatttataacaagaaatcagaattggtatttagatgatttcctttaggtttaatcatgtttgttcctcctcatttatctggtagttgcacatatgttggtggcatcaaccctcagatgggtctttgcaatcagtggaagcccattaatcatgatgcttgccccagattttgaaaatttccagctctacctgccaatttgaaaattaccctgtggagtattggttgaatctacctttcatgttcaccatcttcatttatgtcgttcacatcctgaattgttaaaagaggtatcattgttaaatgttgctaggtgaacaaggaatgtacttcttttcatccgtaattgttgctatttcatgcattattatttaactcattgaatttttaatgtttacgaaataagttttagtgcaactgacttcctgacttaagatttatgtgtagggctggacacagtggctcacgcctgtaatcctagcactttgggaggccaaggcgggtggatcacttgaggtcaggagttcaagaccagcctggccaacatggtaaaacccggtctctactaaaaataccaaaaaaaaaaaaaaattaaccgggcgtgatggcagatgcttgtaatcctagccacttgggaggctgaggcaggagaatcgtatgaacccagaaggcagaggttgcagtgagctgagatcacaccactgcactccatcctgggtgacagaacgagactctgtctcaaaaaaaaaaaaaaaaaaaaaaaaaaagatttatgtgtaggatttactttgtaatttggggctgagaagagaaacctataaatttctttttctcttttttgatgaacatttttttatctgacattattctctttaaaaattgtgggccttcttgtttaatgttttaaattgtttttactacctcctcacatgtatagtagatatattacaatattatattgcaatatttatatatagtgggaaggcaaaataaaattgataattcaaaactgcaaaaatggtcactgctggatggactgcttgttttaggaactgttttgatgaatgtgtcatttagttgggtgatttaaaaaaatttggaggcaatgcaaccttacagtttatgttttactgggaaagaaggagcattctagcaccattgacttgtaaatgcagtttatcaatatttcataatttgcatgactttcttttacaattacctagcaacagttcttctctgcagtgttccttcaaaaaaccccgcagggacagacacagtagagtgaccaccaaaatagcagcaataacagttatgatcaatattctaaaatatgtaaaggtcccaactcagggagacattaaaacctaaatgccttctggtttccagatctgtataattaaattctgactgatgaattttcagcaatgcaatggagctagtctctcttctttaagagattagggaactagaatttggtttcatctgaaatttcattctgaaactaggtgaattttgctttcttaagaattgttagcaggtgtgacccatcattgtttgcaaaggctcctcagaaatgcctccagacaaaggaaattcctgagtctttctctgtgaaagatgaggtgccatcctaggctgggggcttccccaagtgcatgacgcagtggaggctgcagagcttaagccacgggatccagtgtacttaaggcgccttttcaactgaaaaatggggggtgtggggggagatttgtagccattttaaagtagtcttatcctcacacattatgagtattttattgtcttcacacagagaataactagctgaacagactttaggttagttggctagtagccaaaataggaaatgttttagatcctattcccctgattttcaggttctaaaatggactgactgggtggtctgtttcagacatcttcccctccccactccccccacctccaacccttcacacacaaagagttacacaggaaagaagaaaaaaagggatttcttgctggtcctcaaattcgtttgtgcctctgactcttatcccaggagagacccagaagtgcctattgaatgtaacgttccaagtaggaaagcattttaaagtgtgtatttagaatgtatctggaattgcgtaaatatatacatagatctagattctaaaaatatgaaaatatgaagcaatacaatttatgcagtatttgaattgggctcaaaaaggaaatcaaatgaggagccgtcatcaaatcacagtgcggtagaaggtgcacctggtgtttggctacagctccatctgccattgctctgttttccctgtgatctaagcctggaactagtatgacaggaccctttgacagagatatccttagaaggaccacttctaatggccacttttcatacctccccatcaattaaaaaccagcgtggtgaaagatcagaggggcgagctggggtcaggaattgggtatgagctttccttgccacaaataatagggtcacttctgcttttaaatttgaatgtgaatttgttgtttttaagcctgtacattattttttggaaggaattacctatttgtggataatattagtaaactgaatgtaatatacataatgtatttggggatttggagtcactaatccagattgattagttgcctgctagaaaaattcatgtggccacaaggatttttggcaccttttctccctgcagcttcctcattctttttctcttcttcaggttttactcagctccaggcaactcttttccccctggcattagcttgtcgttaaggaaatctagtgggatatctcaaataggggtggagggtagggggcactatttgctgcagattactctgccccatctcagttgtgcatttctatacttggttgattttaacccaaagggaaccagggagtctcatatggcttatccacaggcatcatatggtgaatatccaaaaagagaaatgtaaggatattgtggcaaggctcggcaaaataggaatagcttttcaacaatctttccacgaaggaaagtcagtgttttcttagatctctgtaggtattttacaaccagagagcttctcagcaagtagcacttgtaaactcagagatgaacaagaagaagccaaatcacagcttccgaataggtcaaattagcaaaagagacttgccattaaaagcctgacactgagcgtctgttaagggaaaatcagttgtccaagtcacttaaagacttgtacctcaattttctcataagtaatttaacagatcattcttaagaattgctggataggccgggcaggatggctcacgcctgtaatcccagcactttgggaggccaaggcaggcggatcacgaggtcaggggattgagaccatcctggctaacactgtgaaaccctgtctctacttaaaaaaaaaaaaaattagccgggtgtggttgcaggcgcctgtagtcccagctactcaggaggctgaggcaggagaatggcatgaacctgggaggcagagcttgcagtgagcagagattgcgccactgcactccagcctgggtgaccgagcgagactctgtctcaaaaaaaaaaaaaaaaatagaattgctggatatatttggactaggtattggatgtgttaagggaatacagagatagagcagacatcctgctcttgagaacctgatagtctagtaaaagggaaaagacaccatttgttcgttcattcattcaacaggtatttatcaaatacactctaagaaccaggcatgttctaggcatcacactgagcaaaacagaaaatcctactcttaatttagcttaccttcttggggaaggagacagacaatcagctgattaatacacatgtcacatgccaagtggcatcaaacattataaaagaaaataaggcaatataagggattaaagaagggaggatgtgggtactgtcttataaagggtggtaaaggaaggcctttctgatgtgttgacatttgagttaagtcctaatgaagtcaaagaagtgaattatgcagatattagggacttttattctaagaagagggaacattaaatataacagccctgagacatgctggaagaacactaagggggttggtgtggcttgaagggtacaaacaagggagagaatagttgcagatgagtagcaggaaggcaaatcatattggatcttgtaagccaaggaaaagatatggcacatccttgaaaagccatggtatactctggaagaatgcacatatgagtccattcatttcttggtacagtagatatgtcctgatcccctacactgtgatagtcactgttctagataatgagtgttcagtgggaagcaaagtagacagagtttagtgtggagttgtacacaaagacctcattcatagcattgttaaggaatgagactctgatttgtcatggcagtatcttttagtacctccaaaggttttccctcgtgcatattactaaaagccaagttacttgcatggaataatatttggtttcacatacccaattgtgtaaacaattatttctcaaaatggaggtcgaaatctgtggagtttcagcttacccctgctctcgtgaccccattagattataacccccaggtctcacatacattcaccatgaaggtggattttgttcctaaatagttgccagatgtagcacaatggtggctcacacctgtaatcccagcactttgggaggccaaggcaggtagatcacttgtggccaggagtttgagaccagcctgggcaacatggcaaaacccgtgacagagcaagactgtccccaaccccccccaaaaaaaacaagatgccaagttaaatttgagtttcagataaacagtgaataattttttagtactgcgtgaaatatacttacacaaacaaagtattcattgtttgtctagaccaagttttgtattttatctggcaaccagttgtaattctccacatattcctgtggaggttacataggcaatagtaacagcagtgtatgaaaaggtttgattagtctgtgatgatttcactgatcacaaaaggtcaaaccactggaatttaacccactgaaaatgaaatctgggaagagtactacaaagttctagtgacttggctgcttaaattccattccttccgcatctgctggtacctagcccagtagttttcttggaacaataaaccacttgtgaggcacagtcaataggtacaatataatagttgagagccactcagcccatgcaagtgagtgtataagtttaattagtcgtgtattaattgagtaagccactgcgacactgtgtgagcccatacatccagttactggcagaccatttactcacgaaagatgatgaaaataggaaatcagtcaaataatagagcatttggaattcgcacatccaaaggtgaagtagagaaatggcatttctgataaacttgaaaatagaaggggccatatttttcatgtgcaatatggaatgataaatgtatatgttttcatctgtaattgggacaactttgctaggtatgacaaatcttgtttgaacatgttaaagaaatatagtgtaacctttgaatcctcctgctttaaaaaagaatagtgttcacagattcaaggaaaacaattttggaaatagggttaaactctattaggcttaaagccagataataacaaaaataatgatttttggtgataataatcataatagtagctcacaatcattgtggactttctgtgtgccagtatgttagtttgggtcctccaagaataatatgtcctgataggacaagagatttattggggcaatacctatcaaatataaagggggacagagcaagagtagattgagagaacttttaggctgcagtacagttctgacaggtgggaaaggaggagggaagaatgagagattgggttggaagaatcccagagctctcactcccattgcctaggctggagtgcagtggtatgatcatggctcactgcagcctcaacctcccaggctcaggtgatgctcccacctcagcctaccaaatagctgagactataggcacacgccaccaagcccagctaatttactgtatttttagtagagacgagggtctcactatgttgtccaggctgggttcaaactcctgggctcaagagatccacctgcctcaacctctcaaagtgctggggtcacaggtgtgagccactgcgcctggagtaagcttctaagaaaattttgaccatgccaatggagagtccctgagcttaagtcccctgttggaagaattctgtgttttataggaatgggtctgtgttggtatcctccccctcagttattggctggaaacagcctggaggaagtgtggcctttaagcaaatgtggtggtggattcagaggagcagccctgttaggcaaccatgttccttgcaacaggtggtcagggtggaccatttttattcatggccaccagagccatgcactgtgctgagttctatattcatgatcttatatcatcttaatataatcctatggaggtaggtgctattagtgtgcccattttacagattaggaaactgagacacaaagaatttaagtagcttgtcctacagtcaagaaggcataaagggtattcagactcaactctaagtccagagtcttaactgcttaaccatggcattctattagagaaagaatggaattcaaactctggttctataatgtattgattgtataaatttgaacaagttatttaaactcttaaacttttattttctaatgtataaggtgcgatgtcatcaccttcccaggaaatgtgttttcgttgctgttttgttctgagcacaaacaacgttagttccttttccttcctcttgttttgctctcatctaggattgtcatctcttcctttatttcttatctcatcttcccaggtatctgcctcagccttgttcaggcacccacaggcttaactacatcctcagaactaacaggactgtttctgtgtggattatatgtctggatgtagatatgtggaaagtgctgagcacttgcaacaatccataaatagatactcaataaaatgtagctcgccttctctctcatccacctcattgcctcatagacatgaactaggtgccagggacatcttctttttaagtttcttttttttttttttttgacaaaatatacatctttatagaaaaattacattcttatttttttatgaacactttgttctttttttctacagtctcaagtattatgagtatatggtactttaatagatatttttaaacaatggactgagttttcatttgatttttctgctggaggtggagactataaaatgaggttagttgcaaggtatttataccagatgccattatgtttgttagatggcataaaacaattatgattgccaataaatttaaaagtgtttccgttgcaaaagatttaggagtatagttttactgaaaacataaaatgtttcttttcattccccattttttgtgcagtacaatagaaatttgtgccccattcctttcattttagatttctgaattatttaaaagaattggttaattctccatttcaagtgagcaagacaaagttcattaggatatctgattcctagcaggtcccacattcacagatcatgttaactccatagagaggtttatcttcttttaaaattacaaatgctacccacactgaaagcttttcagtttaatgcattgttacagctttgaactcttcagtaggatcctaaacaatagaaagaaggaaaatgaagcaccttgttgtccgagcttgagccagttctaaaagtagcagtgcagaacgtctatgtcctttcaattctagtggatttgcaacacaatatcatgaaaggcatgcaagtaaaccttagcacgtgctccaccagtagttaccaactggtggtccttgaagggagccagaggaaaaatcttaaattatgcattttttccccttatataaagctgcactggctgaagatttttgcttttgactttatgcttgtgaactcatgggttctcttatacttacagagactctggcagttatagtttggattcatttaatgaaaggtaggggaatgatgaattatctattatttagcaaagatggtaaattaaatactttgagaagctggccttatgagaggaaatgattacaagttgtccttaatggtaagaagatacagaagcctgtgctgtagaccactggttaatagcctttaactttatcttaggaaagacgaagaaagaagagaaaagcaggtgctaggaatagccagtcaagactggttgttgcaggtgctgcccgtcatctccattgtacccctttccggtgttctttcagcagatattgttgaattcagttctatctgagcagaattgatagtgaggccgatgtggaaagcaactcagagtaggagactcaggtggtacttctgtatgtaaattgactaggaaagcataactttgaaacaaaagattctaacaaagtttcatagcccaatcacatgtaagtgtgtagaacatttgagttttggactctgatctctgtggatttttttctgtgcattcataagagaggcacaaaaattgactgtggtcaaataatactatgtactgtaaactttagattgtttgaatatgttaatttgatgtaataattctaagatatagaggacaaggaaactgaggcttggaagttgaggcacatgttcatgatcaatagcaagtgagtgcctgcttcatctttcttgggagagctttgagaataaacagggataacggatagtggtgtgctttgaaatgttttgtactcagcagctataatctcaaataatttgtattgttaggttttcaatgtattgactattctgtccccttaccccagggaaagtatagacttgaggtcagggaataacaatggcatatgacatgtaagtatggtgacataatgtcatatgatatactacataatatatgtattatagtgttacatgcattatgtattacattattgagtaaatatgtattatattacaatgtgtaatctgtagtccttataatctattaggactttgactgaacaccagtcaatgaaaatagtaaatgtcacagtatactgaaagcgaagccagtgagagagagtctgcagaattccacattttcctcaggatacctcgcagaccatgggtgacacatgaccacctgacattggtaccaagtgagggagaatgcattattagaaataaacttatcgtttttcaaagacgacttatttttaaaagctacagtataaatggaagctccagtgatttctttggacaccgcaaatttgtgttttaaggagaccactattctagactatgtgctccctgagggcagaaagtagtgtattatattccaaacaaaatggcactcagtaaatattttagggtgaatgaatgaatgggtaaatgaatgaatcttgtgttcaggagtttaagtcttttcaggggaaaataatacataatcataagttattcccctccttccaattgatctttcttaattgtacatatatttattaatatataatccctgtgccaggcagtgggcatatccacataaaagagaaaccaaccccatactccttgagtacatattctagcaaaggatacagatatttaggcagatagttgcataaaatgtgattgtgatctcctaaagttatttggatggtgtttggggcatatggtggaggcacaagtgataaaggctatgcaagaagcaacaaaagtaaagttagaagtgttcagagaagagcttgttaggtatttgacctaaatgctgaagtgtatacatgttcctagatgttacttagagctttcttgctccttaaaattagctcaaaccccccattccacaacctgaggaaatctaaagcctatcccagtatttctgtgcatttctggggatgcttacagcaaaagttttcttctagctgtcagttcctgcacctgctgagttagtttactttatagatcttcccccaagtcgtgcaatgctcttttccatgtcctgtgcccgtatgttgggttgagcaccttctctgtatttctgtctgatctacctgtagaaattatgtgtacagctggctttggtgaagttgtaggagggcgagtttgggcacttcagtaaagtctcagaacatactaaccgcatcacattgattttaaacaactctgtttttaagagcacttaggtcactctgccatgttaccattgccctctcttcctccctccctctcttctctgagcctctccttgttcttctttagttttccttgagccttgcaaatttatgttcttgggaatctcctttgtaaataagaaatgtgccatcaagatatttcccaatcaatggattctggcactcttgacaaaatgatagatggaatttgcagtttctgtgtgtatgagagggaagatgcaaagtccttgttaaacaaaaggaacattatgggtaaaggcctaggggcagaaaggacccagcatgtaaagctgcagcttggctaagacatagtgtttctgaacagtttcaaatacgccagtcatatcatgttgaattcttggatggccagtcacccagcgtgtttcccttggaatgaagcttgctgactgactggctgacagctagaaagcatccataaatgagagatggagatgaaattaaaatgtgacttctttggcatccacctttcgaacctaggccttccccactttactctaattcaatttagtagatgttggatggaaactaatacagttaaaaagaacttcatgtaatctcactaacattcttagaacatgatgctcaaggttttctggtcaaggatatttgcatttgcatttatagaatagttaagagccagaattctatgcatgtgagaagtccttgctttgagaatgacatttccaagctgtcaaaatctaatgtgctcaaagctcaaaccaaaattgctttttattctgtaaatattgaagagaaggcttagagtggcaccagtgaagttgctagccagggtactagcctactgagttggaatcagaaaaagtccatttgttgagtttaaattataatacaatccaagcctgagggatgcagtgaaaaagtatgaccagtggtcagattcccacattttcctgctgaccacttggtcactttgacacagtttactagagaagtttgatttgcaggtgtgtaagcacagtacatgcatctttgttacttgactcttctcatctccaatttcttaatgcttacattgaactacaaaaatcttcacatgaaatcttcccatattatattcactcattcaaccaatatttatttattaaacatctgctgtatggcagatactgctccaggcattagtcacaagagtgatgaagcacagaaaagtaaagtttcatgcatccaatagcagattcattgtagaactgagagccttgatgttcggttccttgtccagctttctttctcctacatttctactctgcttttcttacacttgctgtttcaccaaaaaaaaagttacttgaaaggcgattgaaatcattcttttcatttgccaataagttgtaaaggttattggaaagtcatttgtgtaggattttgaatcagtttaacacagttttcatattacatttatgtgtgtgattttctgaataatgcctttaaaggcagacattaagtggattgcgaactccatgaaagcaaggattgtttttcttttttactcactgttttctctttagcacagtgcctatcccatagtacatgttcaataaatatttactataaatgcagaactaaatgcatttcttatgcttcgctatatccctgttgtctggtgcagtgtgtgcagtgtgagctctctctgagtctgtcgctggtaagatggtgaacagtgctgtccgtattcagtggacttctgtatagagcatgtcattcccagtctatctcgatattcagtactcgatattcagtacttaagtgtccagtcaagcagcttgtagttttccttgctatgttggggtgggtactctggtacctggaggccccctggctgcagacacagcaagatggtttcgagcagggtgtgaaatgtttgctgccagtgagggagaaaggtttgccttggctaggagtagcaggatttcaggctccacatctgggtcttccgtctacgtcaccaccaccatcctcatatgcgcatagccatcagctgtcctaagtgcagcactctgacagaaaattgtatacgaggcagaggtggctgtaactagtcaaagtgtgagagaaatactcattccatggcaaagctgactgacatgaagagatctttgtgctgagagagattcagcaaagggaggccagagtaaactaggagtgggctccgggttagagttgaagcaagaacctgtatgaaaagaaaggcaatgtccacctcatatttcctagcagacataaaagacatggtgtctctcttgctcagtctttttcatcatcttactgggttcagaacatgggtaaagttcgaagtggtacattggataattctttcgggcagaactttgttgaaaggaagagtgtggtcgtctaattggagcttggcaagtgcaagggtgggagagaaagggagaccctaccttgactccaccgctcacctggctgtgaaacgctttaagaacagaaacacttactaattgtaactggccttaggaaggtacctgacctcccgtgcctcagtttcctcgtctgtaaaatagtcacgaatgcttcttgcccttctttgctcccaaggatttagtaaggatttaatgatatgatgtatctgaaagcactttatgaacaatcaagccatatgtaaaatgagctattgtaataattttgagtcattaggaattccttcatttccatcccaggtcccctggacaatgctgagaaaccagtggctatattgcatattttcttttcagcccagcagtactcattttcaggttgaatatggtaacaaagctgttgcataagaaatgcacactcctctcttagggggaacattctttacattcagcacaccagtgcacccccatgactgcagagtactgcagggtactgaaaggtgtctttctgtgtttaccgtggtatcactttcaccctctattctgaactgatctggcattctaagattttcaaacataatctttaaaagtataagcatccaaaattacctcaaagagccaaaacaaataaatacaacactgaataaatgatgctccagttgatccagaatacacttaagaaatcttttgactctgttaacctatcagtatttgacttcagattgactcgtttatttattcttaaactcccttgaatctccaggcttttttcttatttgcattgagtatgttctccccattgacattcagatcactttgaattggcttttacttaggcttttcttttttggagacaatcagctcagagacaaaataggcttaaaccacaaagatgttttagtaaatagatacatttcattagttgctgagggctgtaggaacacagttgtcccaagtaatttcttctttgtatttggtgatcttaagaggaaatattagtgtcctttttcttaagccactggtctaaaatatctgtcaagcataagatttaaatccctgacaaacaacttctaagattttagaaaaagttttgagtaccttgtgattccaactcttatctctgcttttgagcctcgatttctaccccctcgtcatagtccttacccacctgtaactttaagacatcaaagttcattttaaaaaagaaaaaaataataagtttcatagaaagaaaacctctcatatatattgggagggctaagacaaatatgtttctcttttcatgcatttttctggttgaactgaattctttcacctcctcttagaaaagtcttcgactgtgccagctagaagtacggcagaatgggtaaagtccagccttgctaagacaatttttttggtctgtggtacctacagaggaggttcttacttataatgtgaagtacatggcataaactggtggagaagagcttccttttgttaaatcgttcatttattccactggcctaatgaaagttatatgaaccacaatgagtcacaacaattaccagtttaattcattttttaccctgtatttatttaaaaggtttgctctataaatataggacctgtagataaaaggtttctctaaaaatcactctcttttcaagatgttttcattagttagtattcatttaagtgggttctactctgcataccattaaaggtgtgtgtaaatgtttttattggtttcttccctatcttccacttttgtatttcctctataagaggcagtgccattaaccttagcagggctgagtgtgattgtctttcgatcagccccatcattgcaaaccactgacccatagcttacattacttaaaccactggttcctaaacagaaaaatagccccattaccttccttggaatggtgatgggctgtctgaaaagtcctttcaaaaagaagagtgagcaaaaatactccctacttcctttgagaatagtcctttctttgatataaatgttgcggtagtagtacctgagtttcctattttaactctacatgaaacatttattgagtgtctgctgtgttcagggtgctgttgaagacacatggctatagcaacatgttttggatgcagtcctttaagagccatacttttttatgcaggtgataggcaggtttgcacctaataacaatgcagggtaaatatgctaagtgctctaactgtgaaacaaagtgctctgagaatgtggaaaagagaatgctttaattcagactttagggacaggaagcggaaagttagatttcaaccagcagagaagggtaaggaggatagagaaagaggttccaaaaaaataaaaaagcacccccaaaggcatagtgtggtctgaaagtttatgatgagcttggataatcgccaagtagtgtggtatggcctttgcaaggtaatgaggggatggaggtaaggcattcatgcttttgtataactgatacggtttggctctgtgtccccacccaaatctcatctcgaattgtaatccccacatgtcgagggaggagggagctgtaattcccatgtgtcaagggagggaagtgattggattatgggggcagtttcccccacgttgttcccataatagtgagtgaattctcaagagatctgatggttttataaatggtattttcctgtgctcacacacgctctctcttgcctgccaccgtgtaagatgtgtctgcttccccttcaaccaggattgtaagtttcctgaggcctccccagccatgcagaactgtgactcaagtatacctctttttttaaaaaaataaataaaataagttacccagttcttggtggtattctctatagcagtgtgaaaatggactaacgtactacccttttagataatccttgcagcataagacaaagaaacgatcagttcacctttggccatggactcactgtcaccagagcttgctttaacccaattctgtagttcagccagtcagaatgttggtagaaaatgcattaaatcaggaacccagaaaacaggcttctattcctggctcagctattcattgactatgattttggataaataactgtttctctctgagccttggtttacttccgtaaattggagataataatactacctacctcatggctgttgagagtcttaaatgagaccatgcctacaaggtgtttagcagggtcctcagcatatagccagtactcaaaaagtagaaacaacttaaaaagatttttatacttcattgcccatcttcattgaactggactttattttacttattgataacttacaacacgctgggagaaacgtcccggtgtttcaaagtgactgcgttaacttggaaaataagatcctatttatttccttccgagtaatagtcatcctaacatactgctcacttgtgtttgtagagtagttattttgaaatttttgagacctgaacttatgaaatgtactttcatgcatttctaaaataattgtatactagagctcttttccattgcttgacagttgttcatgagtgttccagtgagtttatagaagctaaaaagaagatgatcttctctagttacattctaagtgctgaatttttccttccttgacagattcccatccggtatcaagaggctctaaagatccctcaaatcactgttggcatttagtgccattccagcaattttgcatcttgatctttttattgattagaattttaccttccttttcaatcttttgaactctcttctgaactttgaagactcaagtgtttgaaatcttgatctgggtctgtcttaggctatacagaagagagctttaacttatgtttccaaaatgaggccactacctctttaatttttctttttaatttaatctcaatgtctgtagaagaaaagctttcacttaaagcacaaactttatgaaaagcatttttgttaaagggaaatcttaatgggaagaactgtagataacaaatttgaggaaaatgtctggcaacacagacttctgcaagtttgaggctcttggtgaaatctcaaacagtccaaatggaaaattacccagtctgtttcctcaagatagacttgtttgtacagcgactcaaagtttaaatggctgaacagtaggtacacacgctgtacttataagctgtttgtattacaatgctctgtttttaacctccttttagtttggaacacaagctggttaatgtcttagttctgtgcttcctggattattagtgaatagctaagttgtatttaataaacagaaagaaagtaacaaacaggccaataccttcactgagaaagcttctcatctctgagatttttacttctgtttgttatgcagaatattttaaaattagataatgttttatactcatgagatgaaagagttttcaaatatctgagggtttgtgagtatatccgtatttttgagagtcccagtaaaagtttctggaacttacaaaaaactcatccatgagctggccaggtcctctcaaggagcaaatcaactgaggatgacattaaaaaaaatttttttaacttgtttcaacagttgttttccgcatttccacagtaattaccatgcttaccagtaagatacaattcatctctggatcatattttatgtgttttaggcaatagcagtgatagctaacaattacactctagagttttacaaaacacttgcttatgcgttatctcatgaggtacctgacagatcttctaagtataattttatgatattccagcagatctataccagtttcactagagtatgagtaataagcatattgaatttttaaaaattgacacctgtctgaaatttttaagaacaaggccatttagaaaattagatttcaagaactctaaatacttacttatattatacaaaaatgttacagaaagtaccattaagcatggctatttctatatattcttcgatagcccacagaaatttatttaaaataattctccacaatgactaatccattacaaccaatattgttttagttctttctcatgaaaatagactactaaaattatagtctttctagttacccagtatacatatacacatatatatatgtatgtatgtatatatacacacacataccatatgtaagctggctatatatgtgtatatatatgtatatacacacacacccatatgtaagctcgatatgtatgtatgtgtttatatatgtacctatacacatagaggtacatacacatgtataaacctccatttttataaagattggtggcttataagaatacatacagtaagatagaaaatataaacaagtaaaaaatgagaattaggaaatacataaattaaagtagaaaggtaaaaatcagagaaaaagaattgaacaaaggttctaccatatggttctacatagttaataacattgagatataagtttgattctgagtttcctggcagccaaaggaaaaagagaaacgtatgattaatcatgtggttctcattacccatgagaaaatacataccagttcctcaagggaaggaagctttccctggcacttaattgtgatgtaaatttctcacgtagaacttcagcaggaggacaccgggtgatatgctaacagtcagtgctattcaagtagatagactaaaggatttggtaagatagcttcttttagggcccactaactagaaactgagaacctaatacaaaagtgtaactcaataaaagtgattctgagtgatccatgaaagtaacttgctgccaatccatcaggacttttataagagctggagaaattcacatcatgaaatttataaatcctgagaagcaggtaggtctcatagtccttggatgattttaaatatttctcacagccaaacttttgattaaagctgagccacagacagttcccattggtgttttttaagaactgatattttcttaaggactcgactttacagagtaaacaaacaggattggccttacaaggtaaaaactgaagctcctgaatataggaaaagcaagcatttacccttgtggttattttttaaagtgctttttaaaaattcctctcattatcttcccttgatagatttcctgaagatttatttaacagtataatgtctattgttatttaaagagaaatgaggtttagaatgcagagccttttttaagagagtatgaacatgctgatttagttcacctccaaacagaaatgattgacatcagattcttcctgaaagcagtttctcctgtggaaagaactttgggttcttcaaggggagtgaaatggtaggttctgtctgagccaggtcacctacaaaagcaaacaacaatgctgtttcctaaggtggttgttggcagcacttagccgctgctgacctggtaacctttcctttgagtctcatccatagctctcctctgagagagaactttcccatttacaatattacttggacacactactgttgcttaggaccaaaagggttatttacacaggggagatagtggtaggtgtgaaggtatgtgttgtgacaactgccatttacccatgcagtgggcagagtttctcttttgaccttgttcattcatagcagtgaagtgtgggctaggacctgtaacatctcctagttttaaatgctccggatgggtactctacaaaagtcttggtcatatagaacctatatggaatgcagtcatgttaagaaattgttaagctgttgatcatgatattatactgttaaacataacagtacaaaaagagggttttgttctccaaatagctaattcatagctacagttatttttttagtgtacaacctcagatttatttcatcagagagcaactgggaggtcccaggacagtgactaagtgggaatatgcagcaatgacgagtaaaagcttagtttctaagaatctcagtttttgtggaaatcccctttagactaatgatacaagagaaaacatgtggtgtgtgttgggtagatcattccccaacaggatgttttattttttgtgtttagtcttcgtccatagtaacaattataatgaatgcatcaaaaataaagcctgcagaccttgtgacctatcttgtaatcagcacaaattagttttagggcaggaaaatccagctgcatattagttttattagatgttcccaaacattttattgcaatattttggaaaaaacatccacaaacaaacctaagttttcaatgtgtttcctattcaatatgtattttgttttgaaggataattagattgtatgtttataattcctttgttcttaattcatcaaattgctgccttttgggaaaataatttcagcataggaaaattactctttttttcaccaacctgttctcagaaagggaaatgtatctttagtacacccccaactcccaaaaatgttctccacattctaaaaatgcttttaaaagttcaaaccattattcctcatttggttctaatgatattgaaatggttttttcctattttgagggtcacaattgctactgttaatctaatggctaaatgatctgtgcactgtgtctgcttttcatcttcattctctttttattggtgaggaaactgaggctcaaagcgattaagtaccttgcacaggtcaaatggcttctaagaggcagaatgtaatcattccttctctcaacattcaggaaatatttaatgagcccatactttattccagataccttggtagttgcacaggatacatcactgaataataaaatccctgcccctcaaggagcttaccttctagttgatggagacagataattaaaatatcaatgagaaaagtatctagtgcatgagatgataataagtgctatggagaaaaattaagaaagaaagaggaatagggagtccagagtagttttggtttgaaaggcaatgatggccacaaacacattgctaagaagttgacatttgaacaagacctagaaaaggtgagggagtgcgacacacagatttccttggggaagactagtgtggatggaatgaagacagcaaggtgagcaggagaaaaggaactcaggtaaaagcctggggcagttcatgcaggacagtggctgtttgacttcagcagcataagaatcacttggaagtcttattaaaacacagatctctgggcactacccttacagtttctgattcagaagtttgcattcctaacaagggtccaagtgatgccagtgccactggtccagggatcacacttgagatccactgaagctattgggaggctttggcttttcctcttaataacatgaatgccatttccaggaactgagaataggagaaacaaaatctctttatgctgttccgagtacactgtaggagacaagggcagaagaagggaaaccaactagggttctactatagtaatcaaaataagagatcagggtgacattggccgggcgcggtggctcacgcctgtaaacccagcactttaggaggccaaggtgggccagatcacttgaggccggaagttcgagaccagcctggccaacatgatgaaaccccgtgtctactgaaaatagaaaaattagctgggcatggtggcacgtgcctgtaatcccagctactcaggaggctgaggtgagagaattgcttaaacctgagaggtggaggttgcagtgagccaagatcacgccactgcactccagcctgggcaacagagcgagactccatctaaaaaagaaaaagagagagagagagagatcagggtgacatcattgagctatgctctctctccattctgagtttatttgaggttgtcctctaaagcaaaagcatactaagcattagttatgtcaacctaaaattcctttggttaaatcttcagtttaattagtgtatgaattccttttcaaagagctgcttgcccacaactttgagaaacgggtggaaaatatggggagtttatagttgggatacgtttcaaatatggctgacaaggatctgcctaggaacatggaactcatagaatatcctcaggaggcagtggggaacaggacactgagatggtccatggaagagaaacaacagttgttcttcaaattcctgccatttgatctaagatctgatttttttttttgtaggattgaagagatgaaagttcccctggtcccccaaaattttgtttatagtacatacaaatgctccctgagatacccagctgtatgaggaataaataaggaaagagaacaataacgtggcaccaccttttcctccttcctgatgtacaaaatgagggaaagtcataaacctccaattaataactgtgcaaccttgctcaagtctcttaatctcatctgaaaacaggaatagtaatagtgcttgtctcatagcaggggttaagggagggtactcatcaaatgttagctgcaactatcatgatcacaatgaaatgtaagtagatttctattctcttttcaagatggagacttactggtccctaaccaaaattcttactgtatacaaaaatagtgtagtataaagtaagtcaggggcaaaggagaaaacggtggaaatgcggtgggcatgggagtgtgaaaagcagtaaccccttaaaaggagagagaaggaaaagaagtcaggtagaaaatggagatatggtagggagcaggaatgattgatattaaggtagccagaggcaaatacaaaggggaaggaggggatgggaaggggtggcagaagagaaaaggaccagagttcctagaacctgttagcagggcagaggttaaccataagcaactcattaccatgccccccaaagcatcaggccagaacctccgttaaacacaagacggccattggctgcacctgcagaagtctctgcattttttatgaacagcagaaaacaagagaagtattagagaggttgcaagttagagactggagacacctggagactctacatagctgtggtggttttgcagtgtagacttatgaaatctgatacccccatgcagtcctgttaggcagataaactgagagcctagacattttataagcccccatgtaagcatttgaggggtaggattccttcaatgctcttccaataggatggaaacagaagggaagaccatcctgtcttcagggcttgccctcttgtttaatcctcagatggacaacattagtcccgtttaacagaagaagactctgaggcttggttagtaaaagaatatggccagaatccagacctggagcctagctccaaaggattgctttcctgttagcaagacactgtcttcttttgattttttttttttttttttttctgagacagagtctcactctgtcgcccaggccgaagtgcagtggtgtgatcttggctcagtacaagctccatctcccgagttcacaccattctcctgcatcagcctcccgagtagctgggactacaggcacacaccaccacgcccggctaatttttgttgtattttttattagagacagagtttcaccgtgttagccaggatggtctcaatctcctgacctcgtgatccgcccgccttggcctcccaaagtgctgggattacaggcgtgagccaccgcacccagccttcttttgattgttttcggagacttgtactcagcctttttgcttctctcacttctctggttctctacctgcctaccttttagccatttcacctatcatcctggagacccagattttgttctttttttttttttttttttttttttaagacagagtctcactctgtcatccaggctggagtgcagtgaagccatctctgctcacgcaacctccccctcctgggttcaagcgattcttgtgcctcagcctcccaagtagctgggactacaggcgcacaccaccatgcctggctaattttggtatttttagtagagacaaagttttgccacgttggccaggctagtctcgaactcctgacctcagatgatccaccaccttggcctcccaaagtgctgctagattttgttctcaaatagcagctgtaggatttggtgtggtattttttcccctcagctgttgtttcttgaatgctttctcttgttcacccacttcttctttaccacttaccatgattaataacaaggtacctgcaaagtaaggttttcccctgaatacttcctagatggtggaggtttttcagaagtaccacccaacctcaaaaacacatagtggtccacatactggccttggagtcctggaggagttattctataggaacagcaaatccatgcacagccaggcattgtctgtcttgacatatcagggtacggaaaactcttatgctgtaagaagagtcacactaagccaaagtttaggaaccagcctgctccagtatgccttttggaggacttttcttttctaattcaccttgccttcctctgtcacatctaacccaatactgtccatataggaaaaattcagaaagtattgggttggtgaatgcagcacagattacctatttaaattaaagctgtgtctttagggaaaaaaacttctgggggatgggagcagtggcatgagcttggaaggatttttgcattctacagcaaaccacagctgctatggccttaatgtttgtgtccccccaaaattcatatgttgaaatcctgactccatggtgatggtattcagaagtggggccttttgggagactaggtcatgaggctagaaccctcttgaatggaactagtgctcttataaagagaacacagagagctagctagcccttctgccacgtgaggatgtggacggtgtgatctatgaggaagagtgctcccactgggtaataaatccgttggtgccttgatcttgcactttctagcccccagaagtgtgagaaatagatttctgttgtttataagctactttgtttatggtgtttcgttacagcagcccaaaaggactaagagaacaccaccacccaacaccagaaaatgggatttgcttaaaccaatctgagaatcagtcacctggataagtgtgtcgagtgatccattgaatcagccagcaatgcataaagaatcatttccagtacccacatatgactgtgcttctgttttgtgttttattaagttgctctggagtaatgccactatcagtgcttccccagcacaaggaggttggcaattgagttacctgtttgtgacagctaaactttcatgaatctttaggagatccatttgctagcatcttttaaagactctggatttttctgagcattttgtgatgataactgatgcatctgaagtagaggtgggagcccttctttgtcaagagttagaaaatacaggctgtcttgtcttcctataaatgtcagttgttgttgttgttattattattgtgtcagcagtaaactgctccccagaggactaagatacagcattacagagagagcatgccttgctgtgaaaatgggtagtagaagtatgatgatattatttcgtggtaatgaatttacctttatgacagatcattatccccttctgtagctgaactggatgaaggacaagtctagcagaataacctggtagtacttggatttattggctttaaatttttaagctggaaaaatgcagtagcagccaggttatctctgtatgaatgttgcagaggaggacagagatgaaggaagtcacattttctttctagtaatggtagaaagcaggtgatgatgacagtcttttaacgaaacatgaatgcagttgctcatatgctttgccattttagtgcacaagtcaaggagtaaatgagtagaaaaaaatccataagatatcatcatcatcaataataaaaaattgcttaaggtctcattgagtgttacaccataggaaagagcaaagatttctttttaaaatgagttagacgagacttccctctcaggtgtgtataatccaggttcatgctttaaaggctatatgtgaaatagaactgttttatattagtgagctgttggggatagtaagttgcagttttgcataaaggcaaaccatggtacagtgaggatggtgcccctgtgggaagaagatgggcttggaaatcatttaggtttacatcctggctttgtccttttctagtagtgtgacctcaagcaaatcatttaaactttctgtcttagttttctcaggaagcaaagaagttagtacctaactttcagatttctttgcagctttagtttcaggtacatagtaagtcttcaataaatgatcactattgctgttcctgctgttgttattgctgttcttgtcttgattcagaagccctggtggtgatactccatgctatattccaaggagtaaccataacctaattattttgaatgactgagaaccagtgctgatgtaaagctccctaaacccagcacttctccagaagccgtaagaaatccatgccatcatttagtaacctacactgtagggctaagatctcaatccgttttccatttgcacactcatcagagtagatagagactagttgttcactatgtctgtgaatactctatagagttttccccagcttcctcctttcctccaattttccttacaaagcctttccttctttcgtctgagctctaacactttgtacgttgtagtaattttatggagcccagtgccaaacatctctatagaggggatgttgtaagggttgaatatgaagagaccctacatgtgacgtgtgtcctacgaatcttggagtcttgactccttctccagtgtcagtactcgttatctttaatttggggccagatatgagcaccccacacactttccaaaaaagcccccgatccacaaatgtatgcatgatttttccttacataagtcttttcatgtttctggacatattttatctcccttcctcctctaatactttttcccttgctttccacagtgagaaaaacaacaacaacaaaaaaaaaaacacaaaattcacacaaaggcttatgtatataaagacatggctccaggttctcatcagttcaaggagtaaaagcaaattccaaaagtatagaaatttaggtggatgtggccgggcgcagtggctaacgcctataatcccagcactctgggaggccagggtgggtggatcacgaggtcagaagtttgagagcagcctgaccaacacagtgaaaccccgtctctactaaaaatacaaaaattagctgggtgtggtggcatgcacctgtagtcccagctacttgggaggctgaggcaggagaattgcttgaacccaggaggcggaggttgcagtgagccgagattgcaccactgcactccagcctgggtgacagagtgaaacgccgtctccagaaataaataaatttaggtgaatgttaccttctccctttaattttctattttatagaatggttgcatgcaataaaagcagttgcttctcttttaactttttaataaaatggaagtctgtttttaaagccatttgctttgaatatgtaagaatacctagagtgttttaccatggtagagataatttacaaagtaagacccagttggagttgctcagttaagatgtatctcaggtgaaatgttaatcaattcaatgtttctttgtgttttgaaaatctctttagtgtgctgggccgatggccacattttctgctgtgtatatgtgatatcaaactttaacaagtctgttgcaacaaggataagacacagcagtaggaaaagaccactggagataaaggggctcaactctcttcccagtgagaactgccatgttatcttccatctgatcacattactggaagcttactactcttcaggaactcttcagcactttacccaagctccagtgaggaggcgatgctggtgcttatggggtacttggacaagtagaggctctccctcgcttgtcaaaatgcctggggaggaagcaccttctgccatttagtgtatggggggaaaaggaagagggcagtgagggatcttaaatgtctcgtaatgctctggatagacctgcctaagaaagaattaactttccccaaatgccagtcacgtcccagttaagaaaggcctgcctggttcttcagcctcatcagtgttcccagaagtcccagctccagccatcacaaaccaaacgtgccacttgccttctttcttttctcttttcctttcttcctccttcccctcccctctcatcccctcctcctgcttctccctcttttccttccttccttccttccttccttccttcctctgaatttcctgtatatcctctctgagaggccttacttagatgccacttgctctgcgcttttgttgcccctggcacacatgtgactccacctgggtggtgagcccactgtgtgctctttccactcttactcacctgtgcaagctcctgatgggcaggtcccagtctttatctctgtatccccagtactgacacagtcctggaacatagtaggcccttggtgtgttttagggaaatgaactaatgaatagtaggtatttagttagtattgcatcgcgttttctgaaagtaattttaaaaaaacacatactgtaggccaggtgcagtggctcacgcctataatcccaacactttgggaggccaaggcaggcagatcagctgaggtcggaagttcgagaccagcctgaccaacatggagaaaccccatctctactaaaaatacaaaattatccgggtttggtggcacatgcctatagtcccagctactcgagaggctgaggcaggagaatcgcttgaacccgggaggtggaggttgcggtgagccgagatcgcgacattgcactccagcctgggcaacaaaagtgaaactccgtctcaaaaaaacaaaaaacaaacaaaaaaaacatactgtagggagttcagtaaaaataaggtcaaggtttctcagcctcagcaccattgacattttgggcaggatactttggtgttctgtcacgtgcattgtcctatgtgtgggtcactgtcctgtgcgttgtaggatgttagcagcacccatggcctctactcaccaaatggcaggagcattccccagtagtaacaaccagaaatgtatccagacattgccaaatgtcacctgggggcaaatcaccccaactgacaatcatcaaattaagataaaagaagaactaacatattgaattccatttaataaacaaaatttctatatgttgtggcaccaataattcactaatccatttagtaaacacattatggaatgatcttcaaattaatgggctgtatagtcttaaccgttaatgtttgagtattctgtaagctcttaagaatttcagtattataaaataatccacccaccctttggaggcttgaagcacctccaccagtggtgaagagccctttggaatcacctttgcagtcataggctcctagaaataacatcaggagtattaggaaatggtgcccattgcattcctctcccgtggcctttactgggaactgtgctggagactgtgttatttcatcggggttggctgccaccaaagtgtggggagccatatgttagctattctgtgcagtaacacctgcactctatatcacaggcaagcttatatgcctgtaatgataagcctgcctatgtagacttgtgagtgcacagttgcagcacagttggcctgctctttgggtgtgggaagtagagttcatggaggtaaaccattgccaagcaagagatttgtactctccctcatgttttgtccatgtgaaacctttgtaagtgcagtgtccacatgcccaaggggccctcaggtaaaaacacagataacaacattgctccagggtttttctttattagaattctgtattgtctaacatgattggtaaaaccaggtgagctcctaaattgtggtttttagtgacattctataattcactgctgaccttctccccaatgttgtgacttggaaaaaaattcaaattaagacttttttttttttttgagacaggattagacaacgtggtcacccaggctggagtgaagtggcacgatcatggctcactgcagcctcaacttcccaggctcaggtgatccttctgagtagctgggactacaggtgcatgccaccatgcctagctaattgtttgtattttttatttttttattttttagagatggggtttgttatattgctcaggctggtctcaaactcctgggctcaagtgatcctcctgcctcagccttccaaagtgctgggattacaggtgtgagccaccatgcccaacttcaaattaggacttctttacaataagggttattctattcagaatctcattagatgttaaaaaaaaatcaaaccaaaacaaaaaaatactttttagtaattctgtcccacaccttttacttttaatttatattacttttaatttgttctttcccaccttttactattaatttggtgtcgctttatccttgcacatatgaacagaaatatagtaaattaagtagtaggcaaagataggccaagtcaaggatagtagtagggcaaggatagagcccagagggaagaagtagaggggaagtgtgttagcggtgacaaattgtattcagagagaatggcttcagtggtattgataaggaagaaacaaccttcccaccaggttgtttgatgaaccacactattagaccattcttgctttgctataaaggaatatctgaggctgggtaatttataaagaaaaaaggtttaattggctcactggtctgtgggctgtgcagggagcatgctgcaggcatctgctgggcttctgggaaggcctcagggagctttcactcatggcagagggtgacgcaggagcagacaggtcacatggcaggagcgggagcaagaaagagaaggggttggggaggtgacacacactttacaaccagatcttgcaagaactcactatcctgaggacaacaccaagaatatggcactgtttcattcatgagaaatctgcccccatgattcaatcacctcccaccaggccacacttccaatattggggattacagttcaacatgagatttagagggagcaacatccacactctatcagacactttccctggactgtaaagctggagttttggtttgggtaaaatctactgagtccatcatttggtgagaaaaaaaaatctatggtacttagatgtgcacatcaggaatttgtatgtacacattgattacaataatggttataatccatcatcatcttccaaacctgttctaagtgcttccgcctctggagtaggtgttcttactcgtgcaattagggaacagtgccttagttaattacattgcttcagttgaaatcccgactctaccagttactgtctgtgtgaccttagactgtgctttatctgtaaaatgaaattataatatgtaatagcacctacctcataacactttgaaaattacaggaaataacacatggcaaagctgaggagaatatctggcatgcagtgagcactcagtaaatattagctcgtatcactttattgttattgttattcttacaaccacaaaaaaactgtgtcactttcctgcacttcacgtcactaatcctgctggtctttgatgacttgtataggccatcactgcttccacaaagccttccctagccctttcactagtttaatgcccccctctgtgccctcagagcctgcttccactaccagagcccttaccacattgtattgtaatgcttcctctgttggcctgcctcccctactggactgcaaggacctgaaggtcaaagaggtacactctaatgcctaccatagtacctgaagcagagaagatattcaacaaaggtttcttgggtaaattattgaaagtttaattaacttgcttaaggtcacaaagctagtaattgagtgaaacccatgtctgacttataaaagtaaataataagctataagaaaaatattcctctaataatgataatgcactaaattatgattccacctgattattacttacagaatactctcaaaattacttgaaaccttccaaattttggctctatcatctcttcaaacctctgtctgacaatggtactcactttatactctgcctccaacatatacacttgacttcctatccatagggttatccttgttgccccccataaatttgacttgcactttcatctcctctcaagcagtcatcagtatttattgaggcctacattgcagcgacctgtgatgctctaaggatacagaaatgatatcagaaggtggtgacatttgaactggatcttcctggtgtgaatcaagccttccccactagctgttctttgaaagaagttttgactaatctgtgagcccttgatgacacgaaatattttgatatatgttctgagttcactgttcgtatttgtttataggttggcatcaatagatatttgttgaatgaataaatcaggctgtagagaaacattttaggtttataattaaagcacctgaaacaaaaaaaaacactacatttagcttctctctaacccttttaatggtagttggaacatcagaaattagccattgagcttactgactctttttctaacgatttactgtataagagagcagaatgctattggcttcaccagctgtggccagaagggctccatgttcaaattagctacaaatcatgtcccttatggcattgttgctaatggtgacactgagggtcagaaatgcctacggtagtgaaaaatatttcaagtgcccctgacagttaacatctgacaagaaagtgcttttctctgtgtgggttttcgagggagtaaatgaaattgaactcgcatacatatatgtttgtgtatacatgcataaacatggtactttgcatctggtctgtgactacgctgcaaccttgggagatttgatcgattttctgatgttagaggtaggaatttaactaagggagtattctttggtaatcgcaaagcagaaggacttccatgcaacctggtactgggtagcagccattggctcttaattttgtaaaaatgacagatattcaataaagtatcagaatgattagagggaaaaatattagagctggaggagctgccctacttctgaacaagcagttgaaacaaaggcactcattggaattcatggttggttgacattatgtagcctgttgttgcttaattttgtttcctgtatattttcagggttgtgttcatttggttttagcaataaggacgggtcattttggtgctgtgtctttttagttcacctgcatccttgagttgagagcagagaacagaatgcatatttattttcaatttttacatgttatttcgtatttccatagagtctgtggacttttaggtacaatgatgctgtcgtgaacaaataagatgctgtctgaatgttcctgagagctttagtgcagtgaacacaccttctcagcaacaacaaaaggagatcagggaggcttggccaatgtactctctcgtccacatacggactgataagccaatcttcaaaatcaagattcttccagaaagtccaaattgtcgagtttatatttatagaccacatgtctgagagtctcctcccaacccccctcaaccaaagatagtagtttagatataacagtttttaaaatcaagttctcactataaaatctgagttagatacttgggtaagggtgaggagtagagggtatggctgaggaagaaggggcatttcaaaagaattgtaataatcagtccctgaccttataagagtttatattctaattacagagaatataagtcagacagctcaacagtggcaagatcacatagtactaaatacctgctgaggtcttaaggcagtgtttatacactggagggtattttcctccagggaccatatggctctccttaagggtattcaaaaatgtgtgagggcatttttggtgctcacaaggaggggatgttgctggcattcagtggtgcaggccagggatgctgagcatcctgaggggacagggcagttctaaacactggaactgattcccctccgaatgctgataaccctgatgagaaacattgtagtggttccgagaagaacaagagcgctcttacttggagccgagtctgagatgtcctcaacacgttctgtgagtcaaaggttatgttccctaaaatcaaggaagtggcctggatcataaagtgcttcaatgatcaaagtcagtcaagtgaaatgtgtcgatcattctcctgcctaaaaggccaaattctttcagcattgatttaaagctataaggaatcaagaccctttctttaatgatgctttctgatgattctccatttgtattgacggaaggagctaaagtgtggaggctctgcactagagggtagtttattttaaaaagttatttctgcatttagtgttaatattaattgcttattttatatgcctttttataccatctgaagtactttcacatctaaaaaaatttaaataactttttttcaaaaaaatactgaaaaataaaatcagatttctaaattaaataaattaaattcagtttcctagagcaggcagcatggcatatttagttatcaacaggaattttcagcaaacgaaagtcttttaaaaaataaagtgaaactggaaaaaggaggccatttttaattctttctctatatacttctgtacattatttatgaaaaagtagataaaacttgatctcctgcaagtaagattgacctaacgtccatttctagagtattagtagtcatcatcccaaaaatataagaccaaaatttgtatccttatgtctagaataatgcttggcctctatagatattcaatatgtatttaaagaagagatggtgatttatatttgaaaatatttgaggaattataaacaattattttcataaacacacaaatatatatactaatatgattatatttaggaattagatttctaacatttaaaatagcttagagactaagtactgttatttctcactttttgtagaaaaatcaaaaaattctagagaatttatttttaataatttgttactagctttagaaaataatttttttactcaaaaattcacttaaataaaattacattatctacattttgatttttatagacaacttttataagaatacttgcattatttaacattccatgtgaaaagaatgtggttatttcttaattttttctgttaaaaattccctgtatgattgaagatctaagatataaagattatgtttgttatttataacagttatcattttttgaacacattctgtgttctaggttctttgctaagcattttaagtgtactatttcattattcctaatgacaaacttatgaagtaagtataatcattagtgtcattttacaggtgtggaaattgaggcttaggattttggaattataatttctgtaatactgcccctcctactttattgtaaataaataatatcttggaaatatgatttttgaaagatgaatgaacattttgccatatagatccctttacaagagaaaagacaagtacattgcaaattcaccccgattcatatttagccctgagtatttgtttttttcagatcacaaacaactaaaaactatgaaacttactatgtttgataattacatattttacattagatatataacttacttaagttcaaaactaagtctggagaaggtggataaataagtcaaaattaacttcattttaagggaagttttacaagcaatggtaataagtcgctgaggagaatggaccccggcatgttggaatccgtggttgcaagctgacactttgagggaatgttcttagcaaaacactcacttcaacggaaattaggtcagccttctggaacatttatcatgtatacctgtcaccagcaagacccagtccttaaagtgaattgagatcacaagcaatggtccctcctgctctgagctgcaaaggacactctaaaccaatagttctacaaatatgtgagcttggcagacgctcccatgaaactaaagccaacacccatatagttgctctgggaattgaattccttaatgctttgtttatagaattttgaaacagcaaatggatttggtctgttctgaaaaaacaatctgtcctgtggcttgtttggaataacatctagagttgctatagaaggatggaggcagatgacccatgtctgatttggaagacagtttcgccagtttcttctccttgtcctttattgttcagccaggttggtttttgcccgactcaaggtatttgcatagaggaaaggccaccttctaccgaagctaatttgatatagaaactagagtagttagcaaaatccagagctaaaagagttagcaaaatccagagtaatagaaggtaagatagagtgtatggtaaaaccaaaacaacgtaaatgagtcataacccagtgccctttcagtaatcatatggcatcattctggtggtttcagagcagtgtcagcaagtatggagtcctgtgtaggaatctgagagtgcatctgtgtcagtgtacatgtacttcagcccagtgaatataattcattgagggttttatgcatggaaattaccacattcaccaggtagcctgtatctactggactaagttaccttgccttggaaaggaagtaattactaatctttctcttgtgtttatgtttggcaaactacacctaaagacttcactaaaaaattggtaaaatatatatgaagctggttgaaaaaaagatgaaattatacatatgtttgtgtagtagcaggaatcttccattacatctcaagaatgaaaggaaaaaactattaagaatagatgtttcatttctgtgttcattcatcacagatatactgagtacccaccatatgtcatacattgtacaaatggtagaatcagaaagatgagagaagtaagatccccactttaactgagtccttattcaagctgtgtgtctgtgtgtgtctgtctgtttgcgagtgacagatccttaaacaaaaaataatgataacctatgtgaaatgccccagtagaggttattttaaaactcaaggagagaactctataacttaaagatattttgtctacaaaaaggagcgaaggttttattcgaagaaagaggagcctgttttatatgaaaatcctgaagatttgaaggggctgaagaagtagaatggatatggaagaaatccaccaatgatttcttcctggaagaattaaacacacacacacacacacacacacacacacacacacacacacacaccaactttcatgatcacactctattaagccaggaccaggaaacaatttctaatcagcactctgatctgggcagagattgtgcagtcttttataccaggcctcagatctgtgttctctattcacacatgctcacttccagctgttgtcattgaaatctcacataatcttccaaggtcaaagggcagtcacccatggctgctgcagttaaaaggttatgctgatttctgttgtcaaatattggcccttttctcttccaaccactcccattctacttcttttttttttttaaacaagaaaaatccagcctagaattgcattacatgactttaaagtcttaaaagtgttcctccattgtgctaacacgacatggcctgaacagtctaattcattctgttacatttcacaaagaattttctggtacttctaaaatactttgtgctaggccagcaaacttcaaagtattgtgacccacatgattgtggcctgccatagtatctgcagaagtgaataatacaggttccacaatttaataaacatggtgaattttggcatcgataactaattactgggtaaatgagcaagaattacacaaaaaatgacttttgaaaagatgaaagctctttgcattttgtggttctaaacattagctagttttattttatatttggagacgtatataatagtacatttaatatttggagtcttagaaaagtaattgtaaggatttttaaaaaatattattgcttcactccatccaggattttctttccatgcttggtgaaccaaaatcagtgttgagtatcttaaaattagcacatggcccctggctatctactttcattatcattgcatgtgtcctcaggtggtttagcaagcaggattctctgtaaatggtctgtctcacagccctgtgtataaaacctaaaaaggaagaaaagggagatgggccattacgattttttgctgtttaacgtccatgaaccagggtagccctcaggtgatccagtttcatgtctgtttcacttaagataatcagtttctgatgtattcagggaatacatttccctgttttttccctagtatatgtaaaagttcataagcagaaactaaagctattacaaatagcttgattcatttgcaaattaccagttgttactgtccaagtttagaggaaactttgatgcagaacataaaaacaataagtttgctttttaaaaaacctctttaattcaaaaccgggttaattaaaaaatgttaatttatagtgcattaaaaccataaaattaattttaaaatattaagcttataaaatactgatactatgctaattacagaagaccttagcttttctaatatgatgcaaaattctctgttttttaaaatggtgctaaagtaagtgtttaaatttttaaaataatccctaaagattatttttgtttctctgttcttgtacaagtctaaattttcagttgagtccgcttgcaaaacaactgtttcagcttttaagactaataaatgcataattctaaatgtttcggggaaatggggaaaataatttgttgacatgacgagagagagaaagggagggaggaaggaaggaaaggaagggaaggaaggaaggaaggaaggacggaaggatatttagcctggaagagagaaaattaggttgatgagatgtcttcagatatttgaaggatagtagaaataaagagagccaacatttgttctgcctataccagaggacaaaatctaggtaaattacaagttataggaaggtagacatattcagggaaatatgatttttttaacccctcatttttttattaaccacaatttttttgttgcaacatgacgattattactccactactagatgaactttaaggtcccttccatatccagttcattgtgtgatgccatggatctgatatttgcaaagatacaaataggtaaaaatcttttttcacttttatttttagatattttgatatctaatagacatagtcctttaattgctcaatcacttggaacttaaaactcatgaactttctttctatgaagtcattgggcaatcacatttagtttaattaaatgctacccttcctttattaactgcaggaattggtgaaaagatgtgacaaggcctttggattagactgggtaattaagtctctgatgctaaaaatcatggattaaaatgggataaaattcattatataaagagtggtaaatatacctgtgttctaatcctaattttgccactatctgtgtgacattaagcaagtcacttaacttctcatgtctagtttaaaagcattcctttgcagattaataatacatactgtactagcaaaatatgtttgtagactggaattggcctgagggctgctaagttgtgacacgttagattcaaaagggataagttagtagttatgtgggttagggtaagtgcttagctactataacaaagcaaccaataaaacgcaaaaacatacagtagttaatgtatattgaaatctatttttctttctgttaatattcccagatgagcagcctaagttggcaggatggttctactccacagtgtcattcagggtcccaggttccttctgtcttactgctctgctattccacgggtgtgtgcctgcatggtagaaagtgttttcgctcataaaaaggggtagagacaatgttcagggcaagaatttcctttcaggtacgtgggggtagaagttgattgtatcacttgcgttcactttctggttgtggccactcctaactgtaaggcagtctggaaagtgtgctttctggctatcaaccacgtatatgtgtgacaaacagcagactcatcacaggaagatattgcagtagtctttattagtttctaatgttctcctagaaaggtattacaaaaacatgaattttatataaatacattactgaaaatcttgctgtaaatatctgccttgactggggacataagtccccaagagtaaggaccttgtgttattttacctgttgcatcccaggtcctaggattgtggttgccatgtaatagacattaagtaaacatttattgaatggaagcagtaaattaaatattgactctgtctctatggctatggcagaaatcattgagtgagcaatgatggcaaaaacaaacaaaaaaacacagattaggtgtctgtattgagtaacagtaaatgagcagcacagggaaatttggagccacaaaagaaggccaacagtgtgtaagtcccatgacacatacttctcaaacctctttttgccccattcttcttttggtctaagagtacattatttccataatggtgacaatttcttaatgtgtcatgataaaccaaaatgacaatcatacccatgttacaaatgcatttaaagcaatccatgtattcatctgagaatctcaaaacacctcatccatattattagctgacaaacatttctgcattttgcaaattctcaggcacaactttctagatatagaagtgtttcagccttactgtcagtccaacaccatatgtcaaccttttaatgtttaccataagcacactaccaagtgaatttttctccactatcataaaggttaatctcacaaacagaatatatatgtacttttattgctcctgtgttcttttttagatatctgaatttttgcatttctttaaactataaggaattattctaaaaataagccgtatctcaaatgtcaccaatgagtggcagaacaatttaaatagtcactatacagtcagaaatcagaccagaaatttaaaatttggcattaatggatcagcagaaacatccctgcacctgactcctcaaaaggaaaaactgttttccaagataatctaaattaagagtacagaagtaatatcactgtaggtgagctaacaaaaatttacatcacgctttagaggactaccaaataacagtatcataagtcactcatctgaatcactaaataaatatttattacacacctagaataaaggcttatgctgggccctgtggacaatgtgagataatgagacccaaccctcccctccccggtttgttgtaggagtgcagagataatacatataaacaaataactgtccagtcaggtagaaagaggcaagtgccgtaagacaagcagagaagttctccttaattgaatagtgtctcctgagcacacctaaaatgttctgtgttggggtgagagggaagattaacgagccacattcccacaggtggctcataagccagtggggaattcacagaaggagaaattaaaattccaaggagggagtctggttgatgaggtaaacttttctttagaaggatgagaatgtaggttccctgagagcagtgtccccagggactagcacagacctgcacagcacaggcagtccaaaatccttctggaatataaacagcgtgagaaggagggagcttttcccgtcaagtggccaaggcacaccagcatggagaagcctggtaatcattggcctgtcttgttattagggatggaaccctatttaccaaaggaagactagaatagagatgagttctttttgatgaaatgactggggtattgcagtttgcctacatcccttaaccagacgagatttgatcatttagagctgacagccccttgatattccagcagagaaaacaaaaataccatcttggatataaactttccttctcagatgcaaaattaactctgtttcttggacctgaaaactttctttagtggtcagcctcctgtgtggtttgttcccaggtgtctctggccttgacctctgaacagctcttcaaggttacctgtctctcttcaaatcttaactttgttcctctcctgcctgctaaaaggcggatagatgttcagttcctccatgaaatgagatttagttcccatgtaatggcattttccataataactgctgatatcatcaaggtaaagagagctgcttctcctaactacccatgaaagaatttagctttttatatttctacctctcccatatagtttaatctctccccactgcgagtatgactgactccaaggtattgaagtctgtgctctaattgggaattcaatgaacaagacttcagtgaatgaacttttttagccatattatataaaatgaaaaaggatctgctcctcatttcaatctcctgtacaattgctcctgaacagtagtacagaattgtagagatagcacattgtgcaacctggctttttatctgagacatacttaatgaaagcacatgttttgcactttttttctgagaggccctattcaaaatgtaaatcttgggaccttttgggagtgtttaatgtgctttccaatggaggatctttcaatattaataatatctgaatttggaatcgcttaaactcacctttttattttcttttccacttttttcttactttgcagtaaagtggaacaatcagattagtgtcatttccctgcaagtcatttttaagatttggtttgtgttcatgagaatgaaatattaattcactcaggtttgcttagtagttgtgttagcaatatcactttttccatcatttcttaggtttcatttctcattgctgtcttcttacaaagttcatcagtgggtttccaagcaattggtaaaggaacaagagcagtttcatcaccatttaaagttacatggagtgtttacacagacctttccatggggacatattataaacataatctagccaaggctgtctgataatactgtgtgaagagatggttacatcaaaacctgccaaagaaggctaggcgtggtggctcacgcctgtaatcccagcactttgggaggccaaggcaggcggatcatgaggtcaggagatcgagaccatcctggctaacacagtgaaaccccatctctactaaaaatacaaaaaattagcagggcgtggtggcaggcgcctgtggttccagctacttgggaggctgaggcaggagaatggcatgaaagataatggcatgaaacccagaggcggagcttgcagtgagccgaaatggcgccgctgcactccagcctgggagacagagctagactctgtctcaaaaaaaaaaaaaaaaaaaaaaatctgccaaagaattatactctttatttttgtgattatagtgcattcacatatgttttaccttctaaattgcacacattccactaaggtaagccttgggaggcaagttgctggtagggaaaagggatgaaattgttatttttgcagtgactttctcaggatcacacaagatcttcttttaagcttgggactagatcctttttgggtggagggagctttatggccatgatggacaatgctactgccctttaactctatttttacttgaactttaaaaatatgaaccataaagggaacaataagacaatccccaggcatttatcatcagaaacgcctgaatcaatctgaccagaagcttcattgcctgtcctgtcctgatcctgtttagtttggagggaatatgtggatggttcattttcatagtttcccagtacagactgactcagttttagttaaactatattgctggaaatgagagaaagagacagaaataagaagttctgccaatgattttaccaagaggaaaaatgacataggtgagcccagtttgagtttcattcactctgaggcatctcaggaacactgaccccatcaggcagtgtgtcaagacctggagggccagaggcacagaagatacttcccctcctcagagggcttacagtctaatgtgagaaaaagacaaagttacaatcacgtacggcaggtcccaggtgagaaatatagagtataactggtcagtattcagaagggagaaaaaaagtgttccccagtggtgggggcagccagggaagacttttgtgagaggtgacaacaaagctgagttctaaaagacactttaggaggtggttaagctaggagtaggaagaacagatgtttcaggaagaaggagctgtatcaggggatggcagtgaagcagtgcaacgaggagcttgcagttcacttaggtcaagggtagggccagaagtgagagagaataaacaagaggctatatctaggtcccatgccatggaaaggagttagtactgtactctgaacgttctgtggggctcttgcaagcattctttctttttaaaagaaaaaaaaatatatatatatgatatgtatatatctactattatgatatgtatatatctacttatatataaatatatatttattatatattttttcattttaatagtttcccagtgcagatcagctcagttttagtttaaactatattgctgcaaatgagacagagagacagaaataagaagttctgtcaaagttttacagtatatataaaaatatatatttacatatatatatttcatttcagtgacctttggggtaaaagtgatttttgggtacatggatgaattgtacagtggtgaagtctgagatttcagtgcatccctcacccaagtagtgtaacttgtacccaatatgtaggcatttttttaatccgtcactccctacacagccgccccctcctgagtctctgcggtccattatatcactctgtatacgtctgcacacccatagcttaacttccacttgtaagtgagaacatgacggtatttagttttccattcctgagttacttcacttagaataatggcctctggctccatccacgttgctgcaaaatacattattttgttcttttttatggctgagtagtattccatggtatatatatataccatattttctttatccgctccttggccaatgggcatttaggttggttccacatctttgcaaatgtgatttgtgtggcagtaaacatacacatacagttgtctttttgatatattgacttcttttcctttgagtaggtaccaagtagtgggattgctggatcaagtggtagatctactttgagttctttaagaaatctccatactgtttcacatagagatggtacttattcttaccagcagtatataagcatacccttttcaccacatccatgccaatatctattattttttttttactttttattaatggccattcttgtagaagtaaggtggcatctcattatagttctaatttgcatttccctgatgattagtgatgttgggcattttttcatgtttgttggccatttgtctatcttcttttgaaaaatgtctgatcatatcatttgcctactttttgctgggatttttttttttcttgttgatttatttgagttccttgtcaattctggatactagttctttgttgtatgcatatttcttgtaaactttctgatagggcagggggctcagaacacattggatttgtctcagtgtctccaacatcttgctctttcctgcctcagggcctttgctcatgttaatcctctgcctgaagagctctttcttcttttcctatttggctccttcgtatctttcagatatcagctcttaaacaagacctgccctggccaccctttctaaagcttttgatatttttctccttcatatcatttattttatatatatatatttttttcgagacggaatttcgctcttattgcccaagctggagtgcaatggcacgatctcggctcaccacaacctacgcttccccgttcaagtgattctcctgcctcagccctcccgagtagctgggattacaggcaagcgccaccatgcccggctaattttgtatttttagtagagacaggatttctctgttagtcaggctggtctctaactcccgacctcaggtgatttgcctgcctcggcctcccaaagtgctgggattacaggcataaaccaccgcacccggcctataattttttttttttttttttgagacggatcttgctctgtcacccaggctggagtgcagtggcgcaatctcagctcactgcaacctttgcctcttgggttcaaatgattctcctgcctcagcttcctgaatagctgggattacaggtacacgtcactacagccggctaatttttgtatttttagtagagacagggtttcaccatgttggccaggctggtcttgaactcctgacctcaaacgatctgcctgctttggccttccaaagtgctgggattacaggcatgagccaccgcacccagcctccatttataatttttttctttttttcttttttttttttttttgagatggagtctcactcggtcgcccaggctggagtgcagtggcgcgatcttggctcgctgcaacctccgcctcccaggttcaagctgttctcctgcctcagcctcctgagtagctgggattacaagcgtgcgccaccatgcctagctaattttttttatttttagtagagatgggttttaccgtattagccaggatggtcttgatttcctgaccttgtgatctgcccacctcagcctcccaaagtgctgggattacaggtgggagccactgcccccggcctgagccaccatacctggcctatcatttttaaagtaatttttttttttttttttttgagacagagtcttgctctgtcacccatgctagaatacagtggcacgatctcggctcactgcaacctctgcctcccgggttcaagtgattctcctgcctcagcctcctgagtagctgggattacaggcgctcgccaccatgcccagctagtttttgtattttcagtagagacgggtttcactatgttggccaagctggtcttgaactcctgaccttgtgatctacccaaagggctgggattacaggtgtgagccacagtgccctgccgtaattttttttacatgtttttagctgtttctgtaaactccctgaaggtgggaactgtatcttgtgcccctagcatgatgcatggcacatagtaggtactccgtagacatttattgaataaatgagtaactcatcagatttgcatatctgtcagacagccctggctaaagggtggagaggggattggagagcaagccaagagagatgatagacagcacagttaggaggctttcccaccatgctggtgaagagggaaggtcctgagccacagtcgcaggagggtgatggagacatacatagagtcaggaatcacagaagcggtggggactggttggatgtgggtgattgtcagaggcaggagtcagggatgatgccaaaaaactagatgagtggccgatggttcattgaaatatggaattcaaaagagtaagaacgggttttgggtgcagtagaaaatggattcggctttgcgcatgttggttctaagaatacctgtgggctatctggatggaatgcccaacaaatacttagatttatgggtttggaacccaggagatagatctcagtaaatgataaagagttgagagtcattggcctgtagattcattcatctactcattcagtaaatattcacttactaacgtgctttgtctcaggcattaagtatacagtggtaaattaaaacattattttagttttcacaaatatcacagtctagactgctagttgatgacatggaggtagataaaataacttaggaaatagatacaccccccccacacacacacacacacgcacacatctgcacacacatacagggagagatgagcacagaccctggagaacaccaacatttaagaggtggacacaagaaaagggggcaaccaggagagggtggtaatttgaatgaatgaacgcaagggtcttcccaattcccaagtccttgcacctaaatcaccctagcctttaaaatatattgcttgcttttttggtggcaggattaaattgccttgtgtttacattcacgctatacagaaattcatgttagttcatccttaaaatgaggaatttcaaagattggaactgaaacaagtatcagcctgtaagtcaagtaaagaaggtagggatgagcaagagctggagatcaacccagattttcctattcatctatgaatttccttgttattgttctatgtgttttaagtcaaccttaatgtacattgtggttagatttcctttgctgtgatctgtgggataaatgtaatgttgatggtctccctataagaaagagatgttgtggtctgttttgccaagacctcattagagaattttatttatttattaattttttaacttctcagttctcttaatctaagagacagcatcttaggtgcttaccaaagccaattgaatacctgggtgtgggtggttttgagaggtgaaatttcttgagcactttgatggtaaaattttgccattttatttcaaaaagccatttacaattattgtctatcctaaaacttggaactgtttcatctcaaataccatagattatgtgtttgatataaaagttaactgaaatttaaaaaaatctcagtagaaatttcttatgcaaaaatccagtgtaacctaaaaaagacaagtaacttgcaggtccatttatactcctccaaaacatggcaactttttgcatgtgtttatgtgtatgacatttagtaaatttattggtggatatgcagtgccacaggtaaatttgctttccctcagtattgtatgaaatctagcttttattaataacaaattttgtttatggattgttatatattcagattggtctattttcttttattgcattttctcaaggtatgtttcttatgtcaaagaacaattatttcaaaaatcccttcggccaacaattttttgacccagattttaaagcagggaaagactaagctgaccttggagtgatctctcaactagactctacctgtgtgagagtcatagaatcagaaaattttagaggtagagtgggaaactacataccatagattatgtgttccttgtcatttataagttctatgtttctgaatgcatcataaaattaaatgagtagttggtgatcgacataataccaggtgtcttaaagggaattaattgcatccagcaaaaatgaagcagaaacaaagttcgaagattaatcactttttgaaccattgatttattatcttttctcaaaaaaatcaacagacacaaaaaaaaatttggggtgtataaataatctgaatttttatttgtgctcaaaagaatttgttttcctgttttgtgagttggggcttgctttttctattttgactttttaaaaattcaccctgtggtgcctctagaaaagaacacctttaaatcttgtttgagttaaatgaatagataactaattccaatcaaatgtttctttagagaataatgtttaaaaaactatgatggaatgcagctctcctagtgattcttagatatgctgtttttatcccaattgttaaggtcttagaggtcacccaaggtaactatttattgtaaattgtcttttgtttcatatttccggttgaattttttttaaccatttcaaaaatcagctagttgttgtaccatagctttgcacaaccttgaaattcaaaccaaaaatctatctgcttagctaaatgactgtgccctcccacataaaccccaaggagagcagagaatgagattaggcaccacatgtgttaatcataatgaaactaatatttaaagctctgttgtcaaatgtcttgtatttatgacactttgttttcttttgtttttgtttccccaggacatttgggcttccaggacagttttgtcacatcaggtgtttttagtgtcactgagctagtaagagtgtcacagagtaagtataattttgctttgatttggtacagatttgccttggtttgtgcttactttctgcctaggactcctagagaccaaaaaaagctttcagaatctccttttcattcacccattggaagaattttgacacacagtttgtttgacaaccaagaatttaaatcaggaaaaattaaatattattttgatgtgaggcataaaagaaagaccaaaatcctgagggtctcatatattctgaggcttccctgatttctaagaaattctgcattttaaaagaatttgtttttgacctttaaaaaatgctaatgccctcagtatgagtgacacagtctgggatgatcattaccagtttgtcaataatcactaacagtgaatgaagagtacctgtcaccatcttgctccattgatcaaaggcccattcaattgattgtagttttgttatgacataatctagcatgcacgcacacacacacacacacacatacacacacacacacacacacacatacacagttgccttcccttaggaatctgttttttcttatttaaaagcacaaatacaatgattatgatgttccaggtcccagtaagaagaaggaaaaataaataccaaatattaaaattttattttgttttactcctccaactacttcaaaataccacttgtaggtaaaatttacatggttaaaattggttttgagcagcatcagccctttgtggaatgagctggagtaaaaagaaacattttcatttcaggttcataccccccattcactgtgttacaggcttgcaagattgactgagtaagccagtccatctcagggcatgacgtcaggtcaaacaagtcaagccatcctggtcccaaaatcctggattttgtctgttcttattttagccactcataggctaggagagtcttgagagcacagaatgtgatacacagtgtgggaacaggggagaatctaatgactactgttcatttactgtctgccaggcactgtcgtaggccttagtgtaaggtacataagttaatccttgcaataagcttttcagacaagaaattaccccatttttaaagatgagttaaattgagggtctatataagttatttatccaaagtcaaacagtgaggccaggcacggtggctcacgcttgtaatcccagcactttgagaggccgaggcaggtggatcacttgaggtcaggagtttgagaccagcctggccaacatggtgaaaccccgtctcgactaaaaatacaaaaagattagctgggcatggtggtgcacgcctatggccccagctactcaggaggctgaggcaggacaattgctcgaacccggagggtggaggttgcagtgagctgagatcacactaccacactccagcctgggcgacagagtgagactccatctcaaaaaacaaaccaacaaaaaattcaaatagcggataaatcgttaagctaagtctctataatgccagtatccgtactcttagactggcccaaaggaacttgaagagatctatagcatgagactagacagggaaacagtgggaaggtaactgtcggggttagaattgtgggagtcaaggactcccaggttgatgctgaggtattccagtgtagaagagttggaaccctaagaaatgagacattaggagcagcaggtcataacttggaagagagaggttgctgccatggtattgaagcgtacttaaagtaccaaccggttaagtagacactacattgccttgttaagctggagaggatatgctcccctagttatagcacagctgattaggcagttatttgccatagacaaataacagtgcatctgtatatatcttttttttttaacttcttaggacttttgaacacaataaatatctcacattttcttgtaattttaataataaccgtaatatggggagtatttgtgtgtgtgtatatatgtgtgtgtgtgtgtgtgtgtatatatatatatatatatatatatatatatatatatatatatatatatatatatatgtatcagaccataccagtcatagtagcattataggaaaatacattcattgagccctcactgggatctaaaacatagccttaaagagtgaaatgaaaatccttttaagcgtaagattggagcactagccattttattctgccctggatgctgcaattcttacatttagtcctcattaccatcagccttcccaggcctgggggttgtatgagaaggcccacacagtacagaatcacccccagcctctcctcctccttccactccctgtctttccttttaaggtcttatatcccaaagcttatcagttccaagtttgagtagaactctggtcagtctaagatagcttggctgccaaatgaattctaaacctgccttcaagactgccagagattatggctgaacagggattgagtttgcagagggacctggacttgtttcctgtccctgcttagggggttgcttagccagtgcctggcatcatgaacatcctttggctctcaaatgctttttgattctgcacactgctgtgtaatcgctctgggactcactcacacatggcctcgtgctgacggaaactgtttggcaagagtgggtctgggctgtgtcagctcgatcatggcttcaggccaaactagtcgactgtagtcaggagacccctttttcttagagataatctaggtttgtcggggtatatttcacaagattaccttggctgcctgggtaaggatccccagctcaggtttcgtcacctacgcaccctcctgaaaggcttaacactcaagccgcatgctggagttgaaatccctcagcattgccttgcaaggctgccctcttccttgttcccccatgtgggaaaagagaagcaaccgtttcagaactatggtggatgctttttgcagatgagtggacctggggtgcattctgtatcctcgaatagaaataagctaactggccaggcgcggtggctcatgcctgtaatcccagcactttgggaggccaaggcgggtggatcacctgaggttgggagttcgagaccagcctggccaacatggagaaaccccatctctactaaaaatacaaaattagccaggtgtggtgtcgggcgcctgtaatcccacctactcgggaggctgaggcaggagaatcgcttgaacccgggagacggaggttgcagtgagctgagatcatgccattgcactccaggctgggtgacaagggcgagactccatctcaaaaaaaaaaagaaataagctaactggcacaaaaggtgattaaacacatgatgttagccctgttaggagtgtgatgtcatataatatgaaaaattagagtagctagcatttatcaagcatataccatgtaccaggcattgtgctgggtactttgtaagcattatctcattcaatcctcccatggttggtgttactgtccctttttatagatggagtctgtgatgctccaagaggttaagcaacttgctctttttcctttattctactcagctagctgactgcctaccttttcatcaaaacctctcctataattgcattatagaactaaatagaatccaaggattctgtgcttttattgaataatcagttcttgttgatttgatacacttttagcttattaatttgtgcattaaaaaaaggttaaaactattttcatgtaaaccaaagcaagtaagatacttaattaattttttttcctggatttgtttttaggtgtgagtttgtttttaattaacagactttattcttttttagggcagttttttaggtttacagttttaggttaacagaaagtacagaagtcccgtatacccctcctccaaaacagtttcccctattgttaacatcgtttgttagtgtggtacatttgttaaaattcatgagccagtattgacgcataattaataattaaagtccacagtttaccttagggttcactcttgtacattctgtgggttttgacaaatgcatagtgatgggtagctactattatggtatcatatggaatagttttactgccctaaatatctcctgttctccacctattcattacctcccactccccaccactgatctttttactctctccatagttatgcctttcacttagatgtttttgatggtctcagtgtcctacaatctctgactgttttgcagatttcttcttaaccttctgttatctatcccagccccatccagtcccctgcaattatacctaattatgactacttacatgggctgaaaatttcacagtcatcattaatgatggcttaggttgagatttttctccctttctggatctttagtattcgatttttaaatttgctaatacaaatatttacttacactaggtttccagttagtttttgtttttcattttcttccttttaaatgtaagagaggagggaggtgctatttcagtatttcctcatgtggattcactgaaataactatgtcctaagtgtgttgtttttaatagcgttactaccaaggtggcaatggcagagaaactcaggagaaagctgctggcttagcctcacaaattcagaggtgagggatgaggcaacaaggatgcttgccattgaattatactgatcagatacatgaacctgttggaatcagggactcctgctggccaactgaagctgcaatcttccgtgaactcccctttcctccttgcctcctgcctaccaccttttaattttttttttcattatcatctaaagtccacgaaaggcaagaatggaaagttctgcttccatggcaaagaaaatactgtagcataaaaatctatatttgttctcttgctagtttttcccccatgtggtaggaccatctgaaagtagctcaattatttattgccttgttccaggggaggaggaaaatacagaccactagatgctgtgccagagagagagagagaagtattctctgctttggggaagggggttttacaagtgttaacaatgtggttcagaatcactaaagttgttttagcataatactatgaggaaagagacaagaaccatctgttgaaatggctcttacatgatgctgcattttcaaacaaagccttctcaaggcatttttagattggtctctttcccttgaagttgctacaaagagagcccactctactagctgctaagtgatgctgcttagatagctctctctgtcagcacccactcttttgtttattttgcgctagtgttttcctcaaagtatgagtgctaaggctgtcaaatatcactcctggtaggaacccagaaagttctcctgaaaaatccactacttctgcccatttccttccaaattgctgactctattttacttgaagttggtggagtgacttcgaaaccctaactacttcactgggaaagaggaaaaccgcaaatacacacaggccattgtgactctggcctggtgggctctaattttctagcggcggtttgtacacccaagccggctgcaagggttaagtaaacttcgtggctaaggatgacttcatggccctggaattttgaaaagccaggattctcagtacactgtggccagccttagagtctttgggtgtgaaaaccactctcagttacccggactgatttttggttcctgttgcagtgctgcagaatctattaaaatccggcagctgaattgtcctggctctgccacaaagctcagctgccgggtccactacaggattcctgagttgtttgtcaatggagagtgggagtgaatggaaccaggcatatgcctcagcctggcatgaggtggcaccctagtggctgttttctgccttagaaatgtgcgctctttctatattttcacacaggaattgtcattaacatccaaattgcagttcatttctaaagttctttttgaagtctctgggtccttgttacgttttcaagtacccatattcagatgcttagattttcaggctagtaatttagtaagaactattggcaatattctaacctgacatggtggaacttctaagacagaatgaactcggctacaaggcacaacaagaaaacgaaactcttgggtaggaacaagcccaaacttgaaaatacaaaatgttcttgcacagaaggactaatgaggaaatgggtgtaggataagaaattccagacatccagtcatttggggtgccatttaaacattcgcagtactttagatcttaattaaagtgggatagatttaaaactttctttctaaactagtggcctgttggttttcctgtgttaagtaacacgatagctgtgatcattgcatggaaattaatttttaaaatagcttatattcttaagcaagatcttctttcaaaagaaaccatttgggctcgagcattaaaggaagaaacaaaaagaatataataaaaaatagattgcagccctagcatgaacagttgccgtgaccttgccttttgtttgccattacacaattcaatggcagtctactcaaactatgtgctcgatcaatatcctattaaagcagcacaaaaagtctccataaacttagtggttagctatgtttataaatggaactcggcataattggatggtcaatagcaggctctactagtaattttaaaatgaacgtcacacattttatatctgtagaagtcaatggcacctcttctagagtgaaggtagagtgtggagcagacaaaagagtgggtggccctttaaaaaaatcataatgtctatttccaaatgtagtttttaaagaaaatctaagttatggaagagaaaattctgattggcccctatatatttttattttgcctatctgaaccaccttcttctgaatatattatgactttgcaaatgttacattttctagttttaatcaacccctcatagagaggtaaaataataaatattgccatactcgtaggaagaaaaataacagtctggctggcttaattcagccagcttcctctactataattcaataaattttcaaaataaatattgaaattgaattagttcaggaggatgttttgttgtatgattttttccttttaattttcttgacatgtttggggtgaatatttgggtagtaaagctggcagcaagtgcaatggactggtagtaatagaaattgtcgtcaaactacgctttcttctgaatcctagctcacagtatgggtggccaagcttgatttttttcctatcctaccctcctcacctaatgaagccatgtaaggtgagagtatccccacccttagactgactctgtcctcagccgactcagccctatgaattaaaaggtgcatataccttgtgttcgatatgtgccctggctgttgtcatggaccactgagctgttgaaattagaactatggcaggaatacgcttatgacattagtgtatccttcagtcactgctctgcatgaaggtctagtcctttctcttacatgcatactcctacaatcttcctggttagagctggcagtgagagttctcatggcagaatttggggccgttttgatctctgttctcagctgaagcttctgataaatttaccagactatgaatactcttattataaagatttgaactggggagaaacacaacataccccttgatgtacatactaatgtgttgtcatggtctctattcgtatgttcatctatttctaggtcattcatcagttatgctttctatgtgtcaagtataaaacctatattcaagatggcagcatgatattgtaaaacagtacaggatatagagttggggaattgagctttgcaacttatcaactctatagctttgggcaatatttaacccctcttggctgtgttttcttctaggttacaatcatttattcattgagcaaatgtttatgaagtcctaactgtgtgctgagtctaagtccaagtactggaaataggaatacctctcaggagtgtaatgagggttaagtgacagatagtctagtgtctgccacatagtagatgctcaacaatgataaccaccacgattattgaacagagcctcagcccctgatcgttcttcactgtgtgctcagagccaatcttggagctgaccactatcagtaaatttattgaaaatgcatgtgtgtgtgcgtgtataaattaagaagggccaattttagaattcatgttctaacaaccaattattagaagagccactctagtgacccttacggagttagtaattccaatagagtaagagcatgccaatagtagacctcattcctctgttttgagcattgtttttcctcaaattttcagaagattctttttcctcaaattttcagccagagcctgtgtttctgcattattctagaaattgttctcctaggatatctcgtggatagcagaatgttttaaaattctcaatctaacactgacacattaacaactttttaagtggcaaaccacacctgggtcatctgtaccggcattctttttttttttttttttttttgagatggagtctcgctctgtcacccaggctggagtgcagtggcgtgatctcggctcactgcaagctccaccttccgggttcacaccattctcctgcctccgcctgccgagtagccgggactacaggtgtccaccaccgcgcccggctaattttttgtatttttagtagagacggggtttcaccgtggtctcgatctcctgacctcgtgatccgcccgcctccacctcccgaagtgctgggattacaggtgtgagccactgcacctggcccatgtaccagcattcttaaaagtagtacttagttttacagtattttaaaattttgctttcactcatattatgagcaaaaattccctatgaatggcagaagcatgctacaggtcattactgacaatgtggtttgtttgggttttcttgagacagagtctcactctgttgtccaggctggagtgtggtgatacaatcatggctccctgtaactccacctcccaggccccagggatcctcccacctcagccttcccagtagccgggaccacaggcacgcgttgccacatccaactaatgtttgcattttttgcagaagtagggttttgtcatgttgcccaggctcgtctcgaactcctgggctcaagagatctgcctgccttggcctcccaaagtgcctggattacaggcgtgagccagtgtgcccagctaataatgtgctttttaataaacctttatttatgcactcataagcctcaactttttaatggtggatattcatatccagtagtaacactgaaaaactagaaggggtttttgtgacctccaaagcttgagagaaatcctatattaccctgcagtagggccacaaatattattgagatttggctggagtacattatcatagctaactcttgccgagtagaagggctgttggtagtgaccatcttagcatgtctagaatggggccggtggagtccacattcagcaaaaccacacataggtcaaatactggaactgaactaatccagtgtgtggttaatatgagtacatgttaatacccaggatttttcactaggtggaggagaaaaaaaatgaaagttattggtggaaatattgaaaactattttttttttttgtaaacagctgaattagtcagttgttgggatgggactctgttgatacggtttggtttcctaatagctaatggtcaagtagtcccagtgcactattggttgtggggcttatgtttagcttagcccttccctggtttatagatcactgtggcaaaaagacctcttaggccatcaaatcccatccctgtcagagaagacttaatcccatgactgaggctgtatcagatactaagcaggtaccacatttgacctcaaccaaaagctaagacatgatgatactctaaaatgcagaaaatcaatttcagcccccaaagcagaaggcactaatgcagatcagtcagcattgctaacccctctgtggactgctctgttagaccaagtggcagggcccttcatccaatggaactcttgctgacgcttataaagtttaagacctgcaaaagcagagaggcgagaaggagaatgatgagatagaagttttgccacataagtgtaggcgataattattcttctatttaaacgtgttgaatatatctccttcataactgatgacaaaggaaagacagcaacactagaaatgtgaatttcactcctgtttctttgaacagatatctaggaaatatctacattcaagcccttcttctgtcacttacttagttgcatgatcttgaccatgttacttaactctcagcgtagtttctcatttctaaatgagaataatataaatacatattccatagggataatgcaaagattaaatgagataattcaggtaaaatacctagcacattgcctggcatgtaataaatgctcaataaatattagctcttagctatttttcattaacaagctcgtgtaattttagttcaactcagtaaacatttggtgcatatgtaatatatgaagcaccctgcactgtgtactgaggagaatacaaaaataagtaggagacagccttttcctctacagggtatatatttaagtttcttgagatctaagactgagcttattttatggcaataaaaagcctgaatacacttaatttacaaattaaactcacagtaattatctgtcaaagataaagtatcttcctgattcggagtggggtgggaaaatgtatcggttaatttttcctattttaatgaaacagaaacattttttgaaaaataaaaattcctctcttcacctcccttttctccttccgccaccatgtatatattccttaacatgtgttcacaagacagggatgtgtgaaaatagggctctgtctgtgttagcggatgcctttcatggggttaaaaaatattctactggcttttgtcacctaatagtacatttcgtaaaaagcattgcttaaatcttttaatagcaggcaagttcattttcacatagagggaaatccttgttttagttcattgcctttttttaatgttcctgtttggaaaaccatactcttagcctgcatttggtcagaccttttagaaaggaaaagtagaaaacaggagatcagcacagggtttacagaccagaaatctgcttggcaaaggagttgctgaagactgtggcgtagaagctgcagagaaagtacctttatgattgatttccattcaagtcagactgactgcagtgtggtcatttttctaacccataactgctcacactgcagcagtctgctatctgcagggtgtctgaattatagcagtctatgttcgtgttacctcttatacaaattacttacactggtttctttttccatgcaaattcatcagttttacagcctctcacagccacagtcaggaaactctggcagagagcacaaattgataaaatgagttaatttttactatacttattttttttctttctaaaagccctttctcataggcagtgttcaggaagcatattacggtaaaagggagataacaaaggagttgaattttcttgccataaattactttccaagttaattccctttaacgatgattccagatttgcttgagttttcatagcattgtgcgttttacaactgtgcctttgatagaaagaagaacaagtattttcccatgttcagtccctttgtgccagtgacatgaactttcttacaagatctttgccactggaatgcaaaacaacactaaattgtgctgggtccatagaactctgtgctgctattggacttttcccctcccccggtcttcaaatacaagttcccaaagtctcactgagtgttttagatcatgtaatcagaagaaaaatatctctccattttttcatatttgtaagttggaaattgagttgggttacttattgccattctttcatattcctcggtggccatacagatttgaagaagggacaataatggtcagtctctgaaatgtaagccccacaagggcaggggttttctatatcttgtccactgatgtttctcaagcatctggaatgatgcctggctcactaaaagtgctccataaatattgttgaattccattgaatacagcctctctgaggatatgtactattaaccataggctggacaaactagtcatttcgttaatgctccctgctgacttccgttgaacaagttggaaacttagcacactgtaatctctcaggcagagtagctcaaaaatttgtatggaaattttttccatcatcctctctttccaacaatgcaagcctgagcagcttgtctctggtggatggcagaagttcaataaccacaaccttatccaactactaatgtgtacagaagagcaggtcattaagagggttggctactaaaataacccctttcttccagtagcctacattactataatgattccttaatagcaaaccatttattaagaaatgacacaaagactacattctacttatgacaggaaagaggcaggggtagaggatgaatgacttggaagtaatatttgaagagaccatttccaaaagttaaccttttgagaaaaactcctcgatagagcaaaatacttcagattcgttaattacaatactacttaagaaaattgaggagccttcaacacaatttatatgtatttatagaattctgagtttcatttggtattgtttaaagtttagagggggcaaatagggagggtaattattcactcttcttaattcaaagcatatttattgatgatcaactgtgtacacaaaactggtcaaagggagctctaggacctgtaggattaaagtcatgtgtatcacctctgacttcatgacctgggagagttatttaacctctttgtgcctcagttccttcctggtggtatggtgaggatcaggattccccagtgctcaggctgcagactagtaccagtcagtggcctgttaggaaccggactgcacagcaggaggggagtggcgggtgagtgagcattgctccctgaactctgcctcctgtcagatcagtggtagcattagattctcctaggaacgcaaaccctattgtgaactgcacgtgcgaaggacctgggttgcagcctccttatgagagtctaatgcctgatgatctgagggggaacagtttcactccgaaatcacccccctactctgattcatggcaaaattgttttctatgaaactggtctctggtgccaaaaaggttggggacttctggtgaggagtaagtgggatgatgtgcttaaaacccttagcccaacttctggttcataaatgatgcctaataaatcgtgatggtgatggtggcagcagtggttagtggtggcagttcatttttgccataattattattagaattatgaggcccaaagagttccagtgacttaatcaagtaaacaggtggtgattggcaggattgggaatctagacaatctctccccgtcctatactagcattttttatgccccatgacatctctttataaccttcaaaatgcatctcaacctagatagggagaaaatgttacatatgagacaaagcatgataaagcccagagtcaattacaaatggagcaaaactggatttcacaataaatggaacagaaaggcagtgctgtgcttggtccagtcctacctaacatctccacatttgattggcagcgactgcatcgtttttatagcacaccagaaggcagttagtctttaacctcaaaaacccaatgtgataacctgggcaggccagaatttatgtgacattggacaaatcatttaaccttccacaacttttattagtttcttaattttcaaaagaaggacttaatgccattattagttaaaaagtatactgtgttacatacatcttattgatattttatatttgttagaagaatatgatcatttatttatgccctttcaagtgcacaattgggaacaggtctttgagacctgtttgctctcctggaggaggtgtcaaatttccattgtaaaaattctattttctttcccagcagcagagtcttggcctccattcccttctgctgggacacttgcatcaatcttctgatttccccacctccagaatcttagcccccttccatgcattctgaatatggttgctgtgttagtccgttctcatgctgctatgaagaaatacccgagactgggtgatttgtaaagaaaagaggtttaattgactcacagttctacatggctgggaaagtctcgggaaacttataatcatggcagaaggcacctcttcacagggcagcaggagagagaatcggtccccagcaaagggggaagccccttataacaccatcagatctcgtgggaacttactcactatcacgagaacagcatgggggaaactgcccccaagattcagttatctccacctggtcccacccttgacatgtggaaattacaattcaaggtgagatttgggtggggacacagagccaaaccatatcagttgccttgtgattgttcccaggtccacagtgatcttatcacttccctattcagaaactgtcctggatcccacttttttttttttttttttttttttttgagatggagtcttgctctgtcgcccaggctagagtgcagtggcacgatctgggctcactgtaagctccgcctcctgggttcacaccattctcctgcctcagcctcccgagtagctgggactacaggcgcccaccaccacgcccggctaattttctgtatttttagcagagatggagtttcaccgtgttagccaggatggtctcgatctcctgacctcatgatccgcctgcctcagcctcccaaagtgctgggattacagtcgtgagccaccgtgcccggcccactttgcttcttatctccaaacttatgcacatactttgtctattgccaagaaagcctctcctgtgtcctgtgcctctttaaatctgaactatcctcgaaggctcagcttaagtgcccactcttcctggaatcaaacctttttctgatctcacaagccaatgggatccatgactcctttgaactttcctagcacattctttgcattttttcctatgaaatttagcatgttcggcattgcattagatattcaggtattattttagtattccacttaggttgtaaaccttttggggacagagacactgtgtatctttttatcatttcaagtttaagacaaatactatatgtgggagtcagtgtggcgcagtaagaaaagcccaggttttgaggtcagtatccttacattttaaccctgactctctctttttgtctttttgtaatcgaggacaagttatttaatctcacttcaaggcttcgttctcctcatctagcaaatgcactttgaggtttgagaatgaaattaagtacagtaagtacagtgcttatcaaaacatggcatcatgggtgctccaaaaagcctgcctaaagcccacctcttcagttcttcatgacctgccaaaagctctttctgttctccagattagaggtactgagaatacccaacccaatgcaaggatactttgatagggactgctcccctcaagtgtgaagctttctctttggctgtgacagtgtcactgagtcagaatccaacccaataagccaactgtccatgtgattcatacctacaggcagttgcagggggatgttcctttataagactcttgaagaaggcagagtttgggtctgtgaattactaggattatttaactcagggtgtgaaacccattctcatttcagaaacttagtgatgttttaaaattcaagacacacataaccagtttgccaagctctcaagttactcatcagaagtctgatagacactttcgggacgtgccaggccacctggtgccatttgccacattacaattccagtgtacttaagtggttcacaggaagtatatatatgaccaagctaagcccgtttatgtgggcttaattattttttaacatctggaaggtgggcacaccatgtttacacaggcttttctttttcttcccctattctggctctcttgacatttaaaaaagataaggcaaaagacatttttctaggatagataaagtattaaatttaagtgcagctggatgttcaccacgagctaggaggcctcttcttctctccgtctgatcaagtccctcacattcacactttgctctgtgttcctctccttccaagagcgagggagtgagggccagacagtgtccgccatgctcaggaatgaaacggcttctccacccagttgagacctcatctcccttctgacatttgtgaaaaacatctaaatccagagctatgacactgatcagccttataacccttctttggttaatgagaggtgtgaatctctaatctccaggaaggcacaaagcattaagtacctactgtatgtcagcttgctgggagtgaggatgagtgatctaggctcatatttgactaatctcccccacccttcctccatagcctatttcatacataaagattacctaataaaagaggaaattatgcaaataaatttaatataaaaagcaaattagggaatgactatcagaattattaattagaaccctgtttacacttattgtcaagcctcaccgtttttttttaaacgaaaggcccttagagcctgttactgagagatgtgtttgaatttcagaaagtagatgtgaatttcagtcttccattttttttagcagtgactgtttttgtatattgacagttgtgattaaggtttattcattggtattaatcaaataactaagtatttattcttagaaattgttttatttcctcataccgtccctcgattccatagttccattatggcacctcaattcacctggtttcccaagtgctaatcgtgggagttatcccatactcccctgttcccattattacgatagtcaagaagtcagcatgtcttctttttatttatttattttccaagatttttattcgagatgggttctcactccattgcccaggctggagttgtagtgacatgatcatagttaactgcagcctcaaactcctgggctcaagtgatcctcccgtctcagcctcctaagtagctgggactacaggcacgtgtcactacacctagctaatttaatttttaaaaaaaatattttttttttctgtggagacatagtctcactatgttgctcaggctggtcttgaacttttggtctcaagcaatcctcccacctcagcttcccaaagtgctgtgattataggcgtgagccaccacacgtgtgcccagccagtcagtacatcttgattctaactcctgaataacttacatcaggctcctcctttccatcctttgagtttagtccccatccccactataccttgcataaatgccccagtggactctctggtttgcctattatattcttcaggcgccccccaccctttcacctccatgcctaccctcatgacagactgatctttctaggtgataaatgcaaatttgatgatagcattcccatactttgctggtccttctttgactattgaatacaactcaatgcagcaacccattccattgaccagtgtttactgactgcctcctggtgtcagggactatattagatgctgacagtataatccccagttatagtggggtgaggtagatgctttaatagcttataaacttgggaatctgctgaattcaaatttatgttccttaaataaacctgccagatcccaccgggcacatgttggctcatgcttgtaatcccagtgctttgggaggcaaaggcaggaggatcgctttagactggaagttcaataccagcctgggcattatggtaaggacccatctctacaaaagaaatttttaaaaaattagccgggtgtggcgtagcatacctgtggtcccagctattccggaggctgaggcgggaagattgcttgagcgcaggagctggaggctacagtaagctatgatcacacctctgcatctgcacttagcctgtgtggcaaagtgagctcttgtctctaaaacaaagaaagaaaaacctgccagatccttcataacctcaccttaaccatccttcctctttcccgtgtattctacactatgtcatcataccaagctatcagaaatccagtaaacattttctgctctcttgatgctgtttcctctacctagaagtcctccatccctttcagttgcataattcctcctttccttttaacattgtttccaggcttcacgttttctgaggccattcccttgaacttcttatccccaggttgggttagataacccacttctttgcagccacttcaatttaggaatgcagatggtccccaatttacaatgattccacttaaaattttcagctttacgatggtgggaaagtgacatgtgttcagtagaagtcatacttcaagtagccatacacttattctgtttttcactttcagtacaatattcaatcagttacatgagatattcaacactttattataaaataggcatattaagtgcattttaagctgatgatatttttaacttatgatgagtttatcaggacatagcctcattgtaagttgagcacctgtagctctatcagatgacttcgcagacttttaaaaaattaatctgtcagactttcttttccgtttaagggtagggaccatgtctttcatctaagtgccttcctcactcatcatagttcttggcagtagcaggctctcagtaagcattcattggatgtacaaatgtccctggttcatgataacccttattgttatttcttctgatggatactaacctgtaatttatttattccagtatcaaatcatgtgggcttagctctcaaaccagtgcctcagtacagtatctattgttcctgctttgacataacctttcaaaaagattatttgcactaataatttacaccactaattttacggagttgttttatagaattggtacttgttatttgtccattggaaaacatgtattaaactactgtcaaaaaggtatctaaagattcaaagacagaaaatgcaaggaatcagtctcacacaagggtcatttctgaaaatcacaaataatcaaaattaaatcaaaggtcagaaaatcattttataagaggccagctaataaatatgttaggctttgtgggccatatggtctctgttgcagctactcgtctctgatggtgtaatgtggcagcagtcatagacaatatagaaatgaaaggccatggctatgctcccgtaaaactttattcataaaaactatgggcctgccttaaattacaaggttggacaaatattcagttaaggtgtatgcaagatggagaggtgattcagagtaaagagaaaccacacatttcatgttataagaaactgggaatggacagcttagaaagatgactttgttctcaccaaagttcaaaacagaattccaaaatacagatgagtagaagctgtcaggatcagataaagttagaaaagtctaaagagtgttttggctggtcattccagaaaagtgtaagaccaaaatgtggggaagtatttttgttaaaagcatccaagaatgttgcaaccttggtgacaatttactattacataaagagaaaagatgaaaaatatattagaaaaaatatgcctttcctgtatagactatttttagtcaatattcctttggagtcatagtttattactgattattttcgattcgcttacatataaatgcaaaaagaaaatgtgctaaatgcaacactgaggatgctgtcattgatttttttatccacagaatttaactgatttttgtttgttttcttaattctagcaccaatagctgcaggaactggcccaaatttttctctctcagatttggaaagttcttcatactacagcatgagtccaggagcaatgaggaggtctttacccagcacatcctctacgaggtaattttattggcagctcttgaagaaattatgctacatggttgcacaccttgattttaactctgggcccactatggatttagcaatgcgcctttagtaatagaagataacaaagtagtgggttcagccccaaaagactgtcggtctcgttggggagataaagcaaatatgcatgtggcaagattaaatacacacacacacacacacacacacacacgcacacacactaaaaaactgtgaactaaattgtgtgacacaggctaaaaatagttaaagagagctttatgcaaaaagaataccttgtttccagctctaaatgttggttagggttggtgagatagaaaggaaaaggaatggaattctgggtggggtgaaaaatgagcaaaggcttggaggaaggatggatgatgaacataacatgttctcaggaaatgaaggacaaggctggactgcagcaaagggcatatgttttggcttgtttggcaggaagtgaacactggtgacagtctcagtgtcatgcccacagcagacattacagctcagtgccagctcttttcccaccgagcccccaaagctctcaatatccagtttactggagttgccctaaaaggtgaaacccatttgatatcctggtgtgaggttatacaaatggaagtagtcacttgcataacctcaagtgagggtggggccagaccacagaccccattgtattgagagaccttaaaaacagtaaagctagagtagtgtaacctgataatgattctggggttcttgctccctttaacgtcacaaagccaaaatcaaaatgaagcatttttgcaagatcgtgttgtctctagataacctgtaccagagggaaagggattaggcattaaacccacagtattcttttacaaattggctttagcactggactgtgacaacaaagaatagaatggtacagaacgatctttaatgtttgtgtactttgcagaaaaatgtctgacaaaggtatattcctcctaaagcaagtacctgagtcttatgatttaaaacaatgcccaaattatagaacttttccttggtgcacactcgttcttaccttgcctttatatattttaaacatcactactttaaaaaaaagatcaacttagtcatccctaataccttgaagacagttaaagaaacaggtattcccttaatataactatcaaatcctaccatcatctttcatgttgtttaaatgttccctttagttccctgtagtatcagctcctcagggggacaaaaaagtcacacatccaaagtatatttataatagaagaaagagattgtgaatatatttgggtgttcatacattttgaggattttgaatgtttgctgatgggagagaccttgtgtgtaactgtactcagtcaacatgaaaaagctttgcaaatacctgtgggcagtgattaatttaaaagtttatgggctgtttgtttttcatgtgtgtgctgtatgtgtaccatgtacctcccaaacagtgtttccccctttttatgttttcacacaattctccagctatgttttattatcttttgtgactctctgagaggaaagctcattatgaatgtcatttaaaaggccagtgtcgttctcatattctgcaaataactaaccctgataaggagctaattataacctgcatcagtagttaataacccggtaatatgtttgttttactctcattaggctcttcctaggatgatttttaaaattctttaaatacatagattcagcagaattaacgatgtacaggttagaaagtgtgcccagaagaatatctcagatttatatatagaaatgttcaccgatcaatatgtcttcctgctgtgccaatattaatgggtcattttctctgtggcaggcaccatattaggtgagttgtatacctgttctgatttattcttcacaataatttgacaacacacacagtgttttcatttaaacagtggagcaacacaaagctcagagaagttaagtaacttgcccaaagtcacagtcctagtgaatagaggagtctccattcacactcaggtctgttggaactttaaaaatatgctcttttcacacagaatcctcttgagaataggactgactcttttagtaaggaacaacagaatatgaggtcctaaaaaaggagtttctagcatctctattcctccctggcatttagtgtttgccgtcttgagttattcttaaccatctttgaggccaacacgtgtgcagcctccccatctagacagtgagtcccttgaacgacagcgtctagctcttcccattcagcagcgaacgttattagtaagaaacaaggacaccgtccttggcaccatgggtgtaaagtcaaataagaggggctttacaatctagtggtagagactgagaagtgggaattttcagttcagggtcctatgaacactcaggaaagttaaggcattttgcagtcttaggaatgctaagtaagacttctaggccgtaattacacagagtaggaattaagatatttggaattagggtaatacttttaccttattttttagatataattgctagaaatacaagaaaaaattccacatacaagaagaaatagtgcatcactccttaggagaatattcatccttttcgtgtagatcttacagatactttcctgcttccctcaagtgtttctgggaaaatgagtgtgttagaaagagcaagaaaccaaaatcaatgactgattcatttcaatagatagataggtaggtagataatgtgatgcaatggtactgactgtaagttctgtaccccttcagggtaaacatcttcaaaatcatagaaagagcagtgtaaaaattgggatacgatacattttttattccaaaaaactttatcaagataaaccagctgtcaaaagtttgtgaagtcagagtaaagttgtctcggaagcctccacctgtgcttcctaacttgcttcattcctgatctttttatcttttccatgctccctccagatgttaatttttttttttctccaatagagacagagtctctttctattacccaaggtgagtgcagtgatcataattcactgcaacctcgaagtcccgagctcaagcaattctcctgcctcagcctttgaagtagctaggactgtaggcatctgccaccacacgcggctgatttaaaaaatatttttttttgtaaagacaaggtctcgctatgttgcccacggtggtctctcaactcctggcttcaagtgatcctcctgccttggcctcccaaagtgttggaattataggtgtgagccaccatgcccagccctcttttgtcaacttctgaaaatccttgctttcaaactaaggcatcaaccgatagctatagaatctttcaactctaggatttaatactggcttggggtatttgcattttattagaggatgccaaggaaatcaaaacctttaaaaactcagaaaagtatcaataatgggagaatgatggacaatggagttggcctttggggctagatctaactgaattatacttggatgaatccatgtcacatgtatttgtatggctgtttctaagtcagtagcccaattcagcagttttttagtatcttctgttagccagacactgtggtaggcactagagattaaaaagtatatagtcattttccctgaagatcttacagccccatcagaacatataggcttctcattttatttgccagagtacttcagggaaatgtttatttttttctaacatgtattctttctgtttccaagatgatttccagtggctttccattttaaaacaacaggtaatattaaatgtagaaagaggccagaaaccatgtggaaaaaaattgttatagcaggagcctgaaccaagagttatgccttaagtttagccctgagcttcctggttgccaaggcaaaaagggttatatagtttgcatttctaataaaaggatacaagataaatttgttcaaagagaccatatttttctgattatgttttgtaaggaattcgctgtgtatatcgtcttataaaggactcccattagatgtagttttacataaaatatagaaaagttcttcagtggctatttttcattgaactttcaaggaaagcccagcaaagaacattaaataagcattaaaggcatttcctttgagtactaagctagcatggcacagttatgttgctttcctgtggtctggctttaatgagaatagaacttaatggctaagaatactggaatgccaacattaataattagaatttcttgccataaattggccctccacattttttcattcagattgctgcaatagcttaactgtctccctgccctaggctccattttcctgttttcccctttgcctttctaaatctatcatctgcacaattaccaaagtaacttttctaaaatataactcccctgtcattccctgtttagattatttcggggagtctacattgcttataggagaaagtccagacgtgcaatatcttctataacctccacccttctcactcgctgtgccccttcttccccacctcagccatcctaaacagctggcagttctctgaacatatcacacttcactcacaatgtggcttcttcctgataggctcctcccttctgggggttatgttcgaaatatctgataacctgtgtgacatgagcataccaattagaacagacactgccctgcttgcagggctttctttggctaggtcctggaatgctcctgatctgcaagacattaaccctttagatttcggactgtgagggtgtctgggacaaagaaggggaggcaaggttggaagaaatgtatggagtttaagacaatgacagtttgcccattgataatatttttaataccaaatggctgcctgagtggtacatcagctgtagagcagccctgcctctgccctttccttcattcttccctgtctccttgaccctcttgaagatagctcaggagccatttcctccaggaagcctttcccgaacccctggctcatcactgtctccattgtgtgacccactgtaccctgtgtgtggttccatcataactcctatatttctcttttgcacagttttgtttgcctctctgtctccatgtctgactcatctctatatcccagcactttgcacagcacctggcatgtaggatgcgcacagtaggtatttcatgaatgaaacatacgaaaacttctgtcccctgaaacgtgaagaagagatttcccaacacgcactcccagtagatatgaaatctactcatcctaataatatgggtagatttgacagttttatcacccctgcaaacttcctgattctgtggcattcaattaaaacaactacagcaagcatagcagcaggcggcatttcactacgttttcactcctgaagcctcaaactggggagaatattcagtccttcaactggaaaaaatgagatatattctgaaagtttcttgaccgtacctctccaaaaaatgaaaatccctaccctgatggaataaaactttgttttgataatctttgcatagagaaagcacataaaagtcattgggccactctttttttatgtctcttgttctcaggggacagagcactccttcttccttcctttttatttgttttgttcactgatttatttctagtatttagagcaggacctggactagctgtgcagtaaatgtttttttgaatgaacaactccaagtggaagatgggaaaatgtggcaaaagaaaaaaaaagcaatccaaacttttcattttcttttcttttctttctttctttttttttttttttttttttttttgagacagaatcttgctctgtcgcccagggttgagtgcagtggcacgatctcggctcactgcaacctccacctctcaattcaagcaattgtcctgcctcagcctcccgagtagctgggattacaggtgcctgccaccacacccagctaatttttgcacttttagtagagataggattttaccatgttggccaggatggtctcaaactcctgacctcaagtgtgatcagcctgccttggcctcccaaagtcctgggattacaggcttgagccaccatgcccagcccaatccaagcttttcctgaaggatcacgagccctgctttttatcctttctgaggttccagcagggattaaattgatgcccaggttcattgctgatggccaggccccagccaccacctgtggagataggaaatatgtggccttactcccaacacttccaggtggaggcaggagctagagccagccgcttattcctcaaaggaaacaggaacaggatgtggcagcagcagcaacttgattgacaataaaaatcaaactcagacacttggaacaacacagacccaagactttgttctacatccagtgactcaccagactgaacagaagtttaaaaggagtcctagaactacattaagttgcccaattgcttcctcccttggctttctttcaaccagaggtgcagtgtccaagagaaaggtggttgcgattgcttttaaacatgcacccatttgttatttcagctccacaaagcgcctcaagtctgtggaggatgaaatggacagtcctggtgaggagccattttatacaggccaagggcgctccccaggaagtggcagtcagtcaagtggatggcatgaagtggagccaggtaagcagagtggcggcacgggcatgtggctaacactgtgaaactgaaaatacgtgtggggtcccatgccacgcataaaagtgaagaaagaaagctcaaggtagttcactttttcaggatgagcacttgtttgtattgtaatctgattgccacattcataaaaggatggctgtgcaaagcagtagtaattcaactgaaatgcaagactggtgagatggtgtatgattttctgctcttacatattttcccctacaccacaatccagcatttgatttgcttttggtttttttgtttgttttgttttgtttgtttgtttgcttttttgagacagagtcttgccctgtcgcccgggctggagtacagtggcatgatcttggctcactgcaacctccttctccctggttcctccttcttctgcctcagcctcccgagtagctgggattacaggcacctgccaccacgcctggctaattttttgtatttttagtagagacggggtttcaccatgttggccaagctggtcaatttttgtatttttaaaagagacggggtttcaccatgttggccaggctggtctcaaactcctgaccttgtgattcacccacctcggcctcccaattgtttttgtttttatactatcttttggtttagtttttgaaattatcttttaatcctaataaaaatctatcaactttttcagcaggatcgataacattcgaaagaagaatgggttccttgcgatagtttagactcagatttttatataataaggacactttgcaatatttttcctattactggatatcatcatgattatttttctatttaaatggaacaactctctttattctgatctgtactaaactgaacaaatgatgactgctggtctaatctcctggggtagtctaatcttggctctggagtcttgggagtaatatggataagtctgattgcaaaaactatttgaaaccctttccaatgtctaacacgtggtttagagggaatcttctccaaagcttcctgaatatggcaagtccaatgggtataaaggatagagtatgtgccttgaaatcagacagttggagtgccaacctggcttcaactcctgctggctgtgtgattgtgggcaagttacctagcctctctgagcctgtgtctccctttttataatctgacagtactaatagctatttcctagcatagctactacctagcatagagtaagtatgaaaatactgttctatggccatccttccccagcttttgcttcagagttaattccctgcaagtacagacgagcaccaagaaaatttctgaaccaacctcttcatctataaatcctagctcccttgtctcctcccttaattttttttcaaaagacaatgctcaggggatgtgactataaaggtgtagcacggggaaaatgttggggtgatagaaccattctgtatcctgattgtggtggtcacagtaatctatacaatcgttaacattcacagaagtacatacctccctgctcaagttaattttactgtatcataattaaacacaaaacaaaaacacctcaggcccattggcggtgtcttttatcttgcccctgctattaaaatgcaaaaatgtctctttgctttgcttctgcctagtctttcattcattcactcattggatagtcttcactggggactttctctgtatgaagcactatgccaggttctgggaactcaaggatagatgggaaggttatggcccctgctctcaaggaattcacagtcagaggtgggaaacaaacacataagcagatcattatacggtgatatgggaagcgcagagatggtggtgttagtcttccgtgacttctgtttctaattagtaccaaccacagcactcaaggtgtggtggttcttctatgaaggtcacacatcatcttttctccgaattcgtgttcacatcagtttgcctaaagtgcctaagaaatagtcccagccctaaatgagaaggaaaatgctgactctcactgccactacccgcatcatcagcatgacctctatatagtgccaatgaaaagtttatgtgctattaaaaaattaaaagatggaaaacttctttgaaccctttttcaaaggctaattagagccctagtcaatttacctgcttcagtgaaaatcagaattaaacatataggtttggtacatttgtgcttgattattgtgtagatgcatttttgtgcatattgaagctgctttattaggttgaggtactcagagctcccccatcatgaggctgagctctaggtccttgcatttaattcctctgggtatattgggggctgtggaggttgattgataattacagaatattttgacctagtgactcttttattcagggcaattcctattcctatctgtacattatgattcaaacgatcataaattttaacatttgaatacctgaatcctttgtagtcattaaataactgaagtttaatggctgaatcctttttggtaagaggtgtgtgtgtgtgtgtgtgtgtgtgtgtgtgtgtgtgtgtgtgtacgtacacatatatattcttagagaatccctcacagttgtattcctggactgactctccattctctatccccatttcattacagaaaaatgcagtttcatggtatatgtttatagggagtgatagaggacagtggataaacgtacatttggccatactcagcaagcgcagaaagtcataattgcaacaaggcctgaggggacattaaaactcaactgaaggatgttgcacatgttcttggtgactttggtgtcattaactcacaccagccattttaaatggataatttatgctgccagatggtcctttttggggattttccataaagcccaatcccctttttggcacagagagcacctttatgttgttcccacacttatgcaggcctgcatagcttttccccaggggtacagttaaattgagtaggaggcttttagtagttcacatgtaaattaccttcagaaatatgttgggagttatgtatatctgaatgcaccagcagcctcttggttgcctacatttgggataattctctcaaacaagtactaaggatactgtgtttaggcctcagatgtgacacaggaagcaaggcctgtacctgctcctcactcagaatgctttggtttccgtttacctgccttaaaatgcttttccaggactccctggccaaaagagggccaaaggttgccagaagagacaaatttcctagagcaacaggaagattgtggaaagtaaaacaaaccagacatgcagtaaattacatgggctatttcaaatgtcttttgtagtatcctgttccccattagtttatctcagcacttttagtgcacagctcttattatctgggaagaagggcataggagattaaagatgatgttagtttaaaaacatcagacaacttcagaatgactttcgcttctcttacaatgctgcatttgtctctcgtacttagttttgtttcccagttatctcaaaactgggttagatacgaagctttgaagcaaatcatgaattgacaaaacgagtcctatgaaattctatcaagcacaaatgcacatatcatcaactcttgtttatctgtacaaatgaagaattacagagaaattgataatgcagataaacaggaaagaaaccaatacacagcgcccacattgggtcagacactcatgttgctttcaaatatatggaaaaattctagttacaattgagtacctactgtgtaccaggtttttaaaaaattaacctcctttaaaatatgcaaaatataatgatcctgcctctaaagagataaaaactgagactcataaaaggtcaagtgacttgcccaagcccacacagatagtaaatctgtggatccaaaatccatatttgaaaccaaatctgacttcatagtctaagtttatcttctacactcagtaacctcttttaccataaacatttggagcagcattttagggtctcatgtcctggactggtactttagttaaaacgttataaagccgggtgtgatggctcacgcctgtaatcccagcactttgggaggccgaggtggacggatcacctgaggttgggagttcgagaccagcctgaccaacatggagaaaccccatctctactaaaaatacaaaattagctgcgcatggtgctgcatgcctataatcccagctactcgggaggctgaggcaggagaattggttgaacctgggaggtggaggttgcagtgaaccgagatcgtgccattgcactccagcctgggcaacaagagcaaaactccgtcaaaaaaaaaaaaaattataataagaaacaataaataactcatgagagagacctgaaaaatattcgattttccttatcccaaagccttgtaatacaacttaatctagagaagaaatatagattattaaatatacataggacacaatatataagcaaagagtattaactgttaacaaagtaaactatcgttttcatttataaaatcaaataaccctcagcagttaggtctttgttcaaatagtagctcatcacacaggccctcagtgatctaaaatagctgctgaccctcactccatcatcctataactcacaacactgttttgctttctttacatctgcatctactattttttttttttttctgagacagagtcttgctctatcgcccaggctggagtgcagtggcgcgatctcagctcactgcaacctccacctccgggttcaggtgattctcctgcctcagcctcccgagcaggtaggactacaggtgcatgccaccatgcctggctaatttttgtatttttagtagagacagggtttcatcatattggccaggctagtctcaaactcctggcctcaagtgatcctcctgcctcagcctcccaaagtgctgggattaccagtgtgagcccaccacgccaggccatctctctgctattattgtctgttttctctctctagaatatatacttcatgaacagtgggacttagtctgtcttttccattgctgtatctctaacatccataacagtgtctagcacataataggtattcaataaatattgattgaatgaatgaagcgataaagcagagaatttggggtgctttcaataaacttgaaagcagaatttgctatcaagaatactctcagaattggtgtttactacactttcaatttgtaggctttcagtcaaatccaattactagcaagtcgtaagcagaacaattgcttaggctcagccaaggacctcttgacgagcagcagtgcattgactttattacaagtatccctcacctgaaagtgtgttcctttaagtgaatcaaaccttttttaaaaaaacaaataataattctgtattatttctaagtttgttgtttagtattagctccgtattaagaatcccaacagtgaatcctttgtagaacattttatgtagtatagacaacctccctgacttacctgtgaaaaattcagatttccataccaaatgttctcttctacaagtgtaaggagcacccatatgagacacttcagacccttgctgctccaagtgtggtctgaggacctgcaacatggcatcacctgggggcttactaaaaatagagaaccctggccgggcatggggcccaaggtgggaggattgcttgaggccaggagcttgagatcagcctaagtaacatagcaggaccctgtctctacaaaaaaaaatttttaattagccatgcataatggtgtgtgcccgtagtcccagctacttgggaggctgaggcaggaggcttgcttgagccgaggaactcaaggttacagtgagctatgattgtgccattgcactccagcctgagcaacagagtgagaccctgtctcaaaagaaaagagaaacaaacagaaaaacagaatctcacgccccacctagaccaacagaattttaacaagatctcccggtgatgcttgtgcatgttacactttgcaaagcactgatttaggctgcttttttgttcctttaggtgggttctccctactcagtacttgtctggaagccaccttaactttaaatgtcacgctctccaaccgttctctctatgttaaagtaggttctctttaaaacaattctagataggtagaaatctagcctattttcaaatagattagaaaagattggattctgggtgactctagatacctcactataagaaaaacaattctcttgtctccctctctgtcccatattcctccagtttagggcctgctgcatgaaaaggaatggctggtcttctaatcattatcattaaagtcaagccaagttgttgaatccttattaagtgctgattgtatgcagtatactagagtagatacagagaggactccagcaagtccctgtctccaagggcaaacctctgaatttcctcaagtgtcagtcactacctgtaaggtgggaactgttccttctgctccatctctgtcacaaagttatgacagatgaggtaatgaagtccaaagtcctttgtgaaaattaatattctctaatcacgtgaaatatcatcattaggattactgaggcagccaggcttacccagctgagggtagttgaaagcagacagggttaagtgtcacaggagtaaaagaaaagagctgttaaatctggagaataagggatagtttccttaaaaggtggcaattaaactggatttagatggaatcagactgagaaatgttcaagtctcacttgaaagtgagacttgtctcttagtcttttgattgttagtatatataaatttaagtcttcttcctaagttgaaaggcagctctgtggctgttctgtgagcctttctcaggttatatttgtccccgaagttaacgatttataccaggggtccagtgggcttcatggatgactgcgttgcaccactttcagatttgagaccgcatctgcattaagtacagacatatcagtaagttttggcagacctaaaaagtaaagcaaatttttttattgtaaaaaaaaatgaaattacagtacttttcagtgaagttcagtactgtgtttcaaatatatgcataagaagctacttaaattttctcctgtagaaaaacattcaaaattccaaatgccttcaattatactgggattgtaaaacaattaacagacacagttacatccaccaacatgttgaaagtttcaaaacagtttagtgaaagttttgaagtcaaatttgataaggaataaatttagttttatttttataaataacttttggagatacatttctctgcaaagagtaagttgttctcatttttgaaggtcaaaattaagtactttaggccgagcacaatggctcacacctgtaatcccagcactttgggaggccgaggtgggcagatcacttgaggtcaggagtttgagacctgcctggccaacatggtgagaccccatctctgctaaaaacacaaaatttagctgggcgtggcggcgccctcctgtaatcccagctactagggaggctgaggcaggagaatcgcttgaacccaggaggcagaggttgcagtgagtcaagattgtgccattgcactccagtctgggcgacaagaacaaaactcctgtctgaaaaacaaaaatgaagtattttaataacatgttctctgttcctatcacaatgattaagaaacacagttttaaaaaattgtttaaaggcatctgtcaaagaatatttcggtaaacatctggtcagtcagcgacccagggcattcagaactaggggtcagtgtcacaactactggcagcatagttgaattttgcagacttatgttagtcattgtaattttaaatatcacatattaggttcacctggattcccaactctgctggtcctaatttgactgccaacagtcatttatcaattgtaagagtggaggaagtctaccaacttagatttctagctgagacacaggggaaacccattatcagtgccagtaaaaaggcagcgactggtaacaatagtgctttgatcatggacactccactgcactagcatatattagagaaaatgattaaatctcccatcatctcttgctggagtaggaatagtcactgctacagaacattgccatgggatcgatgtcttggcttttcttctgcatttatggagcagtaggaaagcatcatctgggaccacatcctcttctatgatctcatattggcacctgcccattagagactggtacaccaggggacattggtacagtaacaaggggcctcttctttacgaacccttctttatcagagaaatttcacccaaataaggggttatgacaggaaagctgtattaccaaatgagcactgtaaccacccttcaaaaatcccttgccttctttatcaaggctgttttttcttaatgtcagaaaagggcctaaaacagctccttgtaattggagtctaaaaggttacctcttagaggaaaagaaatattcttctcatacacacacacatatactctgtgtatgtgttatatacatatataataaagcatgatccagaaaactgtttggattcctgaagcctctagtacctggcgacttagtagccattcaatcaatatttgtttaataaataagtaaataataagatggagatcacacacgtctcactttgtccttcgagtaggatcaagcgctcagaagcagagcgatgtatacgtttgtcgaacgaatgagcgttgctccgcttgcatcggagaacccagatgtacaattttgtgaatgcagaagctctcaggaaaacagatgctgcatttcagctggtcttgtctgaataaataaattacccaaatctccaaatttttaatttcatgtttgaaaatgaagctgtgtaaatattctagaaggggaggaagaaggagatgcagtgtatacattaggtttatatgtgaaatcctcctccctgtgcctgtcaccatcctcagtacagcccccgtggctcaggtggccaactcatggtgtggcttgggtggagcatactgtaaagaggaacattaaagcaaatttcattccaaccacagcaatcttcataggcttgctggggaggaagataagtgagaaatagaatgtattttaaagaggaaaaagtacaaattaagaattttaaaagttagtcattctcatattctgccatgagcaagcctgagaattttagcaaactacttctctgaattttcatttcctcatatgtaaacattgaggacaataaaacagccttgccttcctaactcatagctttgaaaagatcaaatgagatgataagaacaagagctgccatttattaagcatcagctctgtgtaaaagtatcgtgcagggcactatacatatttttaatatacgcaaagtatatttaataaatcaaaatgctgtaaagaaatactgtatatcctttttagggggtaaatactttgaaaaccctaaacttactgtatgaatttaagatactgtgaaatttatttgataacatatattacacctctgcatctattatatgcaaagcactgtgcaaaaatgatagaagaagtatgaaaataagcaaaacagaacttgccttcaaagagcttacagcccagtgaaggaaggaagggtaactggttaaataagtacccaatggctgtaatagataagatgtagagcacagcaagcttcatatgggtgaggagtttattcagcggcttagaccacagtcctctgctgtgcctgcttaaaatagctggtgcatcagccatttcatcgttaaaggagcagcagtgaatactggcccgtttccttcgtttcgtaatatcagagtcgaatcttactccatctctaagaagcttctagagagctgacatactaggaagtcctcaagaagtgcatatacaaaaatacagtttatcatactatactcatggacccaaatctcccctgcctgaaacagacagttttctgatttgtagataatagattgggtagaatacaagcaaataatttacttggagggaacaaaattaatctgaatggagattaaattcaccagagggtagaataaccagaaagtgtagttggaagaggaggaaggaaagaaaaaagacagagcgatcattgatagaaagataatagatcagacttacctaagagtataccatgttttcctatatctaatattatttaaatatttatagaacttaaattgaaggtagttttaaccatagatataaagatgaaaatactttagtgatcttacttcctgcgttctatcatataaacacagtgtagctattttatagactcaagacaagttgattaacaataaatatatattggcttgtattttgtcactgctgctgaaattttaaatatataagcgttttataagtaatagcaataactgatgtttattgagcacttactatgggccacacattgttctaagctatatgcacacatatataaatatatatgtgtgcatacatatacattcatttaatttgtaaaaaagtgataccactaatactattgtttgcagacttatttccctctctcatagggtcttatatttttcctacatactgatgattctctttaaacgttaaataacctaatatagcaccatcagtttatatggaaataaagttctgtggtttttggccatcaatgtttttaacaaagtagtttgttaacactccagaataagtggcttttacatggggaattggggagagagggaagaaataagtccttggtctgtgcagatcccagaagtcaatcaatagtgtgtgcagcacgctgctgtgcagcagtttctcatgaggctgtgcacatcccaattgctttctgctcagcagaggattacaataatgcctatttatccagctctgtccatccaaggattttagatacatcataaactcatcaattaatcagagacatggcacccatttcaaaatgctgggagaattacatcctggaagattacgagaaatgctcacgtcgacagagtaaatcaagaactatttcctgatggattcctgaatggcacaccaagtactgaaatgaagagggctgtctccagcactgattcacaaagtatatctcaagtggaagaaaacttccggaataaaacgtcactttactttgaagcatctgttaaacttgaaaaattaaactgaggtagaatggcaaagctcattaaatattaatacaattaattggcttccctcttcagagtaaagtatcactgacctccctttcttaacaattaaaacccctctgaaacctttgggttttttaaatacagtgtaactttggttcttgattctctggtctttgtcaagtgaggaattcttcctgtggtccagcacgctcagcccactgtggggaactggctttccagacagctgtgaatgttcggtatttattcagacaatactcccacactttgatgatttactgtggtccaagcatcttgttcctcattttgaagaaacattccagtctgtaggtatcgtctactttgtatgtaatgagaggtagtttaaagttttcatttgcgtagctggaagtgcactcacgtcattagaaattcaaggaatggcaactcaatatccatttctaatctgaagggtcttccctgcccctgccatgttagccccacccagaaatcacttaactatgattagcttccaagattagtgaattctaggatagcaggattacttatgacttaatgccagtcagaatttgccatctgcctttcagccatttcatgaacccagcagaagagagcatttatcaaaatggctgtgcaacacccctcatgtcttaacactctttagggacttatataagcaacacttcatgttcgaatgtcaaaatccacgtgtaaggcttaaaagtagtatgggatgcttaagaatgcttttcagggccagttattctttgatatttatcacttcatggtgctgacacctgcttctaattttaagagttcgttcttccagtggatttttttttccttcagaaatcttatcctcaaaagacttaactagcaatttttctttttttgatgtgcttgatgttttgatgagtttgtctatcagcattgaaaccttaacatacctttcatttagaataaaaaaaaatctttgtgacacacatttattatattggatcacataaatttttgccctggcagtacattcgaagacttttgcagagatataatttattagaaatgtcattatctgccacttggcctacttgatagttgtcttaagttgacaaaagctatagacatagataaagtcttccttgagggagcaattcagtaaataactttcacccaatacccttatttggttgtctttcacacccaagggtcaggttggtggcaattgtcatttgagagttagtaagtggaaagacaaagacagagaggaacctagttttgtctattgagacacatatggaaatagtcctttggtttgggtgtagccagcctagttgtagtgcccaatgtggtttgctttcttgtttttatcttgtctaaagacctttccctcacaagtttcctcacaagtgctggataaagttcattgcatgagtagaagaagccgcaaaagatgatatatagctagcaacccgttctgattggtctatgaagagttgcctgtataaaattggatccttgtgttcggttccaaaaaaaggtgtgaatgtgaagaagaagtgttaaatcatgactccagagaaaatgtcggccatgagcagtttttagtttaagtgaaaaccaaactttaggatttggacaaataagatgaggagaaaaaagggtgaatcattaactccaatatgaaaggattatggtgatcaagtttcacccaacttgaataagaaacccaacaaagactatgactgatggaactaactcatttacttaattgatatgccaaactctgccaagcatttacccttagtgtcaaataagtaatttttaataaaatatttctaagatatgaagacagttaagaaaatagcatgctttttaataattgtactcataagtaaatggatcattacattgtcacaaagaatgacagtgagcagaaacagcctgctaatccctcttagataagtatttaacataattagacagacaccatctcttctgttgaatgtagcattaatcattagaagtgcaactttacacagcatacttgtttctgatatgtcattgttgttaaaaaaaaaaaagcaaactattttgtcagatacagtgcttcagaaaatgactcatgtagttgtgtgatttacataaatacagttatttccctttttattgttttttgtttgctttaatagtgtttaatagtagtgtggtccttttacatccatgaagctgcatttgaggtaagtggttcatacattttgttttgcaaaatatcagtatagtgaacatacttgaatttgaagtatttttaagctttgaagggatcttttggctcatctacctaaactgaaggcacaactctttcagagaaaggttttcttataaggaatgggctagaagttttctgcattaaataagagctgaagagagaacctctttctattaaaaatttgaggttaaaatgatggaatgtattgccctcttccagtattcataagcactacctttaaaaaaattcattttcttttgctgtgtagcttctagcttgaactatgaactacggaatacttataaagtgatagcagctcaattcattgcacaacgctagcttcccactttctctgtgattcaaaggccttcgaaggcaaagaatggggttattgaaggatggcaggcagatttcactaagtaacaggtggaggtcaaagcagtttatttgtgggatgaacagagtgcagagatgaaaaagcaaatgctttgccataataagatttagcaagaaaatgctgacaacacgaagccttagattctagctgacagaaccttttctcgtgttcattacttgatttcacagttcaagcaatttgaagagggctaaaattttctttctttttcccttatgaaatgtttcaatcagtttcaaatttttactttagctgggttctctgcttgtatccaaggaacactggaattaatagagctccagcacaggcgtatcccaaacatggaccctcacagactatgcatctctttcaaattaaattttatccataggacccttaagctctagctctctatcatgttttaactgacagaagagagtatatttaagtaaatactaaagttcacatcatcaaggctaatgttatatgccaacgaaagtattcataagggtgttaaccaagcttgaacactgagttacttccagcttgttggagatggagaggaaaagctttcatttttttcccattatacagttctatatttgtacagtgaatatgtttcgcttttggaagttaaaaaaaaaaagactaaacatgctgaacaatacaaaataaggtttatctactgttgtacagcatgaccaaaaaagtaaaaagttatttggtatcatatcatagagaccagagctgtccaatagaattttctgcagtgatagagatgttctgtgtctatactatccagtattctaaccatgagccacatatggctactaagcccttgcaatgtggctatgctgagcaacttaatttttaaattcatttaattttaattaatttagatttaagtagccacatgtggctagtagctaccatattgggcagggcagatataagccaaacatatgtatgattgagttttttactattcagctggatatctaaggagaatgaataaaacattatgctattttatactatatgtattgtttatgcaaagaaataatttggttttctcagaaatgtcttctttatcctcagtccttctgtgaatgcgtataattgctatgttgagctaaaatcagtcctttcctgaacacatggggggatgggatggctagggggcagatggaatgggtagggaatctccaacctcttgtaagtatatggagcatgtaacacaattttttttatttcagtcctgtcactggggtgtctgtgtttaccttgaaaggagaggaaatcccccaactagtcaagagattttatttttggcccagaaaccagatttttatatgacattttccttgtgtctattctttactctctctggttgtaaattttcactcacaaatgaacatttggaatatattacagaactcatcgtttctttccccctgaataatccatgtaatttttactccatactcccattttttaaaaactgaagaaatcactgatgtccccaagccatttaaattacctgaacttctttatgatgtgataattctttgggagtccttttagctcattttcaatggctacatatagagtaagaaggataaacctcagaagctatattaactttcatttatgctctctatcataaaaatgattttaaaacatttttattgactgaaaaaggctaaaagtcaaaatagtctattttacctttttatcgttgagtgtgctaatcataaaaaattatattagaatgaactctaatggattttatcattaggacacacatctaacaaacgtgtggtgtcttcaacgacctccttgtatcacgcagcctgtgtttatgctcacaagaacagaatggtcccttaaccgtgggattcttctgttcagtcacagcctttatttggcatcatggttagagataatctaattacaaggtatactttaaatggttctagaaaggtcttgttcctgcctgtgggggaattactagagtgcagtatagctctgcatctggaagagatgtgtctgagtgtaaatctgatggtggatgacttgcaaaagatggtactggtactcagcattcatgctgggcttgagaaatgtcactgaaatttatgtggacaccattagtctgatggacatgactgagctgtctgttccccacacttagatctagtggagtaggggaatctgaatgcctgagtgtaaaaaagagtcacaaagcagttagcatcattaagacttggaatgtttgcaagaagaaacatgttcaagtgtcattaatagttcagatttaaatcagctcatgataggtttgtattgataagatacataagtagtactcccccgcgccctcacccagaagtagggatcttggtagcatggtacactgaaaggagcaagagctttggtttcctgggttcaaatcctggctcctccactcactgattgtgtagcctctcaccttcttaaggactgcactgcctcaggcaccctctcttctctgagtcatggctttctgcctgtctgctggaccattcccatcagtagacaagcatgctggactctctcccaccttcagaaagctatcccttgcttccctccctcttcctgtagccactaccctatttttctgctctcctgtgcagattcctccttcgtttcatggaagttgactacaccatttcccctgtttcttcacttcccattgattttataaaccatgctatcctgtcttctatgtgcctcactctcctggaactcacttttcaagactgtcagaaacattcatgttgccaaatccagtggacccttttctgtcctcattatacgtgatctctcagtggcattcaactcagttgattgcagccttctccttgaaacacttcttagtttctataaagatatactctccaatgagttaaatgcctcaacttagttgcctgtttagatgctgactttagacactcgggggccttccttgatttttacacattactgaattctaaataattgtgtgtgtgttatagcctctggttaagtgagctatttattactgcattgtaatatatagtctaggcttggacactatcaacaagtcttaagagaagaatttttgtcctttcttgttatagatagataacatggtttgcaggaggctttatagaaaaagcaacttgttgaataggcaagaggcctatagtaaatataaaacatttatatactcttttgcaactcaacatctggggtcattatcttcttctaaatctatgtgatatttattttgtggaggttctgtgttagaatcgctgataattcattcagtgtgtgtttgataaaatcttaactgatccttactaaggccaagagaaaactttgatatataagacaaatgattcctagtatacttcagagtgggtttttttgcatacacttttgtatctgatatacccttcctttttttccccctttggataaccaaatttaaaacttcagctataaatatactttattgacttaaataggacactgtttttatagtatactagggaaactacatgagggttttataaaatgtatgcacttgagaaccagagagacctggatctgcagtaccatctaatagctgtatgatcctagacaaattgtttaacatcacttgatatctaatttctgtaatattaagttattggtagaaaagataataatacctacctatctcagatgaaaatgtaaggatttggggatggacacggtggcttatgcctgtaatcccagcactttgggaggccaaggtgggtggatcacctgaggtctggagttcgagaccagcttggccaacatggtgaaaccctgtatctactaaaaaaaaaaatacaaaaattagccgggtatggtggcatgtgcctgtagacccagctactcaggaggctgaggcaggagaattgcttgaaccagggaggcagaggttgcagtgagccaagattgcaccactgcactccagcctgggtaacagaccgagactccatctcaaaaaaaagaaagaaagagaagaaaatgtaaggatttgagatatttataagtacatggcacatagtgggcacttcataatttgtagcttttattattttcagcctggtttttggacgtgatcgacatgcagagatttaatctctgtagctgcctcctgcctctcttgaggccacttgatggatgaaggcttccagttgcctttaagcctttaagtttggtgtaatcgttgttctggtaataacagttataaaaataggttgttgggaattagatgatgacaatgaacaggacactatccaagtcatgaacaattaaacttgtaacattttggggtcctctctaacctgcttattgtattggatttaaaaactaaagtgctgaggttgcttgctttcagagtttctctccgtttgtgactataaatgaacattattgaaactaaactttctattcttgactttgtcactttgaagaaaagaacatacaccagttatatcttctctgacaacttgaattacatctcccaaactcctgcgacagacaagataaggtcctgctgtcccgagcagcacttaccagggatacttttaacaggagaatgaatttttggataggtgctctaacaaagtaagcactaacactgagaagttacagttccttttgaaaaatccagcatgttgttcggttgtcactggaataattatagtttatggtgatccttcccttctcttccattcccattaatgttgtagctcctttgactcctaaaaatctcccctttaagaagatacctaaggaagaaaaaacagctttgtacttcctaatgattcctgcagtgtttcctttactattgtcactatggagttcttggtcaaagtgtctgaaaaatatcataacttgggagtaggggagaggtgaaattaattatgattggttttcttctttttattttatgtgatatcaaattgcagtgaaaaattccctaaaacaaattttaacttcttaggggagaccccaagaatttgagtttttttcccacgtcactcaatctaattttgttattgatgtttctcgaaagaatcaggagaagtagaaattttcaaaagtatttatgtccctcgaaaattaccactttttagttccctttctaagaatacgtcttaccgttttctctaggtgactaggctagtgaaagactatacaacctagggtggattaggtaaaaataagggaaactttcagaattatagagagtaattattgtacagtaaacatctttaatacacacatgtctagcattgcagtcgtcttatatttgaatatcatgtttgttttctgtactgcagaacaaattttcacagagttagcaacttgaagcaacacacagttattaatattatctcacagtttccatgggtctggagcctggccacggctgaactagatcttctgcttaggtcatacaaggctgcaatgagaattttgttcagactccatttctttctggagctcaagggcctgttgctgactctcgtgattgttggcagaattcagttgcttgtggatgtgggactaaggtccctgctttctgaaagctgtcagcaaggggccccactcagctcccagaggcccctgcagttccttaccatgtggctgtcacaggccctttcacaatatggcagctgacttcttcaaagcctgaagaagaatctctctgacttctaattccttttatacaaggctcccctgattaggtcaggccctccagggataatatatttttccttaactcaaactcacctgattggggaccttaattatatctgtagaagtcttttgcaatataacataacctaatcaatataatcacctttgcggtataatataacctattcacaagaatgacatttatcatattcacaagtatctcacacatgcaagaggagaggattatataaggcatcattatacaaggctggaaactaggaagccatcttagaattctgagtaccacaatttttttttcaagataaggtctctctctgttgcccaggctggagtgcagtggtatgatgatagcttataaactcctgggttcatgtgatcctcctgcctcagccttctgagtagctgggactgtaggcatataccaccacactcagctaactttttctttttcttttttttttttttttttttttttgagatggaatcttgctctgtcagtaggctggagtgcagtagcatgatctgggctgactgcaacctccgcctcccaggttcaagcaatcctcctgcctccacgtcctgagtagctgggactacaggcacatgtcaccatgcccagctaagttttgtatttttagtagagatgcggtttcaccatgttggccaggatggtctcgatctcttgaccttgtgatctgcccacctcagcctcccaaagtgctgggattacaggcatgagccaccgtgcctggcctcagctaacttttaaaaattaattttttgtagagataaggtctcactatattgtccaggctgctctcgaactcctggcctgaagcaatcctcctgtctcagcctcccacagtgctgagattatagacatgagccaccagcccagcctgactaccacaaataccaatgatgaatttgaaggaatctttgtgaatagtgcatttgacctgtattttcaaggttttcttgttgaactttgcacttataagtgcctccagagatgaaagccactacatgactagaatcccatatatgtttgcccttgtctactgaacacaatttggaatgactcatatagcttagaaaaaaatggcagactagagggaaattgaaaattcaaaaattctggatgtttagaaaaccagtgacaagccacaggccttcttgacatgtttctccaattctatttactctcattgggtttttttataccaatcaaaaggatgaaatgccccattgaaacaaaacattatgctagatttctgcttctcattctacaaaagtctttatttttctgcattgaactttgaagtaacatttcatttcctccagaaaaagagtaggattacttcatccgtagtctttttttaaaaatctggtacttctagaaaatacattgaaattaaagttttaatgcattgaaagaaagccaatcagtcattaatccatacagtaattttgtaacagttgtgcataaataattggcaaaagagattttaaaaaggagtttatttttaaagtaatgtacagaaccaaatttgatttcaaaaataaaagccaacattaatgttttctagcttttaacagaaagcagtttactagcattttggaatttcatctggtcaattaaatatacaaaacaaattaaccaaaacatacattatgtatgtagagaaaatattaaagtatataataaggaaatgtgctcaatacgaactctttaaaaattgaaaacacaaagtaattttgagattcatgacagccttagggttcatattacttgactgtgataaatttagaagattatacatagtttggctggttgttcctgcatgctgacggtatttcttccgtctttaacccttgcaaagaagatttaaattttgctatttttgaacttgtttaccaacttggtcattcttgatacttgttattgcccaaattttacttgtaattccttttagaagcataaatagtggatttcaatcatgtcaatatttctgcagtatttagaatggcatgaattagaaaacatgaatttttcaaagaaatcataactttttcttgagtccagccatttgctatcatcaataagattagttaggatactggatttcatcagtgattccattatctgaaaaaaaaaaaaaaatctgccacctttaaagttttgatttttgttttaattatctgttctgcttctgttttatgacatgtagttcaggcattggactaaatttaaatcagtggaatggttggcagcctataaattggtctacacaaaaaggtttaaatgagttgggagatttgtttacattttgctagctttttatttctttcattttttttatttgaaatctcctccttagtggaattacatgatgataaccttaggttaggttatcttacagtgaatgttcacccaaaatctcagtgcatcctacattagaactttggtatggtgtgactggttactgattcagcaagcaacaaatataactaaagtcacttaattacttcatttttaattcaaatcacatggatgttgatctagaaaggatctgattcaaattgtcaaattagtatgaaatcacataccactctatgttgtacttatatctgactatgcaaatgtgtttaccaattttcaatttttctttcttggggtgaaaattctaagctttgctatgtttaagcatctattcatgaagctacagataaagctgagacctgcacaagtagtttaaatatcttttcagaccatttgggtgtttcagacccttggaggtcttggacatagaggggaacaaagcagacaaggactctgtccttatacagtctgagtcacactcaaaggtcatgttgtagaattgcattaaggaaatctgtgatcagaaataacagggacatatttagatacacgcaaaactagctaaatttctggaaagatctatacctataaagtgcttggcacagtacatggtactccataacagttacatgttaatatcattatgatttttattacttttccagttcatccaaataattctctggtcatgggcagaacacagcacatgtaaacatgtataagtaaaatggaatttggttcttttaacatcagtgcagaccagttttgtgctacaaccttaagagagcccaaatttgtcccctgatgcggagactaggagtcatttcttttatttttatatccaaattttcattgttttaattggcaccctatcaaactgatagatgcctccagttgggtatgtcagcgtggttgccgagaacattacaaatccagtaattacaaggaactgtttctccattattttcttcccaaagcattttctatgctggaaatgctgtgaaaactttagacacaataataaaagtactatttttaaaaacaagcttttattgtattaacatgaaagcaatatatgttcatcatagaaaagacaggtaagcaaaacaaaggcaatgaaaatcacccaaattcaatacagagagagaactaccattatagtttatgcatattgccttccagttctttctctgtgcatagaaatagccttttcaatggtgtcatagtataacatcctattttgtaattgcctttttcaattaacattatattataaatgttttgccacatcattactcttttacagtattgcttacattggttataccatacttatttaaccagtccccaattgtagggcatttaagatttttttacttttcttttttctttttttctattctaaagaattcattgaatgaacaactaagttgccattgttgagggtattcttatgttaaaacagccaaattatttaaaatatggagaaagtgatttggtgtcaaagcaaggtaaccaacaagatgaaacgattgcatgtgaagtcttcataagcatacatggtttcctttttgggagtcacagaggtcacagacacaagcagcaacttttaggaaacactggaaaagttgaaccctgtattattattgaagaccaataacccaaaaatggactgtgattaattagaataaattgaaatcaaatacagaccgacttatcaggggactattctgtcacctctttgtttctgtgacaaatgcaaagcaattcacaacatctttttcattcacaggtggatttctctttttgtttgtttttaattctttaaatgttatcttttaggttgcacaaatcattgttccatgaattaaagtgtacttaccagttgatccttcttgccaggaatgccatctccaaccacactgaagaagtcggagaagtctggtttcagcagcccctccccttcacagacctcctccctgggaacggcgttcacacagcatcaccgacctgtcattacaggacccagaggtgagctgctccacaggcacccttggttgtgcttatatcatggcctttggacccaagtagcaaaatgagaaacaatgaggactccccctgaacactcgtgaggcagtgagtgttccaatttcttacccttgggggcagccttggaattttagagaccaaagagatttggcatcacattttttgtcctttcctaaggcaaaaagagaccaaatctgttttttgttggccagtgagatttttgcagaaagatgggaagtaacttgaattgaaccaaaatcaaatctgttctacaagttgtgtgtgtgtgtgtgtgagagagagagacagaatgtgtgtgtgtgtgcgcacatgcgcgtgcacacatgcatgcattgggtgagtatatttccatgtggtcaattacctgttttcaagtagtagctttttctcatccctgctgactctctttccataaaacctgatttcaatatgtggcattttgtgttgaggttgtttgcatcagggtgttgacgagcagtcttcattcactccttttgaagtggtagatagtttgtctggttttcattgcaatgttttcattatttttgtctcatatgcttttaagtttattattaaaatgtgtccacgagaaatatgatttgtatttcgcattaaagacaagccttaagcctcaagagaatgtcagcaaatcacttaacttgatcttattgcaagataaaaatatttattattttgtttatgaaactcccacagtagaagtatgaataattgtagccatgtttgctttcctttatcagattttcttttaggtaggtctgtgacctaccagctggtttcataaaacatcctagaaaattatgatctcttgtctgctttgacatatacctggggaaactgatgtttcttgcattaatctcaatgttagccccaccaatctgaatccctttatgaatgtgctctgtgtgcatctcagggaaatgtggcaggtaagagggctgtccggtgcacacatgggagtcatattgaagaaagtaagcattttgaccactgtgggaatgaaacttacttgtttcatctttaaacatcttgtgatcattggtagaactttctcaagatcccttctttcatttgtgtattatgtgtggtataatcagagaggcttactatcgatatataatttgaaaacctgcatcagaattagattataaggtcccagaatgaggcttattaaatagtattaagatattatcctcatagttaacactcattgagcatataaactgtagtgggggatcagagatatgaagcccttttagtcagaatatttatggcctgaaggagatgaggcatgtgttgtttttcatctgtttggggtcaagttaacatattctaaatgctaactgaatggtaaaagttcctgcaggagctcagtattggggggaccgtggaggttcattcactctttaaacaaggatttactgagtgcctctatagacactgggaccagtggttcctgtcctcatagagcatgttatctactgcagaagagaggcacacaaggaaataagcaagtaaaagatgatgggccgggcacagtggctcacgcctgtaatcctagcactttctgaggccaaggcgggcagatcacttgagctcaggaattcaagatcagcctggccaacatggtgaaaccccatctctactaaaaatacaaaaaaaaattagccaggtgtggtggcacatgcctgtaaatcccagctacctgtgaggctgaggcaggagaatcacttgaacccaggaggcagaggctgcagtgagccaagatggtgccactgcactccagcctgggcaacagagcaagactccatctcaaaaaaaaaagagacttcaaagtataaataacattgaagtcaaatcttaaaagatgcttagataaatggagggccatcctaagcaaaggaaagatttgtggtgtagtaagttagtaagaactgagaagaacagtatgccagcaatcaggagagctgggtaggctccctcttttccttcccactcaccttctgggttttttaatgtcctcatcaatatagtgggtacaatactaataatgaccatttcctcccaatcttgtattcttatacagaaacaacaataaaacagtatttgtggagattccatgaagagcataatgcaatctgtatatattatcattagtcagtaaatattaagagtgtctaatgtgtgtcttgccttaaaactgtagttctagaaattactgtcatgggcacttccctatgggtacaggttgagagcttgttcatgctagatgactaagcacattttctaaaatgacccacgctgggttgaaccagagtggacctccttagctcacagcataacaagttgcagtctattcatattcattcataaaactgtgtttgaggaaaagagaaagatgcctagtgtaagaattatggaataccaaagattctttgttttcaccagaattcaagatggctcccagcatcctcggctctcctttctggaaagtctactcaggtacccgttcttaccgtgtcccaccccgcttagtggtctggtgaagggaattggagtagttgagatgaaacttcagttgcctctttgtggtaagaatcataagaattgagataggctaacgtaagacatttttctggctaagacatttttaaaaggttggaattcagcctcattatttatttgctgtgggtactgtaatttccttcatttctctctgaactagttggaaagctaatgcttggaatgataccacatttgggagtaagacgtggtgttttaggaagatgaggccaaaattgaggaggaagagtatagctgcaagagtcagtgtggaatcgatgtcacatgtgcgcataaaggagatttcaacctctgacactccttgtattgggcaaagttgccacaacccaaaatagtaaattattagataatccagagaatcaaactttaaaaggatcttgaagaaaagaaaagaatgtcctttatcaggtccccagggcatggggcagggatcacggaggccattgactgctctctggttagcactaggttgtgaggcttctgctgccttccctagcatttatcacgggaatgcttcaactagactagcaccagttagtaagcaataactgtccaacacacatccacgctcagaatggagatgagattttacagagctacagcaaatcaaggtcacctcactaaaaacacaagggccttacttttggctgcaaacataagctacatttggaaatttcacagccaccttttacaaagaaaatctctctcttaagattgcaaagcaaagggagaaacacagggcgttgaagggaggtagcgtagcacagcggttgtccttgtctgttttgactgccagaacagaacaccatagactgggtggtctataaacaacagaaatgtattgctcacagttctagaggctggaagtccaagattaaggctctggcagcttctgtgtctggtgagggcccacttcctggttcatagatggcatcttcttgctgtgtcctcacatggcagaaggggtggggtcgctctctagtgtctctttcttaaaagcactaatcctattcatgagggccccaccctgtgacctaatcacctcccaaaggccctgctacctattaccatcacattgggggttaggatttcaagatatggatcctagagggccacagacattcagcctatagcagtggttaagcacaaaatctcagggggtcagataggctggtgtctgaatctctgtccactacttggcacattgcttttctctctgaaccaaaggtttctcatctctaagttagagattatcatctctaactcaaaagaattgtattatgttaggagcaaaggaaataatgtatttgtagtcatttgcacagtgcctggaagtacagtatgcacgtgggtcatacaattaaataatcctttttcacccaggctttgaaagtatcatgctgtccctattgccttcgcccagcaacattctgcccatcccccagatcagctcaagcactttctttttttttttttttttttttttgagacggagtctcgtcaagcagtactttcaaagtgaaacctcctctcctccacccagcttgccatcatctcacactgcttaagctcctgctgcctttcatgtctgcacattgactccaccaacctcatctggccttgttagttaatctacatgtctcctggaggagaacctccaaagggaaggatctctaacttagacatttcactatctttgttgtgcctcacacagtgggttttatgctcaaatattggttgaatgaataaaagtagtcaaattgcatataaatgcacacaggagacatttatcccctctctgaccctgatgagttttcatttcttcagataaatgtgtgatagttcatgcagtacttccttgtaagaaatgtccaagacatggaagaaccatggcgttgcatccaaagaaaacctatgcaagattctctaagtagagctttgctattaagagctatgggctttctttatgttgttctaaccacttccctatttatagtgtaaaggtagagacatgtggtttcttaaaatgaatcccctctctgatagtggctttctttatggctttgataaatcacttaaccttgtcgcctcagtttggccatctgtaccatggggacaatactttaccacctgtttctctgtgtggttagaattaggtaaagaggttatttgggaatatcctatcgatagggggaagatattaaatttcagtagaggcatttgtacatcgttatacgttagtataattactgtgcactttaagctgaaagattgagctttcaaagactttcttttaccactacttaaaattgtaaccatagtaaagtatttactcatgactatttgtcttattcatgataattgaaaaaagaaatctttcttcatccctttgccttttcaagaattgtaagtttgcctggttgatgatctgaagggtctaacttgttagagaattatttagagtaatcatcagttacatcttaaagtttcttgaaggtttagatcttcttgaaacttatctttttgcttaaaatctttgctgttttgaagattaagaagatagtgaatgatactttatttaaatactctgcactaagtaaaacaattctgtgccttagagatttaggaacagagagcagcctacacgatccacattgggcagcacaattgaaagtaattgaaagagttatggtctgggaatcttttggtataatgtgttcccagtatcagtgaagattgtttttggctgaaagtaacagaatatctgactgaacaatggcttaagaaaataaggagtcacatttttctcatacaaaaacaagtatgtggctaggtatggtgactcacacttgtaatcccagcacttcaggaggctgaggcaggaagcacttgaggccaggggtttgagaccagcctgagcaacacagcaagaccctatctctacaaaaactttttaaaattaggagagcatagtggtagagacctgtggtcctagatactcgggaggctgaggtgggaggattgcttgagcccaggaatttgaggctgcagtgagctatgacggcactccagcctgagcaacagagaaagaccctgtctcaaaacaacaacaacaaaaaaaagcaagtatgtgattcaaggctgatagggtggcacttgcagtgccatcagggattgagatttcttctcctagacatgtttcagtgggttgtttttatgaggtcacagcatgggcgctgccccctgccttatgtctgcatgccaagcagaaagaagggaaaaggtgaaggcaaaaaggacctgtcagcttatcctgccactttttcataggatcttctgcagcacaatcagactgtgtcccatgatcacctgtagctgcaagggaggctggaaactccaaatttttagctgagcatatggccactctctataaaattaagcttttatcagtgggtaaataagggataaatatgctggttgacagttagcaacatattccccattatttttacagatgagaaatctgagctagccagaaccaagaccagaaatcaagtctctagttcagtgccttttttgccatatcagtagtttctacctttttctcccccgactgggagaaattaactgcatttatttaaacaattactttgttttcacattttttatgagtcaaagtcataacatatccatctagatcttttgataatcataatataacctgtgccatcacactgagttttttttttttaatagcagccataaacaaatcacttagccttttttattagtccataagtccttgctactggtaaatttgtggtttctcttaggtgcacgccactttagagacagtttttgaggtcagtttggcttttttcaatattgtattagtttgcagatacctattactatctggggacccattaatttttttccacaaatatttatcaggctcttacagtgtacaagatgctctagtagtagagtgaacaagagaagcatggattctgtcctttgagtgcttgcctcctggaggacgagaggacaaggaaaccagcagttgcactgctgtgctagaagcacagggtgcggtagaaaatgaggggaaggacatccttgtggacaactacagtggcatctggcactacgcaagtccagacacacaggagacccaaccgctattgtcaaacagtttgccttcgcattatgggcatggaaaacagaacaacagcaaataaatcatgctcttagataactaagtaccaaagaattcagacatacgaaatgcaaacatgaggttaaacccccacctctttatgagtcaaaaaaaaaaatacacgatgggagtttagaagtaaaattgcctggattctgaaaatacgcctaagatacactaaagcaatcaccatataaaccaaagatttattgtgcagctttcaaagaatcattccagtttctgtttggagaggtagtcagaagtttatatgctctataaacctctctaagtccatgatcctcctggcccaaatagggatcttgctctcagtgatgaaacatctgaaggtctgaagttaacaatatctcccagtttggccaagaaaaatatactgcagagaattatgagaattaagatcacctttcaggaagttggggtcaccaagaaaggttagaggagtgtggattcataataggcatagacaataatagaggagcggggaaggagaggtaaaataggagggtgacagtcatcactagatggcagggcctattagggcaaggaccacacctttatcatttatctctgaatccctccgccttgtgcccggcataaggaaagcactcaataaataattgtcaaataaatgaatgaatgaatgcatggatttgattgaagaaacagaaagtttgagaataataggaagttctttccttctccactgtgtagtagtataatattcaaatgcatatattcagcagcacgtagaaagaggcatggcatgtttaagtgctcagtatatatttgatttgtttgtttatttgtttgtttgtttgtttgtttgtttgttttgagacagggtctctctctctgacacccaggctggagtgcagtgacttgatcacagctcactgcagcctcgacctcctaggctcaagggattctcctgcctcagcattccaagtggctgggactacaggcgcatgccactatgcctagctaatttttaaaatttttttgtagagacagggtctcactgtgttacctaggctggtctcgaactcctggctcaagcaatcctcctgcttcaaccttccaaagtgctgggattacaacagcaaataagttatgcccttagataactaagtactgaggatttaagacatacaaaatgcgaacacaaggttaaaccccacttctttatgaatcaaacacacacacacacacacacacacacacacacacacacacacacacacacacaggcagtttagaagtaaaattgccttgattctggcaggcgtgtgccaccatgcccagcctaatatatgtttggttttaattaagatctaccttgatagaccttaagagaaatgagctcaaaattatttggtcccctatttgtagaatatttcctgtggcattttaagtttttctctccaaactaaggtccctccagaaagaacgtcccctggcgtttcactactactgtaattgtggcaccccctcccctggcctaggcccccaagtgctaggtttgttcatctttctcctatcacatccacaaacttctttgcctcttaggaaagcttttaacttagttggagaacatgctggtgatccactgaatctaatttgtctctcctggtttagtgcaattgaatcatctcaggaaaatgagaagcaattaggtacctgttgctaacaaggcactgaaataatctgccaacagacgcacggtgtttatttattattggagtatgtcacttgagcaaacattacgttgcctttctccaagaagaattgccagaattgattttcaaatgcaggcctcatagacctaacaagtaccacctttaaggagcatggaacagagaagcaagagggcttgtgagcctcgttcagggttagttcaagtgccagtgcctagcctaatgggcagcgttgtggatgggatttgaagttgcaggacactaaagaaaaagcagcttttttcttttttttttgcagaggtcctttaagtcccagttcaggaaattattaaattcattagccagatacttagaaccagctattactgcccagccaaaggaaaaaaagagtgccagcaaatgttttaaaactacaactaaacaaaagtcaggaagcgtgtaattaaaactgtacctttattgtattgtaaagagtttcactgtgacatggaaaatatttaaaggagaaggctgtttagctaatttgtctgcaagtgaactgcctagtggaactatcctaaattaactgtaaggccacccaccgagccaccctcataaagagccatggctgctcagcttgggtttgtgtaacgttcaataattactagataaatgcacaactaaaagctctattacactaataatttgtactgtgatagatgtgtgggacaccctgctgggttaatttgtcatccctgcagcaaacttctaaagagagctcttccgtagtggaatcatgttaatatgttgtccctgggaggacaggttagagcagtgagaccacttggctccttaatctcttaaagaggcaaagggcctccagggtgagtgctgaagagaatagggtgatgaacccaggggacctggatttaaactcatcttcacaaaagaagctgctttcccttggaattcctttgcccctttctctctgtccctctcagtcacacgcaggcctatgtgtcccagtggtgcatgtgtgcgcacaggcacacacaggcatagacccacgtatccatacatagtgaaggcagtggttctgagcaaggtttcttagaaaccccctcattttaagacttcctggtatcgtacgcttggactgtaccttgcgtagtcagataagccccgttctttctggtttagcttaacctaagttgattccatgtatagactcattatttattttccttttttcagcatagaataaaaaattcaagattgaacttgtatctcctctttatgtggaatggtttcttctgcctcgccctctccctctctctctctctctctctctctctctctctctctctctctctctccctctttctctccctctctccccgtctctccccctccccaaccccacccgcacccaggtctgctattctctgtgtgagctttgtgcttaggctaaatatcctcagactgtggcccagatagccacagtgagcagctccagccttaatttccaccaatttaataatcccaagagaaaaaagagcagcttttcaacaacagatttagggaagggcctactcctgcatgcttatgattctgattatctgggtttgggtcatttgctcacttttaaaataacccttatgtttaaaagacaatggagtgcctcattggtgtgacccggcttccctgtccacccatggagtcagcgggttaagtccatcctaaccacataggctgaggctgagggacagagagttccccaaagaaacattagagctctgtttccagaagaaggggtgaagaactgctgggcaggcaaaaataatagctacccccaggagataacagcaaagctggcctgagcactggccaatgggctcagcttactcactagctgtggcttgttcctgcagttagtgtttgcagagcacaagaaaaacccaggcctatttgttcatgccacagacccccagggtcacttgaaaacagttcggctcttgattctcaattagctggtgttacctcattgcattgtataatccagattacttttcatgtatctctatttattctaaaaacaatcctaagaatattaaataacccagagtctagcatgctgtttggcacacagtagattctcaacacatttgttgaatgagtgatcctactatgaatgaggcacctgtgtacattaatgctaatcctcagaaaagcctttcaaattgcgctattctttcttacccccctctgccccacccaagacagagtcttgctctgttgcccaggctggagtgcagtggcacgatcttggctcactgcaacctctgccttccatgttcaagcaattctcctacctcagcctcctgagtgtctgggactacaggtacacgccaccatgcctggctaattttttgtatttttagtagagatggggtttcaccatgttgaccaggctggtctcaaactcctgaccttgtgatctgcctgccttagcctcccaaagtgctgggattacaggcgtgagccaccatgcctgaccaattgctgctactatttaaagataagaaatttaaagataagaaactgtaggtttggaaatgttaaataattttgcccagattaacacagggagtgaatgattttacaaccagaagagtcaagctcattttgtagtagaggacactaaggaatataggaggctggcgtcttgctagtcaatacccaagctgacatgaaaacttggtaccctgactttaatcactagactgattattctgttgcttattccattccttgtgtgaaatttacccacagtaggattactcctcaaatcctatggggtgaattcaggaagatacttcaagttcaggaggatgccttgaaagtagtctttggctgggagcggtggctcacacctgtaatcccaacatgttgggagaccaaggcaggcggatcatttgagttcaggagtttgcaaccagcctgggtgacaatgaaaccccatctctactaaaaatataaaaattagccgagcgtggtggcacatgcttgcagtctcagccacttgggaggctgaggtgggaggatcgcttgagcctgggaagcagaggttgcagtgaacctagattgcatcactgccctccagcctgggcgacagagcaaaaccctgtctcagagagagagagagagagaaaagtagcctatgctttagtaatcatgttgcacagaaatagaggcttccatttcagtataaatctgacaatttggtggagagaaatgctgcaaaataacccatggctttatgtttgttatgagatttgcttttctgtctgcttattttctgtgtgtgtgtgtgtttttttttttttttaatgcaggaaaagacttgcaacagcctagatccagcacttggtcgttacgcaagaagcatctgcatggatcttgttttttgaagtcctctttcacaggactgcagtttgtaattccatttcacttccaacaggtcattggatgattccctccctttttctgttaatctctggaatcatccaatctatggtggttagttttcttctcaagtaattgttttgatttgtttttcattcttcatttagtctcacagtagtatcgcttacatgttacgtaaaagttcaagttcccttcatgtaactggattcttgtcaactttgcctattaaaccatcactctaaatatttccaataatcacagctgttgcgtggcgtttgaacacatttcacatcagccatcatggaagcttaggcaattagtgtgagaatatggtcaattttgattcaaagaggccctgtcaggacaaaggctggggctgtatttcacagagcttaaagtagcacactcaggtttttttaaactctaaatattacagtctccccaaagccaaagtatcttaaagactgagtctagatatactgtacaacttaatatcccataaacatttttaaaatcatttgttttaaaagccttccttatttcaatttttagattttaattttatttttatggatcagttgtactatttgtaaatgtaatcccagagactgaattctatacatccactagagcttaaactagatgagcttcagagagtatttagtccaagctgcttactgtgagaagagagacctagggagagagaagccacccacatttataatatgccaggtagtggcagaaactaagttaaaacccaagtctctttatctagtctgaaaatattcctaaaaaatgccctagatcttctgaaaag

SEQ ID NO: 413 - DNA, 72475 bp, Homo sapiens
actggtctcaaactcctggcctcaagcaatcctccggccttaggctctcaaagtgctgggattacaggcatgagccactgtacccagccaaactggtttttaaaaaggtagatattttaaactgcatttagaaattcaatatatttatatttataaaatatatttggtttttaaaaatagcctaccaacgcattgctaagaacatatccccatcattaattgacacatgactatattttataaagagcatttaactatcacaaaagagctcataaaatcaaaatttgatagcagaaatgttttctaaattagtgaaaggatgggaaaataaagttggtgaaatctctctgaaagtagaatcaaacaaaagaatgtacaacactctgatgaacgtttgactaagagttccagaaaaaaaaagaagaagaagagggtggagaaaaaattgtcaaagaaataatacaagaaagcttctcagaccttaagaatataacactctatatttaaaaggagtaccataataaatgagaaaaaatgaacacaaagatacatcgtcatgaacttgtcactgtatttggaataaaaatggttcataaagcttccaaaggggaaaaaaaagtttaataaaaaggacatcaaatggtagccaggcttttcaaaaatgatattaagaactaaaaagaaattaatcaatgcttctaaagcgctgcaagaaaattatttccaatttagaattctatgtccaaacagaagggggataaggcaaagtaactatacatccatggaaaatctcaaaaaatgtatctcttctgtatcatttatcaggaaactattggagaatgagctccatcaaaatgcaggagcaaaaaaggtgaaaatacaagatttagagtataaagaatccaacgggagtgcaggcctgcagaacaatcattctagattagagcaggataagagactctggggggaggggtgatggatgtgtgttacgttttgatcatgaggaaaataatattcagaggagttctatatttgctttggaggaagaatcagtgatgaagtgaataatgcaaactttaaagtgacaccattgtaaactgcaagaaaataaaaaatttgaataagaaaggaaatgcaatcatgttcttgctttggctcaatagtgaaaattcttacataatcataaagtaagttacttggaggcttacttctcccatttataaaatgggtaaatgaataataataacactcactctgattgttgtgataatggaattaatgaatataagcacttaaagatattcctggcatatagtaaatactcaataaatattagctgtattgttagctatgtgtgaagaaaatactgaaaatttatttaaccaaaagttatgatacaactatagtaagaatagagagttcttttttcttagataataagaagtcaataaccatataagcatattttttagaaaccaaggagtaaatactatataaaacagctaaaataattgaaagtagatgtcactggaagtagcatcaggggaaaactaggtactgaaggtttttttaataatccttttaagaatatttgactttctaaaactacttgcagttttttaattaaaaataaaaataattctaaaataacagagccaaaccaggaaaacactaaaacgaaagtatgtgtggccatatctgacaatattgaattgaaattcaaaatggatcagaaaggataaccaattaccatgaatatgaaactatcatgaaccattatgtacataacaatgtaatcaaactattaaaagtgaaaaggtaatttgacaaattctaaattacagagcaaagttttaacagaccacatattagttcattcttacactactaatgaagacataccagagactgagtaatttataaaggaaagaggttttattgactcacagttcgcatggctctggaggcctcaagaaacttaaaatcgtggtgaaagaggaagcaaacagtccttcttcacagggcagcaggacgaagaagtaccaagcaaaaagggggaaaagccccttataaaaccatcaggtctcatgagcactcactcattatcacgagaacagcatgagggtaactgcccccgtgattaaattatctcccactggtccctttgacaacacgtgaagattgtgggaactataattcaagatgagatttgggtgggaatgcagccaaaccgtatcagaccactctcaaaaactcaaaaactgacagataaaatggaacaaaaatagataccaaaaataagaagtttgaataagatgttttctttctttttttttttttttttttttttgagacggagtttcgctcttgttgcccaggctggagtacaatggcgcaatcttagctcaccgcaacctctgcttcccaggttcaactgatttgcctgcctcagccttcccgaatagctgggattacaggcatgcgccaccatgcccggttaattttgtgggttttttttttctttttttttagtagagatggggtttctccacgttggtcaggctggtcccgaactcctgacctcaggtgatccgcccgcctcggcctcccaaagtgctgggattacaggcatgagccaccgtgcccggcctatgttttcattttttaaagcgtaatttaatagttttgcctcagagaagtttgtacctataaagaatacattcttttcaaaaactaatgaaacatttacaaaaattgatcatttattaaggtctcaatgaaatttttataaagtttaaaacataaaagccagaatctctaacatgtaatccaaaattagaaaattaataagtggagagagaaaagggctatcagattggtaatgttaagctctcttttaaataacttttggttaacaataagcaaaaagagacattatatctcaataaagaaaagagaaagaatgcatctgaaagaataaaaaggtaaatccaagaaaacactgaaaagaaagaaaaaggagaaatttgtgctgccagatattcaaattgaacagtaactgtacaatgaataaaagagagtggtactcactagaaactctagcaatacatccaagcctatataaaggtggcacttcagtgtggaaaggattaattattcaccaaatagtgctgggatcactggttaactatttaggagaaataaagagtagacccttacattatattatttgccgaaataagtaattttcacttagattaaaagtttaaattttaaaagaaaatcatgtaagttttaaatatagtaatctaggggtgactaggagagtctttctggcataaaatcaaagacagtaatagaaaggaaaatattgatagatttgactgtagagtgtcaaaaatataataaatagaattaaaatcaaactacacactggaaaactatatgcagcagaaaaacagttaactctagtattctaaaagtttatatacttcaggacaaaaataacaaatattctttcaaaaactgatcaaaagacctaaaaaataattcaccaatgaagaaatttttcctcaataaatatttagaaaaaatataaacttattaggaatttaaaacgcgtatagttaaaaaaaataccagtgatatgcatttttcgtttgggaaaatggcactcagacattgctgttaggagttaaaattggtataaatagtgttttggcagtagatatcaaaagttttaaaaacacataggtcttttaatcaagatattataccctaggaaatggttataggaaaataattaacaatgtgaaaaaaattgactataagatatttattacaacgctgttaggaaaaaattcacaatctaaatgtgcaccaaagataaattagtgaaatagatgatgatgcaaatggattacaatgcggctactcacaatgacagcactgaaatgtattagttcacatataaacatatgtactggtaaagaaaacaaaaagattatgtaagaatttatactctcattcatcatttatacctgttctgttctcatgtgtatgccaaatgtctagtacataatagctcacaataactgttaagtatgcaaactgtaaaaaataattgcatatattatatacataatcacacagaaataattacaaatgttaattatataattaaaaacttcactataaattttaatgttatatgtaaggataaattttactcatataggaagataagtatgctattttgttaaataaaaagacaaaatacaagttataaatgtggtgaatatacctagaaaagcagattggaagaaaagtttaatttctttgggtaatagaattatcattgattttatttttcctctttctatctttttgtattttccaatgttttggcaatgaactatttgtaatgggaaaaaaatattttaaacaagttgtgtattttggaatactatgcatttattttaaactatattttagaagaatatcattaatgtgagaaaatggccacagtacattattaaataaaaaacaatcgtttggaatattacattcaatatggttctgattacatgtggacatacatatacaaaggcaagaaaactacaaggttatattaaaacctttaaattttttttctggatattaacatcgttttcatttccttcttagcaattttctgtattttccaaattttctaccaaaaaaaaatctctcttttgcaatcaaaagaaagggccacaggaaggaggaggaagagatatttttatttttaaagaaatggaaaatatatcaatgggttgaaggtcaagccatcaatccttaacagatttttctcagctttgtgggaattcattctcaatgataaacttatttttccctcaagtacatattttctacaattgttcatgcttatgcctctgaacactattaaaatattaatgtattcttctcatgttgttctctcatgttgcccactctctatctgagcaataaatctatacttttccaacctctaaaagagcagggaaacttgcccaaggtgacacactgcttgttggtggagtcaggactgcaacacaatagtccttactcccaggccaggattatcctcttcggaaacaagtttccaaaatctattaagcaatttttaaatgtttgttctttacatccttcaagtcagcaacgaggcaagttttgaccacttctgttatgggcccaattccaaacagcctccaagggctcctgccctatgaagagaggaatatgatcataaagtaaacatgagtgtggcccacaatagtgagtacctaaggaatgtttaataactactttttactaaattgttatcctgcttcattgatggaggaaaagcctgcagatgaattcaaaaccaggaaaatctagctttggctgtcattcacagtgtccctccctatccatatttgacatcccctagaatcctggaaagcttcctagcaccatgaggctgatacacttaggcagaaacaccaaccgttcacacttacacaagatatatatacacttcacacacatagcattctgccaaggtccctcctcacaaaaacaaaaacaaaaacaaaacaaaacagattgtaacaatctgtcagatccataaatggtatgtcatctaataacccgcaataagttctaaagcacatcagatcagcctttcaaatggtaaatttccatgaactattaatgaaacagcatctctctcttttcaaaattttcttaactcttgcatttgaaatccaatccaacttagaactctttaaacatcaaacccaacttctcatgcacagtaaacacaacgtccagaaagcatcattagcccaagttagtaaagaaatgtttgctgctgtttcttcccgtcataataagaaatgctgctcaataagggatgattaaaaagtccatatgccacatgaatctcatgaatataccttttccattgctttaagtatcaatcctataaagaaaactaatactgtgacttaatattcttttcactttgccaaaaacttctcctaaccaccacgcacattttaaaaggcggtaaaatctaattaacttctttgcaaatcagtgtagtgtttacatctcagtgtgtgtatacaggccatgttaatctccatccaagagaaggaagaacacaaggcctaggggtctctcttgctgtgacttctactaccatattcacaatcatgttacaaaaagaaaattaacaataccctaaaataaagaattccactgcaagctttataatccatcattaatttcctctttactcataaaacagaatttcacattttggagtttaagagtgctgagctaaatatccttttatgtttaagaaagcagattaacttttgaggaaatcatcatttcttgttatagagacaaaatagtacatcaaggaaaaaatatactaattgatggctttctaaataaagcatgatcattgagtaatactaaattggttgtcttgtgtgtcaaattaatctcttcattacggggaaccaggctggctattttgtgcttcaatccatctttaatagcagcatttttattaatcaagttaatgatgacagtttttagctagtaacaaatgatacatttattcaggccctttttcagatgatccaagctattgtgagcaaaagaaaaagaaacagcaatttggaagattagattagtatgcctagtttaaactctacacttactctagcaaatgagatcagaagcaagcattaattaatgagtaaatctcccaaggaatctccaccataaaaaaaaagtcattatcaaacagagcatgcaaactcttacagatattttatgttaaagaacatataaaaagctacagatttgggctaacttaaagtttatagttttcaaaaccaaaatgaccaaatacttaatttcaactcagccacccataaagtgacattactaaaatcagaactgtttttagaacactcctcttgaaaataactgttaatatagaatgaaaaggtagctcattttccccccttcatttaaggtaagtaggtaacaaatctggatagcccaatctatcaatttatagcaaatgctctaaatacagaggttggcaaacaacagcccagcccataggccaaatctagtctgccaagtatctttataaataaagttttattggaagtagtcacaatagttcctttatgtattgttgatagctgtttgcacactacaatggcagtcgagttgaattcttgcaacagaaactacatggcccacaaaacctgaaatatttactatctggctcttttcagaaactctgctagcccctgctctaatatattgtttttcaaatttttcacagtagaagtctttcaaacaaaatcctacaagaaagcctagcaaataaggcatttgaaagcaatattttattagtatacattacttttataaagtaaattatgtaacaattacctaatatgaagtcaatcagttttgttgaacatagaaacaggaggttgcagtcataacagtaactttgttttctattcgaggttattttgtttttgttttctggattttttttttttttttttttgtattttgttttggttgcagagaattgattcacacaggtaagtggctgcaaatagtaacagttttttaaagctcccttgcaaactcaggatactctacaattaaaagataatagaagttttattccaagaaactgcacaacttaacccggcagcccaagttaacacattgctaatctccaaggttttaaaattcagtacctagcacttttgttatttgtgcttcgtagtaccattttaaaaacagattttttaagtttaaaagaattttagcttgctgtgagtgttacatataaagtacataaaactgtttgccaagttttctcttcccacttatagaaaaatctttccccaaatttcaaacatgtgatttcagtaaagctttcatatttcctgatgataccaacttcccagccgcaaaaattgactcaagccaatataaccgtagccccatctcaggattcttttcctaggcatcagaaagaagacatttcacttcctctttgaagctgaaatagagacatgtgaggcctgaagtttgccaggggtggtacttttcattcttgcaaaagaaacacatataagagaaatacactgatagacaaagaaaacagaggtagatgggaagacagtcttagtggcactgaaatcaatgcttccagttgtccttgagacctagctgcatcacaccctctctgtgttttaattacagaagccaagaaattcccacatttcttgtctgtggtagtttgaataaggtttggattgagtatcctgataaacacacacaagcataaatattttaattgcaaatgcatgagtcaaagtctggaggaatatatatgatagtggatacttgttattatttctggctactcactatatgaacctctttcctaaatctggacaatcttcctcccccttataagtctcagtgggaagtagaatcaaattgcactatataagctgaaagaataataatagctaaccttttatatatgcatcaggaagcattctaagcaatttacctagattaacctattcaattttccctccaaccccatgaagtaattgcaactatatttctattttacaaatgaggaaactgagacacagaggggtcaagcaacctgcacagagttacaaccagtaaatagaaaaacaaagctgtatgtagcccaaaaaatttggttccagaggccctactctaaaactcctcgttattttgtctctgaaaatcccagatcattctttccaagtccttgctgcaaccaggctacaccaatccaagtacccatcccagagttgcagggaccaggaagatctgtatatttgacagtggtggcagctgcagaaggatcacgctcctgggaagcaatgattgcagtgccaggtcaacgtccaatttctacagctcagcagtatcagtgaagcaagcctcagcacttatcacgcagtgcctgtgacagtcatatcctcagcagtatgctgggtattgcctctcagttgcctcctggctgcacagtcctcaacttgcttttgaaagctatcaaatatcttcttaatatattcttttcctgtttaaatcagccagtattttctattagttgtaattaggaaccttgacttataaatgtcttgctaacagtgattaccccagagaagtggatttggggaatggtaaaattttttgttacttttgacattcctatatagaatgacaatatctggacagagatgggttctagagcagtatggagagtgactttgaagagggcaagactacatacaagaggacctgtgaaaagtcagttgcaataggtcgcaactgaggttcactttctaggctttaaatagggttgtggtaagataaatggaaagaaaggaacagatttgagagcattttgagagagcatttggcagaacttcgtgcctaaatcgacatgggagaggatgtaaagaaagctgtcaagggtgaattccaagtttcttattttggtggctgaacaatggtggtgccaccatctaaagtagaataaagaagtgggagaaagcttataaaagaagataatgaattccagttggtcttgttgagttctgagaacctatgagatacccaaatagagatagccaacaagcagttgacatgcatggattccagagggtctatagacctagaaatatagactatgtctcatctttatagatatagcatatcagcattaggtgatcataactgaaatcatgaaaatgaagatcatctaggaagtatgaagtgtgagaagagcagagataaggaaataaatggatttcagggaaatacgttaaggataggcaaagaaacatttaaaaggtctcatataagaaacaaagaaacagcagtcagagacactgacggagatcaattaatgtggactattcagaatccaaaggtgtacaggacctcaaaaaaaagaaactaatcgactatatcaaattcaacagaaagatctcataagaaaaggactgagaaatgtctgtggattttgtaattagaatgtacccacaaagttcataatgaaggcatttctaggagtgctggtctggaaagtgtctcatttacaaaacatatttaaggacctagaacttaaatgtaagtagcaatataatggcatcgagaaaaaagtcaatacaatagaaggtctgttctgattgtccacatttcagtaattaggttctgattctggatgaggaaggcaattctttacatcctttctgtaggctcagaacccatggaacgtgtttcctcacacagctgaaggaattataaataacctactcttgaatatacacacacacactctcctgtttttattacattttaaataagactttaaaatgctaacttatcagaaatacactagaggaaaaagaaacagcatggatgtaaccctctactaatgaggcactaatgcataattattataatacacgtacttctctccatagacgaatatttataaacactgaaatcgtctagtttgcagtgaagtcttatgtacagattatttttctcttgtggtttgtccttttttcttattgtggtaatgtttaatgaatttcacaggctctgctcattctctgaaaacactgaacgaacttgtatacataataggtgctgccttcaatgagtatgtagagatgagatattaaacacaccatcatcagtaccagtagtcagttaccttcactgtaaatactcggagttcagctaaaacacaatatgttaaaacaaagctgtttgaattaagtaatttcaacagatggtacctagggaggggatcaagggaagcatatattaaaataattcagattaaagactgataaggttttagggaatccattaaatagcacccttttctcagcctgagctctgagccaactgagaactaaacaagagatggagatcaacatatcagcaatgttaccaacaaaggccactctaggttgaaggacatggtttaagtatgcaccaacaatgactggaagtaagcccattcactcagccccatcaactgctgaaatgcagtcctttctggtcatcaaggtgatcaagctttggagaaaaatattctccaaagaccacatttcacatcgtgtaaatgctaccatttgttcatttaatttctttttttttttgagacggagtctctctctatcacccaggctggagggcagtggtgccatctcagcttactgcaacctccacctcctgagttcaagtgattctccgcctcagtctcccagatagctgggattacaggtgcccaccaccatgcccagctaatttttgtatctttttttttagtagagatgaggtttcaccatgttggccatgctggtctcaaactcctcacctcaagtgattcatcctcctcgacctcccaaagtggtgggattacaggtatgagtgaccatgcctggcctagttcatttaatttctactaatagaaaacatacatgggaaagcagattagaatgtgtgcttcctgtaagtagttgaacacatacacacacacagtgggagaaagtggctaggcttttcatgcccaattcctcttccaaacgcactagtgagataattaactgtacctctgtgggttggagaaatgggtggagcaagagaaaaattccctccatgaaaactaggggattgagcaggaaatgactcccatttcccattcccctaataaatacacatgattattaattgattacagtaaactttactttttatcaactgcagggtgggtataaacatgttgctatatacttcatttctctttggtcctttctgccaacattatgattatgtctaaagatatgcattgaagacatatatacagactattggtaggaacagggctttagcctggaatcataatttcctaaatcaagatctagcttctgactatggaaggttaacactgagaaaaagcattacccaaattatattctgctttgtgtaaacaccagtatccattcattcaacaagcctttattgagagtctgcaatattccaaatggtaggttaagcaatgcagatataaagatgaacaatttaaataaaattcctgacttctaagaaagaattcctcctaaaaaaattcacttcatcaaataatgctaccaaaatattaaaagctcaggatccaaatacataagagaatgtagcatatgacaacagtaacttctcaaacccaagaggggtaagttggaccacaaaataaggggtgttgaggtatctggacatccctctcgaaaaaagcaaacatttaatcacaccatacactttcagtcagattaaattccaaatggatcaaaggttggaaaatatacaaaagtaaaaccccacaatttctagaagaaaacaggggaaatattttagactgttaaaatgaggaaagtctttttacttatgactcaaaatgtaaaagcaatgttctcacctggagatttgactagggaaggatccgcttccaaattcccttctgtggctggcagaattcctggcagctcgcctcttcaacaccagcaaccgagagaacaagcctctgctacttccagtctctgacctctagactctctttcatagagcccaccgggttaggtcagacccacccaggataatttcccttttgattaactttaagtcagctggttaggaacttttattacaactacaaaaatcccctcagctctgccatattctcctaattagaagtcacagattcttccctcattggaggagaggggtttacactagagcattactcaatggggatcagggtgtgtctgccatatctccctaatatatagagatttccactgaacactaatcattagataaatgcaaatcaaaaccacaataagataccatctcacaccagtccgaatggctactattaaaaagtcaaaaaataacatatgctggtgaggttacagagacaaggggatgcttatacactgctagtgggaatgtgaattagttcagccattgtggaaagcagcgtggtgattcctcaaagagcttaaaaacagaattaccatttaatccagcaatcccattattgggtataaacccaaagaagtataaatcattctaccataaagacacatgcatgtatatgtttcttggggcactattcacaatagcagagacatggaatcaagctaaatgcccattaatggtagactggataaagaaaatatgctacatgtacaccatggaatactacacagccataaaaaagaatgaaatcatgtcttttgcaccaacatggatggagctggaggtcatcatcctaagcaaactaatgtaggaacagaaactcaaatcccacatttctcacttgtaagtgggaactaaacaacaacaacacatggacacaaagaacggaacaacagacactggggcctactggaaggtggagggtggggaaagggagggaatcaaaaagctacctactgggtattatgcttattacctggcgattaaataatatatacactgaacctccatgacatgccgtttacttatataacaaacctgcacatgtactcttgaacctaaaattaaactttttttaaaaaaagagaaattacaaatgtaatttttaaaaacatttaattttattatttatttattttttattatactttaagttttagggtacatgtgcacaacgtgcaggttagatttttttaagttccaagaaatctattaaaagaaaatccagtggaaaaactggaaaaaaaaaaaaagaatagtcaattccagaaaaatatacgagtagctcttaaatatatgacaagatgttctatctcatttttttttgttgtttgtttttttgtttgtttttttttgagacggagtctctctctgacacccaggctggagtgcagtggcgcgatctcggctcactgcaagctccgcctcccgggttcacgccattctcctgcctcagcctctccgagtagctgggactacaggcgcccgccaccaagcccggctaattttttgtattttcagtagagacggggtttcaccgtggtctcgatctcctgacctcgtgatccgcccgccttggcctcccaaagtgctgggattacaaacgtgagccaccacgcccggcctctatctcatttatgcaaagaaaaaaatgcctttttaaataatacctatcatattggcaaaaatctagaactgttcatgtattctctgtggggtaacaggtactctcaaacattgcaggcagaggtgtaaatctgtctagcccttataaagaacaatttgtaattggcaatatctataaacacatatcccccgaccttgaaattccaaaccagaatatctaccctaaagatctatcagcatgtatgtgaaattatattgatttcagcaatatttctaagagcaaaatattggagactatgcagacatagctatccaacaaaaggtgagttaagttaactaaggtccatttatatagtggaatactgtataattttaaaaaaatgaggaaacattccaaatactgctatggaaaaattaatgtagaacagtgtatataatagctatgttttttgttaacaaaaaaaaaggagaaaaataagaatataatttgtatttgcttgcaagtgcataaataaattttagaatatatggatctacatctggaggtgatatgtatgcatatacatatatgtgaataatagaagatcagtaggtaggtaggtaggtatgtagataaaggattgatagatatagactattttacagctcatatcttatggttgtttctctgctaccatctagtcatggccaaacttctagttccaaattcagtcagaactagagttgtgttattccaacatttatcgtgaagaaattcctatagatctgcaacagtaaactggctatgactgaatccacaattacccaaattcaccatattaatactttgcatgcattttcacccctttcctattcttcaaggttttgtagtaacccaactattcaccggatgaatataagttatatgcctgatacaagaatggaaagggacttttcaccattacctcctagtttgctcaacaaataatctcttaatgaatacttccatagaattttacagtcataaaaaatgcttttgggatgcctgcaattatctaaaataagaaaatatggcaacttgaactcatgtatttatctgtttcctcttttactctactaaaataacaaaagaggaatcagaaactatgaacccacaaggaaaagagaacaggaaacgacaaaaacaggagagggatatccttctatctcactttaatatgaacaagttataactcatttcacaaaacagaaaatcctacggcctgagactgcagcgggaaaaatcaaggaaatgtcactttattcatgtccccagaaccctaggaaagcatcagcattcaaggaaagttggattgatagttcagctaaaactttgttagccaagcctgtgggccagcagcataggcactcttaaaagtgtgttagaaatgcagaatttcaggtcccatccagacctaccgaatcaggcctacactttaactcccaagtgctctgtaaaccccttaaaatttgaaaagcagtgatataaagagcagttcaaatcccagaatttctcccatattccacggagccatgcaactgctccctcaaccctagataagaagttttctcctggatgatgttgaaccgaagaggtcccagattcaggcacgctggcatcgctgaagacaggagtgaagcaacaaagtacaggtattctgctcgtctacataatgaagaacaaggcccactgtgcccttatcctgttcagcaatccaaagtctagcagcagcctcccattcccaggtagaacattagaaatttttctatgggggaaacctactagcccaaaagagaagacctacacatacttgtacacatgcagaagactgacatggggagaatccagattaagagtcacctcgtcaagactatattttcagggatcatttctacagtgcactactagagaagtttctgtgaacttgtagagcaccggaaaccatgagcaggaagtgcagcgttctctcctgagcatgaagccggctcttggtgtggcttcgctgcaactgccattggccattgatgatcgttcttctcttctctgggagagtaagagagagaggacacagtctgagtggttcccatctgaaaaaaaaaaaaaaagagagagagtcgcctcatcaccttagcgtccctatagtaaatagagagtaaggcacacaagtctgattccaatcagagtgaggggtagtttttcggtttttttaatacaatgtgcattctctcagattagtttctagctcagcaccaataataaaaaagagaaatactccaacccaagctacatgtgcaaagatgttcactgaagcattgtttatcataaaaactatatttttaaaaaaaaccatccgttaaaaaaaatctggtttaagaaaactaggtctctgtgaaatggaatactataaaaccattaaaaagaatgaagtagatctatatgtgttcatatggcataatctccagggtatgctgaaaagtgaaaaaaataaggtacagaaggataaatatgatagactaacatttctatttaaaatatgtatgtatgtaacacatttccacctacatatgtacacaaatatatatgcttgtacttggaaagaaaatgtcaagtacatttctgaaagctgttaacaatacctaaatctggagaaaggaattgtggacttggaatgggagaaagacctgtgttttattgcatacatctaatttttttaccatatgcatgtattttcccacttaataacaaaatactaaaaggacagttttttaagtagtgtatttttatctgaagcactagctaccattagaaataaaatattcccaaatctgtatcccttacctaaaattatctcatgatagtgagacacataaaattaaaactcaacaagtccaaaactaagcttccaatctcgttatctcaaccatgactgccaccaccattaaacatgtttcagttcttctgtttcctagtctgtccacccttcatcaggtctcttgagtcagaaacctggaagtcatagaagactccaccttttccctcacttcctacctctaatcaccagaccaaatgctgtcaattctatctcctaagttcctcacaaatctgtatccaacctaccatctagtctgccttaactaacacagtatttacacctctcccagctcactctaatccttcttactaactctctgcatctagtatctcttgaatctaaattccacaccgtttccagagcggtctgtcaatattccccaatttaatcagacctttctcctacttgaaacccttcaatagttatttgtcttcttttgaataaagtctaaattacttggcatatcacacagttgtggcctctgcctgccttatctaccactgtctccactttttctttccccaccccttcaatacacaaacctaccactccaattacttgcagctcccaattttatcatgccaaactcatattgtttcctctatctttttttcttttctttatttttatttttgagacaggatcttgctctgtctcccagactggagttcagtggctcaatcatagctcattgtagcctcaaacttctgggctcaagcaatcctcccaccacaacctcccaaagtagctgggactacaggtgcacaccactgtgccagggtaatatttttgttttgttgtagagacagggtcttgctttgttgcccaggctggtctgagactcctggctttaagtgattgttctttctgaaacacttttgcccccttctctaccaaagcctcattatttcacttggtacctctccactgattatgaatatttttatattacttcttttattttcctatcctgagatcctgctacagtgccaggtacatgacatgctctcattaaatatttgttgaataaatgaagcaagttagacaagccagctatcattccaatgcaggtaataactcctctagcttatcgtaagttcctccttaaacacaacaaatccttacggcttcacattgaaaagaaaacgaatcttgtcaatgcatcttttgattcttacaaatgcaagctgctctcttaacacatcttaaaaataacttgagtgaataacggttttacattgtgccttaaaaactgaagcattcatcctacatggaaaggcccacgagggacactactaatgagatgtgacatggaaaaaatggctcaagtaagaaagtaacagctttcaaacaattcagattaatacatataaattgcaaaaacgctgaagaacagtttatagtttacgcgtggtttgtcccttaaaattgcagcttacaggaggctgggagctgtaattcacacctgtaatcccagcactttgggaggctgaggcaggtggatcatgaggtcaggagttcgagaccagcctggccaatatggtgaaatcccatctctactaaaaatacaaaaattagccgggcgtggtggtgtgcacctttagtaccagctactcaggaggctgaggcagaagaattgcttgaacctgggaggcagaggttgcagtgagcctagatcgtgccactgcactccagcctgggtgacagagtgagactctgtctcgaaaaaaaattataataataaaacattgcaacatataggaaaaactccaatttatttaaccaaggaaagattagagataatggtaaataatgtttgcttgaacaatggagtcaggaaaaaaaatgttaattatataaagcctttgtgtgaaatataaaacattcaactctcaactcattttcctattgcctaaatgtcctgtactttcagaagtattctccatcaccttgatgatattcttttgtatgcaaattttatttacctgaattgttaatgctgcttttgtttgtacttatatcttaattattctctcttcattcacctgtcatgagggttttgattcacatttcagaaaatcatgaacaaaatatttctttgggaagtagggttgtgtcaccaatgtttttgtactactagaggttattctgcttttccagtttaaaaaaatgagcatttcttctttttataaactgtcaaacactgaaattaaactttaaactgtactgaatggataaaagatagattttaaagtatggattgtatgtcagatgaagaatatagtacatagagactccagtgagcaagcaattcacaatataaaatatatgccttcaggaaaaattcctcaggccaataacagtaaatggcaattagtaatgctcatgagagtattattatagtcatacagccaaaaactttattttttcactagcatcacactatacagcatacaatgtctatgctgaaaacctgtttgatttagtcagaagttttgttgaagcaaaagttgtggatagaaatactcaagggttgagattatagcaggacaaattcctcaactttggttgaaaaggaggcagaaggttcacactctcagatctttaaaaaaaaatgtagtttgctctgtttcattgtgcaataaactaaaatgtaagtattgaaaaggaagagaaagcaagtctgtctttttgcaaaagtttcttgaaagtctttaagaaataacaatgtctcactacctgccactgaaatcacagattcaactgaaacattaggagaccatatacacaaacactttatgatttcaaaaagacaagctcattgggaagaaaaaagttctctgtctttgatttcttttagaatgataaaatgaaagggacattaatacatattttaagccctgtgaattcacaatggggttttacaataaagaggtaaaaacctttgaactaacaaaggtccatcaccgtgcactttttttctcacaagtgcattgtaaaggaaattatgctagattgaaggaccagctggcttttgccactacacctttagtaacataacacattctcagactgtatcaatccacccggaatcaaccatatcattgactcctcttagaccgctcctcttattgcatagtgctgttttcagtccaatgccctgtgaaagcattctctcactggcttacatctgagtgcctctttgtactagcccaaagcctgaagtcaacaatctccattaagttgattaaagtagtcctagagactacccaggcttttacactgcccttagattaaagacaaaaaaaaaaaaaggcttcttcttcagaggatgttttagtttgggttggagaatttggatgaggtgttgagttctgtgagttgtatgttttgttttgttgcggggcggtgggggggttgctggatttattttattttctctctaattttcaaagaggtcaacaaaaatatgaaggctcttagaaaaagagagaaggcttttattacaagtgatctccaattatttctttgttcccaaagacagtaatcacagctgttgaaactgaagaagccaacactgtgtcctgaggaagcatttatcatgcaccctggaagaagagccttacataagtatcagtcatttccctaaatttaactcaatggaaatggttcctcagtcaaattcaaaatctaaaggaaaaattgaaaggccaaaaaataaaatagtctaaggtgtgaactgattataaacccacaaaagaatcaaagaaactgaatgagacacagcacaaatgagtgtccattttcaacaacacaggtaaatgtatagcatagtagttgcaggagttaaacatcctggttatctgactaggtcgaccaatgatttgaccttgggaaagttgcttaacctcaaaagctcatttcttatcggtaaaaatgaggataatagtatctgccttgtagggctataaagattttagagaaaaggggccagtcatggtggctcatgcctgtaatcccagcactttgggagggcgaggtgggtggatctcttgaggtcaggagtttgagaccagcctggccaacatggtgaaaccccgtctctactaaaaatacaaaattagccaggtggattggtgcacccgtaatcccagttactcaggaggctgaggcaggagaatcgcttgaacccagaaggcagaggttgttgcagtgagccaatattgtgccactgcagtccagcctggacaacagagcaagactccatctcaacaacaacaaaaagactttagagaaaaggtatcttaagcatttagcacaatatctgtcaaatactgcaacacacaatacatttttaaaattattgttattctatatgagatattttctagagttcaacaaagcaagtttagaagcagtagatgctattatttgagaccctatgctaagcccccaaaagacctggattttagttccacctgaggcatttacttgctgtgtgactgtaagcaagtttcagagcttcaacatcttcatctgtaaaattaaggagtcaaactaaattgggaatttgtatatccaaatctcttctccacagcaccagtctatatgttcaaaactgaattactgctatttattccatcccgttccacacagccaaaggagaatttttctttttctctcctaaacccacatctcaacttaattcatgaccaaaaggcaaattctcctatgggtgagacaatatggattttctctggtgttattcctagctcactgtattagcatcatcgaatattatcttaacacaagtcatagaccacaactgatgttcagtctacaattaaaagaaaaattgaaaataatttgagatttacacaagttccacttcctttttgcaattaatcttggtgcatttttaactccccatttcagtaaatggtactgttattcatctagtccctcaggacaaaaaccttggaattactattaatacctatcttttatttcatattccataccgaatccaaaagcaagtaccgttggcacccacctacaatatatacccagaatttcaccacgtcaccttcacatccatacctacctttctagtccaagtcactgtcatctctggcatggattattgcaataacctccttcctattggattgtagcctttacaattacggaatagcccttttatctctaataatgcttctccccttaaaaatctacatcgatatgaataaagctgtaatacctttcttttggttagtgttttttaagttaccttttcctaccctctcttacatttaacctttctgtatccttatatatttggatcctttgttctttgtaagcagtatatagttggggtttctattcttatccagtcttaaatgtcagtcttttatatggaatatttagttcatttacttgtaatacaattgcagatatagtgggcttataactatgactttataatttcttttacattttacattccgtttcatattctatttcctttcttgttttggattaatctggtacattttaaaatattttcctatgttaatttgttatactatcattttcattgtatttcatggtataggaatatagattacttagattacatcgtatatacttgaattatcacattctagtatgaattattacttatatcactttccaatactgctagaaccttatagcaccttactcctatttaatcctttttttactttttgcattatttttgtcatgcattttgattatatatcaatttaagactccaaaagacattatgattattgttctatacaatcaatatccgtttgtatttacccagatattttccctttctgatatttttcatttcctcttgaatttacatgcttctctctgaagagctccttttgctattgcttattattattatttttagtacaggacgtggcaacaaattttctccatttttatatgtctgaaattgtctttatttcgccttaatttttcaagtatattttcaccaggtataaaatcccagcttggcaattattttctttcagcatgtgaaagatgccatttcattgccttctgacttctattgtttagttgagaagtcagatataagttttattgatgctgttttggaataaagtctttccctggctccagttaagactttctctacttatttgttttcagcagtcttacatataagatgctgggtattgttttcattgtgtttatcctacttgaacctatggattcacgttttcaatcagttttggaaaatggttagcttttaactctgaatattatttctattctactctctcctcttctccttccagaacttcagttacacatcattttcatcacagtccacattactcttatctgtttttccattatttgttctctctgtgcttctgcttgggtgttttctattggcctattttccaattctaaagaaaatgtagagcctccggatgatactatcttccatcagaaaagctttcctccttctgctaatagcaaggacagctattagggggattaatcatctcaagccaatcaggaattgtgctgagttgcagctgtgaagaagttttggtaaaactcaatgtagttctgcttggccccgttcataggtcatggctccccagggtttttcattgtaagcttggtaggattttgatttcccacatctgaatgactaaaggagattcagttctgcccttcagaagtttatcacttagttctttagcttcctgacccacacagcttcaaatgtgacaaatgtcatcaaggaaccatctatgtgtctgacactcctcaagtctgcaattttgttacttcagtccaaaaaaaaaaaaaaaaaagaagtcaaatcctgttggtttctctgcttctcaagaaaggccttctgctactctgctacaggtcaagcctagcctagattttcaacctcaagaggcacccagatttactaagtatcccagatgaaaagtatctccagatcaatccaccactctttctagggattttattatcctcgcatgttttattttggggtctgctccccagagcagcctttgtttcctaagcatcacaagactatgtgatatttcactctacctttcagaagctttcaacctagctctttaatctcctatcttggttcagagttcagcagatgtcttgtgggaaaacctggccatgtatttgagatccctctagtctcaaattttgtcactctagcttcacataaccactgaagtttttattttcccaataagtagtcctcagcctgggccaagttttaatccttagcccatgcccagaatatcaaatgctctcaagggagaaaatagctccgaatcatccatgaccctctctgaaattgtagtttgtcttgtcctcatagctcccatagctctttgtacctttaaaattatacgttttggaatttatctagctttttctaattgttttcagcagaagcattgccctaatgcaacctactacatcatgcttagaagtgtaaatctacttaaatctcccaacaggctttgctgcttccattctggccataccataggctgtttgccacacaaaagcaggacgatccatttaaatcacaaatcaggttacatctcttattattacacttatactaaaatccaaactccttattttgccttacatctcttattacacttatactaaagtccaaacttcttattttgcctttaaggccttatatgttcttgacttgatatccctctggcccattctcctaactccctccttgttcacgtagtccagaatcattggccttcctagtattcctcaagcatgctaatcagaaatctgttcttctcccttattccatcccatcccagaatacaagctctatgagacaatggactctgtctacctttttcaaccactttattctcagcacctaaaatagtgcctggccatattgtaggtgctagataagtatttacttaataaataaatgaatataattgaataaaatggaagctgtctggctaaaatataactggagttgtgaagccctgattaacaacctctccctttgcagactatgatagcctagataattgagaactgattacataatttttaaataaaattcttataggaactttgaaacatgtccaaagccacttggggttccaaggatcacagtttaaaaacaaaatgtgtcaccaagaatccttcctgttctaacattttagtcaaaacaccatattaaaggaaaagctaaagctgaatattccaacgggcctattccactagcacatacatatatatttatttgtggtgtatacatatttgacacacatgcacatgatttttcatgactagtacagctagactcttagagacagagtaatttctcttcaaattagcctttaggaaatgtttgtgtgtatgtgtgtgtgtgtatatatatatgtgtgtatatatatatgtgtgtgtatatatatatatatacacacacacacagataaatatatatatatttatacacaacatgctattatgtatatatatatacacgatatgctatttttgcctttaatattcaactttttaattattaggacatatatttttttgcctatatattcatacatatatatttatttttggtatacatacatacacacacatatatttatctctgcttatatatatatatatttataccactattttatatatatatgtgtatatatatatacctttccactggtacatacatatatatttatttgtgtgtatatgtgtgtgtgtatgtgtatgcctgtgtgtgtatatatatatgtatctctgtgtgtgtatatacacacacacaaaaataaatataatatgtatgtgccagtggaataggtgtgtctgtgagtgtatatatatatatatatacacacatatatatatataaagtggtataaatatgtatatacacacacagagataaatatgtgtgtatatgtataccaaaaataaatatgtgtgtatgaatatatataggcaggaaaaatatatgtcttaataattaaaaagctgaatattaaaggcaaaaatagcaataactatgcacttactttgattctccaacttatttcctagtgtaactttctcatttcagtgcccggctttgggaacctaatcaaaatttgttctaggcttccctcataacaaaaaaaaaatactctttttcagaatgctttagactctagacaacaaactatgcttgtggcaatttcataagtgtgtagcttaaattcttgcagttttgcagtttgggtttaagatcttaggcacacagagttatacaagtttcatttgtaggtgagaaggaaaaaataaaatatggtgttctcaatgacctatgctctcccttccctgaagatgaaaaagaacttcatgctcatggaatttcacaaaagtaatgactacttaagttccaaacaactctagtccttggaaagaactgcatttcatcaaaagaggtcattagtaatcactcatacagacctggtattttcttcccacctctgcaaaaaagtatcaatttgttctctgtctctgggcagcttcctatcatttctcaagacaagatttccctgaagtaccagcgtaggagacacagggttgtgaggtatatacctttggtacctatcccttttcattgcaatacatatctttcatgattcccttgacacaagtagtgatggtttggtttggtttggtttggtttggtttgcttaagtaagatagcatacaaagaattagtcattacaaagacaaaacttaatggaccgaaaacttaaaacgtgcaattattaccttagactctggcaaaattattttgagacaacctaaattcacgaccaaaaggcaaattctcctgtgggtgagataatatggatgttctttggtgttattcttagctcactatattagtaccatcagatattatgttaacaccaatcataggacacaactgatgctcaatctacaatcaaaagaaaaattcaaataatttgagatttacgcaagttctacttcctttttgcaattaaccttgatgcatttttaactcccaagtatccatgttaaacataggtagttactgaataacaaaccacctgagaatttttcatgactagtacagctagactcttagagatggaataattttgcttcaaattagcctttaaaatgtagatactaaaaatgcttcttaattttgagattgaaattgaaaacatttttgtctccagatacttgaggagcctgacggctaaacaaataaaaactgctacttctcacctcacaggcttagcttgtaattcagaagtttcaaatggtggccagcagggcaaatccaaaacataaatgagttttatttgacccacgcagtgatttttaaatttttaattttaaaaatcaagaaatttcactttaaaaatccagatgtcaggccaagctcagtggcatacgcctgtaatcccagcactttgggaggccaaggtgggaggatccctggagcccaagagttcgagaccagcctaggcaacatggcaaaaccccatctctaaaaaatacaagaattagccaggtgtggtggcatgctcctgtggttccagttcgttgggaagctgaggtggaaaggatcacttgaacccaggaggttgagtctgcagtgagccatgatcgtgccgctgcactccagccggggtagcagagccagaccctgtctcaaaacaaaccaaaacaaaaaaaacagatgttcagtgtctcatgctgtgccttgcacaaagcatcagctgaagggggtaagtggggctggttccccacccacgctcctttgctgagccatgttcacaaggcctgcacactcatttgccaagcctggactataatcactaaggggaaagagtgacttttctaatttgcacaaatgtgctatatggtctaaaaacatcgcatcccggggccttcattcatcattcacacatagtagaaatcacctggaatatttaaacaaagcatgtaagcttgaatttactgcactcctgaccactccctattattactctcctgcttcactatattatgcctgttatctctgtagatatttgagtttccaactttggttaggataaaaaaataatacttctaatttattcatctaaattacgtaagtttaaattcactttgcaaaggtaggttgatgatgcaaatgcaaaccctcagcaagctggcttttcaatcagatagacctgggtaactatctaacggggggaaacttatgagacctgtctgtgtgtcaatttccttacctgtaaaattagactaacattacctgctgggtttgtagtgcagattaaatgaaatgacatgtaacaaaatatttagtgtatactaagtactctactcaaaacatgtaatttcatgttaattgctgaaatgacatcatctttctaatcctgaagtagaaaccttgtcaatgatttctagaatcataaatattcattcaaacgtattagactataagctgcatgaaggcaggtaccatgtctacctttcgttagtctctccccaacactggcatacagtaggaactttaaatttattagtagaataaatgaataaaattactttccaggctgcactgggaactgggaaatgagcaagatccttctccctttctaatccaggcatacttttccaacatgaaacagataatacaattaaaataggagtctataacagagactaatgttagaggcatttgaacagtgtaaacaagattaaacatttgccttgggttgacatacatgtcctggacaattaaacatcataatatcataatgcattaaatccaaaaacaaggaaagtccagtcattttcaccaccaaatacatgcattaaattctactaatgtggaaatctcagttgctgtcatttgatcttcacacagtatatgaatgtatcaaattaccacatgtaaccccaaaatatgtccatctattatgcagtattttttaaatgttttaaatgaaagcattaattcaagacatgagatccagaaaccaaatataaaagagctgcagactgtcacttttcaaatggctccaggaagaattttagcatgatagatggctggaagttttacttaaaggtagaaagttttagaaactaagcatgtcccacaggttgtcaataaaatagtgagctaagggcagagctcaatggctctctgacactttcccctctttaaaaaaaaaaattaaaaactggtacaccccggaagactaatttgttcaattgtctcctgtctgcagaaatacgctaagactttggcagggtttttacagtggaggaaacaaggtagttgacaccttctagttagccaacttggatctaaaatgtaaagacaagtgagatttgtttttcctaaatctttctttaagacagcatgtcagtctcattcaccctcccactaactttccttgaaaacatgcaagactagtaccatatacatatactttagtgatccaggttcctcctttttatattagtacaactggaaagtgtgatgctatctctatgtgtgtaatgtagcacaaaggtatgctcactgaggcatacaaccagaatgtgtcacttcagaggaggaaaagtcctctcatccctggaaaaatattttgcgctaaaaactatagctatttccaatgcaagatttactaagtgatatacctggggggcaagtgacttcatgttccaataaataccttattgcatggggtctagttggatatacccactttttaaaggataaggaattttttagctgttcaaaatataaggaatttgtgaccatatattccctaatgtagaagattccattggcttcattttatcacccagatcttatgctgttgaaaaaaaatgtatgagatgctgctactttgatacataaatgttttgttttttaaaaaacaaagatatttttctatatataccagtgaaaagaaaagagatttttctgtttctaccagtgaaaaggctatgagcagagctgccattcgttgactcttgttacttgagtaggtgcctgtaaagggccaggtggtgtttatgcagatgactgagcaagttacaatgtgttcttccttttggataaaacattagtgtatcagatgtgacaaatcagatgttcatcttccgcacttctgcattattttacattgagaattagacgatgtgctggcttagctttttgcttttgtttttttcttgagaataagttcataaataaagttttctctacactctgcataatcatagtcctacagaatagctaactggctagttaaaatgataattacacctatatctgtcttacagtgtgcaagagataaagcacgtgctctggggtaacaaaaacacaccattcatatactctaggagctatttaacatattatccattcctatgctcttgttgtcaagggaaaatgtggtcttctcataaacattttgagatgaaccatctgacactccagtgtccaaccaggaaattagcatttactgagcaccaaaatgaaaggctcaaagcaaacttctacttccaatccaaagggatacctgaagtagactatatgtttaaattaaatttttaaagagcctgaaaataatttttaaatattcagacaacattcccatctatagaatctgcaggagtctttcacccacttagcattcccatgctttcagaccactctaattccccttggctgctctccagggagcattgttcccaagaaaagacattcagagtttccccgtgaacacatatttccaataaagacaactgaaaaatgcatgttgctttgtgtattttattttaacttttagagacagggtctcactatgttgcccatgctggcctcgaactcctgggctcaagtgattctcctgcctctatctcctgagtaactgggactacaagcacatgccaccatgcctgggttggtatctttatattgagagcttctattatgaataagaacagcactctgtcactagtgagaaattaacagaggaaggcattcctctgttataccacaatcgtttgtggggcatgccatacatagtttgctcctgatcataaagctacaaagtttgtaaaaagactttaccagtgtgggaattgagtgaaaatcatataatttgctttgttcaaagtttggaaaaaactttaccaatgtggaaattgagtggaaatgatataaagaggatagatttaaacctaggtctatctgactgccgaatcactactgtatccacaagaccacactgctattgttttttgaacttcagctgtgaattcaacactcaggtggacatattccatgtattaaatttaattccagcagggctttatatggtctcatagcatcttctttatgccttccttatagcacatttacgatataatttataatatagttgttatccatgtacagtgcattttcccctactctctacaatatcggttcctttaaggcaggaaaaaatattcatcttgatatcccctcagaacctaaaaaagtgccttatatatgccaaccattcaacaaattatgactgaataaatgaacccataatggtcttggataattcgggagctgtttcagaatcatcatcataaatacactcaatattataacattgataaaattagtgagaaaatagaaatattggaataactaactgccttagattgttatattaatttgtattactgcataacaaaataccacacaattagcttcttaaaaccatctacatttattaatctccagtttctatgggcaggagtccaggcgtggcttaactaggtcctctgctcaaatctcacaaggctggtacaatctaggtgtcacccaggctgtatgcctttctggagttcacatcgttattggcagaatttagttccttgctgtcatagggctgaggtccccagtttctttctggctatcaactgaaagccaatcttagctcctagaggccctgcagttccttgccctgtggccacctcacacatgacagtttacttctttaaggccagtagaataatctgctaaaactgagtcctatataatcaagggagtgattatcccatcacgtttgctgtctaatataacctaatgaagggagtcactggctcatcatattaacaggtcctcaccaatgctcgagaggagggaattctataggtgcatatgccagcgaatgttgaaggccatcttagaattctacccatcactgtggggtttccagaagcagatcctgggacaagaatcgatgtgaaagttatttattaagaagttttccaaggaaaaaccagtaaaggaatggagaagtgggcagtaaagaaaaaaaaaaaaagaagcaaggatgccaatatctggcaagttctcacaggagctaaatttagctcaattctacagtgaaattcaacagtttgggttatgtctaagggttgcaaagatgaggggtaaggaagcttgaatattacactcctgtccctatcaggtattggtatcagggctatctccagagcatataaattccaacttcaggcatccagaaacaaactcacagccatagcctacactcaactttctcatagagcaatgcagatgctagctgtcaggaatgaaaacttctgggagtcaaaataaacaaaaatgattaagggatttaagaaaataatagtggggcattgacattatccgctacatgaactttttgtaaaagtgtgtaaatatcacaatgaaagttacatcattttgttgtaatatatatatatatataaatgtaattaattatttaataaatatgcaaacttctggttttagtaacatggcagtctgagttaacatggactcccccacacacattcacactatagccatatagaaatgtgaataaattaactggcaaccaatgagtgaggaaagatctggaaaggaggaagctgaaagagattctttaaatctctgtatgaagccctgagctatcctcaacctgaatatgtgtaaagtctatcagactcagacagcaaaagctctgagacccgaactatagtatacaccacatatggaagaacatgagcacataagctatgaaaaccagaataacacagcaaagtctgtgaaaactgaactgacattggaaccaagcccaactagaccaggtcagaacttacaatgtaaatccaaggttgatttcttgcttttaaaaaaataaagcccatctccaaaaggatttaatagagcccaaaactcataacacaatattcaaaatatctaacacacaattcaaaattacttgacataaagaatcactaagaaatctaaacaactgaaagggaagggcaatcaatagacatcaacattaagatgatccaaatgtggaattatcaaacaaaaaaagttatgacagctagtataaccatgccacaagaagtaagggcaaataatctagaaacaaatggaattacagtctcagcaaagaaatagaagctacagaataaaaacttagaaatatacaataaaaaaaattttaaattcaccagagggacttgactcaatggccaatgaaagaagaaagtcaatgaacatgaagacagattagtagaaattattcagtctgaacaatgaaagggaaaaaatggtcaaaaaataaacagagcctcagagactagtgagataatatcaaaggtctaacatttatcacactggagttattgaaggggaggaaaaaaaaggaacagtgcagaaaagtatttgaataaataatggctgaaaattccccaaatttggtgaaagacataaatttacagatccaaagaatctcagcaaccacaaaccggataaatgtaaagaaaaccacacctagatatatcatagtgaaactcctagaaatcaaagataaagttttaaaatcttgaaattaacagggaaaaattacattacatatgggggaggaagaatttcaattactgcagctttcttattggaaactatggagtccagaagacagcggcataacattattttcaagtactgaaagaaagaattgtcagcctaatcctgtatcaaaaatatccatcagaatgaaggcaaaataaggacattctcagataagggaaatatgtcaccaggagatgtgctttcaaagaaatgccaaataaaggtttacaaggagaaggaaagcaataatagaaggaaacttggaaggtcactaacaaggaaagagcaatagaaattgtaaatatccaggtaaataaaattagagtattatttgcctcttaagtttgttataatatgcatgattgctgaaatcaaaaattataatgctatttcaaaataggttgatgtgatacatataacaactacatcaaaaatggggaagtataaactgtcctaaggtctcttcactttacctaaagtggtaaaatattaattctaagtagcttgtgtaaagtttgatatgtatattgtaagccctaggataaccactagaagaaaaactacactaagagatatactaaaacaaacactgtagataaatgagaatggaattctaaatgttcaagccaatcaaaagaaggcaagaaatgaaaaacaaaggtatgaaaaacaaaatgaatggacagaaaactaataaaatagtagccttaaatccaaccacacaaataagtacattaaatgtctgtggtctgaacataccaattaaataagagagcgattatcagataagatttgaaaaagaaaaattcaactatgagctgtctaaaagaaatccatttcacataatggtaaaaaaaaaacaaaaataaaaaaaggctaaaaacaacagaatgaaatagcatatactaggaaaatgctaataaaagaaatgctggagtagatgtattaatattggacaaattcagaataaggaaaatcaccactgacaatgagggaatttacataattataaaagactcaattcactaagaaggtgtaacaattttaaatatccatgcacctaacaatacagctgtaaagcacatgaagcaaaagcttaataaaatgaaaaagacatacagaaaaacccacaattatagttggtgacttcaacatacctctatcagtaattaatagaataagcagacagaaatgcagcaaaaatataggaagtttgaatattatcaactaacttgacctaattgacatctatagactactccatccaacaaaatagaatacacattcatttcaaatgcctttggaatattcagtaaattggaccacattcttaaattttaaagaattaaacttatccaaactatctgccatggccataatagaattaaactagaagacaattagagaaataaatcatttcctccagatacttggaaatgaaataatgcacaattaaataatccaagaaaaagactcaagggaaattcaaaaatactttgaactgaatgaaaaataaaaatacaacatatcaaaatttgtgggatatagttaaaacagtgcttaaagggaaatttatggtattaaatgtgtagatcagaaaataagaaaggtctcaaattaatgctttaagcttccatcataagaaactagaaatgaagagtaaatgaactcaaaaaaaggaaagaaataacaaagagagaaagatcaattacattgagaagagaataacaaaagagaaaaatcaatgaaaccaaaagctgtttcttcagaaatattaaaacatacataaaactggctaggttgattaagaaagacagaaggcacaaattacaaacaccaggaatgaagcaggggataacgcttcaaaacccacagacattaaagaataatgaaggaatgctacaaaaagaaaactctattcatataataaatttgacagcctagatgaaatggaccaattctttcaaagacattaactatcaaaactcactcaaaatataaatagataactgaggggtcttatatttattaaataaattaaatccatagctaaaatatttctaataaaacaaactctagaaccagagggtttcacatgtgaagtctaccaaatatttaagaaaaaattaatactagttccacacaatcttttccagaaaaaagaatgttttccagctcattttatgaagacatcactaccctgacccctaaaccaaagacaatacaagaaaagaaagctacagatcaatatccctcattaatatagatgtaaaaattactcaacaaaattttaacaaatcaaattttatcaatatattttaaaaaacacatcacaacttagtggggtttatcccagaaatgaaaggctaatttatatttgagaaatattcagtgtaaatcaccatattacagactaaacaaaaaaaagccacatgatcatatcagcagataaagaaaaagcatgtgagaaaattcaacattcattcatgatattttaattattaaaaaaaaaaacccttagcaaactaagaagagaatggatcttcttcaatctgatagggagcatatacaaaaaacctaacaccatacctaatggtgaatgaccaaaagctttcctcgtatgactgagaaataagcaagaatatccagtctcaccacttctattcaatattgttctggaagtcttaacaggcacaataagataagataaagaaataaaagacttttaaattagaaaacaagaaataaaactatccctattcaagataacatgtgtatctacatggaaaatcacaaggaacaagggaccccaacccccagggccactaactggtaccatccatggcctgttaagaactgggctctatagcaggaggtgagcatctgcaagggaaaattactgcctgagctctgcctcctgtcagatctgcggtggcattagattctcataggagcaggaaccctattgtgaactgcgcacaccagggatctgggttgcaagctccttatgaaaatctaactaatgcctaatgatctgagatagaacagtttcatccagaaaccatcccccgacccccatccatgaaaaaattgtcttccaggaaaccactccctggtaccaaaacagttggggactgctactgaggaatctaccaaatgctcttaaagcaacaagtacattcacaaaatcacagaatacaaggtcaacatacaaaaatcaatcatttttctatatactagcaatgaacaactgaaaactgaaatttttaaaaagtaccatttacaatcgccccctaaaaaataaaacatacacagatctatacgctgaaaactatgaaatactcagaaagaaggcctaagtaaatagaaaggcactccatttccatagattagaatattcaacataaataagatgtcaattttccccaaagtaatctagatttaacacaatagcaattaaaatcccagagagatattttgcagatatagataagcctgttctaaaatttgtatggaaaagtaaaggaactacaacagttaaaacaattttgaaaaagaatgaaccaagctggataactcaacattacccaacagtaaaatgtatgataaaactatatcaatcaagactggtaaaagatgaaaggacagacacatagatcaatgcaacattacaaaaagttcacaaatacatccacataattatggttggttgatttttaataaaggtgcaaaggaaattcaatggagaaagggtgatcttttcaacaaacgatacttagaacaactgcatatcatatgcaaaaaattgaacttcagccttaacctaataccacacacaaatgttagctcaaaatgtgtcagagacttaagtgtaaaatagaaaaatatgaaactcagaaaagaaatgtagataaacatcttcatgaccttgggttaatcaaagagtcttttgataagacaccaagtgatcaatccgttataaaagaataattaataaattggacttcatcaaaatgaaaatatattgttctatgaagaaaatcataaagagaatgagaagacaaatcatagattggagaaaaaatatttgtaaatctcatacctgataaaggatttgtttccagaatacactttaaaaactcacaaaactcagcaataagaaaacaatcaacttcatttttaaaatgggaaaaagatatgaagacaaaaatgaatgtctaataaacacatgaaaagaaatatgatatcattaggcattatggaaacacaattaaaaaccacaatgatataccattatgcacttactagaatggctaaaaaaaaaacaaaaaacaataccaagtgctgacaaggacacagagcaactggcactctcatacattcctgataggaatgcagtatggtacagccactttggaaaacagcctggcagtttcttatcaaattaaacctacgcttaccatatgatccaacaatcccacatccatctgttttactcagctatttttagggtattcatcctagagaaatgaaaacttatgttcacacaaaaacctgtacatggatgtttagagcagtatgtttgccacaagtagaaacctgccaaagaaagctgtcctgcctagggctctctctcctccatggggaaggtctgcatccagtgactaaccaatgtgggggtatagccttggcctccttgctttaagacagacaatttttcacaggcatcccagtttcaggactctaggtaagatcagttgaaatgtctattgtgactgaatcatagttcaacttttcctttaaccctattattcttccctcaccattcacaggtatgtctcccaaaacacccaccaaaaaaacttccacacacaaatctcagagtctcagagactgtttcatgagaaacccaatttgtgacatggtaaaattaagtttacctcaagtaagggaaagatgagaatacgatttgggacaagaataagaaaaagttaagctaatattggtgttatttttataactgttttaaatgtatgcatgtcttcagcagacactctgatatatgttatagtaattcaagccatacatctctgacagttatgtagtaattccaaaaaattcataaaatatgtaggtaataatctggcctagaggaaaggcgggaaactttaaatattgaaacaccaggtgaaacagtctattgtactcagctatttttttctctgaaagtcacttgtaaaaaatatatatatatatataaatatatatatatttaaagtttaggccagacttagtggttcacacctgtaatcccaacactttgggaggtcgtggcaggaggatcacttgagcccaggagttcaagatcagcctggccaacatagtgagactcctacctttacaaaaaataaaataaaataaataagccagacatggtggtgcatgcctgtagtcccagccactcagaaggctgaggggggtgcacctcttgagcccaggtgattgaggctgcagtgagttgtgatcacaccactgcactccagcctgggcaacagagcaagaacctgtttcaaaacatacatacatacatacatacatacatgcatacatacatacatacatacactatagatacatatatggtttaggaaaaaaactttagttctggaacaaaaacaaacagtaaaaaaagaatattttcacaagaccaaaaggataaagatttttctaacataagactttcttttcattggggcttttacagcaatttgaaagaatagtatcaaaaagaagtgtacattgtatttcccatatattatctcatgttattaattaaatgtttttggttatgaatccccatgttgcatggccacaacataaaaatgagccttaattttactcttttggctactttaaatatcacaacttcagaccatctaaattaggacggcaagccaagaaactggtgaaaaaaaactgctatatcacaaccttacagaatttgaagaagctgttagccatgggaatgatcaagggacaaattcaccccctgcctctgtgcctgactcacagattctaaactagctgaggacacttgaaaaagtctgcttggtgagaaagttctttttctccttcttatgtgtgcacgtgcacacatacagacacactcacgttgcttcaagttcacaagcctgcagcagaatgggcctggagaagggagatgatctctaaaaggctatatataaaagttgtcaaaaaaaaaaaaaaaagaaagaaactgcccacagggactaaacttccaggagtgcagatacagtgagggacagattagctaaaattctgtgtttgcagaatagattaaacatcaaaaagaaaagcagagaccccagaaaaattctctttacagtaagactttttgtttagttcttatttttaatgctttcccacagagaatagaatatgaaaccaagaagcccaatcttaactgagagagagaacattaaagggcataagaaagagaattgaagatttattcaatggacaaaagattgaagagctttggtgggttttgtgttttgttttgttttgctttctagaggatgacttaaactacagcagcctgagggaaagagtaaaaagtcttggataaaggctaagactgctaagaaatcttgggccagaaaagaggaattgctctgcagtggcagccagaggcagtttcaaggactgccatctgcttcctaggattggagctacttcagcaattgtttctaagcctatgttcaaaaaccaaggcaatgtcaccaatgagatttggattatcccaggaaaccagaacatttgggtctgccagcactggtaaattactaccatgtaaataaagcatactctgtccagatctgcttgtcttgctaaggaaacaaaagccacatctcttgctttcaaggagtttgctaccctatagaggaggaaaaaaaaatctatatgtgttaacatatgattttcaaaaggcataaatgtatgtctacaattaactgttgttgtataagatgtaaaagctaagtacttgagggagataagagaaagcaaggatggaacagagttattccaatcagactatgaccagaatcaggtttaagaacaatgggtaaatatttcccaggagacataagttgtacacatttgtcttgaaagtggtaggtgtcatggttctatggaaaagaataagaggaagatataacacaaaaaattgtcacttagccagacatgatggcaaacacctgtagtctcagctattcagagacaggtggaaggatactgtggttctatggaaaagaataggaggaagatataacacacacaaaaaaaattgtcacttagccaggcatggtgttgcacatctgtagtctcagctactcagagactgaagtgggaggctcacttgagctcaggaggcagaggttgtagtgagccgagatagtgccactgtactgcagcctggatgacagagcaagaccctgtctcaaaaatatgtatatatattgctaccttctagagttccaaggtagaaataaggagagtgtgcttgaaatttgcattgctaacacatttcctaagatgtatcaaagaaaaaaaaagtgcagttaaaatgggagtcagtgagaggtttagcagttttcatttgataaatgaattaaagaattaattgaaaaggggcagcgttaggtggaattcaggtgaatgagttaaaactatcaagaaccatgaagagtctgagattttaccttacttgcaagctgacgagttagcctgcaaaagtcatgagatcctatagcagagataaagggtttaattactcaggacccagcaggccacatgaacatcatttttgctttagctacacttcccacccaagtgccatgggggtgatgcagaaggggccccgtgtatactgcacatgcagtaggtttgcatcacagctgagaaatgctgaacttacaaaacctgaatcttttataatgggcagtaagcaaacctgtctgaccttgctccagaggaagacattattttattatactggacagtaagcaaacctgcatccttgaaaagatgatccagaacaaaaagacagttgtttctgctcaccagacagaaaaaaatgcaagagacctatggagaattttctccaaacaagtggaggatagaaaggcctacagaatgagtgcatgtgaaaacaataattaagagataaaggaatatcacagggcagtaaatgaagtaaatgaggggaaaatagtatagcgtaaataggtgagaaaacatcaagcaaaactgctctgaattagttatttgttgctgcataataaaattacccccaaagcttagtggtttaagacaataaaaatttattttctcacatagtttcatgggtcaggaatctgagagcagcttacctgggtagttctggttcaggttctctcatgaggttacagtctagatgttggctgggattacagttacctgaaggcttgactgggactagcagattcacttttaagctgatcattcattcacaggcttggcaaggtggtgctgggtgttgtcaggaagcttcagttgttgaccacgtagacctctgaatagggctgtgtgagagtccgcacgacatgcaagctggcttcccacagagaaaacgatccaacaagagagatcaaagaagaagtcacaatgccttttatgatctagtctcagaaaacttcttctcactcctgccatattttattcattagaagcaagtcactaagttgagctcacactcaaaagaagggaaattaagcttcacatattgaaggatggaatatcgaagactttgtggatatattttaaaaccactacacagtccaagttgaagcatctggcatgatgatggagaatattgttgatgagcaaaaagtgctatcactattagtgagactgtagttaaaacaagagacaggtgctagagtagagtgagaagagatgacataatatacccaagttgcaaaatttctgtgtaggcatacctcaaacctaggggtttggttccagaccactgcaataaagagaatatcacaataaagcaagtcacacaaatattttggtttcctggtgcatatgaaagttacgtttatatactgtagtctattcagtgtgtaatagcattgtgtctaaaaaacaatgtatatacattaattttaaaatattttattgctaaaaatgctaatgatcatctaagctgtcagcgagtcataatcttcttgctgaggatcttgactcaatgttgatggctgctgactgatcaggtgggtagctgttgaaaatatatatatgttgagatagggtctcactttgtcacccaggcttgagtgtagtgttatgatctgggtttattgaaggcttcgcctcccaggcttaagccatcttcctacctcagcctcccaagtagctgggactgcaggcacgcaccaccatgcctggctaatttttatattttttttgtagagatgggatttcaccttgttgtccaggctggtctctagctcctgagttcaagcaatccacccatctcagcctcccaaagtgctaggattacaggcatgagccactacgccagctggctgtaagaatattttaaaataagacaacagtgaagtttgttgcatcaattgacttttcctgttatgaaaaatctccctgtagcatgtgatgctgtttgacagcactctatttatcgcagaacttcttttaaaactggaatccggctgggcatgatggctcatgcctgtaatcacagcagcactttgggaagccaaggtgggtggattgcttgagtccaggagttcaagaccagcctgggcaacatggcaaaactctaaaaacaacaacaacaacaaatacatatatgtatatataactttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgtttttagccaggatggtctcgatctcctgacctcgtgatccgcccgcctcggcctcccaaagtgctgggattacaggcgtgagccaccgcgcccggccaacttttaagtcttttatttaagaaatatattttataaggctttagctgtcataagtcaggagtaaaatatatttttctgtttatattatagaaaatatatttttatatataatatttatatattttctataatatatattatagaaaatatatttttatatatatttatatattttctataatatataaaatatattttatataatagaaatataatatatattttgtatattatatatactttctatatataatatatattagagagagagagaaaatggtgaattcttcccagaagattttcaatttattttgcccagatccgtcagaggaatcctgacttatgacagctaaagccttatcagatatatttcttaaataaaaagacttaaaagtagggctgggcgtggtggctcacccctgtaatcccagcactttgggaagtcgacgcaggtggatcacaaggtcaggagtttgagaccagtctggccaacatagtgaaaccccatctgtactaaaaatacaaaaattacccgggcgtggttgcgtgtgcctgtaatctcagctactcagaaggttgaacccgggaggtggaggttgcagtgagccgagatcgtgccattgtactccagcctgggtgacagagcgagactctgtctcaaaaaaaaacaaaaacaaaagacttaaaggtcaaaattactgtttgattcatgggctgcagaatggatattgtgttggcaggcatgaaaacaacattcatttccttagacatctccatcagagctcttgggtgactaggtgcattgtccatgagcaggaatattttgaaaggaatctttttttgagaagtaagtctcaacggtgggcttaaaatattcagtaaaccatgatgtaaacagatgtgctgttatacaggctttgttgttccactcatacagcacaggcagagtagatttagcataattcttaaaggccctgggatttttgaaatggtaagtgagcattggcttcaacttaaagtcaccagctaccttagcccctaacaagaaagtcagcctgtcctttgaagttttgaagccaggcattgacttctcctctctagttatgaaagttctagatggcatcttctaatacaatgttgttttgtctacgttgaaaatctgatgtttagtgtatccaccttcatccatcatcttctggataacttgctgcagcttctacagcagcactcggtgcttcaccttgcagttttacgttataaaggcaacttctttccttaaacctcatgaacaaacatctgctagcttctaacttttgttctacagctttcttacctctctcagccttcatagaactttcacagagaattagggtcttgctccagattaggctctggcttaggggaatgttgtggttggtctgatcttctattcagaccagtaaaacctattcagaccactaaaactttcctcatattagtgataaggctgtttttgctttcttatcattctgtgttcactggactagcacttttcattttcttcaagaactcttcctttgcattcacaacttggctaactgtttggtgcaagaggcctagctttcagcctatctcagctttcaatatgacttccgcattgagattaatcattgctagcctttcatttaaagtgagagacttgcaatgcttcctttcactggaacacttagaggtctttgtaggattgttaactggcctaatttcaatattattgtgtctcagggaatagggcggcccaagaaaagaaacagagatgggggagcagccagtcagtatagcagtcagaacacacacatttattggttaagttcaccatcatatacaggtgctgtttatggcgacataaaacaattacaacagtaacatcaaagatcactaaccacagatcacaataaaagatataataataatgaaaaagtctgaaatattatgataattactaaaatgggacacagagacacaaagtgagcacatgctgttggaaaaatggtgctgatacactttctggtgcaagacttcctggtgcagaattgccacaaaacttcaatttctttaaaaaaaaaaaaatgtagtatctgtgaagcacaataaagggaaggacaataaaatgaagtgtactagtatttggtttcctgttaaaatttgtatttttgccctttcttgatccttatcctatcaccattatctagttctttgtacataattgcagaaattttatggctttattttgattagactataatgcaagatgatgttcccatagcaattttttgaaaagcaagcacacctgtccagacagagggaaaaattgatccagatgctgaggagaaaattgtgttgatccctaacagatatctattatactgaggttacaatcagttcctgggtttgtggtcaaggtgaaaagccaaaaacctctaatctacggcaggattcaattttctgtatgaattcattccttctaggtttattgtttaatagtgtcatgatgattatatctgtattcatgcaggtttcttaggcagaatataaagtggactgagctcaaagtcacaaggtgggattctattacagtatctcaggcaagaaataataaaggcctgaatacaggcagtagtatggagaagagaaaagtagggaaagtttctagagagatttctgaggtatgataccgagaatttggtgactaattagaggtgggagatgagagagggggaagtgtggaaagaaactcggaggtgctggtttgggagatttgatagatagatagggggcccagctggtcccaggttgcccaggactttctcaggttcagcactgaaagtcttgtgttatgggaaacccctcaatcccaggcaagttgcccatttggacaccctatgatagaaataacattaatttatatagggaatacaggagaaggaacgtttttgctgtggaaaacaaattctgttatgggcaagttgaatttaagaaaactacagaagatgtaagtaacaagttggaaatgcattttcagagcccagtggagaggctggggctggatatggagaattgtcagtcattatatgagaaacaatgccatgcaagatgagaatctcctaggaatgatttatagagtgggaagaaaaggggggctgagaatagaattcagtttaaaaaaaaaaagcagggggagggtactttctcatggaaaaagaaacccatcaagggagacagagaagaggttcagaagtgggagaaattagaaacagtgattatcccagaagccaaagagagggggaattttcagaaggcaggtggtgaggacaaaagtgtcaaaaaccgctggacctggaattaggcttatttcctgtagtgatggaaaaggggtggtattaggactaagtgctacaagagtaaggagagcatggggcccagccccagctaacttaaagaggatcccatctagcagatacatgcttacctgaccctctgagagccgagggagaaagaaaatgaatcatcacttccagcttactctctagtctcaggcactgagacattattcaacctttcctgacttcttttcttttctttttcttttcttttcctctctttttgtttttgttttgacggagttttactcttgtcacccaggctggagtgcaatggcgcaatctcagctcactgcaacctctgcctcctgggttcaagtgattctcctgtctcagcctcccaagtagctgggattacaggtgcccgccaccacacctggctaatttttgtatttttagtagagatggggtttcaccatgtctggtgaaaccatatataaatatatgaaatatatatttcacatatatatttcatatacatgtgaaatataaaaaataaagctagtagctttattttttttaaaactggcatatgttgaacacctagtctgtgccaggcaccttgtatgctttatctcatttaatcctcatagcaacccaatgaggaacttttataaatattcctcattttgtttcccttcaatttccctacgtttaaaaaaaatctgtaatgacaaaaactaaagttttcttaaacatgccatattcctccaataatatctccttagtcttggaaactgttcagtatctctggatcctgagtctttagtgtctgctttgattcccaagaattaaatgaaattttttcctaatttataagatacttttgaattcttttataattttctgaggtacaataatcccacctatctcgtgctagctaccaagttaagaaagtctacacttcaatttttctaaaagaatgcctaaacaggcatgcaagtattcatagctctgcaatattattcttgcaacctctgtatttcaatagtttgctaattgttttatgataatttttgtttacctattaaatgataaacctctagatgtcagaagccaagcatcatacttttctcatcctctacaacatctaacagattattgaacatcataatcattaatgaatatttgatggcttagtcttcttactcagaatcaaactaatgaccaaagcatgcttgcaccctctctagcatggtctccatggtgttccctagctgcagcaccaatattattcctcttactcttgggcttctcccaccaaatcatttcattgcccataggattaatttagacaccagatgaaaatggaagagcacagaaataaaaatataccgtatgtagtagtacccataaaagattaaatgaataaatatccataaaatgaattggcatcatctcaaagccttactgtgaaagattcatataaactttactttttgcagttatacaagtttctgtatacattttcccctatgatattgtagtagcgataatatcatattcccaactcaccaaaagctaaaactctcagagatggtacatatataagaaactaatgaaacaaactctatttttctccctctgcattactcaaattgaaaaaacatccagagttatcaaatcttctgtaagacatacaggtctaggcttgtataactgtgatttctgctaactggccacagcctagtattttcacactttttttatactaaatggttagaactgatcactccacccgaagctgtcatggagaaatcttcatttaaaaatctaaataagacatgcagcagcagggttgaatttttaaaatattattccattttttgcatttcagtaaactcttgcaaatgtcacctatttgccttttagtacaattatacacacataaatccctgtttagtaaaaaaaaaaaaatgtattctatttgtcacatatcatcagtacatttctagtctagacaattctttggataattaactgaatttttataagcactttaggttgctcatctaacttgggaaaagctgtttactcaagtaaactaagctggggtggtggggagagacaaggtagggagggagtaaccaccaagctttgctaataaatagttctcagaaatatcagctcccaatttactacttgtacacaatgggccagttgaaacttgtatggtgatccaatttgccacagctcttgtttttagtctttgtggagctgctgtgtgagcacagtgggggccactcctgtgtatcccctgagtcaatcagtgggcttttgtttcctgctggtcaaaaatatcaggtggcttcaagagtctaattatcaatgaaaaattaaattcaatacagaaatgtagccacaagcaccactcacctcaccctttctgagccctcaccacccccaggcatgtgatgaagtatcaagtcattccttaggattccaaagagatagcagagaaaaaaaaggcccacacctgggggagaagcagaatagatttttacttgtatacctttctcctttcttggtggaggactattctaattaccacaaaagttctggaaattagcaaactataaggcgttttctctaataattgttaagccaagcttatcttaacattgtaccataacatcttctggccatagttcccatcagaaatagtataaacagagaaatgaaagaatatatatgttattatcaataaacttgataatccaaataggcccttttttaatgcactgaaagagttcttacttgctcactaatgtatattcttttatctctactgagtttattccaggcatttaggaaaacacgaagctggaaatgctagcaactgccacttatttcaggctttcaaagtaagtacaggttcctcacttcacattctaagtcagaatagaattggaagctgccaaagccaaatataatagagctttagttttctacacatgtgattcccttctaatccttgtctttttaaaaaatatatgtgcttcatttataagtggtcaactaagcttatggtgggagaaaaaaatctaccgtcttaaaatatccaccctcatcaacgcttcccattagatacctcctccaaaaagtgaaatattaaagttaaaaccaatcaaggcaagctttttcgtggtgctcaaatactttaaccacagtgtcaatgcacatggtttttaaaacgtcaaagtaagtattagggttgattcacaaatactgttgaagtgtgaagtgttcttccatatggtatccctatacagtccctaagtatatccctatacttttgatatctctatatcaaaagatgatatcaaccttggattaaatgtctctagagattatttgatcagacaatgcaattttctctatgagtcttggatatatgttaggtaacagcttgaactagaaagtgctccagtgcagaatgacgtgaacccgggaggcggagcttgcagtgagccgagatcgcgccactgcactccagcctgggcgacagagcgagactccgtctcaaaaaaaaaaaaaaaaaaaaaaagaaagaaagaaagaaagaaaaagaaagaaagaaagaaagaaagaaagaaagaaagaaagaaagaaagaaagaaagaaagacctccaatgctccaaaacccttaggaaaccaattatacaattgtctgatcctattttaaggatcacaaagactcaaagaccgaattatagccaaacttgtccaaaggcactctgggaactcaatagaaaaacataataagtaaagaagcatcctcaagaccagagaaaggcagaagagggggtaaatagtaaaggtaaatttataatgaattatgaattatatttttaatgttttaaataagactttctatcttttgcaagtatgagtattcaaagacataaaagataaacctattttgttctcctgccacttttaaaagagagatatttactgtatactgaggaatatgttattatcattattcactagaattttaagtaattttatattatatagttaaggaataggttatttttgaacatggcattttcaatagagaagagcagttgtttgacattctttggcttttacacatttatgtgaattttgctaatttattttatcttaacacccaagacacaatatacatgtgcataacagcaccacatcagaaacagttattgaacaaggatcactctttataaatgaacacaaggtaaaatcctaacaattaaaaataataaaatactaataacagctaggtaaagggtttttttcaatgtactttaaacctacaacaagcaaagacatatgaaagactgtgtttctgtattcatacatctttgttgaaattagcttgactaaacacctacaagtaaattttttatcacattcattctcttagattttactgagtaaaatcagctttttactatgaaaatgtagctggctgcacaaaataccatcattttccttttaatagattctgtattgtctacatagttttttaatgctgttttatctaaaattttaaaaatatacacacaatacacaccccaatacagttaacattaagacaaaagtttagcaacataaatggaagattttcaacatgtataaggtaacagtaaacattttatgcaaatgcacttcagattttctgttcttcttgatacaccccacccagaaccttctaaaaatgaagctgtccatgctatttaaagttgcattatgcattttatattataaattattaaaggacttaatggacaatgtgctagaaagaaaacaggcaaattacagaataatttaacattgcaaagaaacagagtaacttgcaggacattaaacactctattttgacatagaatgcctgaagctaaagcaattaaagctgcaaaatattgctggctgacatgatgtgtatgtaaatttgtcattcattggcaaaggtttgtaccaatcactgggaatgttcacagtaaaacaatccatgtagtataaaatgcttttagtgaagtcctctaaaaaagtagttatgtatcatttacgtatctaatcattatccatagtaaatttttggtttaataaaagagtcctctatggaaatggccttaagattgaggatgagttcttgacatattatttatatctgttcatttcttaaagggaaaatatcattttaacatacatcacaactggaaaagaaaatacaagccagaaattgacattttatttaatttggttatgtttttccctaggactccaaaagaaggcctgtcttcgagtattgtatctaactctactctagaaatagagtctaacagagccatactgaattctagccatttatcccagcttagaattagtgttattctcccacaggaggtagaagggaaaaaaaaacacaataatcccccaaatgtactgttgctatggaagagaaggagatgcctgctgagattgaaagtcacaaaatatttgggcagttgagaaaacgtaggccaaacctccattgccaaagcctgaagactgtctttgccaggactcctgggtcatttggcactgcagagatacgctggacagaaccctagaagaagctataaggaaacaagacacattttaatattcatttatcaaagctcttcaattatcctttcaaattagatgagccaacagtaaactcggaaccaagagaacattctaataaatactaaaatgacttcataatagaaaaaatagtcaaaatagttggtgaattacatttctttgacatttcaccaatgagtttaattaaactttcccaaagcctaggagcaggagaacatccttctctctctcttttggaaaagatctggctcataaaatttcacagctccaatttccctctctaaggctgtatattcactgttcttgactgttttagaaattatatcaaggattaatcactaaccatatgttttggagaaaatcatcacgaaccacaggctccatttggtaaataagaagctatacaggagactccagcctgccatcatttaatgttatgcataaacactgtattgataatccaaaccaatcatccttaaacaccatttctaaactaaattaattacacatttaaatttatatataagcacatacagtactaataatgaaaaaatatccgtatcccagagtttaatgattctgacagtgtgtaatctgcaaaataagaatattggcttgtgggagctccataaatgtttatcgagcatctctgataggaattgtaggaattttttaacgtgtagtatatgtcctcaaaaagcatatagtctaaggagaaaaataggtaatcaaacatcacacacagaagaatggcaaaagtactaaacagacgtataacagataaaagaagagagaagaagtaggaggaagagagagggagaaaattaaagaaaaaaaaagaaaagtcactgacaaacaggatgaaaagtgatagaatggcccgaaaacctggctcaagtgtcacctggtgtatttatgcagtaatctatctagccacactctcactatccacaattaacaatttcacaaggttttaagaaataaatacctctccaggatgtccatgtaaataaatgttttaggatctgcttcattgctggagttatgataacttagaaaagagacagatagtcttaaagtttatatgccagcaacacgatttctaagttgaaaagatgagcgcacatttcaaagtttcacaaacaataaatatgaatcatagcattgctatacagtgtgaatagatttcagatctctgagaaaagaaccaaaataattctaaaattatctccacctctggacaataataaccagtggtctttttttaatctacaagtttaaaacatattttaatgttgtttctcctaagccttaacacagtaaaagaaagttgaaacatagtcttctttgtgataaacatgtagtatctgtgaagcacaacattaatcccatttgtaccataaaaagtatgatccacttgagccttgctctcctgtgaattatgaatcattgtaatactcgggggatagtcatcacatctctaaggttcctgctttgttcctacaatgtttttcctcggatatctaaagtatctaggaaatttgaaatccccatatgaaatatcttaacatattctttcaacatacattccaccctttccataccacaaattatgtagcacaagagaaccagattcaccaaataaagtgatagtaggtgtatcttattctttggaagaaaaggctacttattacagtcatattcctttggtaagtagctaaaatatccaattaatagggtttaaccatcagacagaatttgtttttagaataatgaaaatgtgttgtcattacattgttattcccttgagtgtatttttttgagatgtgactcattataacttattttagctgttctgttttctaattcttcatgttttcacatcttttacaacaaaataataatacataaataatacctgacaagattttacagatttttctctatcagtatgcttttcttctccaagcatcttaaaacatgggtgtggtaaaatacaaagaatgtgaatgttagcatccttacaagaaaaagcatcaattttctctcttctgctacacacattgcagagtacagttaacaatgcattaagtaattttgaacccaaacatcatgccaaatagttctagtgaaacctagttcctaaatgtagcttcattttgaaagtcactgtttttattaacagtgtcttccaacagccttatctcaatagtaccactattaaccatgaaatttagctgcttctgtttactctttgaattatacctattaaattgccaactcaatttattttcccagttgtcattagcccgttaataatattgttaataagctaaaatgtctctctattccttttcttagcttctgtagctgcctgaatttacttactaatacaatttagaatataggatccaataaaaagtggagtcagttcctgacatctgccttcacttccattcttattaaagagacacatttctagaaaagggttgggagtattgcttgcatttctctttttgctacacataatcagcaacaacaaaatagtctagtgactattttgacatagctacttcagatctatgaaaaaaggatgttttaattaaaatgtaggccagtggcacaactaattcaagaattagttgatgtcacataattaattcaattttaccagatactattcttatcattgaaatatataaaataaggccaggcgtggtggctcacgcctgtaatcctagcactttaggaagttgaggtgggtggatcacctgaggtcaggagttcgagaccagcctcgccaacatgatgaaactttgtctctactaaaaatacaaaaaattagtcgggcgtggtggttgatgcctgtaatcccagctactcaggaggctcaggcaggagaattgcttgatccctggaggctgaggttgcagtgagccgagatcgcgccactgcactccagcctggatgacagagcgagactccatctcaaataaagtaattttttaaaaaagaaatatataagatagccaaaaaccaattgaaaattaaaattaatttttaaacaatttttattatatcacaactatagtcaacagtgataacaaatatatattgtgcccttaggatcttcaagttaatatgccaagtatttgaaataccatgaaagatcagacatggttctttccatcagggaatctatattgacttacaaacatcacttggatatgctgtttttaattaagcaatgacttcatattcaattacataaagtttaagtacttatgttatactaggcactgacccagggattagggacaaaaagatatatctatcacatattgaggataatgttaaatattaattcactagttatgatcaggaagtatgcatagataaatgttcttgacaaacaatccagaattttttttttttttttttgagacggagtctcactctgtcacccaggctggagtgcagtggtgcaatcttggctcactgcaacctccgcctcctgggttcaagcaattctcctgcctcagccacccgagtagctgggactacaggtgtgtgccactacacccagctaattttttgtatttttagtagagacaggttttcaccgtgttagccaggatggttcgatctcctgacctcatgatccacctgcctcggcctcccaaagtgctgggattacaggcatgagccaccgcacctggccacacaatccagaatttttaaaccaacacttagagagagagagatgtgatgatacttttttgttcatagctcactgaaacctcaaaacctgggctcaagcgattaatcctcctgcctcagcctcccagtagctagtactactagtactatgggtgcaaggtttttttgtgtgtttgtttgtttttatagaaacagggtctttctatgttgcccaggctggtctcaaactcctggccgcaagaaatcctccactttggctgctcaaagtgctgagattacaggcatgaactgctgcccccagctgacactttctttaattaataagtagactttgagtgttttatttcttttcttttttttctactttgtcacccaggctggagagcagtggtgcaatcacagctcactgcagcctcgacctcccaggctcaagcgatcctcccacctgaacttcctaactgggactacaggcatgtgccaccatacctggcttagtttgggattttttgtagagatggggtttcaccacgttgcctaggctggtctcgaactcctgagctcaagcaatccaccaactttggccttccaagtgctgggattacaggtgtgagtgaccatgcctggagagtgttttatttcattattccctgagcaatccacaaggaacatttctcatcttgctaaggaaaactaccactatgtactttcaaacataaagaccaatatctctcatcctagaatgagattaaaaagaaaacctcaagagtaaagctatcagctgaaaaacttgttgagataaatgttatgtgcatactgtgtattcatggtaatacagaggaaagcttttcttaatgaggaagaattcaaagttttacaacactaatgttgagatatagaggacccctaaaatgctgtcacagttaactgcaatagatgctattaagctaattttttgaaatctgaaattcatacggtactggcgcagattctcaccatgtagcagataatgttttctcttacacagattcactttcatgtagctataaaagggctgatcttagtagactgcaaaccaatcacagcacttcactctggggaatatagaataaagagggtgagagatcactaattacagttgccaatattttctatagatgtggccaagtcaccatgtaagaagtggtagtatatgtaagaagcaggaatatatgtctttcgtaatactgacattacaaatatatgaagttaaggtatctcacaaatgcaagtccttcaaaaatctgctctctctatatattgccctatactaatatattcttagaccaagcctgagagagaaattccaacatccactgcattgttggacaacaaggaggcttctagtgaaagatagcatctttttataaaaagaaataaaaaagaaggtatgatatgtgttatatttccagatttcaactaaataaatattagtggttctatcttttgattgatgagaaactatataataatggatttctatctgcagaacaagttgagccaaagaaaagtagggaaaggggtcagtaaagttggtgctgagggacaagactaaacactatttttataggtcagtggttccaagtttgtttctaagggctgatgtatgttgttttgaagaacatcatttgatcctcaatatagtccaagtcacagaaaaataattttattatatcatggcctaactgtacaacaatatgagaaatcaaaacaaatttatattaaactttattcaattgaagggggtatgttaaatacatagatttgtgtcttttctaaacacttattattcatatcaagaatatcagggcaacgcgttaagaatgattgcgaatcttacaagccgtataaaaagaattctataatgaaaaaaatccctaatctccaaaaaccaaatatatttaaatgtatatttcttaccatttctaacagaagcatctggagccagaagaacttacatagaagtagagggttttttgtttgtttcgttttgtttttaacatcatagcattatttccctttggcttgtaaagcctaaggtattatcttcttgtgatgctgatattgggaagtaaagaaatatttacattatgggctctgtgatataatgaaagatatgtactctatattacaaaacagaggaaccatgatttaatctttcccacaactcaaaccatgttagagagtgtgcctcttaatgggtttttattatgttttgttccataaagcatttctattcatgatagtgataaaccaatatttcagcattgtttctataagtccaaatagacttttcaaatcagaattccatgcagaaatcagtcccaaaggattacaacatttttaaacatttaaaagagctatgaaatgttcttggacactgaaatcctttacatgcatcagggcatcaaatagatatttatacaagataataagggtaagtgcagacacacaaatcagtacaaatttatctatatggataaagagatgcttctgtttgcatatggatattcatgaaaattagagggaaaaagtcaaaactaaataaatatttaatatttcagcacctgtcatatagttttttgtatgtgtgtgctttactactatggactagcagtagtactgctactctaaccaacttcattaaagaataaaagaaaagtaataagtcatttcacactctgtctgaccattatacaataatagcaagatttcatgcaagggtacaacattatgcccatctgcaatcacagtctctttgcaaaaatctcaattcacacttcacatgcagctaaccttgttaccatcccttcctaaatccatcagtgttgcagctgcacgtcttcacagcccaacatcttaaaattcatcactttggcaccttagcatcactataggtcaagataaagaatccaaccaagaataattaaagggcacccagatgtttagtttacttatctcaagcctttcctttaatatatttgaattgcctgtgtgtactatttctttcatatttttaagatatgtgcagtgtgattattttaagggtatgagacctggaacaatacatttcagacttttttttttacaagtagagttctttgtagttgaaatttgaacaagaggcgtgataatgagtaggttgagggaaggaaaggtgttatctcattaaggtaattactaagacatccccactattatatcagtttgaaaatgtggcaattaaagcgccctacatgggctcctggagacaagagaacaagacagttctcttggaacttctgtagtacggttaatgtgtgtcatgtaaatgaaagggtagactattgctatttaattcttttcctcaaaccccctaccctcaccctcaaatttctttgtcagttatggttctttttttttttctttaacctgaatttagctctcatgaaaggtgctagattgacaacccccagaagctagagccctctacttacccacagaatagttggagcacagaaaacaacagggtaagcttggcaggcaacatgctaccaacctaagtcaaaagagatctgaccttccttcccactctttagtcaggcaagtctcttgctctgatgagaaggctgtcaaattgatacccgaagtaaggaagccttaaaatacacgtaagaaaaatggtaaatgatgttcgtagcttacttcactacaacctatacagggtaactcaggtggtaactcaatttacacaattcagtgaaaccactacctttggtcactaattcatttggtcactaattcatttcccctcctgagctggtcatcttgctcttgctctttctttgcttccactcaagatcaatagtaatgtgatataccaaataacacacagaaaccattctcaaaaatcttgctttcatggtcattgaaatattattttaaaatacaaaaattagttgagcatggtggcacacacctagagccccagctactcgggggggctggagtaagaggatcacttgagcccaggaggttgaggctgcagtgagccacgatcccacaccacactcaaacctgggcaacaggatgagaccttgtctctctctctctctctctctctctctctctctctctctctctctatatatatatatatatatatatatatatatatatatatataaaatatatatacatatacatgtatatatattacacatataaatgtataatatatatacatgtataatttaactcaaaatttaaaaaagaaaataaatgtccagcaatggaaggatggttgacacacctatggtacttttttttttttagccactacacccgagttattttttaattttttggtagagatggagtctcactatgttgccctggctggagtgcagtggcacaatcacagctcactgcagcctcaacctcctggactcaagcaatcctcctgcctcagcttctcatgtagttggaaccacaggtgtgtgccacaacatctggctaatttttaatttttttgcagagacagggtctcaccctgttgcccaggctggtctcgaactcctggactcaagcaatcctcccaccttggcctcccaaagtgctgaaattacaggtgtgagccaccgcacctgggcacaattatgacacatttatggaagagattattatatatcaaatatcacacttacaaagagttttaaataatataaagaaatatttgtattacatgggaaaaacatatacatcccaaatgaaatatgacacaactacataaaaatgcactgcaaaaatccagaaattataaaccaaatggtagtagtgagtggtagaagatgagtttttttcttctctctactttttagcattttataaatcttctacagttagcaggcattatctatacaataggaaagttattttaatgattttcacaaaaagtctgtttcttttgtagtagaatttgaccacataaatttaactccattaaaattgaaggtcaagaatcacctgaaagtgctgtaatcctgcgttttctgttttcttcccttttgtctcctatccttacaggaaaaaataaaaatgggagaggagaaaaaccattaagcaaatacattgtagaaaaaaactgaagtttagaataggtattaaactggatgacttttgagattccttccagtcctgggtttggatcaagatcagctctgcttaaaattcaattacttattaatgtggatgttggaaatatcctctgccaaatttctggacagaaccgagtaccagtcatgttcctctaagggactagatcattcacgagaagaaaagaaaagcccgtaaaacatgttgccaaatagaagggatccttcttgaaatgccaatgccttatgtggcacttgtgtataaaaagcagtgttttgaatagttgggtttttaaattatgttccaaaatattaattaatagtaagatccaacgcatttacaagcttaaatgtacatggtcatcttttcatcattgacatttctcaatggaaatgtttatttgacctgtcaccttcggccacatgaaaacaccccagacatgtgaaataacaaagtaaaaatcaggaggacaaggcaggcagggaatggggagctgaaaggattctgcaaacctgggccttaaaagtctcccagcaggccacaactttcctcttttgaattcgcccacctgacacttcttaccagacccttggccatcatgtctactatcagtttctgaaatgaaagcagtcattgttgctttactaaatgaggtggaaaggtcttaatgtttatatataaattctaatctaattctgccccaataaatttcttggtgggaggactttcagcatgtgagaggcactgtaccttctgcaggaaaaattaggccatgagactcaagatcggctgtgcggagctgcctaatatcatcccttatgcgccagcaggggcaaagaattttaactcaaaataataataggagacgggtaagaggaaatggataacagaagtttgggcccggctctgcaaccaggcacgcccaggtagctgccactcaatggctgaagagaaggcaatgggagagcccctgcaatcgcgcagccagccgcgagggtagtagtcacgtgatgccgctggctagaattgtttggtgcgaacatctggctcttggtggtcatctctaatgtgtgttagaaaagtttgtggggcaatcagaaatgtggattcccagaaatttccaaagcaatccagaaaagaaggaagacaaagggaagtgtgctatcccacggttatccaattgtgctttatgtgactttctgggccaatctatcaatgcatagtaatgaaagattatgtgaaatttatgtgtctattcacatatgataatgtttaatgcaatgcctcagtgtgttcactcaaggccagtgagaaagtaggtgtccctttaaaatcctcttaatttaatggaaacaatttggtaagctttcattaatagaacatttgtgggaaataaaacagatgaataagaaggtgacgctttaaagtggctacagctctgatgcaccctacttccagtgggaaactgtctttcttaatatctagtctggaatctctctgctcatcagtttgcagatacccagtctgcaggaggcaagagttggttcaagaggaagttgggcaatcagattatcaatgctactaacaaacattatttgcatttttcagaaattatgacacggcaattttatcaaattggagatatatttaaaatcaaaagcttaaaattaaatcattagaaaaactgttcactctacaggaaacctagctaatgtgcttgggagactctgacatttgaaaactataccaaataacttagctttcctgcagtaggaagtgaatagcacggacttccacattttttcctaacactctgtcagctgatttgttttagaatgcagaccatttttacaccacaggcaccctaattttgtattataggagtggggaaacaacgcaccactaatatctaattcctctctcctaaagaggcattataaatgtacattgttttatagaaaactttccctactagttcacgtgaggatggactgtgcctgaatgggcgccctggaacacctcttcctccagtccccagaggctttgggggaaaccccgtctcgcgaataacgcttgaatctacagacatggataatccattgcactacatatgtctactggttcctaaattccacttagcattttcgtacctccaactatagtgggaaggaggaagagaagagccaaaggggaagtagggggtgatcaacaaagaggagttgacttccaagaattgaagagaaatctgaaggaggtatcatttgcagccatgaggtctttagagcggtgggagtgaagctggatgcagataagagctcccatctgagcaaagattattttattgtcttcacaggagaagaaggctttatattccctccagagccccccgagatgtgagagaagggccctgctctgtaggccatcccaagtaccgtccttgaaagcgtctggattcccgtcccaggcctatagagcccctgtcctgatgcgcccatgcctccctgaagcgctgtctgtacccgggcgcaggaactcgtggcggccgggcggtcctgaaggtggaggagcgcggggcccagctggggtacgcgccgagcaagaacccgcacggagccggcgcgccgcggctgggcttcaaggccgccgcgccaaatccctggctgcgacgtgtatgcgaatcgttaggaggaggcgggaggacagccacactgagggcctcttcactaaagaatgaagtctgacggcgggaatgggggtgggtgggggcgggaatccatcagctccacaaagtgacagggcccttttatcgtaaatcaagttcaatctcgctctcgcgaaggtcctcttttttcggcggagctcccgcaggggcgactcgctgtcccagaccagatagtagcaagagctgggagagacccaaatctgcagggagagggcgcgggctgagagccgcggtggggagcagggcctgggcccagcgcgacctgcagggctgctgcctcgggagcgcttctgctctgcctgcggtggccgaggcggcggctcgccgagcgcgctccgagctgtgcgaacagaggaagtatgtgccagttagaagggttccgccggccacctcgtcgcagccgcggcgcaaggtcttggagccgcagacctgaggcccggctcctccctcctcggcttccactaagaacttattaaatagggacgattcacagttgatctgtcactgagcactacttaccccgagatctttgggtttttgaattactttattgatctgaagattttgttctttggaatgtgaccctgtttggacttagagctaatcaggaaacgctgccggggaggttgctttgtaatcactttgcttacctccccccgggcgccgccgacccttcctagacgcctccgctgcggccgcctaggcttttacccggaacccgccagcccaggttacctagctccacccggcgccctgggagctgtctgtggtgctagcacacagaaaccgggagcgggagacccagtggacaaggagaggagagaggagacaaactgagaatgtaaggttaaccgagacggtccacccagcaacactcaaactgacaaagaccttcaaaattcagccggaaggaccgggggaaatagtcccttctgggtcatctcatcgccccgagacagatgacctggttttctaatccaagaggccaatgacacctccctttctctgaaagcacacctccccacagccccacacacccctctcacttacccctacccagccctggggataaggtaagaagtcagggcactcggcactggacccttatgataagtggccctaactccagaaaaagacacaaatgttagcaaagaagcctggagatgactaaaaagtgggactgggtaaagacctagtgggagacttaaggagcttggggatactgttccagagtccataggagtaatccctggagaggcccccactcactcatctgcgcacaccgctctctagtcaacagccagggtacagagcaagcccgaattccctcaccaaagattcagagatgcaaaagaaacatcatttccctgcaaggcttgaccccgcccctgagcatgtccaccagtggtgaaaagtctcattctttccaagcatgttgacttcaagcttggttttttcaaaaaccaggcagctctcttccagtacatttttgtaaccacgtggcttaacaagaactaaagtttccctagccctggggagagcttttccaaatatttttagaaagttaaaaatataacaaaacaaactactcacaagccacttgtttaaagaggggaggtgggatccgacagactcctggggaagggctgcctaggcaggagtcagatggcagggagggaggaggagggagagtaagcagttttatttgcaagggaggaaatcaactgtctaatttgccatcgtgtgggctttcattttaaggggtggagcaaaattaaacggatacagggtggtaggtatctttgctggaggcatggagccaagaagcaatcactactttgcaactcattgaaaaatcactagtttgggctagaacagctggctgctagccggggagttaacttcttccttcacactcactacagatttgtgtaggtttgctggggtccctgagctgatcttggtgttggcaaatctaagaggcctttgtaggtctttaaacgtctctctgaaataactttgtattactgtgtttctgtaggaagcaaagattgccactgaaaatctctgtttttctagcctccgacttaatcaaaggagcaatctaaatggagtccagccacggagtgcccttcagacaccagctgaaggtgggaaaaaagaaaaagagtacagttcccagggacagctgtcctctgcttctctgtaactccagatttcccatgagaataggcctctgcctgttaccttgttccttgcttctcagaaaacctggagttgcactcttcacctcctagccaacctcctaatttagttgagcaggcacagaaggaaagaaggaccctttgtgaagaaaaaaattgagtttgcatttgacttttaagcaggtgacttttgaatactagggcacctgctgaggtgccctttgcagtactgctgcagaaaaagaaggaaagaaaagaaagaaaaggaaaggaagaaagaaagaaagaaagaaagaaagagagaaaggaaaataaaagaaaaaaagaaaggaaggagagaagggagggagggagggagggagggaggaaggaaggaaggaaggaaggaaggaaggaaggaaggaaggaaggaaggaaccaggcacccacccaactttcttcctgggacaatatcccccaccccacaacatccaatctgccaacttgtatgcaacagcaggtaaccaaacaaatttagaaaggacattgacacattcagctgcatgatttagggggtgaaagaaaacatgactttgaagaaacttggatttggggaggaccctaatggatcctgagtaattgctagcagcagagcaatatgaggttgattaagagatcttggtctctgtaggcacagtgcttccccctgcattgtccacctcaggagtccaagttcagccttgagtgtaaagcggcagtgggcagacttcccggcccaccatcctgcaggtggctggggactgctggcagcaaatgggtgctctggccttatttggatttgtagttttgtgtgtttttcatacctggatctgagttaattctttgtaaagattctttgtatgcataaactctgtggcctctcaaatccctccttgtgcctagagttgaccagccccagtttcagtgcaaacagaagctatagcaccctcaaaccttggagagtgcctttttaggcctaggcagaccacttttaaactgtttaaacttgatcaaaaaacccaactgcaagatgaaacaaggagggtctgctaagtgcctaggtattggacatcctaactggacatagcggcgcccaatttccagccaagcccagctagctgagtttgtctcagctaagcaggcagaaaatgagaagggccagtccagacccttttgttagaatcaaacaagaccaagaccaagtttaaagcaaactgatgagctggagagaaatctgcaaaccacttcctaattagccaaggtctgatcaaggtgcccccaggcaatttccacctggatttcacttttcttccctccttctttcccacccctcctaaatatacattcccacatcacttcacatttttaaaaacatttttaactacactaaggttcaaccatcagagaaagttggaggccaggtccagatgtattttagctgcttgtattacccctttgtcactgtactagggcaggagtgaggatagaaatgtgaggatgcccagataggaggtctgactctggctactcaggaagtgacccgggggctggagaggagtaggagcaacctgggaactgtatgctccactaagtggctccttcatacagtcctgagcactgagcctggtggggagccagcctggcggggggtgaggggtggtgcttatgactgacttaggccagggtgctacaaacatttacttacatacacacactcacacacactcctaaagcaggcagcgggcctcctccacactctgggcagggtctcctattttgcagtcccagctgtcccaggggtgcagataaaaggcttggcagccagtctcagcctgagttcaccgttgcaaaggaactccaggcatcgcagcacaacgaactcactaggacaagcggctccgcatggggctgggggctggacgcccgccgccagggactgagaaggcaacgatcaaagccgccacaagggtttgttagctggccctctccaagtcccccgggggcgtcctaattgctcgtcccacagcctcccgctcacaggctgtccgacctcgccggcgctcagccgcgggcagcagaacagctgcgaggctcgaggagcgtccgcctgccgcccagcccctgccggcgttgtcatcgctgcccagcgcttcggaccctcgctgccccaggaagacccctagaagaaggaggaggggaggacagagggatcaccacaccggtgaagctggggcctctatgcaggtcaggacggcagcaaagttggccgccgacttagccagcacccgcagcctgcaagtacagattttctcccacagcctcctgggttgctttgaaaccatccatttaaaaagaaaggaactcatacatatcaaataatggttcggaagaggccagcacgaaaaatggagctgcttttatacaagccaacccaacctctttacggattttgtaaattcctaatatttcagaagaaatttgttgttctaaaccaagtcagcacttcatcatagtacattctgctttagtaaaatcagctcccttggatttcatcacttgttaaaaaaagataaactttatttttgtaattttcaatcacaaaaaaatctatatttttgtctaagcatttattttactgaatcgaaaagacatgaaaagaaaaatcatgtttttactaacgtatataagtgactctttttggacaacatataataaatatgatatatcacttatcactcagtctttcaaatgtacatttttttcatattatggagcatgccacttttccaaaagaaaaaaggtcatgagaaatcagtgcaaagttctcagttaccctcctcttttctctggggcagacggaatgtcctcggcaacgccctttgcctcagcacttgaggctgtccatatatagttcactctgcctgtgctgtttccgctccgtgcccttctttcttccctccttagccctcccccctccctccctcctgcttgtccctaaagtcatttttgaaaaagaatttgaggttttgtttttgttgatgttttcacttactggttgcactctgtgtggggtcagcattttcaccagtcacactgctgtgggggagatttccagccctgtttctaggggtggggagatggagagcagagggctggctcctctttgggggtcccctgcccactggtaagcatcttcctctcttactcctctgccttccagagttggctgcaagggaggcctagtggcctggagcagggagaggacgggcagcagtccgggttgggcagggatatggggaagggattgcagtgccttcgctgcaatgttttcaccgggggtgtggggtgcctgggatggggctggacaatggattaagggctggctgtcccccaggccctaggccgtggatgagcacacggggcaccaggggccgctgcagctggggatggggtgctggaggagtccggtacatgctgctgtacatggcagcggcagccgccgccgccgtagtgctgtccatgctgcccagcaggcttgggtgatagaaataaggcgatggaaacatcctctgcagcgccgagtagttccctgcctcggccagcaactccaggcccaccgctgtctgccgcttccacttggtcctgaaagaaagcgggtgtgcaggcacccagcagctgtgggcatggtccaggcaccaagacccggccccttctctggccccttcctgcctcctccttcattctccctgggtggcaggaagactcagagacctcttcaaactggcaatgcaccacatctcctgccccagccttgctcccagaaagacccaaacccaaagccagttttgtaaattacaccttcagtggctgagaccctcacaaatgaaatcctacaggccttgcttccttttcctaaacctctgctctgctgtcgccccccttgtagtttggctacttctggaaactttccttagggccaaaggagacttccacaagcagtcactttcctccttccttagttccccttccacatctcccaactcccaacaatcccaaagagtctgctctcagcccctcttccttccccgccaggctgtgagagaagaaaccgtaaacaaagggatgcagagactcctaagccagggaccccagcccctctcagtccccagggctgggagacatatttctctcataagcctgacaggaccttacagtgggcagggggcttaaggggaggatggcaacaaggtctcaaaatggaattcatttgagggagggttctcccaagggcaaagtacctcctggccattctgaggtgggggtgaatgcatttcaaggtatttcctcctcagagataaagtaacaattaaaacctgtgatcagcttttctcagtctcctccctcccccgctgcacaccctgctaggaagaagagagcgggcgtttgctcaaataccttatgaaggaacgcagggctggtgggccatccatacccggcagctccagccaaattaataaacatgtcgcccattttaaattggctacaaatgacactaatgttttccgacagaattagggtggctgaaaccgtatgtaatgagacagaaaattatggtaaagatgacaagtggatgggcatttccaaccgcacttatggacgattagaacacaaacgggagaaaaggaggggtagagaaaatcgagacaaggagatgagtgccaggcttgaaaacacagcaaaacctctgcctcagattgcccaggttccactctacacttcgtggccctgcgagcactggcagtcacttttgctttcttaatttcccttctagagaaggagcagtgccaggcaggctctgcagcactctagctccatgttgagacagcagaggcagccagtacaggggacagacccacactccttccttctccctgtccggatgcttggccagccgccgattctccaggctgcggctgccaaacctactctaacccagctgggctctcctagtctctgcagctacactgaccaaggcttggatcctgct

SEQ ID NO: 414 - DNA, 40001 bp, Homo sapiens
atacactgatgggattaaagacaaattagacattatggaagagaacattagtaaacttgtagacatagcaatagaattaatccaaaatgaaaaacacagaaaaaaataaattttaaaaagtacacagagtatcataaactgtggggcaactttaactggtttactatatagacagttcctgacttacgatttttcaacttaacgatggtgggaaagtgatgcttattcagtagaaactgtactttgagtacccacacaaccattctgttttttactttcagtagagtacctaacaaattgcatgagatattcaacactttattatagaaaaataataaaatgttagatgattttgctgaactgtaggctaatgtaactgttctgagcctgtctaagacaggctaggccaagccatgatgtttggtagattaggtgtattaaatacatttttgacatgatattttcaacttatgatgggtttattgggacataatcccatcttgagttgaggagagcttgtatatgtgattggggaccctaaaggaggggggatagaaaagtatttgaagaaataatgataacgtatttctaaatttgatacaaaacacaaacccaaaattctgtgaaatttcaacaaatcccatgtgcaggaagcagaaagaaaactacaccagtttgggcaactataaattgcccaaaaccagtgacaaaaagaaaatcttaaaagcagccagaaaaaagtacatacagaagaacaaagataaggaggacagcatatttctctcagaaaaatgcaagcaagaagactggagaaaacatctttgaagtactgaaataaaaaaattataaataggaatattttctaaaaatggagggaaaacacttttttagacctacaaaagctgaaagaattaaccgccaatagacctgcaccacaagaaatgttaaaggaagtccctcatgtggaaggaaaatggtaacaaggaaacctggaactacacaagggaaggaacaacagaaatgctaactccgtgggtaaatacatactttttttcttattacttagagccttttgaaagagaatgaagttttgaggttgggcacggtggcttacgcctgtattcccaactctttgggaggctgaggcaggcggatcacctgtggtcaggaattcaagaccagcctggccaacatggcaaataaaaaaattagctggatgtgttggcacacatctgtaatcccagttactcaggaggctgaggcatgagaattgcttgaacttaggaggcggaggttgcagtgaaccaagatcacaccaccgcattccagcctgggtgacagagcgagactctgtctcagaaacaaacaaacaaattaaaaacaactaaataaaacagaatggactgttgaaacaaaaataaaatgtagtgtagattttatatagatgtgaaatgcatgacaacagtagcacaaaggctgggaagagagaaatgatagtatactatagtaagtttcttatgctatatgtgaagtagcataattggttctgcttctgtaactgtgctttgactgatagaggttctatgaaaaacttgttgggattttgaacgggattgtgttaaatctatagctccatttggaatcttcctattcataaacatggtatgtctctctgtttacttatgtcttctttaaagtcttctaataaagtattattattttttccataaaggactacttcttttgctattcctagttactttatatttttgttactatgaaaaatgtctttttatttatttttgagacagggtctcactctgtcacccaggctggattgcaatgtgaccatggctcactgcagcctcaacctcctgggctcaagtgatcctcccacttcagcctcctaagtaactgggaccacaggcacatgccaccatgcctggctaattttaaaatgttttatagagacagggtcttgctatgttgccagggctgatctcagactcctaggctcaagtgatcctcctaccttgacctcccgcagtgctgggatttcaagcaaaaaaaaatctttaaaaaaaaatagattttatttcagttttaatcttaggttcccagcaaaatttcatggaaggtgcagagattttctgtatattcctcactcccacatatacatagtcatttctgtgtgatggctaattttatatgtcaacttgactaggctaagggatgctcagttagctggtaaaatataatttccgggtgtatcagtgagggagtttctggaagagcttaacatttgaatcagtagactgagcaaagaatatcagattgactaatgtgggtgggcatgagccaactcattgagggcccaaatagaacaaaagggcaaaggaatggcaaattctttctctctcctcttgagctgggacatccatcttctcttgttcttggacattggagctcttggtttttgggccttcagactcagattgaaatatgccaccaacttttcagcttttctgattctccagtttgcagacagcataccatgagacttcttgtcctcaagtaattgaatgattgagtcccataataaatcttctcatatatatacaagggtttttctagaggaatagaattaatgggatatacatagaatcaatgggctacatatatatatatgtaggtatacatatgtatatcccattgattctattcctcttgagaactctgactagtacactccccatagcagcatcctgcagcagagtgacacatttgttacaatcaatgaacctacagttatacattattagcatcctaagtccattgtttatgttaagattcattcttggtattgtacctttcatgggttttgacaaatgtataatgacatatgtccactatgatggttgttgcaggtagcaactagctagggccagtgtcacaggtggtaaaagtatttaccattacagttataggtaaagaaagacatatttgttagagagggtacgaaaatatgtcgcaaggatgcaaagggcagcacagcagagaacgggctgtctgcaaagaggcaggtgctggagggaagttttattgggaagttttatagtgctgaagggggctacatgaagaaccaatcattgtgccagtggttgaggtcactgtgcccaggaatattgttgtgtcctcatgttgtttgtgattagccatctctcagaacaattgttcattgttcttcctcacctggggttcttgccttttgttgcttactcatcgggactccacaatggtatcatacagaatagtttcactgccctaaaattcctccgtgctccacctattcatctctccctccttcacgcaaccccagtctctagtcaccaccgatcattttcttgtctccatagttttgcctttttcagaatgtctttttcaaaagctatactgtataattccaatacagtacagctttttctgactggcttctttcacgtagtgaaattcagttaagtttctggatgtaccaaagtttatttctccatttacctactgaaggacgttttgcttgtttttgcttgtttccaagctttggcaattattaatagagctgctataaatacccatgtacagggttttgtgtgaacagaagttttcaacccctttgggtagatatcaagaatgtgattactgaatcatatggtaagagtatgtttagttttgtaagaaactgccaaattgttttccaaagtggctgtgccatttgcattcccaccagtaatgtctggagttcccgttgctgcacaatcttgtcattatttgatgttgtaggtgtttgggattttggccactctaaaagatgtgtagtggctggatatgtctttttaaaatgtcaattttctaactttttgttgatgttgtgtacaattttgtatattaatcttataatcagcacatttgccatactgttactaattctaataatttgtagattcttctgtatcttctatttaggcaatcatatcatatcatatcatatcatatcatatcataccatgcagatgtgagggaatggtggttttgtttcttcctttgcttaatccttctaccattatgtttcaaacaattttctgttgaaaaagaggattttcagatatagtttgaaggaatttggctacgatatggataatatcaagtttgagacttccattgtgaagtttgatttttgcccccttctcttatgagctaagagaagtttaattttcttcctcttctcacttcccctttattggaagttgaattctacttaatcctaatttctcttctttttcagaagttaattataatgttcttccccaagggttttactttaaggtagatgtcagccaaaatgatgaggttaggtgcaacctgcatctttgtgtttctgaggttcaaagagctcttaaaagccatgtgatcaactctagaagagacctagaagttggtagaaactcaaaatatgtttattcaactgatttcatgcaattattagggaatacacattctttttaagtaaacatggacatacatgaaaattgaccatatgcttattcgtataacaaattcttaaaagttttcaaagaatgaataccaaatagaacacgttcagtgacatcaatgcatttaagttagaaatcagtaacaaaaatatacctttaaaatgctatacattcagaaattaatccatggattaaagagaaaatcacaatagaaattagaaaatacttataactgaatgataataaagactgcataagtaaacacttgtgggaggcagccagaacactacttaaaagagacatgaaaagatgcttgatcacattatcatcatggaaatgaaaatgaaaatcccaatgagataccatattgcacttattagaagctggcaaaagttttttcttttaggagatgaggtttcactctgtggctcaggctggagtgcagtgatgtgatcatggctcactgcagcctcaaactactgggctcaagtgatcctctcacctcaacttcccaggtagcttgggattacaggtgtacatcatcatgtcctgctgatttttaatttttttgtagagatggagtctctctatgttgaccattatggttctgaactcctgggctcaagtagtcctcctgctgacataagattctttcagtgccactttgccacttggaaaactctatggctggcagctcctctgcctgagtttcacttgtgactgcaagggggtgttacagtgtgtcatagctctggcttggggagtcccaaggtctgggccctgagaaggattgcagctcttcccttgtagtctggtgaatgggagcatgtcactgcccgccattcaggaacatgcttcagctcattcatgttacaactcattcagccctgccaccctgctttgtcctgaggctcctgggttggcctggtcctgccactacttcttatcatgtggggtggctggtcagtgccagcagagcacaggagggctacagtgttagagctccttttgcacctggcttttgatgggtcccaggttcttgtcctgcgtccaagaagaatgaggttacatggacaaacagagagtaagcaaggtggagaagagttttattgagcaacagaccaattctcaacaggataggggacccagagtgggtagcccctatctgaaggcagggtagtcccaatgtgtggctgagtctggggtttttatgggctcagagttggggagtgcatgctgatttgtccatgagtgagcctggaagaaacaccatttgattggctaaaaggcatcgaggaagttctcactccgggttatggactctacgcagaactagcagcccagttttcaggctctggctgtctttggcttgaaggttgggtttcattggggaccaacccctgtctgcctaggaatctgtctgcctcctgctactatcactgcctcagcctcccaagtagctgggattacagatgcacaccaccacacctggctaaattttttgtaaaagacaaggtactcagtctggtcttaaactcctgggctcaagtgatcctcccaccttggcctcccaatgtgctgggattataggcctgagccattgtgcctggccaagtttgaaatctgtagtgttttaaaatctgtagtgtttgcaagaatgtggaacaatgggaacccttatgtgctgttggtggaagtgtaagttagtctatcactttggaacaaaggttgatattactcaggaaatttgaagatgtacatgtccataacctaaaattcctttccttgatatataaactgtgaactctcatatgtatgcatcaggatatatttacaataatatttataggaatattattagaaatagtctaaaaattgcaagcaattgaaatgtgtattgatagaagaatggctaaagaaaagtaggtgttgtcacataatggaatattatacagcagtgaaaaggaataatcaatgccttactgctacatgggcaaatatcaaagcaactttgaactgagaaggtaagtcacaaaaacacacaatcagtttaattcccttcatgaaaatttcaaaagcatgcaaaactatacatttattttattggggtgcaataaattgattctaagacaatgagagaattcaatatctagaaaagcaatcactctagggtagaaggggggaaaggcaagctgtcaaaaaagggcacaaagaagaaatgtggcaaaataaagttcatataatatgtgcaattaaaaccacaaaaggcagaaaagagtaaaagacaaaataggaataaggaataagggcaaaaaatagaaaatggtaacaaaagaggtagttattaatctaacaatatcaagaatctttttgaatgtcaatggtataaatgcaccaattaaaagacaaagattgtcagaaaggataaaaaaaatttccaattatatgttgtccacaagaaacctactttaaatataaagacacatgtattaaaagtaaatgataagaaagatataccacgctaacaccaatcagaagaaagcaggaatcactatatcaatttcagatagaggagaattcaaagcaaggaaagttattggggataaagtgtggcattacataattataaaggggtcaattctttaagaagaaataatccttaatgtgtatgtgcctgaaaacagagcatcaaaacacgtgagccaaaaaagggcataaagtagatttcccaagtgctagtaatattttatgatgtaagctgggtgataggtatatgaaatgttgtcttatataaaatatgtatgtaaatcatatatgccattttgtatgtgctatggtctgaatggtggtattcccccaaattcctgtgttggaacctaatacccaatgtgatagtattaagagttgagacatttagaaagtgattaggtcatgaggggatctgctcttatgaatgggactagtgcccatataaaagagacttgagaaaagagagcttgttttgctccttccatcatttgaggacacagagaagacaccatcttctatggtggaaaggaaacttcatcaggtactgaatttgctggcaccttggtcttgaacttcccagcctccagaactgtgagcagtaaatttatgctgtttatgaattacaaattcatgttgtttataaatataccagttgaagctattttgttatagcaaccagaacagattaagagagcatgtatgctgtatgcatatatatatatatctcatatattgtatatatctttatataatattaatattttatgatgtatttcacaacatggaaaagattgctctggtagctacatggaaagtgtttctcctctttaacagagtcagggagacatgtaaagatgctgacacagtattgataaaatgcacaaatcttttgaaatagaatttaggacttttgaattaactggatgcagtaggttaaagaaaaaggaaaaaaaagattattcaattttcaggcttataagactatacatctttataattcatagaaaaattctggaaagctaacactagaaacagtgttgccttcagtggataatcgaaacagggtctaggtagatgagagagggaagcatacttttcactgtcccttttgaattctgaactatgttcatgcattatctatccaagaaatgaaaaaaaaaaaaagaaaataaaaagatgagatttgtatgtaactcatatatgcctgttctgatataatagaaaagttttgtagtagcaatattattacagcaatgagtccactcatgtttttgggatctgatgctgaattaggctaaatagcatattgatatcatttgggtgtttgccctctccaaatatcatgttgaaatgtaattcccagccaggtgtggtggctcacgcctgtaatcccagcactttgggagactgaggtgggtggatcacaaggtcaggagttcaagactagcctggccaacatggtgaaatcctgtctctactaaaaatacaaaaattagcttggcatggtggcatgtgcctgtaatcctagctactcaggaggctgaggcaggagaatggcttgaacctgggaggcggaggttgctgtgagctgagatcatgccactgcactccggcctgggtgacagagcgatactctgtctcaacaacaacaacaacaacaaaaaaagtaattcccagttttggaggtgaggcctggagatgtttgggtgatgggggtggattcctcatgcatggcgtggtgctgtcctcatggtaatgagtgagttctcacactgagttcaagagaaatctggttgtttaagagagtgtggcgcttcctccctctcttgctcttactcttgccatgtgattcgcctgctccccctttgccttcagccatgagtggaagcttcttgaggcctcaccagaagcagatgccagcactatgtttcatgtacaacctgcagaaccatgagttaattaaatttattttctttatagattacccagtctcaggtattcctttttagcaatgcaataatagactaacacagaaaattggtaccaagaagtgggccattgctataaaaatacctgaaaatgtagaagcagctttgaaactggataatgggtagaggttggaagagtttggaagtctcggaagataggaagatcagggaaagtttggaacttcttagagactggttaaatggttgtgaccaaaatgctgatagaaatatggacagtgaagcaagctgataaggtctcagatggaaatgaagaagttattgggaattggagtaaaggtcacctgtgttacactctagcaaagaacttggctgtactgtgttcatgtcctaaggaagtttgaacttaggagtgatgacttggggtatctggaagaagaaatttttaagcagcaaagtgttcaagatgtggcctggctgattctaactgcctgtaatcagatgtggaagcaaagaaataacttaaagttggaacttatatttaaaaggaaagcagagtgtaaaagtttagaaaatttgcaacctggccctgtgctagagaaagaatccaagcaggctgtggaacgaccacttgctagagagatttgtgtgtctaaaagggtgccaagtgctgatatccaagacaatgggaaaaggccttaaaggcatttcagagatcttctaggcagctcctcccatcacaggcccagaggcctacgaaggaaggattggtctcagggaccaagcccagggcctcactgccctgttcagtgtcagagtactgctcctacatcccagctgcttcagctccagctgcagctcaaagggccccaggtacagctcaggccactgctctagggggcataagctgtaagccttggtagcttccacatggttttaagcctgcaggtgcacagaatgcaagagtgaaggacatttggcagcttccacctggatctcaaagggtgtatagaaaaaccccaggtgcccaggtggaaggctaccatgggggtgagcccccacagatactctactagggcagtgctaagaggaaattaattagagtccccacatagagtgttcactggagcactgactagtggagctgtgggaagagggctactgccctctagaccccagaatgatatagccactgacttgcatcctgaacctgggaaaaccacaggcactcaacttcaacctgtgagatcagccatggggactgtaccctgcaaagccacaggggtggagcttcccaaagcattgggagcctgtcccttggcaccagtgtgccctggatgtgggacatggagtcaaaggagattatgttggagttttaaggtttaatgtctgtcctgctgggtttcagatgtgtggggcctgtagcccctttcttttagctggtttctcccctttggattgagaatgtctacccaatgcttgtactccccttgtgtctttgaagtaaagaaattgctttgcattccacaggcttataggtggaaggaatttgacttgagtatcagatgagactttgaactttggacttttgatttagttgatgctggaatatgttgagactgggagactgtgaggaagggttgattgtattttgcaatgtgagaagaacaagggatttgagaggccatgggtggaatgacatagttcggacgtttgtcccctttaaatttcatgttgaaatgtaatccacaacattggaggagggggctgatgggaggtgtttaagtcatgggggtggatcccttatgaatgacttggtgctgtccccacaataatgagagagttatcgctcggttcacataagatctggcgtctcccccgactcttgctcccattctccccatttgacttgcctgctgtccctttgccttctgccatgactggaagcttcctgaggccctcaccagagacagatgtgggtgcggtgcttcttgcacaacctgcataactatgagccaactaaatttgttttctttataaatgacctagtttcaatgcaagaatgaactaacacacaaatcttttgtgtttatcctaggctaggatggaagcgagagtcgactgccctctggtcaaggactgactcctgctgaggtaaaacatggctgctaggcttccccttcagtagggctgtaagtgggcaatgactgattgatataacagcacaaagaaaccatagactactccctggctgatcctagtggctgcagcagccccgttttaaaattgtaaagtgtggttgatctttgacactccttcatgccctatctgtatattttcttaccagcatcctctcatgtgcataatcctacacatgtaagctagtcctcggctagctgcaaagtgataaagccttaaattattaaccctccaaagggattctgtgtatgtgtgtgtgtgtgtgtgtgtgtctctgtgagagagtgtgagtatatgtttaagaggcaggagttggccgggcgcggtggctcactcctgtaatcccagcactctgggaggccgaggcgggcggatcacgaggtcaggagatcgagaccatcctggataacacggtgaaaccccgtctctactaaaaatacaaaaaaattagccaggtgtggtggcaggcacctgtgtcccggctactcgggaggctggggcaggagaatggcatgaacccaggaggcagagcttacagtaagtggagatcatgccactgcactccagcctgggtgacagagcgagactccatctcaaaaaataaaataaaataaaaaataaaaaataaaaaaagagacaggaatctagctatgttgcccaggctacaactcctggccttgagctcctggcccctcaagtgatcctcccaccttagcctcctgaaaagggattctgtgtttttatcaggaatcctaaaaatcagaaagccctcaaaactaaaaaaaaaaaaaaaaaagactctaattatgagctttctaatgcttatgtcttttacattatgctgtttgactaatcactaatgctgatcctgcctcttgttttacaatgttatttatataatatgcaattgagttagttttatttaattttcattcataccattcctcattttgtaatgtatttatggtgacttaaaataaacacagaccataaaatggtaaactacaaataaagagttaaaaatcaggcccagagaaataaaaactagagtagaaatcatgaccaggcataaaagtagtatgcaaatgaactactagaattgagtttcaagtttggcctaggatttctagtgaaagtaaaaagagagacatgatatgttactggctattctccccttgacttcccttccaatacctcccaaaccctcccctccccaagccttctatttccttagtggagtatgtagcttttcctaacactatgccctagaagaaatttctcacatggcgctataagcttatattatcatcactaattccacctatctttgcataataaagggcacaaagccaaaaagaaagttgtagttgaatcaaaattgagctaatggttaacttgtgcactgagtatgtaggaaacagtgagtgtaaatgacaagactaaagagagttgtatatttgtttagcaatttgtatctcagtagcaaataactagggatttaagaatcctcatttgtgtgctttggaaatatcatgcaatcacctagtaaaattgcatcattttttggttcatatgaaaatatttgaagtgatgttcacttggtaattctgtttgctgaactttgtgattcatgtattatttcattattaagttgctctgctctctacataactaaatatcttcatttaatgggccactggggaaataatagtagtttcgaaggaaaagttttgttcagaatgtttatcatgaacttggatgaagagagagtatattggttaaaacagtaataaacatgaagttagcagggttaattcaaacaataaatgacagactctgggtctcattccatcttgggccctgtaaatgaacacatcacagaggatctgaaacatgctaaaatccagtcaaatgcctgtctgtgggttttttatgggccactttctattctaatcctctgttctttgcctgctctatgactcccctggatctgcccctctcatatcaggattaactgcaggcattctttcttactgacctatttggacctacttctccagctaggtccttggcactgtatcctggagataatccatggtcagcctttggctccacaccctgaagctttgtggaatgggtgctcctgccttcccttgctcctgagagcttgactcagcttggcctagttggccatggttcctcacagtatgtgagtgtatgggagtgtgagcagtctttatctcctttgtgtattgcctggagtctaagagggaggaaactgaaacgctgctcagagttgtttatttatttattttgagatagggtctcactctgttgtccaggctagagtgcagtggtatgactgaagctcactgcaaccttgacctcctaggcttaagcaatcctcccgcctcagcagccagcttatgccatcacacccgacttatttatttatttatttattttatagagacaggggctcccgatgttgcctaggctggtcttgaactcctgagctcaagcgattcttctaccttggcctccgaaagtgctgggattacaggcctaagcccctgtgccagcccagagttgtttaacaaaacaaaacaaaaaaaacttaaaggtgtgttcagtcattcaatcattcctcattcattcattgtccattgtgtgcctggcagtgagaatgcagaggtaaacacgacaaacattctcttcacaagagttaacttaatatcaaaggaagaagtaattttaaagtagcttttttggggtgtgatttatttaccatttagtgaacatagttgactggacctttaggcaagagtgatatgacaaagatgacgtgtccttaataggagctattaattggtctccgcagtcgttctcaaactggggatgttgctgctccaggagatattcagcaatatctggagacatttttggattcacaactgtgaaagtgctacatagtggttagaagtcacggatgctgccaaacaccctacaatgcaaggagagtatacagtttttcctaacgctatgccctagaagaaatttctcacatggcactatacgcttttagtatcatcactaactccacctatcttttttggacatatagagtccaaaatctcagtagtattgggattgagaatctctggctagtgcatgtatacatatatattggtgtatatgttaatctgaacgtttctgagaaagcaactgtcaggaaagctgcctttagcttggtatctattattattatttttaatagctggcattaactgatcacttactataggccaggtattatggtaaacactttaaattgatcacctaatttaatcatcaaaaccgaataaagtgggtattattgttcgctctgttttagagatggacaaacaggtgtggtgggattaagaaacttgcccaagacctcattgatggtaaatgccagagcagggagttgagcccaggaagtctgactcctcactctttaccaccactgtttgtctaacttctctaactcagatgccaggctctcccttcggctgttccttagctcattagaaattgctttagtgatcttcttttggttataggcatctgttggaagcccgaggggaaagagaggttgacataacgatatggaagtcaacacaaatttggggaaaaaataatttcacattttaaaacatcaacatctagtttatatgagtaatggttttcccacatgattgtgcagttgacaaattaatctgacccaattaaacagaatcaacaaacactgttagtcatatctaattcagctattgttatgttgatgcagaataaaccacagtactacaaacagcagaagcaagctaataggctctgatgcattcagctttcattattttatactttattattttggctttacttttcattactttacacttctgcttttctaagaatccccagtcagtttctgattaaaaaaaaaataggattggatcgaacttttcaccaaatttggtgttttcagaaggcaaagcagtagcccgctgtcatccatacctttacttgcattacaatgtctgaacactcctccactgtaatttgatctagttcccgaaccctataaatctaactgatagagggaaactgaacaccatgtctgcccatgtgatagggtggaattcttctgtccttctcacctgagtacaacaggcttgtgccatccagaagaatgaaaaggtaactcagaatatgtggggtccttatagcccaggtggatatccttatgaagaagaagaagtatgggccccacaaatcgcaggttagtggaaagtgggtgttgttctggtccagtaagtgtctgaaatgacttgctctgacaaatacatgtgtgtgtgcctatagatttggctgtttcgtttttagaaagagtaacttatggcctgatgtagtggctcacacctgtaatcctagcactttgggaggctgaggcaggaggattagttgaacccaggagttcaagaccagcttcggcaacatagcaaaaccctgtcttcatgaaaaaaaaaaaaaaaaattagccaggcatggtagtgtgtgcctgtagtcctagctactcagcaggctgaggtgggagacttgcttgagcccaggagattaaggctgcagtgacccatgattgcaccactgcactccagcctgggcaacagagggagaccctgtttcaaaaaaataaataagagtagcttacctggaattcatatctgtttggctcaccgtgagtggaaaatgcctttgtatgcagggccagtaacggtttctagtgggttaaatgttagggatgttgactttctttttctcccttcctcccttcctcctttcctcccttcctcccttcttttctttctttcttttcttttcttttcttttctttctttctttctctctctctttccttccttccttctttctttctttccttccttccttccttccttccttccttccttccttctttccttccttcttcttctccttccttccttctttcctccctccctcccttccacccttcctcccttccttctttctttcttctatctattatcatctaattgataataagggaggatgacaggtaaaaatattttggggggtaagcatcctttttcctgcttgttatcaaaactgatatatcatctttctctcatacagtttaataagtctcacagaaactttcattaataacttatctgaattcctggagtggtaaatggttgtctggtggggtttctatttgtttgtctctcttgtcctttagaagtcacagagaggttaactatctcaaaaattcatggctggtcaatagtttagatcagtagcatagctttatgttttagaatcttcagaaaggctttcagaggatccaccgttattcatcctgcttccagaaatgttttctgctactgccggcaaaccctgtttgacactagaggtacttatagtccaatctgaatgataaggttgtgataatagcacctacctcttaactgattgcaatgtgctaagctcagtactggctgccttaaattgtaatctctccattcatctgtgtaatatcttatttatttatttattttgagatagagtctcactctgttgcccagcctggagtgcagtggcacaatctcagctcactgcaacctccgcctcccaggttcaagtgattctcctgcctcaacctcccaagtagctgggattacaggcatgtgccaccatgctgggctaatttttgtatttttagtagagatggggtttcgccatgttggccaggctggtcttgaactcctgacctcaggtgatccacctgccactgcttcccaaagtgctgggattacaggcatgaaccaccgcgcccagccagctcttttatttatacccaatatatggatgggaaaagtgtagtttacattaaaataatacaggttggattgagtcacacagctgataagaaagtagcttaattggaatttaaatgcaggtcggcagatatcaagttcttgaccttgtctcaaaaaaaaaaaaaagtaaaaacattattagttttatttaccacaaatggaagatcagggaatctggaggcacaggtttgtgttgtaacactccaaatgcctcagcacaatggtagaaactctccattatttgtgtgtgtgtgtgtgtgtgtgtgtgtgtgtgtgtggttgtttttttgagacaaggtctcactctgtcacccaggctggagtggagtgaggtgatcttggctcactggaaccttggcctcccgggctcaagtgatcctcccacctcagctcctcaagtagctgggactatagccaggccactttacctggctaatttttgtatttttgatagagatagtgttttgccatgttgcccaaactcaaactcctaggctggtctcaaactcctaaactcaagtgatccacccacctcggcttcccaaagtgctgggactacaggtgggagccactgcacctggcatgtttttctggtttgaaaatcccaaacttcttttctttcatactttgctccagccacactggattactcattgtaccccaggtatgcctcacatttttatgtaacaaatttggcaaggatttaatacatccaaggcactgtatatttgggggagtttaaagaagaatagacattgcataatctagtggggatggcatttgtgggctgagatgctgtattgcagacattagtgtgatgagcactcactccccaagagaggtacagataaaactctataggaacacagaagaggaagtgattacatgcgacaaaagcagcatgtgagctggttcttgactaagagaattttagcaggtagagatggtggaaagcacattctaggcattctagacaatcccaaagctatggcatgggaggtgttaacctgtacagggcatgatatgtccagggaagagctacactgtgtggaagaggactggtatcacattgaacatggtcaaagacaggcttgcaaggtggtgggggacagatggccaagggcctcaaatttctgataaggaatgtggattttgttctataggcctagacaccattaaaatccaaagacttgccaaagcctctatccaccctgatctttcttgactcccctaagaatgctcacctcactagcacctgatgtttcctgtacctggaaaaatgtttccccaaatatctgcacagcccgttcctttgtttcctgcaggtctttgccaaaataacactttatcagaaagattcccctgactaccctgtgtaaaatggcacccccttgccctgtatccttaaacccagttttattcttctcatagtccttaccactatctggtatattctttgtttaccattcttccctccctctttctttctccctgacctgaaatataaactccttaaggcaagaattcttttgtatatgttttattcaccgctatatttacaacatcaagaagagggcatggtacaaagaaggtgctcaatatatatttgttcaattaatgaattaattaaagtttgaatttccagcctctgaggccccttagaatacttatatgttagcaaatttttcttatttttaaaggctacatgcaaaagattcatctggattgtttgttaaccaatgaggaatactggtactctccctcagaggtaattatgcaaataatcctcagatcacatgtttaaaacaataaagtgtgtcccttaggactctcagatagctagttatagacaataaaactcaaatgggctcaaaagaaaaggagaatcttgtggttcacaaaataaaaaattccatcatgtaccgcttgacccagtgatgtaaccaaatcctgtttctatccctctctccgctcgatctttcatggctggatttatccttggattccacttggtggcaaaatggcaactacaattctagatgttacatttgctccccacatcatgcatcagaaaagaacagtgcttttgaacttggtctctgacacagagtttgagattcactctctctctctttggctcaaattgtgtgccttcttcattcccacctcagtcattgtgaccagtgtcaggggtggacaatgctgattggccaagccatccagggcccaccactagagcggaggtggatgagtgaggttaatatgaccacaactatgtggtcgaagagcaaatgtttcaaaggaaaatttagggtgctattggaggaagaataggaacttggatcctagggaggcagccaacacaatacctggctttgggtattctctttcaggtagttgacatttgctccccagactggtggtgatggaccacaactgtgtggacccgtttctaatctagttaggtgatatttttgttccccttttttttctgcaggtatttcgaatactcactatgcgccacaaatcccctaccttgtcctactccttcttagcaaatgattttgactctaattcatagagaaaatagaattaaacaagtataccatttctaccacctgaccatccaattcacaaactcatttacatttgtgctcattcgtacctagtccctggtaatcttaagcgttgcaattagcaaactatcctctgtgggcctgccacatttttttgtaagagaaaaatgttatagaaagacagttatactcatttggttaagtattgcctttagcagccaggcgtggtggctcatgctgttctccctcaatctaccagggtgctcaaagatatcagacttaaaacaaaacaattctcttggttcttcgacactctcatgaccctgctctatcttttattttcccttctcatccaagcttctttttgtatatatacatatctttgccatttattttttaaaatcttattcaaaatattaaataatacagtttcagattgaaaaaaattactgcaataaaacaattcagagatatttccattgtgcttcccttccttgttaggaaagtacactgtccaccctagagacaggatggacggccttcttccagctctaccgaaagcacaagcccactggctcacctgggccctgcttaacatatattagggcttatgttttctgaaatgttgtagtgacacttgtaagtcaaccatggttcaaatcacatatttatgtattgatcagttctttattatagaaagatagacacaaatgaaatatagtaaataatttccagttgccataaaaaacaaaaacaaaagaaaacaagcgtggaggaaaaaaggtcattgtacacaaatatactttatgtatacaaacaacttcattcaggtataattttaatttgaaagacctagatacagtattatttaagtgataatggcccataagatttattcaaattcactataaaataataaatggagtaaacaaatgtggtataattttaaactctgcccagtgcttgaaaccttggaggaacccatgctataatcaattgctaattaaaagcaactgtacatgtatttaatattttatcacagtttctacttctaaatttaacatagtaattcaaaccaaaaaaaatagtatctctgtaacgttttatgtatgtccactgcaagctgcagagtctctgttgccaagatttcttgacacatttaatgttttacctaaaattgtggtcagattgagcaatatcgttatcctaaattatgtttaaattatctaaaaatatccaaagcagttttcttggaaggaaaaaaaatattattcaaatgtaaagcattatcacacatatccttgtacattacagtttgggaccacaaaaaaatgtgtggttaaaaaatagtatttgaatggcagagaatgaatgtgagtcagcagtgacagatatgttagaatttagttacaggtttgggatcttttaaaagtagcatcactaatacttccagaagaagcataataaatctaaaacaataaaaactaacagtgtaaatataaggtaatgcttaactcacattttggacacctgattaaactcaactctaaaagtacagatcaaaaaattatatactccttgtttatgacatttaatttccaaagcaccaaggcaaaagagagacccacctctcatttaagtaccaattgcctatggcaaacatctgcacaatatcatataaaaagtcaagcaaataaaattacataataagcaaactcaaatcacagggcaaaaaatataattattggtaatcttcaaagaagacattgcctcattaacattctgatctaggcaatggtattctactgttttggaacaaaggccatcacgccattttctgctttgaactagaagaaaaatcttcctttttttgtgatatgtaatgtagacaatagcaatgcaaaaagcaaaaataataagatgaaaaaagaaatggctatcttcctcttctatatttgaggatggcatcttaaaagatttcactgactgttcaatttccatgtaacccctgttttcttccaaggtgtcatcagactcgtcgtcatccctgtggcccgtggtccagtagtctggttccatagtctgttccatagtctggttctccataattgccactgtccagagtgtctttggctgtggatggagaactgttcagcgtgagaagatcctcctcctctatgctaggatcttcattgttatcagcttcctcttgagacagaggtgtaggtgagggatgaggggccacagatgctcctccacttttctcagtattcattgtgggagggagggtggtactgatttgggaaatagaagatttggtttgtttttcatgtgttaaagcattcacatttggggtagaaatatctgagttgagtacagtttgaatcagtgaatcagtccatgatacaacactggatagagtggcggacacaaggaggagcgccaagaccagcggccgcaccagccccgcaaaggcttggatggccgacttgggcagcagttttgcttgtgcgggccccctcatcctcctcagggcagcagcaaccataacggactcttttttttttttttttttttttaatgtattatcactctgttgcccaggctggagtgcagtagcatgatcctggctcactgcaacctccgcctcctgggttcaagcaattctcctgcctcagcctcccaagtagctggaattacaggtgtgtgcaaccaagcccacctaatttttgtatttttagtagagacatggtttcatcattttggccaggctgctcttgaactcctgacctcaggagatcctcctgccttggcctcccaaagtgctagaattacaggcataagccaccacacccagccccaagcttcttagaagtgttgtttttgtctggatgtagtggttcacacttgtaatcccagcacttatggaggccgaggtgagaggattccttgagcctaggagtttgagaccagcctgggcaacataatgagacttgtctctacaaaaaaaatttaaaaattagttaggtgtggtggtgcatgccagtagtcccggctatttgggagattgatgtgggaggatcacttaagcctgggaggttgaggctgcagcaagctatgattgtgccactgcagtcctgcctgagtgtagtgacagagtgagatcctgtcttggaaaaaaagaaaaaaggaatatgattagcctcatattcctcaccttccagtcacttctcaaaccacttcagtcttcatcatttgctgttagttaactagttaatgaggtcaataagtttaattaattaattaaaccatttcattaactaggtaaaatatgtgtggggtaaccattatgtgccaggtactgttctaggctctgagcagtgacaaaattggcagaaactcttgctgagtggaatttgtaatctagtggcgagaaaatgaacaaaataataagtaaaatatccagtatgttagaaaataacaagtgctgtggagaaaaaccaatcaaggaagggagatagggagtgctcactgcgaacatgacgtttgagcaaagaaggtgagttagtgtgcccttggcagagggaacagcaagggtaagaacccttgtatgggagtgtctggaatgttcaaggaactgcaaggaccaatatcgctggagtcaataggaatatggggcagagtgataggagatggggttggagaagtaacgggggtctatgttacttacagccttacatgccattctaaagattttggcttttggccgggtgcggtggctcatgcctgtaatcccagcactttgggaggctgaggcgggtggatcacctgaagtcaagagttcgagaccagcctggccaaactggtgaaaccccatctctactaaaaatacaaaaaaattatccacgcatggtgctacatgcctgtaatgccaactacttgggaggccgaggcaagagaatcgcttgaacctgggaggcagatgtttcagtgagctgagattgcaccactgcactccagcctgggtgacagagtgagactccgtctcaagaaaacacaacaacagcagattttggcttttgttctgaatgatttcactccaaatgatttgggatatcattaaagagtttttgagccaagaagtgatatgaccttatttagcattctaaagggatccctctggctgctctgagggaagccagctaggagattcttgcaattattcagagatgatggtggcttggatatggcacttgctggagtactgttccagttctgaatatattttgaagatagaggtaacagaggattgctataaattagatgtggtataggacaaagaggggagtcaaggataaatccaaggcttttggcctaagccaccaaaaaggtgaagttgtcatcaactgagatgaggaagattgcataaggaccaagttttagaggaaagatcaggaatttgttttgagacacactaagtttgaaaggtcttttggacatttaagtgaaaatgtctagcatacagttaaatatatgtcaggagatcagtagagaggtcagggttggagataaacatttgcaagtaaacatatagatcacagttaaaagtcatataactacatgacatcacaaagggagtggctgagatagagaagtgtataggctctgagtcctgggtactccaaatttaaaaagcccaaaaaatgaggagagagtctaaaaaagcagcagcccatgagacagaagggaaaccaaaaaccaggatctatgatgtcatgaaagccaattaaggaaagtgatcagaggaggagaaagcaaacaacggttaaatagagccaggtgtggtggcccatgcctgtaatcccggtaccttggaaggctaaggcaagaggatcgtttgagtctaggagtttgagaccagtttgttgtccctgagcaacatagggagaccccatctctacgtctttggtaccagctacctgggaggatgagatgggaggagtggttgagtctgcactgagccatgagtgtgccactgcactccagctttggcaacagagtgagaccctgtttcaattgatcaatcaatcaatgctagtaataggtccagtaagatgaggactaagaattggccattgaatttagcatcttgtggatcactggtgaccttgacaagaacattctggtggaatagtgggtacagagcctgattagagtgtgttaaaaacacaatgagaggagaaggattagaggcagagaagatagaaaaattttgaggagtttttgcatgaaaggcaacagaaaaaccacattctatttgagaaaacgaaagacaattgttctttctgattttgattttctgttatcgttgacactgtatgctcccttccccttggcttccaagacttccacctgccaatatctgcatctttgtgcctaagaacttctgaatcctgcatgcaccaaaggaaatgctcagaaattaacacccctaggagcagccctccaccaatgggtgacaggagttggtggataaatatcacagctcctgtggggatagttcttaggctcgtggttttatatcacaccaagccagtggtagctaggctcaaggacacaccctctattagttgccttcacttccttgccccatttcttcacttcccagatggtttccttgtacatcccaaataaattacttgcacttgaattcttgtttcaaaatctgcttcttggggaagcagatttaaattaatttaaatcttaatttaatttaaattaaattaagacactgtgtatttaggtttaatctaaaacttaataaagctcaaatgcaccatgctacacaataaatactttcagtttataattagcatatttgcagttaaaggccccttcttaaataattttgggcaaatgcaacaaagtctttagaaaatggaaagactcagaaagcttccttttgcaagtaattcctaggcttcttttctttttctacctgtgataaataagaaatatgtgtttgatctttgtccccagttcctgacatggaacttctaaaacccttggaatttcctgaatgataggggcgatagtgttactataggtaggcagacaagagcagggcatgagacctccctacccaccgcccaaccaggaacatcaggtgaccatcagatgatggtcatgcagttgataactttctctctaaataatcattgattgtagccagcgccagggaaaggcagtctctcaatagataggaaacacctgaaactagtgattagctgcttccaggtaagatctcagaagttgggtgggtgggctcaagcatgcactttaagaggcaaaatggtggagtttaagccctcgactgctaagggaaaaatgcttcaaatgagcatgtgcacaatgtcagtaaacactgtgtgcatgcggcccctccctactgctggcaggccattgtgcatgcggacagcccaccccaagggaagaatcaggggagaaggatgcaaccctcagaagcatgtcatcatataagaccccaagccaaacatcaaacagggcatggtgtttgactctctcatgtcgcccacttggccctcttccaaatgtactttactttctttcattcctgcctaaaactttttaataaactttcactcctgctctaaaacttatcttggtccctcactctgccttatgcccccttggtcaaattctttcttctgagaaggcaagaattgagattgctatctacctgtatgaatttgctaccagtaacatgctttgttcccgcaagacttggatatgctccctagtggtaaaaataggagcatcttttgttattcataataagcctcttccaaccatactaaggtaacttttgggggacccctcaatagcttcaggataggggctggttgtcagagcaactaaccttgtgaaactttcagccccacctcaggacttctggggaggagagagagaggagctggagacagagttctatcaccgatgaccagtgatttatcaaccatgcctacatagtggaactgccataaaaacccctaaatgacaaagtttgaagagcttctgagttggtgaacacatgaagatgctgagagggtggtgtgcacacagggcatggaagctttgtgccccttcctccatacctttccctatgcctcttccatttggctattcctgatttgagttcttcataataaattggtaattgtaagtaaaatactttcctgagtttggtggccattctagcaaattactgaatctgaggaaggggttgtggaaaactctgacttatgggtgataggtaatggtgatgaaaagagtaaaattctggaaaatatttgaagagatttattctgagccaaatctgaggaccaggacccatgccatagccccagggaggtcctgagaacacgtgcctgaggtggtcagactatagcttggttttatatgttttagggagatgtaaaacttcaatcaatacatgtaagatgtacattggtttggtctggaaacgcggggcaacttgtagggagagggatgtcctaggtcataggcagattcaaagattgcctgattggcaattggtcgaaaaagttaagttattatctaaagacttggaatcaggatgggcgcagtgactcatgcctgtaatcccagcactttggaaagccgaggtgggcggatcacctgagattgggacgagaccatcctgaccaacatggagaagccccatctctactaagaatacaaaattagctgggtgtggtggcacatgactgtaatcctagctactggggagactgaggcaggagaatcacttcaacccgggaggcggaggttgcggtgagccaagatcgcgccattgcactccagcctgggcaacaagaatgacactccacctcaaaaaaaaaaaaaaaaaaaaaaaaggacctggaatcaatagaaaggaatgaaagagtgtctgggttaagataagggcttgtggagaacaaggtttttgtcatgtagaggaagcctccaggtagcaggcttcagagagattagattgtaaatgttttttttatcagacttaaaaaaggtgccagactcttagttaattctctcctggatcagggaaaagacctggaaagggggagaggattctctacagaaagtagattttccccacaatagacagctttgcagggccatttcaaaatatgtcaaagaaatatatctgggggtaaaatactttgattcctttcaaggttagctatctgtcatgttggtatcttattgctacaagagtctattcggtcaatctttaggtctctgtttcaatgttaatactggtcagttgtacctgaattctaaagggaggagggtataatgaggcatgtttggacccctcctttgccatcacagcctgatctagtttttcaggttaactatggaatgactttgggtgagaggaggggtccattcagtttgttggggggcttagaattttacttttggtaacctgggaacttgcaactggcatctgaagtgacacagtcttgtggtactgaagttttaacttgtgagatctgatgctaactccatgtaaatagtgtcaggtaactccaggtaacttctgtgctcacgccaactgggtgtcctacaattaagttgaactgtaggaaacccaattgatgtgggcagagaattggagaattgtttggtatggaaaattcctacacatttgatgttggaaatgtgagtagaaacagtagagaactaccaaaaactaaattatttttaaaagcacattttttctggcattttgatggcattagcacactatgagcattgctgaatatgaggatgagagcgaaagtctgatttcatgccaggtatgttaaattttgcatctgtaatctctaatcaaataaagtctaggaaattattaattacacagtaatgcttagggctcataagtgattttcttttaaaaatactttatgaatgctaattatgcaacctaggatctgtaaggtagacagattattttatggtcagagtagttatttaacttctcttgagagactgatttctcccaatacaacacactcaattactattaaaatatgaaacttctttataagtagataaggattactgaatattccctctttaatgtagctaaagatatacttccctttttctactcctatagaacctaaaaatgttacactgtacttccaaaattacttgagaggctgagaatggtggctcaagcctgtaatcccagcactgtccaggtgggaggattgcttgagcccaggagtttgagaccagtctgggtaagaacagccagggcaacatagcaagacgctgtgtctacaaaaaattaaaaaaaaaaatcagctgggtgcagtggcatgtgcctgtagttccaggtacttggggggctgaggtgggaggatcacttgatcccaggaggtggaggttgcaatgagccgagactgcgccacagcactccaacctgggtgacagagcaagactccatctcaagaaaataaaaataaaaataaataaataaaaattacttgagagacagcccattaaacttgcagagaatcttgcaccaggagttaggtcttgatattttatcacctctgtgtctcagtgtgtcagttttggtgtcttttgagaaaagaaagctcgtttggagctgctgcttatcattttcttttaagaatacctctttcttgtccttgcgatagtttgctgagaatgatggtttccagcttcatctatgtccctaaaaaggacatgaactcatcattttttatggctgcatagtattccgtggtgtatatgtgccacattttcttaatccagtctatcattgttggacatttggcttggttccaagtctttgctattgtgaatagtgctgcaataaacatacgtgtgcatgtgtcaaacaaaacactgcatgttctcactcataggtgggaattgaacaatgagaacacatggacacaggaaggggaacgtcacacaccggggcctgttgttgggtggggagagaggggagggatagcattaggagatatacctaatgttaaatgacgagttaatgggagcagcacaccaacatggcacatgtatacatatgtaactaacctgcacgttgtgcacatgtaccctaaaacttaaagtataataataaaaaaaagaatacctctttctttatccacatcaaaaatacctttttctttacctacattttaagatgttgatattctccatggctaattctagttttcttcatctctcatttcatactctcttccttggagaaaatttttattcggaagagatagacacaatgtttactaggttctgaatactgacctaaacacttcacaaacaaactggtttcatttttatggtgttatgaggtagatactcttattatcctcattttatagactaggaaaatgaggcacagagaggttagtcatttgtccaagttctcataagcagtaagtggagggatcaggacttggactcagtctgtctctagaggacatgctcttcatcacctcactatgcttatcttgtcttttccgcaatgtagattgagcctaacctttggagaatctgaaacttgtcagtcaagcccatctgcctctcctgagcatgaaatctatacattaaagtgcttaacatgtattttcatctcattgtccagcagatacttcaaattctagatagtacaactgagttcatttttcctcccatgaatagcctgcacttctgttttagaaaatggcatcaccagccggtcagtgaaagagttacaattctaggagttatctttggctcttcatttccccctcaacttttacctacatctgttttgcctatcctgtcaattgtatttcctacagatgtcttgaatttggccttctatgcctattgtcatctacccttatcatttttttcctgaatgaccaagtagcaggggttccagtttgtgcataaaccatgcccaccattgtaattcatacatagttggttacaactgatgaactggcaaagaagcccctctgttttagtctattttgtgttgctatagtagaatacttggctctgggtaatttataaagaacagagatttatttcttatagtcctgaaggctgggaagtccaagggcaagggtctccttgctgcatcatcccatggtgaaaagtagaaggagaaagacagcatgacagagagagagaaagaactaactcatcttttcatcaagaactgtagtcgtccgtcctcacactgctgtaaagactggataatttatgaagaaacgaggtttaattgactcacagttccacaggcttaacaggaataatgactgggaggcctcaggaaacttacaatcatggtggaaaggagaggaagcaagtacgttcttcacatgacagcatgtgtgtctgggttcacaaggccccagcattcagagttggggatgtgtaaggcaaggcaggagaggcagctagacttggcaatgacttcatatcacagaccaaccataggcagtggacacctaggtaactcttcaaccttcttgaaattatgaagggaagaactgactaaaataaataacccctccccactgacctttaaaggacctaacagtggaagaattccaactggaccacagttcttgagacctacctgcagatcaaaacacaaatgaaagttttgcagctcttcactattgcagaggttcaggggaagggatgatgtttgccaagcagataaaattagaagaattcaggatacaatatgaaggcagagaggcaagtcatgtggattgactggatgtggcggttagattaaaggtgactttttttgttttttgagatggaatctcgctctgtcacccaggctggagtgtactggtgtgatctcagctcgctgcaacctctgcctcctagattcaaatgactcttctgctttagcctccaagtatctgggattacaagcacgcaccaccatgcctggctaatttgtgtacttttaatagagacgggtttcgccatgttggccaggctggtctcgaactcctgacctccagtgatccacccagctcagcctcccaaagtgctgggattataggcgtgagccactgtgcccggccaaaggtgacttttaacttggagttggcttaagcaattggatgaatgatggtagtatgtactgacctggctaagtctggaggaggaagaggtttagggacagaaatcaaagttctgaccaggaacagttaaagtgataggaaagaattagcttggaaaatcagcggtcttcttgtcaaattttatgtgtgtgtgtgtcttcctgccagcaagcgggtaatatttggttaatgatgctccatgaactaaagtcactttcagagaaatgctttaaatggcagtgatgagctaaagtccatcaggaaaacctgactaagcaaactgtcccagagcaccaggaaaggcaccatgatacatagacagatagagcttgttagataagaattatatctccacactggtgaatggtttttcacttaagaggagatgagcaaggctgggattggctgcccctgtggggacccagggcacatgtcatgtagtgctggtctgattttttttctttttattccatataccttaaggaccattaacttgccctctacaatgtaaaataatcaaatcattcacattaatttattatttctaaaagtttttaaagaaggtttttagaaatcaagttcttacatatgccaaattacttttgttagttaattataatatatttttaaagtgtaattctttttctttttttttttctttcgagacggagtttcactcttgttgcccaggctggagtgcaatggcgcagtcttggctcactgcaacctctgcctcctgggttcaagtgattctcctgcctcagcctccctagtagctgggattacaggtgcctgtcatcacgcccggctaatttttgtatttttagtagggacagtgtttcgccattttggccaggctggtctccaactcctgacatcaggtgatccacctgccttggcctcccaaagtgctgggattacaggcatgagccaccatgcccggcctaaagtgtaattcttatatattctattttttacatttgcttagggtccttttactcaaaatagttacaatttagaagttatctatattatcttatctacatttatcaccaacacaggcaaattaaatttcaggaatctaagacaattcttcccattaagtacttaatcatgttctgcaaaaaccaggcaagttgtattttgtctttttaatggtgagaggtaaaaagaaagaatgaaacatgctattgtgggcgtttgtctacattcccattataattctgattttggggggattcatggagtaaagtccaatctatttacaattagttaaacaattttgcagactctttctgtcaatttttaaaatcccagcctggggattttaggcttttcctcattaatgtacagttgacccttgaacaacattgatttgaactgcacaggttcacttgcacatgtattattttcagtaaatataggaaaatctttggagatttgtgataatttggaaaaatcttgcttttcctctcgcctactttatcataagaatacaacatatatataacatatagcatacaaaatctgtgttaatcacctgtttatgttatggacaaggcttctggtaaaaagtaggctgttaacttttagttgtatgtggatatgcaactgtgctcccaacccctgtgttgtttaagggtcaactgtatttcattttggtgccccattgccctctggataaagtccaaatttttggactaacttaccaagatctttcttcctcttctcttttatactctgggctggagccaaatggagctgcttcaaatcctgaactggcctttctctctactgtttcctggcctatgtatagactgttccctccgcctggggttctcttgtgtgtcttcctccttccacgtaccctcccgccttgctctctctactatttggctacctccccctagctaactcctattcaaccttcaagtctatacaaggattctgcagggaaccctttcctcatgcctcaggtctgatgcagcccacacagccctctgctctgtgcttacttcagcctagcatgtatcttgcttatggaacctgattgctcatccataaccctttctagaatgtaacttccttaagaatagaactctgccttattctcagttgcaatcctagcacctagcacagagccagacaaatagtagatagtaaatttttactgaatgaatgaatacacaaatataaagaaaatgtatatttgatattatggaaataaaacataggtatgaagagaaatattttacctaaaatacatatattttagggtaagtagacattatttttgtgtgttacattattcatatcactgttatcctacattaagaaatacaggtatattactttagatatcatttgaagaaaacatagactccatgtaggaaggcttggtatgtggaagatatgaagtgtgattttttttctcccatgggaatcaatacaattattgatgttaataacaacaagaacaaccattaataatatgttcaatacatatgtagtatttttggttggaaaaatggaaaccaaaggtctcctgtttattgaaattataattttcttctagagtttctacacaggactaggcatcagaaaacatatgttccaaaagtgtgtcaagggtcaccatggaaaccacagggcacaacatttgtgtcccaggcttctggaacactaaggaccgaaagaacgtgagtgagagcaggggaatttaggaatccattgaggatgcctgaatggggttgttggccctgatcacactctagagacaggcatatcatcacaggcaatcagaaatgaagaaggacattaacttgtaccctgtggaattgtcttcagttgataaaaaggacttctctgtgagtgtatattttaattatgctgttagctaggagtcaattaaattacaatacctagatccaaatagtcgtattcatttgagacttgtgaaaattagattttggaaacaagttagtagttcttaatctatgcttaatattaataatatttgtatttattaatataaatgctaggctgtatttgtacagcatcacatttgtacacagtgtctagcatctcagcatgacactctcatttaattttactgttattcttgtgagttagaaattattataatttctatttaatatcagaagaaacagagtccaaaataatgcatacagttggtgggagagagatacctgaaaaccaggcttctgattacaaatccagcattttttccactactccaggctacaaagtaactgatttatgaatccagatgattcacatgagttcatctcctcacattttaattactcatttatttatacattctccaaatacatactgagcatgtattttgtgtgtttcctcatttataaaatggaaataataatatacctacctgataggcaaccaatgtaagaactgagatgtaaattgctgtgcttggttttaaatgaaaccgaactattaactactattattttcctgctagaaatatgtagagtagaaacattattaaatgtgcacatggaagtgaacattcaaaactttagattacggctgggggtggtggctcacgcctgtaatcccagcacttagggaggccgaggtgggcagatcatgaggtcaggagttagagaccagcctggccaacatagtgaaaccctgtctctactaaaaatacaaaaattcactgggtgtgggggtgggcacctgtaatcccagctactcaggaggctgaggcaggagaattgcttgagcccaggaggcagaggttgcagtgagctgagattgtgccactgtacttccagcctgggtgacagagcaagactccatctcaaaaacaaaacaaaacaaaacaaaacaaaaaaaacctttagattacaatgtgtagctcactaatatttctcagcatggctatggtggtgatggctggagaagagtggtgtggggaatattatctatttttggagtaaaaatgttcacttattttttctgtaaaaagagtatgaatggcgtgggtgcggtggctcccacctgcaatctcagcactttgggaggtcgaggcaggagaaactggctctagcccagaacctcaagaccagcctgggcatcatagtgggaccctgtctctacaaaaaattaaacaattagccaaatgcagtggctcatgtctgtagtctcagctactctggagcctgagatgggggaatcattcaagcttaggaggttgaggttgcagtgacctgtgatagtgtcactacactccagcttgggtgacacagcgagactctgtctcaaaaaaaaaaaaaaaaaagtagtaatgacaaataaatatagatggataaattctgtaaaatttaaaaaatgtattgagttgttaacttgtttgttaagtatagcaaactggacaataaattgactactctgaagtatattgacctcatggaactttcttttaccttctaaaactgcaccattctttattgactgcattagtcaagaaggagatgaatattgaattgacttgttttacttaatgttcactataccagtatttcttaaactgtattttgtagaatgctggtataccattccattaataaatcacagggttagaaacaattgaaatttttatagaagccacacaaaaacaatagcaatggcagataatgcaacatcttatattgtttcattcggagattatttcaatatttcctctaaatatcttgaagaaaatagttctagatattatgcatacattattattgacactttatggctaatgtgtaataatctataagttaaacaatgtaatttaagctcactagggaaaaattaagaaaaggttgttgatactacagcaaataatgaatactggtcttatttccaccagctatgtgagtttgggaaatcagttacctccttctctttttttctcttttattttgccatataaccttttataaaggaactattgtgtagaagccttgagtgctcatccactgccttccactcctacccccatattgggcctgtgctaaatcccttgagtttgatggagtctgtttgaaaactggaactagctgatctcccaggtcccttctggtttttacttctttgattctggtttggaattcttaaacaggcattggtgatttgtctgatacagaatgtggctgggttaggctaaggtcttatcatttgcgggcagacttctggaacagaaccgtttatgagtcatgctatctatttttggtattctggttctactgtaataacttttttattacatgtattttactaaaagctgcttaaaattatttttgggatcaaaaattgtcaaaatatgtatatgaataaataattcaaattaccttgaatttcaaattactcagtggcacaggtttttactacgtttcatacttaatctgaaaattaatttacagaaagaattcaaagtatgtattctatattttctttacgttctttggtaactttgtatcactactgaacaaacaactaaaagagtatgttctaatgatacattctaataagaaatgatgataattttaaaataatacaatatgtaaaccacacagctgtcaggcctttgacaatcttgagctcatttttccttgccctcttccagcaagaaagaatattttccgccaggtgcagtggttcatgcctgtaatcccagcactttgggagggcgaggtgggcggatcacgaggtcaagagatcgagaccatcctggccaatatggcaaaaccccgtctctactaaaaatacaaaaattagttgggcatggtggtgcacgcctgtagtcccagctacttgggaggctgaggcaggcaaattgcttgaacccgggaggcagaggttgcagtgagccaagattgtgccactgcactccagcctgggcaacagagcaagactccatttcaaaaaaaaaaaaaaaaaaaagaatattttccttttcttgaagctaaatgataaaatttaattcttttgtttttcatttcttttgctcacatctgaatcttccatccattcttttttctttcagaactgcttacaccagtttaaatgataaaatttaattcttttatgtttttcatttcttttgctctcatctgaatcttccatccattcttttttctttttttagaactggccacaccagtttatcactagtctgcatccagttctgggacccacttagtaagcaattggacaaatgggcagagactggactggaaagtgaggggcttgaagccatgtaatataagacaatgtagaagaaaatggagatatttatctggggaagactaaggagaaatggaaggtgttcaaggaaactgcctttgcatttttgaagagctgtcatgagtaagggtgatcataggtcctgcagcctccaggcagaattagaactagtggcttttgacataatttagagctgcctccagcagtgagttttctagaactgcaggtgcacaagcacgggttgcagggtagttgaagcagttttcaagcaatggttgaggagttagatttaaattttgtcattttcagggcgagtgcagtggctcatatctgtaattccagcactttgggatcctgaggcgggcggattacttgaggtcagcagtttgagaccagcctggccaacatagtgaaatcctgtctctaccaaaaatatgaaaattaaccggcgtggtggcgcacatgcctgtagtcccagctactctggaggctgtggcagtagaatcgcttgaacccgggaggtggaggttgcaatgagcccagatggtgccactgcactccagcctgggctacagagcaagactccgtctagagaaaaaaaaaaaaggcgttgttttcaaactcgacactttttacacttacctgctgaatttctgtgtgtaatattaccttccttttgtgcagttgagcgatatgtaaactctcttagtatttcctttatatgtgaaacgcctttattgtttcttaaaagtccattccttaagtttatatcaagtttcgtggttggaaaattttcttccattatcttcccttgtagactgtaaaagtatgcctttattatgaaactacaaccaacaggaactttgacctcaggataactgagagaataaagtgtttttatgatctcattagaaccttggtatgtattatacgtgtgctgtgtgtgcattatctagttcatatttttcttgtagaattttctataccatttagaatggcttagagagatttgattatactgacacttccttccatgcaattttgttgttgtttgtttgagacagggtctcactctgtcacccagagacactgcactgctggagtgcagtggcataatcacgtaatcacagctcactgaaacctctgcctcccggttcaagccattctcccgcctcggcctcatgagtagctgggattgcaggtgcccgccaccacatctggctaatttttttttgagacggggtctttctctgtcgcccaggctggagtgccgtggcactatctcggctcactgcaacctcccgagtagctgggattacaggcgtgtgccaccacacccggctaagttttgtatttttttttttttgaaacatagttttgctcgtcacccaggctgtagcacaatgatgcgatcttggctcactgcaacctccgcctcccaggttcaagccattcttctgcctcagcctccctagtagctgggattacaggtgtgtgccaccattcctggctaatttttttgtattattagtagagttgggggtttcaccatgttggccaggctggtctcgaactcctgccctcaggtgatccacctgcctcggcctccccaagtgctgggattacaggcatgagccaccgcgcccagacaagttttgtatttttttaagtagaggcaaggtttcgccatgttggccaggatggt

SEQ ID NO: 415 - DNA, 20001 bp, Homo sapiens
tataacacttccctccacacccccagtggattcttcactcatcagaaagaaatgtcattaaacctaagccaatggataagctgaatagattacgtatttgtttccaaatgactagaaagaacaggttatgaaaaaggcaattatttcaaatgaacattaggaaaccatggggaactgtataaatgtgtgcctggggtcacagtctctggggtagagttaactgtgtggcatgatcccaagagcctcaccaatgaaaataacaatcagagataagacaaggctaataatgaggcagaagccctcactcctgtctgggatttggttagagagtgcagccctgttcttgccaggaccctcactcggcaccagctccatcaaggagtggatgttttctcccccactggccttcagagaccttcataccccgcaaatgatgttggctgctgttgccaaagtcctcaaaacctccctacatgggagatggaagaatttctcctgtgcagagatggctgtccccgggcatgaacacttccatctcctgagatctaccctgagtgtcctgatgacctggagggagatctggcctctgaccatcacacccatgtaaccactctgctctctgcccaccccttctttcccctggaccttctggtcagggaatgtgtagaggaaaggagggaagtccactgtccccattccctgtagggtggggagatgcaggagagcccatttattagaatctaaccatgcaaagaacgtccccactcccacccagaaaaaatgtctactactaattgattggcttgggtgtccctatccttggggctttgaaataggttttatcccttttggaaagctgtccccaccaaaggacaaaatctgctcctctaacaaatttatttgcaggcttctgaataatctctgggggccctgggcatctgctctacgtgtttacatctggctgtgtgctccctggcatatttcattcagttaacagttatttagtgcctactatgtacaaggcaatgaggctaagcacttgatatgcattatctcaattcccagaacaactctttgtggtgggtataatcaatgtattcactttatagatgagaaaagcaaggcttagaggatcaaaggaacttaagacccaaggctcgtaaatactggagcaaaaattcatactcaggtcagtctggccccatatcacttgttctatacttccaatacaatctttaaaaagaaaacagctttgattggacataatttacataccatatatttccccatttaaagtgtacatttcaatactttttaatgtattcacaaatttgtgctgccatcaaaagagtccattttaggacattttcattacctcaaaaaaagtttgtatccttcggccatccacccattttctcctattccacagccctgcgtaaccactaatctaatttctctccctatagtgtttcctattctggactttcctcagccctgggtaaccactaatctaatttctctctctatagtgtttcctattctggactttcataggagtcgaatcaaatagatgtggtcttctgtgactggttgctttaattcagcacaacatttcaaggttcatcagtgttgtgttatagttcagttctaatatcccattatatggatatacaatattttatttatgtattcactcatccattgtttgtttccaccatttggctattatgaacaatgctgctataaacactcatgtgcaagtttctgtgtgaacatgtgttttcatttctcttgggtatatgcctagaagtggaacgaactgctggattatatggtagaattctatgttcaatcatatgagaaactgacagactgccttctaacacagctgcacttcgccatcaatgtatgagggcttcaatttctccacatctttgccagcacttgtcattatgaactttttgattctagctaccctgatggatgtgaagtggtatctcaaggttttggtttgcattttcctgatgactaatgctgccaagcatcttttcatgtgtgtactggccatttgtatatcttctttggggaaatgcctattagatcatttgcctatttgtaaattaggttatttgtctttttattgttcagttgtgagagtttttcatatattctggataaaaataccttatcacatatacaaatgcaaatattttctcccatctgtggattatgtttccatttccttttaaaaaactatgtccatgttttattgtattgttacattctctacctttaaaaaaatagtttgaaccgaaaggtcttgaaggcttaagatggggaccctggtagggactgaccacaggtgccagaaaaggatttgctcagaatcttcttagaaatcttccgtttttcacaattccaggatggggtaaaaggtgatagtttcactccgcattcccagatgggctcatctgatgatgagaaaacagcccttcatggagcatatgtatgcagagagaaccccatgttaaaaataactgacacacataatctttaattacaaacgataaatgcttgagaagcaaaacactgcagatcagatgtagtatgaaggagctgggaactgggaggaaatggacgtgacattccaggcagagggagtggtgtgtgagaaggtctgagataggagggagcaagtgtgattcaggggctgatggcttctattgaggtccagtttacatccagtacaattcatcagtttaaagtatattaacaaagtttccttgtgtttcttagagaaaaattttaacttttctacaactgcatattagattcacgtactgtttttcttcttacatgggaatgggggacagtctggcctggtctgtcatttttctgatgatatcatgagtcaaaccatgtctcccctttctatttgcatcttccccctggaacttaagttgagagagacacatgttgatgttgatgttctctgcttagctactgtgtagacacagatgggttgagaggctggactgtgggtagctatattctgaaagcttagtttctgcggtctttctctgaatttgttggaaacatttgcacttcacgtcaatgtccagggcttatgcagtgttttccagtgatggtagtaccccattgatgtacatgtctgtgagtgtgcatgtgtattttaatttctgaaagacctaccgccttggtaaccagtattatttgtgttactatttctgggagcagagcctaaagaaaacagcaagggctgggtgcagtggctcacgcctgtaatcccagcactttgggaggctgaggtgggcagatcacaaggtcaggagttctagaccagcctggccagcatggtgaaaccctgtctctactaaaaaaacaaaaattaaccaggcatggtggtgcgcatctgtaatcccagctactcaggaggctgaggcaggagaatcacttgaatccaggaggcgaaggttgtagtgagccgagatcatgtcactgcattccagcctgggtgatagagcgaggctctgtcagaaagaaagaaagaaagaaagagagaaagagagaaaggaagaaaggaaggaaacagcatgctcattgcaaacccttctggggtaaggatgaagagctttgcagaaactacaaagtttgtttcctgaaacaaaaggcagagcagggtatcttggctgttatagggctgagatttgggttcacttggaattgagccattcttcactcttgagatgcttacttaatgcagatcagctcccactgtagatgttagagagacctgtaattacaatggaatatttggaaatttttctaacagatgcctagccacatcctcacatttcttggtgtgtgcagcaccactgtgggaaagagctggtagcttgagtgaattaatgggactcttctccttatatgttaatttgcagaggctagggagggatggaacccacacatggattcccagcttcccagttgtgctcccaggatatgatgctgttctgcttaagactcctttcagagctcacgcctgaaggtccagacctgtgatggctgagctgagctgagcagggcagggcagggagggtaatccacgtatttggcctcatagttgagatcctgtgtcagcagctgatggttctggggtatgttgcctctgatgacaaagctggtggaggcaggtgtgttggggccttaagactacaggggcctccagggcaggggtgaagcagctgcaccacttgacccaagttgcacctggtggcggtgtcaggaaggatggagcagacctggtagtttctgctccccaaggtctggctagctctcattcactgaaggacacaaagaaaatattaatagctactacaatagtttgtgtttatatataactcctttagggaaatatttcaaaggtaattaacattacaatgaatcaatacagcaagggattgtggaaaatggggtataagtgaattgaattattggagttgtattattcaatgtattgccatattaaaaggatgggttgatgatttttaaaatagctaatttttaagtaggagttttaaaaattactcaaatgatgatccatcatgtgtacagtaaatagacttaagtacatgaccagtagaccaaaaagatgtgaatgcacattagtgatgttaaaaagtccaaattacccatttagttccagtaaaataacattacctagtacattatattaacttgaattttattgctttgtttctatttctatacttttaattttatagttttgagaatacgttatatagattttgtgtttgtatgcctttgagtaatgtgataataaaacaatttaagtcaaaattgggcttcaaagggcatgatgtttcacttttaacaggggactcattctcagccctcacgctagtgtcagccacgcatagtgtcagtgacacctagtggttcaagcaagaactgcaacttcattgaatggtggacgatttcaaagaaaaacaggttctcccttagataagcctctggatccctttgatgaggtgttgaaatgagggcctaccagtccctggtgtctcccattttggcctgttccacactgactcgtcagctatttgaagcaactttatggaggagggaatgacacttcgtatactaggaacagaatgtagaaactaatgatgacttttagagtgagaaagttttcaggaagacatttctaacaattagagtggttcaacaatgtacaccacaaaagccactaagccatgactttaggatcacttggcagcctgctgggctcattcactagctaagccatctacatcacaccaacctcacagaacacacaattcaatttttttatatttgtaaatttatgaattgctacgtgctacagaacttcaggcaatttatgaatggtcaaatccactgattacagaattctaaaggtcatcatggtctttacaatgctctgtcctcagcagcctgtgcctgacccattcccattaccatgcctgctttcccacccaagttcaaggccatcctgaaaaagttgcttgcagcatcatagaggcaccaacacctctgcattctcataattgtctttctgaatcctgggattggggacagggagaggaagaggggagaagtgaaaataaaccgagcttgcagcaccttcagcactaatcatgaggtctgctgctctctaactgcttccccacagttgtttggtgcctatggcctcagaatcatgtagatcctcttataagattatagttcctatcaactgttctataaataacaacttgaaatgttatgttttccctttgagatatcccttcaggtcttgcatactgatgaaactactgactcagtgggtctgaatgatcccaggagctgctgaataatcaaaatatgcagtttccaaatgctgattatttctccccccttaccccaaccaatcaacaccaccaattttctggcctctcaccctccactatatccttaaaaaccccagcccagaacttctcagggagatggatttgaggatcttcttctatctcctcactcagtgccctgtgatcattaaacgctttctctgctgcaaaccctgctgacttagtgtaggtactattaatatattcatatttccattttagaaagatgtgaaactacttttcataagttgtccaggcacacccagttagaaagtgacagaactgggcatctgtctgcagagcctgcacactcaacttctgttcttagagtgtgtctctagatggtggtcacagttatgacccacaaacttgtcatcattcctaggccacacaaaacccttccaatctttgtaggatattagacccacctgtgtctccagacagaccatccctgtcttcaaatggaatgcctggaatttcattcaattatgctctgcagtgttgccagaggttccccagattggctcaaaagtcagcacactctcaggcaaaaaggttgcagtgtcacttgattccaaggaaactcttgtcaagtttaggcaggtcacacatgggcaagaaatcaaacatgaagaggatggtcaggttccccagcacaacatgcccagggagagagcacctgccacaaacagctcaggtccaggggaatcatagctgagaatcaaaatgcagaaatcatttgcatctgatctttcccaattctggaaagcctggaatccagagccatcatgatccccttaatttattaggctgcctccttcatttaatgagaattgtcttgttaaccccattctcaggtctgtagaaccatgacagttgttgttttcaaatatcttctttgaatacaggttcttcttatctcaggatcaccataaatctcctctttgtaaacaggactttggtcacagtcatacttggaatgaatatctcataacctcttaactgcattttgcccatgaccttgctaattttatcacatttgtttgaaacaactttatattgccatcgctcttcttcctggcctctgtggatttttcctgaagtcatcatagttgaagggcttcacccttgtgagggtgtttgtgtgtgctatgcctatgttatcattgagtttgctctgtaaatctatggctcaaactcctatgtctccaactgcacatattgtgacacattaagtacaaggccacctttgactccttcatcatcacaaaggtgcaattctttccctatctgtttgcaatctggagcacatctgttcttttctctagggcaatgactctcaaactccaggatgcatcagaatcacctggaaggcctgctgaaccacagattgctgggccccacccatagaaaaaaaataacagagacgggggtgggaggggataggacgagaggggagaaaaaaaaagaaacaactagagttatcacatgtcatagggtcagtggtgaaatatgtacttattgtctgtcagtggcaaaagctttcaggacttctgtcacttcactgctaacagttcctccagcctctgcttggttaattccagagaaggagaaaccctctgcttcccaggatggcaccttcagccttggggagctgaaacaagtcacatgccatgtgggggcaggagtgacaaccaggaagtcagagttacctctgacgacaactccttctcttatgtcccttggttgtgaacctcttttcctaccatagtctctggcagccactgatgtgtttgctgtccccatagttttgtcttgtaagagtgtcgtcaaaatgtaatcatgcagtttgcaggtttttttgagaacagcttcttttgcttggcataatgcatttgagagtcatctatgtgagacagccaggtgggagggggctcctcagaaaaactccaaccagcctgcgcactagggtggagccacagaagtttgtgctctttccagtggggaggagtcaggcccctcctcttcctttgtggaacctgggatgtgaagggtgggaaggaaatgctccagcagggactctggccttccaagagttcttctttgccccttttctttctttttacccaatgcaaccctgtcttactcaccatttaaattgtctgcaagcctgaattttcatggccatgggacaaagaacgctgtttttagctgaactaaggaaaagttatgcaacatttttggcgcacaacgttgggccagaaaagcagtgagtgaaatggggactcgaaacctctcaatgttgctcctaagccttttcatccttggacttctgagggtgggggaaaacatgcccccaacccccttagctcctgggacttttcatggcatttcccttcctttttcaggacctactggcgagcagcagctccctgctgctctcccctccctgccggggctgggatgcatggcccaagggtcccgcacggccagttggctggcattttctaccataagccgctggagacttccccttctctgtccaagcggttcagctccattggacagtaattaagcttttctcttcgtggggaaaccacttgcttaagaataagaggttcctcccaagatttttaaactattctctctttttccctcttctctaccctatcagcagttaagttttaagcaagttttttttttgttttttgttttgttttgttttgttttagaagacgttttactaggctaagtcctccaactatcactatcactgtttgtactctccataaagttttggttgtgaaaaagaatctcatggagactggattttcttctgcctgtgtgtgtattgtgtgtcatgtctgtaaaaagagctctaattaatttgtcctaaagaaagacaagtgcttgaatcaagtatttttttaagggaagttaaaagttgtggtacctttcagttcatgtgactttaatctttgagaaataaaagcagccttaaagattattggtaaaatgcttgtgtcattaaaatgtaaataggtgaactaaattatgcaggtcagatgcaaggtttgctaagtgttttgaggttacaaactgctctttggattttgagaactgtctgtccttcctgctttacaactggtagggcctagggacatatggaactaaccatgcccttaatttagaaggcaaaccttggctgcagttagcacacaattaaagcaatttaccaagttttaccttaaagttaaaaatgtctaggagttaattgaaactactagaaatagatttacatgcaaggtgtgtaagaacagtaaaatttgttttttagtaaaaggttataagaaggcatggaaatgtaaacttttgcctaggattaaaggattgttttgagttagatatgaaaagctgaaagttcatagaagtggtggaagaattgtggaaattaatcttgcagaagagttctctgtgtgaacatactaattaaattcaaaggggttataaaaagtttctgcttctttaaatttctaagtcatcattttggcaaaaagtttatggtaatctagaactttattcaagtgttttaaacacatttaacagccttcccaaaatcaaacttaagtttcaaaattgtctttcctgacacctaacttttcagatgcttcagagggcccctgaagtgtccagaaaagacaggtaaacaggattatttgacatgtttaggtacatggggttgccaaaatgatgttcaattttctttaggttatatcttggagaataatgctaatatatgttccaaaattgtgtggaatttctaaaattctaatttctgaattctgagtatatgctatcaaacataattaaggttttttatattaagttattgtgaaccacggagataaccaaacctctttgtcaattatgtttctaactataactgccctggacattttgctattcacagataattgttgttttgttttaatcctttaaaagatggcttataatgaactatagaattttaacgggtactctcaaatacaggcttctgataactttagagattataatactggaataaaggaaaacgtacaggattcatgaagagctgaaatgttcatgaatgtcaagcaaaacaagagttaactaaatggactgaacttggaaagctgaagcaacctttttgacttttgcttagaatattgctggtccttgttttgtttttcagagtcaaggaaacttattttgaaatagttatagcctttagtaattaagtaaggtgtgtcgatgaaaagagtcgaactctgtaaaatattttaagagatttattctgagccaaatatgagtaaccatggcctgtaacacagccctcaggaggtcctaagaacatgtgcctaaggtggttggggtacagcctggttttatatattttagggaggcatgagacatcaatgaaatacatttaagaaatacattggtttggttcagaaaggcaggacaactcaaagcaggggcttccaggctataggtaaatttaaatattttctggttgacaattggttgagtttatctgaagacctgggattaatgaaaaggaatgttcaggtaaaggtaaaggattgtggagaccaagttttattgtgcagaggaaactctcagatagcagactttagagataacaggttgtaaaatgtttcttattggacttaaaagggtgcctggctcttagttgattatctcctgggtctgggaagcaaggaaaacaaagaggaaaggggattttctatagaatgtggatttttcccataagagactctgcaggtcaatttcaaggtatggcaagaaaatatactttggggttaaacatttcgattttcttccttgttatgccagagtcagattggaaagtaagtcatgatatacagggttaaaataaagcccatctgatgagaatttatagtttgtagggcatgactcattagaccctttgggtaggaatttgggcaagataaagaatcagagcttagtcctcaggtatatacatgtttgtttctctctgcctggttcctctagactttggaaactatctgtgagtattcttatggcaatatagtttttttcatcagtgcacgaagaatccgtttttcttttgcaacaggacccaattagaaaaaatggttattctaccaagggtttgactggaagggcatacttccctttaaggagtcaagcttgacttacagaaccaataaaagcctcatggaagtgtggcctcacaccctcccctacacagtctctgtacaaggttcctgacctgtggtcagtaaagaatgtgactttctaacaggtctaggagctccaagtttatcttgggatcttaaaaggagaggaccactcaactcacaggtattcgaggatacaaacccatggctgggttggttcaactttaaaaggtcttatctgagatgccttgtggaacagaattccatcaagtccaatccaaaaggcctatgtagaaataattattcttgttgtactttatggaaataatcaggccaagtataaaaccaaagtctattttgcaaaccctcagtcctatgatgatttgttttttaacaaacatgaggactacagagagagaaattatatttcaaagcttatcatatatttgtcattaaattctaaacacactagttgtttgtaagtttttgcctacattttaggataaccctgcttgttcctgtgaaccaaccagcaatctccagctacagctcagaaagaacaagaggtatgggtaatgtagaaatctggatcgatattctagttctgagcaattatcctgcaaatcccgccaggtgatgggaataaataggatgcccatcacttgaaggtttcttttttgggaaagtaacaccaagggagctaaccaaagccaaggaccatgcacccaaatcctagcaagcataactgaagccaccagttatctgggtgtgtcacaagacatccttttctttcccttgttggaggaggactcagttccacagttgcaccttagcatttggcttatgataaggagtccatgcaaccccctgggaaacatttttgtcccaaactcaattccaagcttcaggtcaatgctataagaaagagaactgggccgggcatggtggctcacgcctgtaatcccagcactttgggaggccgaggtgggcggatcacgaggtcaggagatcgagaccatcctggctaacatggtgaaaccccatctctactaaaaatacaaaaaattagccaggcttggtggtgggtgcctgtagtcccagctactcgggaggctgaggcaggagaatggcgtgaacctgggaggcagagcttgaggtgagccgagatcttgccactgcactccagcctgggtgagagagcaagactctgtctaaaaaaaaaaaaaaaaaaaaaaaaaaagaaaaaaaagagaaagagaactggatctaacagatccagaggcaggcagctacaaaggttaaaaggcacagcgcaggtgagcgtggctaatttctgctgattaagccaaccccgagcttgctatttcatggataaaggccacgttaatgtccatggcataaatgagatctagggaactccaaggctaccaacagcaagggagatacggcatacatgggtaagagtggatgattcccacccctaagggccccctgcttcatgggtgcaaagctcttttgcactcacgccagacctgcctaagtcgcccggacttggggatgcaaggacggaagaggaaagaggacactcttccttctctccgtcacatccccgggtatctgctaggaagagaagggagccagggatgtctgctcccctctttctagatgggtagccattcatcttcagtctgtaccccttccaaatgcatcctgaacctctgggactcctttaacaggtgcctctttttttcctttctccttctctgtcctctcttcactaataggtaattgtgtctctgtactacaagacactcccttcagatgcatcctacaaactggaaggagttaatttcccaaaccttaaaatggctgccataggattgggctcaggggaagagaacccagaagcccaacatgctggcaaaagggtaaagtattttaaccagttgggcttttggcctccctcttcctgtgcaaactggtaaaaggcctcagaatttttgagctgtccttaaccctccccttgtttcatttggatacatgttttctaataacatagtttgtctcttcttgccttcaggccatcaaactccaaatagtcatgcagctggagcctctgacaatgtccccttctgctgggaaaccttaaatagacctttgagggagctcggactgttgtttccccaaaacagcatcccctgtcagcaggaagcagttaaaatgggtcttcgtccttatccttaatctaacaaaagtttgatgtacttctttagaaaggggaacgagacagccaggcgggagagggctccccggaaaaactccaaccagcctgcacaatggggtggagccacagaagttcacaccctttgtggggaggagttgggcccctcctcttcctgtgtggaacctgggattccaaggcaggcgggaagtgctctagcagggactctggcattgcaagagtccctgtttgctccttttcttcctctttacccaaaaaaacttgtcttactcaccattaaaattgtctgtgagcctgaattttcatgaccgtgggacaaagaaccccatttttagctgaaagaagaaaaagtcctgcaacgcatgttcttgtgtgtttctggagtttgttcatttttttagttgctgaataggattccattgtatagaatttgtccaatttgtttatccatttccctattaaggggtatttgggttgtttctagttttgggtgactataaacaaaactactaaaaatatactgtataggttcttctgtaaatctcagctttcatttcatttgggtaaaacctaggggggattttctgggttgtacagcaagtgtatgcttaactttataggaaattgccaaactgagaagcagtttctaaaatgtttatgaatattttagtcttcagagctgtgcagggtgggcactgctattattccactcccaggtgctcagctctcctggtctgagcagcttgctgcagtcacaaagttggcacgtggtggatctagggaaggtgggctcaggcactctcacttgatgcaagtactgctctctgcttcagtttctgttttctcactggcttcctttgctttctcacagtctctgccctcctaacgcaggctggcccagcccagccttctgtgaacctcctccatcgggacattttccccgtggtggtgccatctggggctgcccatgccctgagaactgcagctgtgtgccgaatgccggctctgctgctggcaagccactggcctccagctgctgcctccctttgccccattccctgtcagggtccaaaagagacagaacagtcagctctcctggctactctgctcagagccccgcacagcccagggacctagtgacacctattggccatttgttagaactgtggctgcacttgagttcaatgtgcaacaagaaggctctgacgcagcttcacattaaataggcacatacgtggcaaaaggatacgtgctcatgtttaaaaattcaaacagctggtacagacatacaataaaaagtaaagtttctcctccctgtagctcggtttactcctgtgattagcgttttctgtttttagttatctggtcagcacacaaacataaataacatgataatacatggaaatccttgatttatccactttagatagtgtgttagtccattctctcttgctataaagacatgtttgagactggataatttataaagaaaagaggtttaatagctcacggttctgcaggctgcacaggaggcatgacgctggcatctgctcagcttctgggaggcttccggaaacttaccatcatgaccgaaggcaacctgggagcaggtgcatcacatggccatagtgggagcaagagagagagggagagtgcaggggtaggggccacacacttgtaaacaaccagatctcacagtaactcactattgtgaggacattaccaagggggatggtgctaaaccattcatgagaaatctgccccggagatccaatcacctcccactgcgccccacctccgacactggggattacattttaaaatgagatttgggcaagaacacacatccaaactatactagatggtgtctattacctacattgtaggaaagatgaagaatttagggcattatagggctttcctgtcttcctgtcccctttacttcctggtttcaatctgtaatatgactaggtttttctaatggctagatttatgctttaaaaaaaaggacctaaatttcaatttctttctttttcttttttttcccttttttttttttttttttttttttttcttgagacggagtctcactctctcgcctaggctggagtgcagtggagaaatttcggctcaatgcaacctccaccccccgggttcaagcaattctcctgcctcagcctcctgagtagctgggattacaggcgcatgccaccatgcctggctaatttttgtatttttattagtgacggggttgtaccatgttgaccaggctggtctcaaactcctggctcaaatgattcaccggccttgtgaatcaatcccaaagtgctgggattacagctgtgagtcactgcacccagccaaatctcaattttttgatgtattatttttagaaaaagtctatattgattctccactacacacacacacatacacaaagttagtgcatgtagactttcctctgctttccacctccagagttctgtgagccataatatcacttttgtgttgcacgtgtttatagaatttgaatactgaagtagccataattaagtgttctgtgcttgaagttgattctaaaaattgaaaacccttaaacagtatttaaggcattattattatgtaaacacgagtcactgcagaaccaagtactgtgattaggcccacggaaaaggaaataaaatactatgtaattaaaccttgggcactcaaaggagaatgttctatgaataaaggtctcttttctccactccattaattatccagttacccacacttcagttacttcaaatttgaaccacgactttcttagactgtcttgttttccctggatttctaattgtcattctatttgctgtaatttttattgaagaataacatatctcatctgattgtttagaattgacttagacctgcttagaatctttattctgtgttcttatttctataatttctggagtggaagtgacttcctctggtggaagtggagcaatcttccccaagtcctctgactttttggatgcattgttttctggggcagctgtgtagctgtcagcttagaattttttctgggacacctgagtactacattctcatggatcttgtgacattttctttcttagattttatttttattgctaaagtttagatttgctggaacatgtgctacatcagtataacatggtgattaagagtgggccttctgagtttgaaactgcttcatattagtcctgtggccttggataactggatctcagcactgtggcatcttcatctgtaaaacgggcacaatgcagctctcttataagttattttgagatggagtgagacaatatatgtagtactgttaggacaatgaccaataaatgataaatctaatattttggtggattttgcaagcgagaggagtaatggggtgtgtgctcatttggccatcctgaattggcagacaagacatatttctgaagtagtcaagaaggcccacctcgtcactatgcacatcctcaatgccctcatgccatcctcgatgccaatgactggcatgtacgtctccagagctccctcctgaatccagtcttctgtcactgactgtgtccttgacatctccacctgcatgtccattgctcaaaaccaaacttctgatcctctcccctaacttgttccacttacagtgttctccacctcaggatggagctgccatctttctagaatctcaggccaagtattttggaatcatgttgattcttttctttctcttgaatcttcatttcatccatcagaaaattctggatactttagcttcaagatatgcccagtattccatcacttctgaccccaccaccatcaccccatctcaactgtcataatctctcacctggatggtgtagtggtctcctaactggcccccctgcctccacgtggctctctgctgtctagccccaaacttgttgggtgtgatcctattttatgtcctcttcttggggcactcctccctctgactcctgtatgctgtccaaatggccatggaacatttcatgcctttgttcagatcaccgtctctgtgaggacttcctcgaccactctttattgttgcagcctcctctgggcatcctaaccctcctatttggctctatttcttctttttcatggcgcatgccaccttctaaatcatgacataagttacatacttatcatgtttagcgttccctgtctgtttcccctgctagaatgtcagctccttgagggcagaattttttttatttgccttgtttaccagtgtattccaagtacttagtacagcaagcacctggctcagttgtaggtacagaatatgaatacatatgaataagaattctcagttgtaggcaaaactgaggatgtgcatagtggcaaggtgggtcttcttgatgacttctcaacaattctcagttgtaggcactgaatatgaattcatactaaataagaacacatactcagtgaaggaatttgcaaatgatagtgaggagcgtggaggagctcccacactgccttgccccacagtttagctattgaaggtgacatctgaaggaggcagtttggctaataagtacagggggcagactctccttaagggtaagagtgacagggaggtcactttcagagtgcaagaagggtgacaggaaacatgagcatgagcagggcctgagggtctcaagggccccttctagctctaaccttcagtgatttcaggccaggtgaggtgctgagctccctggccccagaagcattccagcataggctggctgatgtctcagcagggatgctgtggaggggcccaagcatgagaaaagtacaagaagtggatgccctcaaggccttctctagtaataagacttgaaaattaaacaactcacccctccctgaccactctcacaccccaaagcctgaggcctggagtccctgggccagctggggagggtcctcctgagctattgcctcaccctccctacgcccctgttaccccatggttatggccacagcacctcctccttcttcccttcccacgcagagctcattctatttttggtgaggccaggtgacagtgaccctgacaaagagcactgcttggtcagatggaaggaaggcaagtgaggggcacctgcctctaagccttattctcccatgtcttcccccagctctcctccatccaccaacatggccacaaggccgcctctggaccagatctatccatcgggtttgctctgtggtgccccacttggagacacaggtggacatggtgttcagaggtgtgggacaaacacataagatggacgagagcaatggtggagagatgggaagggaggctgaggccgggcgtggaggacacgtccctgaggcacccagcagcctgaacactctcattttgtctcttttcatcagagtccttaatctcttaaactgcctgatgccaagaaatgtagagctgcaggatatgctgggccccacccacgaaatttgtatttattcacagccttcttataagcaaatatgttcttttgtcaataagccacccggaagagtgtctctggggacatcacccctttgcttttatttctctggaaaataattaaagaacattcacatcagaaagattttatgaatttatgtaatccctgaaatgttgagtttatgcattcccacacctcccatctaattatcccattcccctcacattaaaaagaagaccagattattttccatcattttcttctgaagtatgctttttgttttttgttttttgagacggagtctcgccctgtcacccaggctggagtgcagtggcgcaatctcagctcactgcaagctctgcctctgggttcacggcattctcctgcctcagcctcccgagtatctgggactacaggcgcccgccaccacgcctggctaagtttttatatttttagtagagatggggtttcaccgtgttagccaggatggtctcgatatcctgacctcatgatccacccgcctcggcctcccaaagtgctgggattgcaggcgtgagccaccgcgcctggccctgaagtatgtttttgcaattcagcagctgctccactgtaatgatgggggagggaccaagaaaggcaaacagaaagcaatgcaaacttggtaacaaacacaggcacctccccacctgcttccgtgaacatctgcatagcgttctcaaaccttacctccttccatatgtaattcagtcaagcagctgttatttcttttccagttttatagatgaggtaaccagagctcagagaggttaaacagcaacgggtagtggcctgtacaggagccaggccttccggctccaagtctcgtgtgctctcttcctgcttcacaaatgcctctccccaaataggactctgtggcccacgatactcactgaggacatttggtgaagtgactaagcatggactccagggatgcacagttctagctctgacttactattgtgtggtcttagtctaaactaatttctttaagtctcagttacctcatctgtaaaatagggatgtggcaggccaattct

SEQ ID NO: 416 - DNA, 20001 bp, Homo sapiens
caaaacaatgatgaaagaaattgtagatgacatgaagaaatgaaaaaacatcccatgctcttggattagaagaatcaatatcattaaaatgaccatactacccaaagcaatctacagattcagtgcaatctctatcaaatcaccaatgtcatttttcacagaattagaaaaaaaaatcctaaagttcatatggaaccaaaaaagaacctggacagccaaagcaatcctaagcaaaaagaacaaatctagagacatcgcattacctgacttcaaattatactacaaggctctagtaactgaaacaacatggtactagtacaaaaacagtcataaaggtcaacggaacataacagaggacccaaaaataaagccacctacctacaagcaacttatcctcaacaaagtcaacaaaaataaacaggaaaaagataccctattcaataaataatgctgggaaaatgggttagtcatatgcaggagaatgaaactggacccctatctctcactatatataaaaattaactgaaaatggagtaaagacttaaacataagacctgaaactattaaaatcccagaagaaaacctaaggaaaattattctggacattggcctaggcaaagaatttatgatgaagaaacccaaagcaaatgcaacaaaaacaaaaatagacaaatgggacagttaaactaaaagcttccgcacagcaaaagaaacaattagcagagtaaacaaacaacctacagaatgggagaaaatatttgtaaattatgcatctgacaaaggactaatatccagaactcacaaggagctcaaataatttagcaagaaaaaaacaagcccattaaaaatgagacaaacaacacgaacagacatttctcaaaagaagaaatacaagctgccaataaacatatgaaaaaatgttcaacatcactaatcatcagagaaatgaaaattaaaaccacaatgagatatcatcctacaccagttggaatggctattattattaaaaagtcaaaaaacaacagatgctggtgtggatgcagagaaaagaaacacttatacactgtgggtgggaatgtaaattagttcaacctctgtgaaaacagtatggaggtttttcaatgaactaaaaatagaattactattctacctggcaatcccactactgggtatctacccaaaggaaaataaatcattacataaaaagtacacctgcacccatatgttcatcacagcactattcacagtagcaaagtcatggaaccaacctgtcaacagttgactggataaagaagatatgctagatttttaaaaaaataaaaaggggggggaggtggacaagttttttttgcattttcaatattctatatacaccatggaatatgatgcagccataaaaaataatgaaatcagccgggtgtggtggctcacgcctctaatcccaggactgtgggaggctgaggcgggcggatcacgaggtcaggagttcgagaccagcctggtcaacatggtgaaaccccatttatactaaaaatacaaaaattagctgggtgtggtggcacacacctgtagtcccagctactcaggaggctgaagcagaagaatcacttgaacccgggaggcagaggttgcagtgagccaagatcgagccactgcactccagcctgggcgacagagctagactttgtctcaaaaaaaaaaaaataataataataaaaataataataatgaaatcatgtcctttgcagcaacttggatggagctagagcccattatccaaagtgaactaactcagaaacagaaaaccaaatgccactcttctcacttataagtagaagctaaactgtggtatacatggacacaaaggtagaaataatagacactaggactccaaaagggggagcattggaagaggggaagggttgacaaataacctatcaggtacaatgttcactatttgggtaataagtgcacgagaagcccagttcccaccagtgcacaacatacctatgttaacaatcatgcacatgtgtctcctgaatctaaattaaaataaattttaaaataaaataaatatagatgatccttgaataacccaggggttagaaatgctgaccccctgcactgtcaaaaatctgcatataacttttggcttcccaaaaacttaactactaataacctactgttgaccggaagccttaccgataacataaatggttgattaacacatatttagtatgttacatgtattatatactacattactacaataaagtaagctagagaaaggaaaatgtcattaagaaaatcaaaagaaatatatttactattcattaagtggaagtggatcattataaaggtcttcactcgtcttcatgttgagtaggctgaggaggagaaagaagaaaaggtgttggtcttgctgtctcgggggtggcagaggtggaagaaaatccgcatgtaagtgtattcactcagttcaaacccatgttgttcaagcatcagcagctgtactctgccgacagcatagggctctctgagcaggaccaattaacaagataggtgaagtaatgcattataaattatctataaatagctagcacttaaactcagctaaatttagaatggtttccagaagccttccacattaataaatatttaatcttattatttctaatctatttgttccaaagcccattaaaacaaattaatttcaaagatctatgtgctatgtttaatgaatttggaggaaaacgctatttcttgaagcagattaaaaagcatttttagtttcttatgaagccttattcaaaccctctgcaagcaagcaataacccagagcagtagttttcaaaatttgatctttggtgacctaggggttcttccccagagctgttttctctgtgtgtgtgttttacatcttttacaggaagaaatggcaacatatgtgcatttgttcccaggaaggaaggtgatagcatttattagattttcagaagaacccaagactcaggaaacatcaagaactactgttctagagtacaaatagaaacagaagagacatgaaataccatcttctctaataatccaactgaaaattaaacctccacagcctatgctggagcacctccagtgtgtgctctgtctggaattctctcattctatctctgggggaaatccttttccctgcaactttgtacaagtcttgatctaaattcttccaccttcctacaacatttggtccaaatttcaccacttggcatttatctcaagtctaagctcttgtcctcattctcatccttaaaacctttaaggcaagtatcagctctcacctcttcaccattcttccaaccttctcaaaaaatatcctcataagagtacagtatactcagtgtattgccaagtctgcatcgagagggctattactgtcattatcctcttgaaggtttttttaaaaaaacctaccatttaatttactttaacaactctattgatatggacctagcaaatctggcatttccccacactcctcactacctatataccaaataaatgacataagtttaaagagcttgagaatttagaatcagcaaagacagctttaataaataaggaacttaccattttattctcacatcctcaaaaaatgaaatagatagaagagtaatttgtagagtcagattcagtttggaaatagaaaagcgagggctctcataggaccagataaaacagaagtttccgtaactcatttagatatttagttattttttaaaaggaatctccaccagtacccctacacagacgcatacgcagtcttcatagatacacattcaccttaaaaccaccgccttaaaccatccctattataatagaacacaatactgaagaacttaaatttatcagcttctgtgagtggagaggattgtttcagctgggaaataaggaacatgagatttacatactttatgagcaataaataataacaatattgtgcctgaaataaataaactttggcaatagtaatgatgtctgctaggaaaaaagtattttaattgaaattaatatacactcaagattccttttaattatatctttaatcaaactcttctaggttatttttccttctttggtgaattttcttttttctttttttgcttctcttttcattgccctggtattattaatacaagaatttgaggaatacctcaagtacttgaccactttttgctttatgtaacgctgccctgtgtttcttttttccaaggcagaaaagatacagccatgcttcccattgacattgttttacaagttgattaaattgcttagttggtcttgcagacaaaatcatctttcaccctagaaatctctgtgccattgttcagggagcagagagcactgaggatacacagtgttctgtgtccttaactgcttggtgactccagcagggaggctgctggcaccagacactcacagcagctgcaagtttgctaccatttctgacataactggccaattcagatgatatagttttatatgtttttaatttaatttactcttgaataatacacatgccaaaaaatttaaaagatacaaaaggacataagtgctgtcccagctacccagattccctgtcttagaagcaatgctcttgtgtttccctgcaagtacatttttgcctataaaagcaaatacatatttttacaccaatagtatacagttatatacacattttcttgtaccttacttttgtgtgttaaactattggatatcatactatatcatgaaataacaaaagcaatagagggtggtatcctcctggatatcctgggaaaccatgtgaagaaaatgtttcaaagagagaagtatgtgctatgtgaaatgctatcgtaagatgagaattgagaatggactactgcatttggcaaaaaggaagtcacttatgactttgacacgaatgattgttagagaatgccaagtgggggaggcaatagctgattgaaatggattcaagatagaatggaggaaaagaaggcatcactcaccacaaataatttccaaagaactttgttataaaagggaatataataatgggattgcaagtggagtcaagagaggggtattttttaatactgaacatattataagatgttggtatgaaattaagaatgatccatttacagcaggaaaattgagtgatggaatatgagaacaagacaattacaagagcaatgtccttcagcaggtgatgagatgggattcagggcaacggaagggaggttggcctgagacaggcatgtagacccctcatccagcgcaacaggaaggagagcagagtgtgtgggcatagacgcaggcgcaaggaaaatggcagatttggtagtgagggcatgtggagtcatccgccattcgtgtctaaattttcactctagaaagctgtaagtgggggtaggagaacatgacaggggagtgtttacctagaggaggaatagaacaaactgactgggttgctggaaaccttgaaggcccagttgaagagggttcagtttgtgcttgagaatttaaagtgagagcaatcggtatgtttgtgtatttttgtcagccatgtgaatacatatatttgggtgaaatgttaaatgtaactgaggagtctggggtttcaggggatgcatgcaataggcagtgcagtagagagaataagatggcccccagaattccacattccttggtaaacacatcttccccttagtgtaggcagggcctgcgaatatgatggcacatcactcccacgattacgttgttatgtggtaaagagattttacaggtctctaatcaaaaggaaattattctgggtgggcctgacctaatcaagcaagccttcacagaaaccttagaccttctctgagctcagagacactctcctgctggccttagagaaacaaaccagtgtgagttctacagctgtaagcaaagaattctgccaacgattgtgtgagtttaggggaagactctgcatcttgactagtgccgcattgtaagaccagaggagaagacttggtaaacgtgtgcctgggcttctgacccttggaaacgatgcaatcacaaatagctgttgttttaatctattaagtctgtaattatttgttactgcagcgtagaaaatgaatacagagggagatagagggaaaggagtgaagggtagacaaagactgattataatgaaggattgcaggaactaatctgagtaaggagggaaacgggaatgtgaggaaagtatggcacagtgaaagaaaagcaggagggatacatttactcttcaaatatttgttgagtgtctaaaatgtgccagattccatggtaagaaggggatctgagggaattagtagtctctgcttgctagatgaagaagtggcttcgtatgatattgtggcaattcttatggacttgaacaacaggttcctcatgactatgaagatgtcctgccatctactgtggtttggaaccacaaaagatgggggtggcggggagtggtttccccagagaggcagatccaatgccgtggcactggccaaaatgttagcaggtttattgggcctccctggagggccctaggctcagatcctaaagcccagctattgaatgtatgttcctactctgaggactggtttgtgtaagctcccacagagaaaacatttcttgccaaagccctgaagcaggagataggagggcacttccaaaaaataaaatgctggaatacagacgcccagggggaaagaggcatcagatggagctagaaagaaaatcaggagcctctgtaagcaaatcgactctgtaagcaaaaggaagaagctctatctattataatatccggggatggtaaggccaacttagagccaccgtagactaggacaaggaatgaatggtgttccaaaacccttgactaaaaaactagacttcaaagtgattttaaatgacagcaaatcctaagaaatgctttcaagttgaaatgaattattagctccattgtgcacttgtttttccttttagcccagctattcccatatgtagtttttaacactgcaactctctccagtgaccttaaggaacatcagaattttggaacaaaattaaatttaattaaaatagttaaactatttcattacaactcttataagaaagagcggagagtgactgatgaccaaaaaatcaaataaacaggctgtcttaaaatagaaaggttagcaatcatttactcaaatctttagttaataaatgcataatgaagtttccagtctttccactgcaattgtttatgtactctcatgtgggattttattgtcatttaattacattggaaaaggcgcaaagcaggcagggtactttagtaaacagtcttttctctagctgcatcaaagtatcatcatttgctattgtctttcaagagctattccttacacaagaaaagagccaagttagtgcttgttttctgtcttttgaccagtctctactgtctatagaacccatgattataagggaaccactaagaccgaaacagagaggatgctaaaagaaggaaaaaaattaactgggttgcttcaaggttggtctgccctaaaatgtttctgaacaatcaaaagagatctgaattcatttatcaataatagcattaagtacaacaatcatttggaaggttttctaggagctctgaccatttttgtttgtatattatctctagataatgaaacaaggctgagagagacttttttttgacaaagatgattccatcctcattcttaagcatgttcttcattcacttagcttccgggacacttgccctctgaaggttttatccacctccttggcctctccttctgagctcctctttccctgcttgacccctgctgctccagggcccaaactttccacctacactctgtggcagagcaaagttcgccagtcctgtagctggaataccaacttcatactgaaaaatgcctccagctctgacttctctaagctccaattcaaagtgccaaaatgatttattttccagctttattggagtataattgacaaataaacatggcatatatttaatgcatacaatttgatgttttgataaacattttcattgtaaaacgattaccacaatcaagctagttaacatatccatagctatataataattattttttggcagatctctcttactctcttagcaaatctcatgtgcacaatagagtaccgttaactatagtcaccatgctgtattttagatctctagaacttattcatctcacgtacctgaaactttgtactctttgaccaatgtcttcccacttccctcccttcccaacccctggtaccaccactgtactctgtgcttctaggagtttgactattatttagatttcacatataagtgagatcatgtagtatttgtctttctgtgtctgacttacttcacttaacataatgccttccaagcccatccatgttgttatacgtggcaggatttccttctttttttaaggctgaatatatttcattattccacaatatactacattttctttatccaaacttaatatgtgtgtagttttctattgctgctgcaacaaattaccacaaacatagtgacttaaaacagcatttgtcagcagaattacattccttctggaagcttcaggggcgaattctttcaatgccttgccttttcagcttctgcagccgccttcatcctttggcttgtggctccttcctccatcttctatgtacatcattccaaactcaggttccagtgtcccatctcctttatcagattctgattcctcctgtgtccctcttataaggaccctttgatgacactgagcccacctggataatccaggatatttttgcatatcaaggtccttaacttaatcacatttgtaatgtaaagtcccttttgccacataaggcaacatactcatgcattctagggatttaggatatggacatcatagtgggagaagcactattttgttttaaacttgagtatttttaactccatagtgcaaattctatggttggtgctatcttttgagcctcaacataccaccactcatctagtcctggcagagctgagctggagaattctgggcctggagtagttccaagactccaaggaagaaatcccagtgttgtaacaatgatgatagccttgatattctcttatcagattctcttctccatcaaggtatttttacagtatgttataagcaatccctatcactccacaaaagaattaatagatacagtctgctctaaatgtgcaaatcataacacattcataaagatggcacaaggtttgctgaagggtattactcttagcactctgcactatgtgaaataataataatactgagagtacctaacattttgtgagcaccgttgtttcctagatgtgttcacgtgttcattatatcatttaattcttaatataattacaaagtataggtattatcatttttgttgataaagaaattgatgtttataggtgttgagtgaattaccatatagcttcaaatgaagagaagggagtctaagactgttctagctgcctccaaagccaatattcttttctataaggccaaataccttccagagcaaaggagaaatttcctgctgaactcttcattcatccccaataaatataagaacaaaattaaaatgtagggcactggtgaattgctttctggaatttttttcttgggaacctcaaaggagtgacagtgacttgtgtagattttgcaaattgcaatatcccctagctctcatgtaggttatcatcgtgctgggagcatgataaatactcagtaaatacttggtgaaggttgttgaataaatttaggtgcaaataagcaaactttttcagataactggttatttttcattttttccatgaggtcacaagggatttagttggggaaagagaagataagcccagaaagtatactaatagtaggattcctaaacagagcagggaagggacgctcctcattgcagagctccacgccccatggaaatgacagcttctgaagaagttgtagggtggtaaccaccaccgcacagatctaccaagtaagggtatgaaatccttttgcccttaccaatttagtcgttaaacctcctccctcaccactcttcatttacttacgcacaggactaacatatactaaatccctacaataagccagtctcagtgctgaattctaaggatataaagataattaggaatcagtccctgccctaaagagggtaaaaacacaataatagaagaaaaatatagaaaataaattcactaaggtattataggggctacaacaaattttatcatttatagtgggaagctcaaaatcagaatggtaaattctacctgattagaggtgaaagtgaggtcagaagaggcttcagagaaaaggggagtttaaggaatgtttaggttctctcaggtttgggggaaagggtaagagataggtggagaaacagggatgtgtccagatagagggaataacatgagcaaaggtgcagagatattgaactgttgtgttttatagaaactgaaaacaggttggtttcatggctacttttcattttgagaaaatgatcattagtcaaaaacatagtttgatttaacacaacaagtgccttccacttctacagtttgcaattgctttggccttagctgcaggtaactctgctaaattccccacgctgtgtctccttctagacaagcacagggcaggatttctacctaagaagcttcagctctgcagctaggtaaagtcaccattttctatgcccagccaaggaatgcatgaagctccctgctctccctcccttgtcttcctgcatcagtcttcattttcttcctcctattgtctcctccacacccccacctccactccatctcttcagtggaaccttgcaagaagctaatgtgtacctagctgcctgttctcatgtgagccaatagaactaatcaaggtaccagtggaaaaacaagcagagatttgatccatcattaagctaaaccaaaacacagagtctctagggattttgtgtgtgcgtgtgtgtgtctttcctaggttcataaatcttagaaatgagaataagagcaaaataattaagggataagtctgagttcttgaaccttgaatactttcccccatcttgtgtttatttttgtacccaccacttaatctacacgaagagaagtccacattaaggaagtcctttatgaaaaaaatcacatcaacaggtgattaaaattttctcttgatatacttttacataagcattgcgagcttattgagggataagcatcttggaaatacagtatttccaagtctaaatgtcaaacataattcaaaaatagcccactggagtgtttcccccaaacaaagcaaatcctcctccaaacccaacatgtcatgggtgtgcaaagtttaaaacaagggcagaggactctacaataaatcccaaaatattggcaggcctgtaaaatatttatgattggccacgtattatgagactctatttctagtacattcttcctaaacaacaggactttctgcattttcaaagagctatcctggataatcaccaaaaagtaaatatcatgagtaaagatgttcaaaattagtagtattaaaaacagtgatattttaaaaaatacaagatatttgtatttcaccaccatccacgcttagagttttcctttttttcatgtttaactctcaaacttctatatatctgtgagaagtatggtttcacttcagtgtagacatcatcactgtatcttatagtcagaagagattgtcaatatcatttaattcaaccttttcatttcacacatgaccaattgggtaaatcgtaaggagcgcctgctaagaggtactgtaccagggctgtaggagagatcttgatgggaaaaaaagatgcatgattccttaaatcatttggaaaaaaattatttcatttctgtgttaaagaaggtttatatctacttgaagagattcagtaatgtatacatatagattaaagcaaaaaaggataactgcagaaaggctgatccaaaccaagtgcaatacatagactaaaggaagtcattttgcctggtggaatgttggaaggctatctcaggtaataggatttagactagattaaaaggatcaatatattttcattaaatagcagtgcaataaacagttattttccatagatggaatagtgttagtaaagattcctatatgataaagaatatgtgtgtcccaggagttctaaaaccagatttggtagaagcaacagaaggaatcattaggacttcttaatattgagaattaaacaataagtttgcttctggctacaagaagtagaatctcaatttaaccaaataaagccacttagtccagagttaggtacttccagacatatttattcagtagcttcttaaattcatcagggaaatgctttttccactttagctctactctgccatcctcaccatgttaagttgaatctctcctcatgtcaccaggtggcctctgcagtctggcatcactccaggtaccacagcatcctatgtaagaaaagagactgtttcatccctgcatctccttttaataatgaagagattttttccagaagctctccagctgagttcttatcagctagacctagatcacatactcatccttacaccagtctctgataagacaaaagtattaccaaaactgagcagtgttttaccttcgaggcacaggaagagaagtcagggcttcgctaacaaagaaaaagggagactggctcttgactaggcaactcacaacgttaaggaaccacagctattccctgaagcctgttggaggaaaaggtaaagtaaagggcttctctccctatttagaacaatggctcctttacaaaggctgggaagatggtggttgggagttcctctaggcaacaacagaccttattcaatagatgatggtttggggtttgggccatggcaccttcacatcctactcaaatcactaggtggtcaggtccataaggaggacaggagcagagagaggccatagttcaaggtcaagatttttagagaagtttgtaagttcttctcttccttcctagtgttgggcaggtgagcctcataacatcattaggcaccaatcttaggcactctgagggtaggtccttcccaattgcatgtctcttgccagtcatataatgcaatccatatatttaaagagtttctcaaatcaattcaaatctcaaatcaatttattgttttgtcaattactttatttcagaacatgatgtcagaattcttaatacctcagtaaaggtaatgttttgggtaaagtaactgttgcatcctgcgtcaagggcatataatctgggcacccaagtcaattttcataatcatatgttgctacattgtcattttagtaaggaaatgatgatgatgttttgtgaaaccacatctttttttcagctactgttttttactttatgataggaggggaaaaacacaaaaacagaatgagtcactccattgccaccacttctctatcattttccttcctgttttcctattggaggttgcagttaaggtcacttctggactcattagagtctcaaatcaggcttagatgaaagcactgaggagatgttttgtccttcatttgacaaatatttattctagaacactgttccaaagaattaaaaatctaaataaaatatagccatccaggcagctagcagaaaaataatgaaataaaagtacatttattggcatggaaagttgttcacaataaaggaaaatatatatccataagcattgttcacttttctgtgtgtatgtgtgagtagagactgtgtgtatgtatctatccagatattttttttcattattcatgtatatacatagatatattgagcgtgtagtgtgctatcttaaacaaacaaaacacttgcctgtagttactctgtcttctaagagctggtgtaggggtggtagacagtgatgtagaaggtggtcagaatcacagctttcatgccagtgggagaataaatctctatactgctttcttttgcctacacaagccagtacaaaaggagtcttgcctaagattttaatcatgttaaaagaaagattaaaatttcaaaatttagggtaagttttgcctaatacattttaactttagagcaatgcacatttgcataacaaaaatctcaaagaacatagtttctatctttaaggagctcttttagaaaaacacagaggaagaagtcactgcctctacctggaggtacccaggtaggctccctcaaggagttggtctttaaattgggttttaaatgaaaagtcctcagaaaataaacagcacatgttaaagcataaaggagcctggcaattcagtaggactggacctcagacaggggtgtatggagacccacatatggaagggagtgtaagtggtagcaaaaggctgtaacagcaaatggggcccagataatgaaaatgtaagccagccgggcatggtggctcactcttgttaatcccagcactttgggaagccaaggcaagaggattgcttgagtcaatgagttcaagactaacctgggcaacatagtgacacctctgtctctacaaaaaaaattttttttaaattagctgagtgtagtggcacacacctgtagccctagctactcaggaggctgaggcaggaggatcactttagcctgggaggtcaaagctgcagtgagccgtgatcacaccactgcactccagcctaggcaacagagtaagaccccatctcaaaaaaaaaaaaaaaaaagacagaaagaaaaagaaaagaaaaagtaatcatctccaaatgagatttcaccttcaacatcatgaagagtcactgaagattatatttcctttaacaaaaaagaacacataattttaaaagtgtttttatgtaaatttttgtaatcatagaacaaaggatatagggaactaactctttgttcttaacctgaagctttagatcctttagactaattctcttggagtagagcagcacatccaaagtggggctccggactgggatcagccaataacacatttctcaccagaccagggggaaataacagacataagaacaatgtagggaattttgtataaaactaaatctattctgtattttattttaatgtgtgtacatttaaggagcacgagcacagttttgttacatggatagactgtgtagtgggcttttagtataaccatcacctgaatagtgtacatggttccctcctctcaccatctactcatctctcaccccctctcaccctcccactcttctgagtctttattcagtattttgaaatttatttttaatgtctctcattagcaaaacaaaaaggaaattggcaatcccatgttggtgtcccctaatgtatttttactttcttgttcattaaagctgaagttcagggaactactggactacagttgtgtagtttcactagacgctgaaactagccagaaaaaggaaaataagcagggcaaaacacataaaaacaagcgagcaatcaaagagttagaggaaattccagtggtctaggagaaaatgtggaggtgaaaaaggaactgaatttaataacaaataaagcattagtttcctgcaaagttgaaataaatattttattttaaaaaaagagacattgtacattcttcttttaaatttttcgtgccaaatacctagtttatactttgtatttttagaagaatcatttgaggcttaaaatgcaaggcgtgtgtatatataaatgtctttcctttatgagatacgtgtcttctgcacagagggctgtaaaaaattatctaaaatttttttaataataagaaaatttttgccaaataaatctttattctcatattttttaaatgctaaagaacctctctcagtagattgtgttgtcaattctagcatggaagaattagaatcatgttctggcttgtgcagtgcagaggaattacaggatatttgctgggcgtttcaccttataattcacttttcctctgtgtgatcttctctttctaatgttgttcttttctttctcctatagtcaatttacttgcaagcacctactcctagtttgtttcctgagtggttgtaggtatctgccacaggctgataaacttcccgaggtcagttacctcttagtcttagtcttctcttagtatccctgcagagaacccaggcccatagactcatttaagcttgtttacttactttgccttccctcaaagagcgataaagaaaatgaccttagctccataatcctcaactctgatttatagaacaaggcatcccattagtggctttcatttccatcctatcagtcaattgtgttttggcaggatacctcaaagttaaacatcataaagctagatttaatgttaacttattgctatgtaaatggaaatatccttttcatatttcactttctatttgtgttagatcataaaaaattaaatccatctagctctagcatataataatgcatgtttagagacaagaataggaatcagaagggtagatttgaaaataagtttgaaaatgacaaaaagatatttaaatcagacttcatcttttaaagagcaaacatttgtgctttataaaattcactaaatttatttgtttccttaaaataataagaggataaaatttgaagctccatatgcaagttttaaaaatgataattttaaaatgttaattctttgttagctaaggaagtattttggatatatctcttccacaattttatcttcttcttttcaataattatttttaacataaatttagcttataatttcatcatcaaagctttaagaaatccataagtatttttagcaacattgtaaatctctcttatttctattctgcttttttccattccattttttattatagttaaaaataactataatactagcccagtgtgcattcttcctctttggggtatattttaagcaactaacaatgaatccaatttgtcaatagctcagagcgcatattagacagacaaatacattaagcacggaaatttgcattgaaataaacataccatcacgacttcttaaattaggattcacagtaactaccatttagtgagttcttatcatgtagcacacacagtgctaaaaattcaatatgtataaatacacacatacatatatacatacatatataatcttgtttattctttatagtaacagtatgaggtaggtacatttaacgttcccatgttacagataagggtactgacacttattaaatgaagatatttggtaagaggcaaagccagaaataaaattcaggttctgcctgtctaactctaaaatctatagacaataacctgcataattgcaaagtgggcagactgataaccttataaaatcaggatcacccaaattcaaaatgacacccaacactctctgacccttattacataatttctctagtgagcaaacactgtcatactttgcaaagacaatttcatacttcctcaatgtctgtctcatagcagctgctcaataaagatatgttaaataacaataatagcaaagatttagataatgctatatacaaagcacttctctttctttcctatttttttaagttttagattcaggagggacatgtacaggtttgttacatggatatattgtgtgatgctgagctttgggcttctattgaacctgtcacccaaatagtgaacacagtacccaataggtagtttttcaacccttgaccctctccctcccctcttttagtgtccccagtgtctgttgttcccatctttgtgtccgtgtgtacccaatgtttagctcccacttttaagtgggaacatgcagtatttgacttttcttacctttatacattttaactcatttaattttcttaacagccctatgagggtagttactattgctagtctaattttgcagatgaggaaatggaggcacaaagaaattagataacttcttctgggtcatgtaagtggaagaattagacttcaagcccaagcagtcttgtgccctagttccacagtccatagcccaaacaaataaatgaatgaaataaccagaatgatttttgccaacatacatcaaattatcactgccttgaatcaaatcgttcagggactccccactagtatgtaggataaaaatgtgcagttcatagtccagcctgtaaggccctatatgatctactacttcatctttcacctcacattttgtgcccttcactctcctcggtctcatacagcagatatcattcagtactttccttccaatctgggtccttcacacatgttgtttcttctccctagaagctcattcttaagaccttcaactgattaacttgaattcatcattcaagactccacctaaatataacttcttgtgagacagtgtctctcatatgcctatataaccaaggtatctactcttgttatataatcttgtagtacttagtacagtttcaaagggtatgtgcctgtctatctgtctcttcctccttcattacactgtaaatttgatgagggcagagaccatgacttgttctagtacatgtcctgtactaggtacttgacagaagcttgttgaaagtgagaatgaataaacagctcaatcaaaagcattattcaaaatgtattgtcataatattgtgcgcgaatgtgtatgaatgccaattgccaaatatatctgccaagcactaatttaataatcaagaatatccaccaggtctctgaggagctaagattgaatatggttatcaagccaaagatataatgaaaacgaaagaggatcggcttcctcttttctctcatcatgttaaatgcagtaactatagttttatctgctacatgtgtgataacagcacatcccctcttcattgagaaaggcctcccccttacctcagtgtcctgtcacaggtacgagccagggaccatgtcaggccagagttgtccatgcttcaagcaacaatgattccttagaacatgagcacaaggccccacatgggccagtcagaatcctccatgtgactattagattagttcaaattaggagcacttccttctttgcctttggagtcacaattctaggaagatttaaatttaagctgcttaatagccatcttcccaagtcgtatggaagaagcctgtctgtatcaccagaaaaagaggcccaatgtgctaacacaaacagaaataagcagagatgaaaagcagagagacatctctaattctcatttaagctattgtactccactatatctgaagtcagctgtattccagactttccaggtaggtaggcaaacaagtatttctttttgataaagttgttttgagaagatctttttgtcacttgcagccatgtgccctgattcatacatcttcccaatcaaatcacaattccaatacttggaaacacaaagccttggaggggcctgcgtcaagatttacagaaaactgaaagattataggcttggttcagacttacagggaacttacacacagtgcataagaacagaaaatcctgtcataatcacaaaaaccataccaggtcatacaaaagcctgggaaagtggaatgtccctgaggaaagaagcaaaaaggaagaaaagttaccccttccacaaaagtgtcctttttttccactgagggttgctactattacaggtagaggcccaggagaaatactcatcatgtttcctgcatgtccaaatgagaattcccatcaaagcaggcctcacttcctctacagaagctacaggggttgctgtttgtttcaacctaagtctgggttatcactattttaaacctcaagaacatataatcctgccatcatctgactcttttgtagatcttgtaacatttgaaatcttacatctgttc

SEQ ID NO: 417 - DNA, 20001 bp, Homo sapiens
tcccctcatgaaaacatcaatttggaaaaccattcaaggccaggtgtggtggctcacgcctataatcccagcactttgggaggctgaggcagcagatcacttgaggtcaggagttcaagaccagcctggccaacatggtgaaaccccatctccactaaaaatacaaaacttagccaggcatggtggtgcccacctgtaatcccagctactctggaggctgaggcaggagaatcacttgaacctgggaggtggaaattgcagtgagccaagatcgtgccactgtactccaacctaggtgacagagcaagactccatctcaaaaaaaaaaaagaaaaagaaaaagaaaagaaaaaccattaaaaatatatacacctactatgtactcacaaaaattaaaaattaaaaaaagaaaaaccatccatgcacaaaattatcttcaaaagagctaagaaatccaggaaagagtttatagcacttggacggagcagagaaataagagaagatatattgaggaggatagaaaaaacggtttcacattacccatgtcacccctcccacaagcccacacagcacagcttggagaaagctcccttcgtataggggaaagacagtaaagggagcgcttgattttgccacagatcccctcactaggcccaccccaatgctatgatttcaaataaaagcataagattacaccatgaggatctaagcccaaaggtagcagaagaaaggaaataaagatcacaacagaaataactgaaatagaggctagaaaaacaatacaaaagaacaatgaaactattggtttttttgaaaagataaacaaaattgaccaatatatgaacaattatatgccagcaacttgcttaacctaaaagaaatgcatatattcttacaaacatacaacctgccaagactgaatcatgaaggaacagaaaatgtaaatagactaatattaagtaaggagattaaataagtaatcaaaaacctcccaccaaagaaaagtccaggacccagtggcttcactggtgaattctacccaacacttaaaaatgaattaacgccaatatttctcaaactgctccaaaaattggagaagggggaacatttccaaactcattttacaaggccagcattatcttgataccaagggcaaacaagaacactataagaaaaaaaaaattataggccaatattcctgataacataattgcaaaaatcctcaagaaaatgctaataaactgaattcaatcacacacgtaccatgatcaagtgggatttatccctgggatgcaaagatagttctccataagcatttattacatttgccaataaatgtgataaaaccgtatgaatgaaatgaagggaaaagttatatgatcatctcaatagaggcagaaaaagcaggtttttaaaaataaaatccaacatcatttcatgattttaaaaaacacttaaaaattacgtatagaaggaatgtacctcaacataataaaggccatatatgacaatcccacagataacatcatgcataatggttaaaagctacaagctttttctctaagatcagaaacaagatatggatgcccactctcaccacatctgtccaatacagcactggaagttctagacagagcaatgaggcaggaaacagaaataagttatttaactaagaaaagaaaaagtagaactgtctctgtttgcagatgatatgtgttaaagcaaaataagcctgaggccattagcctggaattatttctgtacctggcacgattatgcaagcaatccaaaatttaacttagaggcattccttgtatctgattaattttgaatcaagtttcagccaatcataaatggccaagtagctgattggttatataatttggagcctccagttaaaccatatcgaaataaggtaaatacctagctgtggccaatctagtttctttgttttcatgttcaaccaataaaagctcactgctcacacttctagagcaaggcccatgatctcctttcagttttggtgcttcccacttcatgaactgttctttgccaaataaatgttgttaaattttattatgtctcaagtttttcttttctttttttctttttttttttttttttgagacagagtctcactctgttgcccaggctggagtgcaatggtacaatctcggctcactgcaacctcctgagtagctgggaatacagacatgcatcaccatgcccagctaattttgtatttttagtagagatgagggaggtttcaccaggttgcccagactggtctctaactcctgacctcaagtgatccacctgcctcaacctcccaaagtactgggattacaggcatgagacagcacacctggcctcaagtttttcttttaatgcataattttacatatggaaaaccctaaagactgtatgaaaactattagaactaataaatgaattcagtaaagttaaagttaggtgaaatttctgtacactgaaaaccataaaacaccaataaaagaaattgaagaagacataaacaaatggaaagatatcctgtggttatgaattaaaagaattaatatttttaaaatatctatatgacccaaagtgatctacagattcaatgcaatccctattaaaattttaatgacatttttcacagaaatggaaaatgagattgcacacttatctctcatcacatgtaaaaatcaactcaaaatggattgaaggctgtaaggtaacacctgaaactgtacaattactagacaaaaacataggggaaaagcttcttgacactgatctagtccatgattttttggatatgacccaaaatcacaggcaataaaagcaaaaataaacaaatgggattgcaccaaactaaaaagctctgcacagcaaaggaaatggtcaacagactgaagagacacctatggaataggagaaaatatttgcaaactgttcatatattcaggggttaatatccaaaatgatataaggaactcaaacaatagcaagaaaacaaataacctcattttttaaacgggttaaaggatctaacagacatttctcaaaagaagacatacaaatggccaacaggcatattttttaaaaatgctcaatattactactcaaggaaatgcaaattaaaaccacaataagatatcacctcatacttgttagaatggctattgtaaaaaagacaagccgtaagtattgacaaagatgtggagaaaaagggactcttgcacactgtgggtggaaatgtaaattggcacagccattatgtaaaacaaaatggaagtttccttaaaattaaaaatggggctgggtgtggtggctcaaacttgtaatcctagcactttggaaggctgaggcaggaagatcatttgaggtcaagagttcgataccagcctgggcaacatggtaacaccctatctttaaaaaaagaattttaggcctggtgtgggtggctcatgcctataatcccagcactttgggaggccgaggcgggcagatcacctgaggtcaggagttcgagaccagcctggccaacatgatgaaaccccatctctactaaaaatccaaaaattagctgggcatggtggcgcatgcctgtaatcccagctacttgggaggctgaggcaggagaattacttgaacccaggagatggaggttgtagtgagccgagattgtgcccctgtactccagcctgagcaacagagtgagactccctctcaaaatgataataataataataattttaaaataacattaaaataaaatgaccatataacctagcaattctacctctgggtacacatccacaggaaatgaaatcagtatgttgaagagatatctatattcccatattcatcatagcattattcacaatagccaagatgtggaatcaatctaagtgtctatcaattgatgaatggagaaataaaatgcatgtgtgtgtgtgtattgtgtgtatatatatgtgtgtgtgtgtatatatacccccatacatgttattatatataaaatattattataatgtaatataataataaaatattattctttcctacaaaagaaggaaattctgtcattcacaacaacataattgagcctggaggacactatgctaagtgaaatacaccaggcacggaaaggcaaatacggcatgatctcactcatatgtagaatctaaaaatgttgaactcctagaagcagagagtgcaatggtgattgtcagggactaggaagatcttggtcaaaaggcacaaagtttcaatatgcaagatggataagtcctggggatataatgtacagtattgtgactgtatttcatattactatattgtatacttgaaatttactaggatcttaaatgttctcatctcaaaaaaaaaagtaactctgaggtggcagacacgttaatttagcttgatagtggcaatcgttccacaatgtaagtgtatattacaacatcaagttgtgaaccttaaatatatacaattttttgtcatttgtgcctcaataaagatttttaaaaagtactttcaactgcttattaacaaacatttaataatgtttgttatcctacaaaactgtattaagagactgacaaaaatgaattagacattttgtctgttattaactatgtctccatctaataaaggaaaaagacatttatgtaacatttggcttgcagggtaatacgtgctaaagatgtggtttatgcaaggtatcatgtggaacagtggaactggtgaacagctctgcttggttagtaaaggggaagggacaggatgttgaagacacacacaggttatgcctttaatgatgagaaggtatttaccaggcaaataaaggcaagaataaacttcaaaccaacagagggactaaaaaaataggataatttttagaaaccaaaaccaacggtcttagtccttttgggctgctataacaaaataccataaactgggtagcttataaacaaacaaaaaatatttctcacattctggaggctagaaaatccaagatccaggttctagcagattcagtgtctagtgagagttctcttcctcatagatggcaccttcttgctgtgtcacatggtcgaaggggctagctagctctctttggtctcttctataagagcataatcccagtcatgtgggctccactgtcatgatctagtcaattctcaagggccctgcctcttaattctatcaccttggggattaggaattcaacatatgaattttgggcagacacaaatattcaaaccatagcaccaacttaaaccaacagaaggcaagaaaagaaaaacaagtacgaaacaaatgaaataaatagaaaatgcaaagtaaaacagtagatttaaaaccaaacatatcagcaattacattaaatataaatgtactaaatactccaggtaagagtcgaatattgacagcctcgatttaaattccactatgtgttgtttataagagacatccaaaatataagaacaaaaagtggggaaaatatctcattctagtagtaactgaaataatgtaataactgttaaaagcaagataaatacactattgaagataaagaggattcccttataacaaaaaaagttttaacatactgaagattaacattctaaatataaatgtgtttaccaataaacagattaccaatggctttaaaagaataaatacaacataattctatttatgtagagttttaatacagacaagattatatttttagagatgcatacttaggttgtaaaactatatttttaaaagtaaaagaggtattattaccacacacactataacaatggttacttctaggagcaaggaatggtggtatagctagtaaggaatagcctggagtcttcagcagggctgacaacactgttatctttcggatgtgtttccacagatgtttccttttattgttcattacattgtgcacttatgctttgtgcacttttctggcatttttatatttcatgatttttaagttttaaaaaattgtagatggaattcttcagtacgtatctgcatacatgcataacagcttaagaaggaaagcttgtattggagaaggagatatgggtgttgtcttctgcagatagcagcagaagccatgggaataagtgagactgtgcatggagaacacactgagaggaagtgagctctcctgacagaaggttcaggaacacaagcagaagcagaagaggtgcaattgctaagaaggagcaactcagagggtgctgaagagcaaactgaatgttaatgtttcagaacaaaggagtagaatgtttccagagaagaaaataatcaatattgacaaattcaccagggaggcaaagtaagataagaaatgacaagtaattatggacatggcaattaaaatgtcaattaacttagtacaagtagttttagtttctatcaaaaccataacatataaatcaatttattttcagatattattgacagactttcactgtcataaagagtcatgagttttatcacttgagtcattttaccttggatataaataactgattagagtgattcacagtttgaaaaacccagcccttaactatttgagatcctggtaaagaaagtgttagtatccagctgtttaaccacataatgtgaaagagattgccagtttcctctcaatattcactgtccccaaagtactccaattgtttagttactttgtcacccaaccaaaagaaaacgtttcctagcctccactgcagtcaggagaagttgaatgactaaattctggccactgatatgtggagcaaagattgctaacaatatgactacatatattattgctaattataagattatatagatagatcagcctcctaaaaattttgctttgttcctattccttcctttcctttttattgactgaaagtggcaagtggcaaaagcagcagcaaccttgtaaccaccatgttgctagaaccaccttactagcttagctctttggattgcttcatggagcaaagtcctacctaggtggcactgtattttgagctctttttattaagcatactgaccagtttcctaaatattacatctaagtaaccatgttgtgtggcatttccaggaaactgccttaaaagggagaggactccttcttttaatcttcactccctttcctccttcctggactatggtttttgtaagcagagctccaacaatgcaggtagaacgccccaggaagtgaccctgggaattgaagccatgtttggcagaacaacgagacagaacaaacttcagcctttgattccatggaaccagcatacctgccctgaccaacttacctctggaatcatttttcctttttaagccactactgtccatattttgttactttcggcctaacctaatcatttctgtggcatatatagtgatatgaaaatgaatggaaagatggacaaaatgacatagcattgcttcccatggccaagacacacaacaaaactaacgttattagatccatttaataggaaaatgagacataagaacaaacatttgttaagattttatatttatcatttagacagagactataatcttcacagtaaccctacagggtaggcaacatcatcactattttaaagaaattgagacctagtaagggagagcaagttgcttggcatcactcagtgtgtaaatgacagaatttgaactcacagttctcatgaacaaaacccatgctccattctatgccttatcttatttccacaatgaaaaaagaggaacagaaggcaaattaactagaacaaaaattgcttttgcacagatacaaataactctgtttcaatcagaataaaaggtttcctgactcactctagattcacagggccttgtttttcttttataacctcaagttaccacacttttaagaaataaattatttcgtaagtttataaaatagaactgaattgtgtagttcccagaagaatttcttagagcagtctgttcccctgaatcaaggtgaaaaacagaccctgttatgtgtaatgtacgcttcttatttttatcctggaatgagtgcttttttcaaatgttgaaggttgggactaaaacacaaccacctgggccactaaaataggtcctgctgccactatttctgttatttcagattctacttggaatttctcatttttcaatactcttggaagatcctaaatgctaacttcgtttattacttagaaaggaaaagacttgggagtgttctctataagtttcacaacttgtctgaatattaaaacacggcaataaatttattaatggtaataaattgcatcctaatcttttcagtgaagtcatgcaaattagcacatgactgtttacttgtgtaataaaaagtcatggctttaaatgaggactttgactttaaagacatctaataaactatgccttttttcattgtcatttaaatccttcctccatcattgttttattcattcaacaaatgttttttgagcacctacaatgagaagcagtaccatgtaatggtcaagagcacaaactgcatttcaaatcctggctcctctttcagttggctctttgaccttggtcaagtcacttagcctttttgaccctccattttctcatctgtaaatcaagataatagtattatactttcaagagctattgtgagcacaaaatgagttaatatgaggattacatgtatacataataaatatataataaatgtttatgaaaaatacatacctacatacatatatacatacaatatactgagctttaaagagctgggatatagcaatgatctaaacacacatattttgttcccatgtaacatatattccaggcagacagaggcagacaataaacaaataattagataatagctcatgtgtgataaatgttctaaggaagaataaaggagataaaaatagagaatgatggtggggcactattttttttacagaatggttcagaaaggatgctgtagaatacaatatttatgtaaagataaaaaaacacgaggaagccagccatgctgatgaaggattgggcttctaggtaatggaaacaaatacagaggtcccgaggtaggggcgtgcttgaagcatatgaaggacactgaagccaatgtgtctggagaaaagtaagcaaaatgaagaatgggaggagagaaagagacaggaatagcagggtcttacggtcataaaaggctttgtagccaatggtaaaggcattggcttttacccaaacttgactgaaaggtctagcaggatttacagccataccaccctgaacgtgcccaatcttatctgaaagatcttgcaggactttgagcagaggatggatattatttaatacagatttgtaaaggttccctccagctgctctgtaggaaataaatcataacagaggggcaaaggttgctaaaaggagaccaaagtggtatatattgcaatatccaggtagatagaccctagaaaaatacttgcatatatgtacaaaaaggtatgaacttagctgttcattctagtattgtaacaaggaaaatttagaaacaacccagctatctgtctatgaggaagtagctaaataaattgtgatatactaaatgtcacatattatctattaatagcatattaataaatcaaattccatgacttcaataagagtaggcagtggaggtgataaaaaaaatttggtgtaatcctggatatatttccaaaacgtagcccacagaatttgccattggagtggttgtgggaagtaaaagaaataaaggagtaaagatgactccaggattttctgtcctgagccagcaagggtatagttgctctactgagtttgtgaacattaggagagaagcagaggattcctgggggagtgggaggggatgtggttaaagaattcagctttggacatgttgaatttgacatcagagagtatggatataggagactgaagttcagaagagcaatctgagcaagatgtccatgtttgagacccatggtgtattcatggtattgaaggccatgggtttggataagatgaaccaatgcagtggttctcaaacccagctgtgcactagatttttgatcaactaagtcagaatcacaggagtgggacctagacattatataatttaaaatcctttgggctgagaaccaatgacttaagcaaacagtataaaaagaaaagaaatggaaaaaatttgaagagaaaacgcccaaaatagaaaatactatgggttggcagtgcatggtggctcacccctctaatcccagcactttggaaggctgaaggggtcggattacatgaggtcaggagttcaagaccagactggccaacatgatgaaaccctgtctctactaaaaatacaaaaattagcctggcatgcctgtaatcccagctaccagggaggctgaagcaggagaatagcctgaaaccaggaggcggaggttgcagtgagccaagatcacaccacagcactccagcctgggcaacagagtaagtgagacttcgtctccaaaaaaaaagaaaagaaaagaagaaggaaaatgctatgggtcaacaaatttgaacagtaaattgtcaatactaaagttgaagattcacatacttttggctcaagaatttacttttaggtttataaccttagagaaatgcttgcatatatgcacaaaaagatacaaatttggctgttcactatggtcttgtattaggaaaatttaggtacagtccaaatatatgtctataaataaactgtggtaacttaaatactatatattatatattaatagcatataaatgcaatataataccatatagcaattaaaaatgaatgaatttgatctatatgtatcaatatagattaatattgaaatcacagaatgaagaaatctagctaaaaaacatagatatatttaatatatattacatagtttatatataaaatatgtatttttatatatttaacatatattaaattatatttatataatttacataattatattatataaatatattaaatatgcaatatttaatataggttttaaatctatgtattttatatatttatatacatttcatattttacaaataaaatatatttttacatagggatataggcactcagaatttttttcatttgctttagttggattttttagtttagtttttttagtcaggtttactgagatataatttacatacagtaaaactcacgtctttaattgtacagtgcaatgaggtttaagaaatgggtacagtcatgtaaccatcaccataaacaaatataatagtttgatcactccaaatgttttcctcgggcttctgtgtagtgaatccccttacccaaccccagcccctgaaaaccactgatctgattatttctctattgtttttttttccagcatgttatataaatggaattatatagtatgtaagattttgtgtttacttccttttttaatttttatttcagtagcttttggggtacacatggtttttttttacatggatgaattatatagcggtgaattgtgaggttttagtgcacctgccacctgagtagtgtacattgtacctaatgtgtagcttttttattcctacccccatcactctcccccttctgaatcctcaaagtccattatgtcactctatgcctttgcatactcatagcttatttcccactcataagtgagaacatacagtttttggtttttccactcctgtgttacttcacttaggataatggcctcatgcttcatcgaagttgctgcaaaagacattatttcattcctttttatggcttgtgtttacttcttttacctagtaaatgtctttgagatttatctgtattgtctcaataatttatttctttttattactgagtagtgtccattaaatgcttgtagcacaatttgtttatctattcaccagttaatggacatttgtgttctttcaaatttggggcccttatgaataaagctgctgtaaacattcaagcaccagtttctcttttgacatatgttttcatttctcttgggtaaatatctattaactttataccaaatatttttttttttttttgcaaaggatctgtcatgttccacagaattctttgggaatgaagtagtctgacttctgacctggcaggcacaaggtccaaaaggaatctctccatacattatgaaaatagattttaaataccaaatgggcattgtctttgggctaaatatacaatatccgtgacatatacctactactattttcaaacataactattatgctgaactaaaagatacaaatttatttcaaagcattaatacattcagggcaactttgccattatgtgtttcctaatcactggatgtgaaaagcataaccactatcatatttgagtctatgaatcttttttactttattaatattaaaaaagatagggaataatgcctagagcagaaatgggttgcttcaggatcacccaaggtactggttctcagcctccacccctgacctactgaaacggaatctaatataaagcaattataataatagctaccttctattgagcacttactacttctagcaaggtgctaattgctttacataatgcccttcattccatccccacaacaacccagtgagtcaggtgctattactactcctgtgattcaggtgagaacattgatccctcttgactcaacgtcaagtaatttacccatggttgcacagtttgtaaaaatccttatttttattcatctatctctgcctttaaaaaaaatcagtagtaaaaccattacaatgatacaagactatgagtagagctgaggaaattactttttaatccttagataaggaatcaattatgagtaaaaaaaaatgagtgaaaaatatcagctaaataatggaaatgaaaacaaagagcaaaatcttcttccaatctttgtttccaaaataaactcaaaagtgagattaggaggatgcagctgatattgggtccacaggcaaaaagaagctatacaactgtgtccagtgcaagagaccaccaatcaatggggaacgtgtttcaacctgacaacactgcagcagttatttctgtattctaacttacggaggttccaagaaaagagagttgagaaagatggaagaaggagaagttgatcagggaaggggaaacaagagagctgagctctcaggcaccatctgctcagattccagtccaaaagatccttgggcattgatggaagtgtctgctgcagcacccaggactaagtgaaccacattgcccacagtaccaaggcaatcaccttctattctttgataagcttacttccaccccaaaacctgatcttgcttaaccaaatccacttattccaatcactcatagttgcataaggaaagaagacttacattaggctttgcttaatgtagttcctttgttatgagtcatggcactaattaaacctaagaatttttaaaatatgaattcatgtagtgtgaagcaagccatttcaaatgttattctcagggatagttaatcatttacatgtgaagtctacagatgaaacaaatgacttgagtcgtttagagggagtaattgcaacaaaagtgcctcatcgtgatcaaagtgatacctctttttaatcattagtatcccttggtaagacacttaaggattctcaaccctcagttctctcatcttaaaaattagtccagttaatctctaaataattctttaattttaaaatttatgaaataaccaaaatatgaacagtagtctttaggaactgggacaattgaaaaacatattttatattttctacaattttaaactttttctactggacaaatattactcttctaacaggaaaatctacctttatttgaatccatggtagtgattccgtggccagaaaaatatcccccagtccaagaatacatcttgacatcattgactattttcctaaagttttgaaaattctaagtgtatttatacttaaaaaaaaaacactacaaaaaccaaatacttggtgctggcctgatacttcattttttagtttattccattgaggcttatttgatcattaggattctttgtccatttccagagcctcttccttggtacaaaagccttccgtggacaaagccagtgtgacctgtctactcaccgattacactcactgccctaatcctcatgcatataggattgtggagtttcagaaagtcacatattacatacagacaattcattgatcttaaacaagaactaaaaacagtaggagtttcgaagatagattggcctgggtaaaattctgattttgccactttcttgctgtgtgacttggataatccactgattatcttcatttagcttccaattagcttcatttccacatgcgtaaaatgagaattacagtactgacctcatatactgttgtaaggaatacaatgagataaaacatataaaatatttatacaatgcctgggacatacacgctcaacgttcccactacacaattcttatgaaatctttcaacctcccatcagaaaacagaagagctagcttcagttgcacctatatgatgccaaacacagatgaaaatgaataaagtgatataattgccaaagtttctaaacatttgtgttacacaaaaaggatcattcaattatgttgtgttgagacaggaggtagtgttttatcttctgcagtagcaaatggaagttattgactcctctgagataatataaaatccaaaaatatttaagaaataataaaataaacttagcttaacatttacctacataactttcggaaactgatataaatgcacctttctctgtgctctccattcatacagtatagttaaaaactatttttctcctatcctataagtcaaatagagattttaaaaatatttaaaatgataaaaatgagacaatgttggaatactactgaattcctcagagataggcacaatacgcctaaaactgcacatgttatgaacaatattgataactactgggagactttggcaaacacttagcagctagtgtgctgcaaaaatactctcactcttcaaaaaatctatttttttctctccagcaacaagaggaatgctcatgcacccaacggaggtgggtgccaaattgtttcacctttgacattccccttccccagtctttcacaaattctcactctcagccctaagggagtgtgtttgggcttgggagttgggacaggctctggagttgttggcaaagataaagagtattgaaacgaaggcaagtgagataagaagggaaagaaaaagaagaaaaaaatatatcataggacaggtgaagaaatactctccacttatcattttaagttaatttaaaaaagggaaaggggaacccaaaaataggttctgagctgcttactatgatgcaaattaatctcattcacaccccctaattcgctgggcacttccaagattctcctgaaaaaaatcaatatttttttaagtgtttatgaataaggggctcattgattttaaaatttgacagcatgtaggaaaagaagactggttagcagaatttaaaatagaaagaatcaaaagcctaggttagagttatatccttcaagtttagacaaacttagcatctagctttatttacatttcaatgaatacttgggacaccttttatgatgaatttacaggggtccccaacctcctgggccacagactggtaccagggtctgtggcctgttagcaaccgggcagcacagcaagaggtgagcaagcattacctgctgaattctacctcctgtcagatcagcagcaggcattagattctcataggagcacgaaccctattgtgaaccgcgtatgcaagagatctaggttgcatgctccttgtgataatctaatgcctgacgatctgaagtggagctgaagtgctgatgctagcactgggagcagctgcaaatacagattaaccttagcagcgaggtttggctgcacagagaccataataaatcaactgctttcaggctcatatcaaaaccctatcagtgagtggcaagtgacaaattaagctgcatctggtggcaggctttacagtgacgagtgagttgatgtatttcaattgtacagctgcatttaatgtcaggctttaagtcagaatcagacgcattttattccgcttatggcccgcccattattttatttaccacttccattcatgcctctttcccacactgcacacttgtctcagtcacagttttggtaagcccacgagctaaccctagccacagtgagtaaaaaacaaatatcactggagagcttcttggaaaaggggaaaagacccagtgatgagacagcagaagactctaagactgccaacaaaaagttgcatttaaaagaagataccgagacttaaattacaggttcattccaacaggtgattcacattctccaagctggctttatatatgtggtgactggctacccaaagaagccatgaaaccttcaaaacttcttcaccacatgcagaccaagcaccctgcattaaaagacaaaacttttgcatctttcaaaagaaaaataatgtgaacatgaagaacggtagcaattattgaaggccaccacttcatcaaatgtgtctgcactgagagcatcattctcagtggctaacggcactactaaagcaaagaaatcctttactattggtgaagagttgatcctgcctgctgctaaggacgtttgccattaacttttaggagaggctgcagttcaaaaggtggcacatgttcctctttgggccagcaccatatctagatgaacgatgaaacagcagaggatattgaggcaccacagttagagaggattattgagtcactgtggtatgcagtccaagttgaggagtctatcagtgttgacaacaaggcaacaatgcttgtttttgtgtgatgtattttttttcaggagcatgtgcaggaggatattgtcatgcgcttccgtgtgaagagaccaccaaacaggctttgtgtgaacaataaaggtttttaatcacccgcttgcaggcaggctgagtctgaaaagagagtcagcgaagggagataggggtggggccattttataggatttgggtaggtagtggaaaattacagtcaaaggggtttgtgttgtcgcttggctgcctcttctctattattgtacactttgaaggcaaagttaattaagtcctgttgtggggtttgagggccggaatctaatttttggagttttatttaatgtcaggagcggattgagtaataaaatgcatattgagaataagacggccttctgaccttttatgatctagggctgtaaagcgtctcagggttgctgccaaacaagccatgaactgggctgggtttttatatttgatgaaaaagagcctaaacactaactgatttgggagaggtcagctaaagaaaaaggagcattaaccttgactatgcctctagctccaaccacctctttaagaggaaattgttgggcaggtcggggagggctagtcgccgaacaaaaccataagccagaccaggtgtgaggagggcaggtgatagaaggattatagggtgggagagccgaggctgaggaagaattagagcctgattcagcctggtggggagtgacctgaggaagagcagtctggggaggaggggagaggtcagatggatcagtagaaaagggagattgaaaagactcatcaacgctttggggttgggactgagggacaggtgggagggaaaggaggaggatttgggacgagtctcattgggaacagagactagggcatgaccgatgtgtcaaagaatgcctggacatcaggcacctcagaccatctgcccattttatgacaagaattatctagatcttgtaggatggagaaattgaaagtgccgttttctggctatttggaacaattgtcgagtttgtattggggtcaagcggcattgcagaagaaaacaaggcatttaggttttagatcaggtgtaagatgacacaggctaagggagaagaaggaggaacggagggtggaaggttgcccatagtgaaggaagcaagcccagagaaaagagagggcagcgacacggagaagcgggtggtgagcagccctgggctgcaatgtgggtgagctgccaaagtaagcgtcccggcaattgatttgccaccaagggaatgtgggtgaatgactaaggcaggcatccctgcagtgatcagacaccaatggagtgtgggtgaataatcaggcgggcgtccccgcatgattaaacaccaagggaagactgtcttcctgagtccgtgaccggcgcggagttttgggtccatggataaaatgtgtctccttatctctattagagaggaaaaagaactgaaattggaaggacagggagattgaagggtagtgagagagggagattcaaggatagcgagagaggctggagaagagagtgaaaagaggccgcttacccaatttaaaattggtgagatgttccttgggctggttggtctgaggaccagagatcataggtggatctttctcacggagtaaagggcagaaggacaagggattgatctcccaagggaggtcccccgatccgagtcacagcaccaaatgtcaggcacgtccatgtgaagagaccaccaaacaggctttgtgtgagcaataaagctttttaatcacctgggtgcaggcaggctgagtccgaaaagactcagcaaagggagataggggtggggccgttttataggatttgggtaggtagtggaaaattacagtcaaaggggattgttctctggcaggcaggggcgggggtcacaaggtgctcagtgcgggagcttctgagccaggagaaggaatttcacaaggtaatgtcatctgctaaggcaggaacctgccattttcacttcttttgtgattcttcagttgcttcaggccatctgtatgtatacatgcaggcttgggctcagaggcctgacagatatgttgtgtttacttttgttgccaaccaacaccacagctgcagaactattcaagtctttatatgattacatatcaggaaaactgaattgggcgttttgtgttggtatatgcacagacagagtggctgccatgactggatggctttctggtttcactacccggatcaaagaggttgcttctaaatgttagtctatacactgcatcttcctatagaaaaattctggctagctaaaaaatgtcacctgaccttaaccatgctttgcaggatgtgattaaaattatcaaccacattaaagtacatgtccttaactcacatcttttcacacagctctgtgaggagatggatgcagagcacaagcatcttttcttatacccagaagtgagatggctttctaaaggtagatcactgaacagagtttctcagttaggagagccactccagagatttcttttagaaaaatgatctccattggcagcacatttcagtgacccagaatgaatcacaaaacttgcttacttgtgtgacacattcaacctgctcaatgaactcaatctgccagttcatgggagaacaaccactgtgttcaagtcagcagataaaggggctgcattcaaagccaaattggaattatgggggcaacgagtgaacattgggatttttgacatatttcaaacattagcagagattttgaaagagactgagccagggccttctttctcccacctggttcgtgatctcctatctcagctttcaaaagagtttgagcattacttcctaaccacaaaagacccccgaaatggaaaggaatggatctgcaatccatttgtgaataagccaggtgaatcgactttgtctgtgctagaagaggatcaactgcttgagatcgcaaatgactgtggccttagaagtgtgtttgagacattaaatctccatatgttctggattaaagtcaagatggaatatcctgg

SEQ ID NO: 418 - DNA, 20001 bp, Homo sapiens
taatacctcaggcagtgtgcattctggtataggcccagcctctaattgtgtgaccttggacagctaattttgcttccctagacaccccagtcccttcatctgaaaataagaacgtatcatgggatcatctcaagtgtatctagagctctactgttctaggattcaacgactggtaaatctacaaatataatattacatgatcaggattaaatgaactctaatgggcaaaatgcatgatgtagtcatccaaatgctaatattgtaatgtggatagaaagaacagattttaagttcaccaaaaatgaaatcaaaatggaccagacatattaataggagctcaacttcatttgtaattttaaaatgcaaataaatacaatgaaataccattttcacctatcagattagcaacaatgtaaagtttaaagatattcagtggtgactgagtgtggggaaactggtacttttaatgctgtttatatgaatggaaattggtggtcttctcaaaggtcaacttgttaatatgtatccaaagttaaaatacagtcacgctcacataacaacgaggatatgtctgagagatacatccttgtgcgatttcatcattgtatgaacatcatagtgtacttacacaagtctaaatgatacagcttattatatattatatacatataggctgtattgtataacttattcctcttaggctacagacctgtgcagcatgttactgtattaatattgcaggcaattataagtatttgtatatctaaaaatagaaaatatacagtaaaaaatacagtgtaaaagattaaaaatggaggccgggagcagtggctcatgcctgtaatcccagcactttgggaggccaaggcaggtggatcacctgaggtcaggagttcaagaccagcctggccaacatgatgaaaccccatttctactaaaaatacaaaaattagccaggcatgttggcgcttgcctgtaatcccagctactcggaaggctgaagcaggagaatcacttgaatccaggaggctgaggttacagtgagccaagatcgcgccattgcactccagcctgggtgacacagtgagactccatctaaattaaaaaaaaaaaattaaaaatggtacgtctgtatagcatagggcacttatcaggagtggagcttgcaggactagaagttactcagggtgagtcaatgagtgagtgatgagtgaatgtgaaggcctaggacattactgtacactgctgtacgttttataaacactgtatacttacgttacactaaattgattttttaaatgttctttcttcgataataaattaaccttagcttactatcacttttacttcataaattttactttttttcaaacatttgactctttgtaataacacttagcttaaaacacaaattatacagctatacaaaaatattttctttctctatatctttattctatatacttttttctgtttctagaaattttaagtattttttacttcttaaactttttgttgttttgttttgttttagctacagggtctgctctgtcatccaggctggaatgcaagtggcacaatcaaggctcactgtaacctcaaactccaaggctcaagcaatcctctcacctcagcctcccaagtagctaagactacagtcatgagccaccatgcctgcttgattttttaaaaaaaaattttgtaaagacagagtctcaccttgttgcccaggctggtttgagctgctgtcctcaagcgatcctcctgcctcagcctccaaaagtgctgggattacaggcgtgagccaccatgcctggccaaattttttgtttaaaaacgaatacaccaacacacacattagcctatgccaacacagggtgaggatcatcaatatcaccgtcttccacctttatgtcttatcctactagatgaatttcagcaggcagtaacacaacacggagctgttgtctcctacgataacaatgtcttcttctggatgcctcctgaaggaccgatctgagactgttcttaaggaggtatcactcttttcagaaagatgctcatggtggtttgtttcttttttcatgttagatttgtgtgagtctatcatgggctacattatgaaggctgtgacttcacccagcaataggaatatttttagctccattacaatcttgtgggatcacccttgtatatgaggattgtcattgaccaaaacattgttacgcagcgcatgatggcaacatatccttgaacacaaaatttcacttctgggaatttagcttatggatatacttgcaaaagcacactaagctatgtgtacattcctgtacattttcaaagagaaagtttatatcattttggtcatgttaaagacttgggaccggtggttatattcctgtacacatagcatagtgtgcttttgcaagtatatccataaactgacaggacagaattgtttgaaaaacaaccatgaatataacataaatgctcattaacagaaaagtggttaaataaattatagtatatcattttatgaaaaatttttttttttttgagacagagtcttgctctgtcacccaggctggagtgcagtggcgcgatctcagctcattgcaacctctgcctcccaaattcaagggatttttgtgtctcatccttctgagtagctgggattataggcatgcaccgccatgtctggctaatttttcttttctgacggcgtctcgctctgtcgcccaggctggagtgcagtggcgcgatctcagctcactgcaagctccgcctcccgggttcacgccattctcctgcctcagcaacctgactagctgggactacaggcgcccgccaccacccccggctaatttttcgtatttttagtagagacgggttttctccctgttagccaggatggtctagatcttctgacctcgtgatctgcccacctcggcctcccaaagtgctgggattacagctgtgagccactgcacccggcctaatttttgtatttttaatagagacagggtttcaccatgttggccagggtggtctcaaattcctggcctcaagtgatccacccgcatcagcctcccagagtgttgggattacaggcgtgagccaccgtgcctggcccattttatgggatattatgcagctgtttttttgttttgttttgttttttaactttgtgtgctgatagggaacgatgccaagaatattattaagtgaaaactcatgtgggagagcaatatgcataatatgatacaacttgtgaaaaaaaaagaaaagaaaagaaaagaaagaaaggaagaaaaaggccagtctgcgccccggaccgactctccttccgtcggaacgaccctccttccgccggagccgcgtggcctcatggaaggcatggaggacgccggagaggaggccggagaggacgccggagaggacgccagagagggtgccgcagcgccggcagccagggtgcacttccgcgtggcgaggttcatcatggaggcaggtgtcaagctagggatgcagtccattcccattgccactgcttgcaccatttaccctaagttcttctgcgagaccatcctggacgcctttgacccttacctgattgccatgtcttccatttacttggccggcaaagtggaagagcagcccctgtgggctcatgacatcatcagtgtgtccaacaggtacttcaacccaagcagtgagcccctgggattggactcccgcctctgggagctccgggacagcattgtgcagcgtgagcttctcatgctgagagttctgcgcttccaggtctccttccagcatccacacaagtacctgctctactacctggtttccctcaagaactggctgaactgccacagctggcagcggacccccgttgccgtcactgcctgggccctgctgcgggacagctaccacggggggctgtgcctccgcttccaggcccagcacatagctgtggtggtgctctacctggccctgcaggtctatggagtcgaggtgcccgccgaggtcgaggctgagaagctgtggtggcaggcgtttagtgacgaccttaccaagccaatcattgatactattgtgtctgatctcattcagatttataccatagacacagagatcccctaaggccctggcccaggcctgcccaaagagaagcccaggatggtcagctgcctggggacattgccaccacatcgctatgatggctggtccccagaggaccagctgggaggactggttgtgctgctggagaagggctggtgaaggcgatgacatgctgccgctttgacagtccctagcagtcacggtccagatgatgatggtagctgtgcctccagcgggcaggccgggagcacactgggtgcagctgacccaaaggagccacatctgcttttgtcctttgagaggactctgactacaatagaggcatgatgccaataaaaggaaaatcatgttatcgatgacactgaatccctagggattttttttaagccagatttatagcgagaatgaatgtgcaatgtggctgaaatctattttgtgtaaaaaaaggtgatgcaagtcaaaaaaaaaaaaaagaaagaaagaaaaaaagaaaaaggccaggcgcggtggctcatgcctgtaatcccagcacttggggagccggaggcgggtggattacctgaggtcaggagttcggaccagcctagccagcatggtgaaaccctgtctctactaaaaatacaaaaattagcggggaatggtggcacatgtctgtaatcccagctactaagggggctgaggatggatggatggatggatggatggatggatggatggatggatgattgttttcaaagagaaattttctagaactatttaccattttggtcatttaaagacttgggactggtggttagaggatgggggacacatcttttgtttctcatttgattatactttctatttgaattttttttaccatgatcatttacatgaataaccacatgcactctgatgccttgcgggggggatgttagccctgaggccagtctggaccctggctgccagtgtggcatacaggagatgatgggactctgtgaacacaagcaccactgtggtttgagtatgtccctcagagtgcatgtgctggaaatgtggtccccagtgtggcagttggaaaggtagggactttaagaggtgattaggtcattaagaggaattaatgctactctccagggaatgcgttatttctcatgagagtaagtgagctctcactctctttcaggactggattagttatctcaagagcacgttgttataaagtgaaatagtccctatgttctgcctctgacttcttcctttctgccatgtggtatgctaatgctgtgctcttggactttacagcctccagaactatgagcccagtaaactctcctttataaattacctagtctcaggcattctgttatagcaacagaaaacacactaagacctcccttctggtgcacaccttttattttttcccttcccagtattcctttccccttcttttagtaacaggacccattttcctttctgcaactgcttttcttccacctctcagtccatgtttcaggttgggaactggactttgacccccagttccaaaggtgggccttgaccttgggctggccagggcaccacagaactatcacaatggcttcaaggaggggcactggctcaagcatgaccaataagaacatcctccagtacttcagctagtgctcctggaccaaggctctccccttccctctaagtgcgggagtactagaacaaatgtctggaactgctttgaccattgttgccacgactgggtggatattttcctgaaaataaagcaaaacagaggaaagcagagcttatgtgatgagagacagattcctgtggacacagagcacctggatccagccatgcagaacccttcttaattgcttttctgttatcttaaactttatatgagctaataaattctcatttttccttgagctggtttgaattattctattaatttcatccaagagtctctataaatgtaagcaccttagtaatttcttcaacagccagcagagcccatagtgcctttttaagcctttgcccaacggtgtggactcccaagcagcagcacttaccgtaaatatttttcatcattttgcttgtggtttccttatgctcccacccagtcctagtacagggtcgagcagagagcagaaactccttgaaatgtttgttgcatggggcaatcattctaattttcaatatcctaacattgcctctgtgtaagacacaaatatgtcttaaatatatgtaagacatgaatactttttgtgcctattttttttcttacattttgggtctttgcagatattaaaactttggaatagatgatgcagagcatagattcctaagcctcaactcttcttgcaaaacttgaaggaccaagctttgcaagaagagttgaggcttaggaatctatgctctgcatcatctattctgctgctctgccgcagaccacacaaagccttactcaaacctgctactctaatgcttgatgtctgtatatttataaattactataataaggcgagaattataaggacagaaaaaacctttaagtgagcagcccaatttattttttcttttatttctctcgttcttgatttctttctagtttgttaccaaattcttaaacattagcaatttaaaatatgttcgaaatggaaaaaattgaaaatggcctgttctctgaaagttcctagttcgtagttgtaatagctgttcaacatcttcttgtagccataagacaactgcagttccaggcgtagaaatcctgatcctgtttcagtggtcaacactcactaaatagtctcttactacccaagaaactgctgtatgtcacagggaaattcaataaacaaggtacacatcagtccattgcatctgaaacagcatattcactacttatcactcaaatgtgaattttttttcttttttggagatggagtctcactctgtcactcaggctggagtgcagtggtacaatctcagctcactgcagcctccttctcccgggttcaagtgatcctcccacctcaccctctcgagtagctgggattacaggtagccaccaccacacctggctaatttttgtatttttagtagagatggggtttcaccatattggccaggctagtcatgaactcctggcctcaagtgatccacccaccttggcctcccagagtgctggaattacaggtgtgagccacaacacccagcttcaaatgtgaatttctaacccatatgcaaacacaaccatcccagaaatgtgactggcaggaggaaccctcatccctcagtggaagatgttcccatttatctcctcacagatgtcaccaccacatgccctacttagtggccaggagttcagtgagacgctgctcaccacattaattcatcaagagcagggtcagcgctggctctgggcaccctgcacccgctcaccctctcactgtgaaagttcactgccagccacctcctcaaactgtccataaatcttgggagatttgggggctctgcctggggctcaccctaaggagacaccacacttccttgccacacctaccacagactcagagtcatccaacaagacctgaaacagaaagtgacagttacaacgagacaccttacgagggggtgtggtgtgcgcagtgcacagtgaagaggcatctgttagctctggacacacctctcatccctttgctgcaggacaggttggctgtgacccacagcaaatatagtatgtaacagcagccctaactgtgtctggctgtcatgacttgcaggagtcctggggaccaaaaaggctgtagccttcgcctttcagtgttcgatcttttggtatcaataaaatcaaaggcagacacaaaagggaattggaaaacccaagaggaaaataccactgatacatttcactcagctgttcctacggctccatgccttggtccattcaggctgctgtaacaaagtaccacagactgagtggcttacgaataacaacaatttatttctcacagttctggaggctgaaaatctgagatcagggtgccctcatggtagggttccgggagggccatcttccaggttgcagaaagccgtcttttcattgtatcctcatatggtagtaagaggctagagagctctctgggatttcttttataagggcactaatcccattcatgaaagctgcaccctcatgacttaaactacctcccaaaggcccgacatcctaatactatcactttgggggtaatatttcaaaaaagaaatgggagggggacacaaacattcagtccataacactccatgatacttatacaaggcaaagcctggccttggtggcagcccagtggattccagttgtgtgttcccagtgatggctggagaaaacactgaacccaagaataatgaaatgttggccatggtggcctacaaggaaaagctactggcaattgagccttgatcctgttttcaggatcaagatttgagaattttttgttaatgctatttagctcaaaggtatgcttttctcagttctgctctgcatatagtttcttgaatccactcctctttccctcacttgcgttgctgcacctgccctctgtgctgtcagttcttccttacttaggtccaccctgcacaccaccacctctacctgaatagcccctcatctgaatacatggaatcaggcagacctgtatttattcatgttactctcctcaacccataaaatatgttagcattatgatcagcaggtcaccacctgctgagatcacttaaaagagtgtgtgcatgtgcgtctgtgtgtgtgtatgcatataaagagtctgtgtatatatatatatattataaaaacagtacagtatatattgatcatattatgtaactgattcttcagcatctgcagaaaaaatctcaaagtcccttgtcaactcactacctgattctccctcatcactcatgaaacccccattccactgtactgcagctcatactactccatttgcccagaaagcctcctcttttttatttacctcagtactgaactgaaagcaccttgaaggaaggaatcattttatacccatctaacttgatgtttgagaataataggtgattaattcttggattgactgattgatgacttctcttcagccttgtgatacacagctcagagtccattgcttccataggagctcatcgcccacctgcctgcagggatcccttcctcttttgaacgggcacctattggctgtgcaatccattcagcaacacaccatgagatatcattcttttgctattgtattgtgccttttaaattaaaaaaaaaattggaaaatttttgtgggtatgttctattttttatgagtttatgcttaatctcttcagggaccatataattttttttccctaccaccatctctaaagtcttaaataggtctcacaaaaagtacaaacaatattcatccactataatttagaatattagtattattaattctagaatattagaattaattctaattatgtatcttgtttacttataggtaattgatattcattattaattaaaaccaaataggtttatttttacatgctagaattttgtaatttcacatttttttacactggaaagtcaagctttctcttttcatcttttagcaattgtgaatgacacatgaaacatgaccttttggtactgaacttagtactttatagtactaaatttataatactaattatagtactataaatagtgctaattatagtactaatttatttctaaattgagtactttatacacaatttagaaattgaagtgtaattcctaagattaggaaagatacatcgtctaattggtctttgatatctgtccatgtgcatatgaggatgtattattttgtgtctcaccttttatggtggccggccttcaagatggcccccagggattcttgcctcctggtactcatgctccaagtagtccatagtctcttcccacattgagtagggctggcctgcatcatcaataacgtatcgtacaaatgatggagtgtgatctccaaggccagatcgtaaaagaaaagacattgcagcttctcccttgctctctcttgggccactcactatggggagctaggtgccatgtcatgaggacacacaaagaggggtccacaggacaggaagttgaggcctcttgccaacagccagcactgaattgccaaccatgtgagcgagctacttggaagcagaccctccgcatcggtggatgtcagcggcctcaactgtacttgacatcacttttttttttttttttgagatggagtctcactctgttgcccaggctggagtgcagtggtgtgatctcagctcactataacctccgcctccagggttcaaatgattctcctgcctcagcctcccaagtggctgggattacaggcatctgccaccacacccagctcatttttgtatttttagtagagacggggttttgccatgttggccaggctggtctcaaactcttgacctcaggtgatctgcccacctcagcctcccaaagtgctgggattacaggtatgagccaccacgcctggtcaacatcactttgaaagaactggagccagaaccatttgtgttcctaacccacagaattgtatattatgcatgttcactgttattttaaactactaagttttggagtaatttgctatattttactatatgactaatatatctgaagatagaaatttttacttaatgtaaataataaaaagagagtttctatgacaaactagaatgctgtaagtacagatcaaaagagtcttgtgaaaagacaatcagggaaaaacaagtttcttgtagtgagatggattgagtgaacttatatctgaaatatgaagaaaatactttaaaactcaagcaaaaaaagaaaataatattgaagactttattatttgaggtcttactgatttgtttggtttgagaaaagagtccaggatacacataatgaccgtgacaggtaaccacaaaaagctgaaggggttgcctgtgtcactgccctagtccaagccagtgttctcacccaaaccatgatacagtaagagcctcccactagtctccccacaacctctactgccacatgtccacactgaagccagaaatgtctttttaaaattttttttttattttttagagatgggttcttgctacattggccaggctggtctcaaactcctggcctcaggtaatccttccatctcggcctcccaaagtgctgagattacagacatgagccaccacgcctggcccagatatatcttttcgatgtctgctgaatgtcaccattccttcaaaaaatattcccttgcccctcagatgaagcccttgagtagggtctcaggactgcatgctgtggccctgccttctcccccagcttccgtgatctctctgtgccctctagctctacaggctttctggaagtcctccaagtttgtcgtgctccctcccacctctgggcctttgcacatgctattccctctgtctggtacactccccaggtctcacctccaaaccacatcctccccttgaactctcctcagactctcatctttatctctcaaatctccgtgccatgggcagcctctcagggaaccctttgctgatgcccttgtccaggcaaggatctcggtcataagctagtagggaccttatacctttccctcccagctttggctgagtgagcaattatttgatttttgtgtctcccacagctgactgtgggcagagccaaccctactgggtttgtgccctgcacaaaggtgcccagcccaggtcactgtccagtaaagtcctgcctgggctctgcctgccaagctctgcctaggtctgtgtcacacagtttttggtttttctcttggggagatgaggggtggggatgatagtttatactggatactccatgagaacaggggtggcttctgatttaggtcaccattgaatccccaacagttagcatagggaagacactcagcaaatattgccttaattagttcatttagtaattaagggccagttcagtcaggacttatcttaatttgaggactgtctaaatttttcttgcctctaagtaccatgttgccctaaattactcgtactccattgccatccctcgagtattccctaaccacaaattcctctgggaagggaaacactaaatcaataacatcttaatgtgagttaatttatccaagattaaaaagtcaattgctttacaagacccccagaaaataaggtaaagaacatgtgagttgtaaaggggaagaaagttctagaaacctcccaatattttccaggctttgagctttttctctgacaagaaatagttataataagtcataagctataattccttttcactgtaaaatgaaatggttacttaaaattaattaagtttctaccatatagattgatcaagatgttagcaaccatattcctttttcccattctaacctttccataacatactttcaaccaggaatggatctaaattggggggggcctgaaactagtataattcagggatcttctttaagaaaaatgtataaaagtacaaatacaaaatacccatgatggttgtgggtacaaaatacccacagctatcccaaatcacccaacatgggaagaagtatgagagtggagtggtatggttaaaatttctcaccaaatgtcacacaaatatatgaccacgtgaaaataaatgtaatcacatacaaccgtgtgacacacacacacccttcccccggaggctcagaatgggtcatgcatggaaggagccctgcaaagtctgcctcggcattcagtaaatcctagttcagctctctctcagtctcttctaattcctgtggagagggcccatttcttattttatacacatgtgtcaaatgtctttttcagactccttttgtattattttctatctcatttttgtttagctctgtaaaaccttatgtttgaatcttcactatggtcaattacacaataaacgagtcttttgttttttaaataaataagtctttggttttagtcatctttgttgagcccctcctatgtaccaggctgtggtaagccctggggatacagccaggaacatgaggggcagggtccaaactttccactggtagttgtaggagaaagacaataaacagatagataaactatcaaatattagggagtgagaagacgagaacagcagggaatgtggtcaagagtgaacaggtgatctgggacagcctctctgaaaaagtggcatttcagtggcacctgagtgacaagaaagaaacaaccacacaaagctggtcaatttcatagattagtgcaaaagtccgttgatttgtgcaaaagcaacgagcctgttcaaggagcagaaagaagaccagtgaagccccacaagaaagtccaggctttggaggccagggtaatgagtttggattttattctaagtgcagtgggaagtttctgaaaagaactagggaaaaatgatgacatgacattttacatttttaagtaatcactctggctactgtgtagaggatggatttgtagtgggagcaagagtggaagcaaggaagctagggaggaggcctttcaattgaacaataggggagcttggggcaaagctatgcttttggtcaccagcagagtcccccctacgcggggccactcctccctcaaccactgtttaggcatttggtaggaccctgagaaaatacaaaaaacaactgccaaatacctgtctagcattgcctatgtttttccagatctatttttccaagtatcttctctgcatattgtatacctaaaaggatggaggatgagggagggtatgggagaagacaggaagccagctcactcccaagtttttctttaaagatagaaaaaataattcctaaattgggggcacaaaattagaatgaccccacccaacccagctctagagttaggcagacatagactcaagtcctggctccactagttatcagctatgagacctcactttacttctctgcacctcagcttcctgatctctaaaattgagtttgtttatagtatttcagtggggatttaatgaaatcatgcaagtaaaccacattgtttgttgctaggtaaaacataggcatgttcttcttcccccgcgtgaaaacttggccccaggcacaggttgctaatgcagtcacagcagacgtctttgttgcccttcactgtgattcaaccccaccattcttgagcaagtctttgaagcccatccaatcttaacagaactgcttttgtgggtgagacatctctaagaagttcaattgtgttttggaccaaaatcatttgccattcttctgttcctaacacacgggtctctgtgtgttgatctaacaaattggtagtgttttgagtaatacatcatgaggccaatggcaccttaacgatgtattacattaatatatcatcaaagccatggcattgttatgatatattactttaatacatcattggagtgccacagctttaatgatgtattactcaagaccatagcaacagctagaaagatcaagataagttttgtatttttaaaacttattctcagtaaatataatttttttttaagtttccacaataaaatatgtgttcaaacgaaatacgaggatgcaaggcctctgataagtaagcaacgagatgcttccttggtcatcctcctcccactgtctactacgtacctggctcctaagttcattttaaaccactttatccaaatctcctaaaagtaatattgctactgaatttatgattctataagtatcccagggatctccaatttaatgttacagctgcacatttatagagcagttgtttttccaatggtagcttaagcattttctacccacctttccaaaggattctacactgtccaggccaaaatgtccttcaagaaactcttgggcaagtttgattttttgtataagatgtctgaatcccctgtatctctaacttctcctccttgttggcatatcagtgtgtgtgtgagagagagagtgtgtgtgtgtgttgtatataacattgtatgtcctctctgagagatttccaatatgtaagacggatttagagatagacctaaatctcagatcttccatgtaacagccttaagcattcactatttttagcataatgaaagttgaccaagaaattggattactggagttgcaccaattgcaacagtatcagtatcaataaaaacaggaaaatgttttagtccgtatcctcatgacaaatcttgactgtctaacaagagttccactcacttgaaaatggtttgaagagcaatcacatgcttcctgtgtgcgtgtgcatgcacacacacacacaaaatgggagaacaagacattggggccagagatctgacctcaaagcaagccttcttaagaaggccctaatattctaatactcacactcccttgaattcaattgttaaaatttaattttccagcctgggcaccacggcaaaacctcttctctacgaaaaatacaaaaattagccaggcatggtggcgcatgcctgtagtcccagctacttgggaggctgaggcaggaggatcacctgagcctgaggaggtcaaggctgcagtgagccaagattgtgccactgcactccagcctgggtgacagagtgagaccttgtctcaaaaaaaaaaaaaagtttaattcttcagaaaattcagaattcgtgttatttagggaggggtaatgcagttctaggcagaggtgacagcctgcttctgaaatttctaagacatagctttatactgtcagtgtttttcacgttgtgaaatttagaagcacccaatcaaccactctgcaacaccccgatttctctatcctggtgtctttcactcttttcacagctttggctcaaatctgtcataccagattcctctgaacacctctcaggcaggaaagccttttctcatttcgagtgcctgacttgggaattgaattctctcaccctcttttctctcttcatctaggctgaaggactgcaagggagccagctgcatgagaatagattaggcgagaaatgatgattcagcacccacggcttcctgccatgtgctaaatgatcagtttagtctcaatcagcagataaagaaaaggcccggggaagggacaagaagattcgccctggcaaagggaagaatgacaaagatcttcgcatcagaaatgtgaggtttgcaataagatggtactgaagaaaaaaatgtgtcaaatggtttttgtcgtttgttcttgaaggtaaccagaggcaggaagccttgttgcttataaatcacaattaaccacagagctacaaggggcctctgagattagactcaatccccgattttacaaatgaggcacaggaagtgctgggtagcacctgcgattcctggagcacctttagagaagttcacaaattacattcagtggcgatcaaacaggagcatacgtttttctctgcccagaagggccaccccatcctcatcatctgtacttaacccaaaatgctcagtctaagtcccactttctccaggaagccttcctgactcacccaagcctgtgatgacttccccctgcctctgatcccctatagctgactgtcccttcattttcattatctgctactttgtattatcattttccctttctaagatgtatttgcccaataatttcaagttcagaaactttggaaagggtacatgcacctgccccgggcaggcagaagagtggtgggagcaggtgaagacacagcctttgggttgcaggagcaggcatgctgcaacatgctgtgtgcttctcttgcacagcaccttcacaaagcagctgtttaatacaggctgtccataaagtcaggaaacaaatcatataatacaattcttagtaaagattgaagatgttcctaatgccatcctgtatatttgcctgggtccagactttgtggaccacctgactatgttggttatttgtacaaatgaaggaagttctgacataagttcctgaaatcagagtgcaaaagaaaacgtttgtgtcccagaacttctggctcctcttttcaccattctactataatcatttctttttaaagttctaagttgaaatggtaccgtatcacttttatgtatagtcaggtatatgcagatatagttagatatatagagatatatacaaaactgcagttttatctttcataaataatagtttaaaatacacactaaaataaagactacaaaatacttggtaattttcatctggactcttcatagaaaattagaaatcaatggatttttctggaactcttattgggaaacagatatttctatatgcagtctcctaaggagacttgtctttttgtacacacataaacgagtaattacttctagtacacaaaagttcacactcatcaacagaagactctgccttaattccaacttttcctgcaaaccattcagataatcattcagagtcaactgaattttcatgatataagaaaaggcacattcattgcaaagcattcatctttaaatttgtaaaacatgtccttgtgagatgatattttcaaaaaggatctgccagctactctgttaatgtattgcatatattaacagaagactaaataccatagttttccaatctagcaagactgcacaatgaatcagtttcactaaacctaattccattcaccacaccgaatgtgtgccttcagcccttggagtattccaacgcactcaaatgcttgacaagaacaacacgaaaattgagtttcccgtcagggtcaggatgttgcatttttgcttcacatacaatgaacagattcctttcctttttcactttccaatgattgtgtgtgtcaggcagatacaaacaacagaactctgtacttccgaaatctcagcatcaatgcatacattaaatggaacaaagtgatgcccacgtgacacttttctgaggcaaaacacttctccccaggaaaaaaaaaaaaaacgtggtcaggcattatatgtttccccagttaccctcgtctcttcttgaccttccttcctgctggtgctatatcctttgttaccaagataacttgtttataaaagtgctgtatcagttactgaaaacaagtgacacatgatttacctggggtgtattacaaaagtaaatgccaggatcgagcaagaaactacagactctcctttctgaacattgacttctatcatgaagaaaatttgagcctataaaactgtcactaggatacaagaattacccccagagtaaaagtttgctatgaaaactacaaacattttaaatttctttcctccttttatgctctgtaatctctcgtgatgatacactgtttctggaatttaaaaatggattcatgggctgggcacagtggctcatgcctataatcctgggactttgggaggccaagatcacttaaggtcaggagttcgagaccagcccggccaacatggtgaaaccttgtctccactaaaaatacaaaaattaacaaggcttggtggcacacacctgtagtcccagctactcaagaggctgaggcacgagaatcgcttgaacccaggaggtggaggttgcagtgagccgagatggcaccactgcactccagcctgggtgactgagtgaggctctgtctcaaaaacaaacaaacaaacaaacaaacaaacaaaaaggatccatgtattacattattaagtgcaattaacacatcttgtaaaaacccacccctttactccattcacacggcactatgcaatccccataataagctctgttctcattcaaatcctgaccctggcttaggtgattcctcaccaaaatgctgtcttttcatcctttgtctggccaattattacttgtacctcaagtctcaaattaggctttgcttaccccaggaagcctctctcaatagtccagcgcttgacgagggtagatgattttcctacagcccactgcgcttttccttatcataccatctatcacccttcatcgtaaatgtctgcttccttctcaagccccctccccaggctgaggtttcttggggacaggtactccatctttcttactactatacactcagcacttaacagtgctgggcacatagcagacacactcactacatttttctggaataagtgaacatgatgtactcaatttttagtacatacaatgagaggagtggggaattattcctacacaaatagctgaacctcgattaaattctgctccccgtcatccagcatgttccagttccctgtcctctctccattccttaaagagacatggctggcctggcgcggaggctcacgcctgtcatcccagcactttgggaggccgaggtgggtggatcacctaaggtcaggagttcgagaccagcctggacaatatgatgaaaccctgcctttactaaaaataaaaaaattagccgggcatggtggcacgcacctgtagtcccagctactcgggaggctgaggcagaagaatctcttgaacatggaaggcagaggttgcagtgagccaagattgcaccactgcactccagcctgggagacagagaaagactccatctcaaaaaaaaaaaaagaaaaagagaaagaaagaaaaaggaaaagagagacatggctctttcttgcctaaaatttcatcctccaggtcttcatatggctggatgtttcttgccattcatatctcagcttaaaggtcagtgaggcctcccctggcctttcagtctaaatgcgctaccgaagcattgggtattgtttcacctgtcacacttctctgcatggctcatattactacctgatcttttatttctacatttat

SEQ ID NO: 419 - DNA, 154987 bp, Homo sapiens
tttaagttctaaggtacatgtgcacaatgtgcaggtttgttacctatgtatacatgtgccatgttggtgtgctgcacccattaactcgtcatttacattaggtatatctcctaaggctatccctcccccctccccccaccccacgacaggccctggtgtgtgatgttccccaccctgtgtccaagtgttctcattgttcaattcccacctatgagtgagaacacacggtgtttggttttctgtccttgcaatagtttgctgagaatgatggtttccagcttcatccatgtccctacaaaggacaggaactcatccttttttatggctgcatagtattccatggtgtatatgtgccacattttcttaatccagtctatcattgatggacatttgggttggttccaagtctttgctattgtgaatagtgccgcaataaacatatgtgtgcatgtgtctttatagcagcatgatttataatcctttgggtatatactcagtaatgggatggctgggtcaaatggtatttctaccttatagatcttaaaccaacagcagccatgctttcttgacatttctttgctgagagctggaaaaactggtttcttcactattcatgatacaatatagccaactatatgatcgttaggtaggcattaactgcagaaatcaagatggagttatttctacctatgatataataaagaatccatctaatctttgtcccccagttcctggcacagaacttcaaaaacgcttggaatttcctaagtgataggagtgtcttgttattcacaaagagtccttttgatcatatttgagtttatgttaataagatgactcatggtgggggtcttagtttcaagagaggggctggccactccagaaacaccaagcacatgatttagagagtggaacttatgggcctatccccaaacaccagagagagaagagagattggatattgagttcaatcacatgaataatgatgcaatcaattatgtctacttaatgaaaccccagataaaaactgatcaacagatcatcaagtgagagcaccctctctcactgatgtaccctgactccatggggacagaagctcctgtccttggacccttctagatcttgctttatgtatctctttatctggctgtttatttatatcctttataataagacaggaattgtaagcatcatgccttttgaggtctgtgaggcattctagcaaattattcaacctcaggatgaatgattggggtttctcataagagaaaccccaaatttgtagttgactgggcagaaatgtgggtagcctgggactccacttgcaactagcatctgaggaaagggcagtcttgttggggtcttgttggggaccttgccctttaacttgtgggatatgatgttaacttgggaagctggtgtcaggattgaacagaattgtaggacacacagttggtatcagagaattggtgtcagaatgtgttgcctcttcagcactctcaagtagggaggccgcaaaagggaccatacggcataagacgtatggtctcttagctctgtagtgactgctgtcaccttatatttttatagcaataggaaaattggtggaatattcacttgggctaagaggcaaagttcatagaatttgggactgaatgcaccaggggatgaagtccatatgaccattctgcagcaagatgactcttcaaacatccaaaaagcataatttctttgcaatctacttataatattcctaattaccatcccctccactaacacctccatccagcaatcatgtcaccccaactttaatctcaaccagagcacttattaccacttggcatgaaaagcacttgctgaagtcccaggaacagaagagtgacagacccacagaggttgcctgtcagattcgctagaaatggggaacgtgggtatcgcaatcaatggggatgatcacacattttcttacttttttcttcttttttattgtggtaaaataaaaacacttattattttagccattttaagtgtccaattctgtggcattaactaccttcacattgttctgcaactattactaccgtctatatccagaattttttcatcttcccaagctgaaactctgtacccattcaacaccaactccccattactccctctccacagcccctggcaaccagcattctactttttatctctataaatcagactaatctaggttttgcaaagaagttgaatcacaatatttgtccttttgtgactggcttttttcacttagcataatgtcttccaggttcacccatgctatagcatatgtcagaatttccttcctttttaaggctgcataatattccattgtatgcacacatcacattttgttttcctatttatctactggtgaatacttgggttgctttcactttttggctattttaaataaagctgctgtgaacatgggtgtataagagtatctgtttgagtctctatcttcaaatcttttgcatatatacccaggaatgaaattgctggattatatgatgtttttttaatatggtaattatatgtttaatttttaaggggaactaatatattatttccacagcagctgcaccatttttcttaccttttaaaaaatattttctctaggtttttaaaatggtcttatttatttacacgttcattaattcttagatatggggtctcactatattgcccaagctaaagtgcagtggctattcacagacagggtcataggacactgcagcctcaagctcctgacctcaagtgattgccccacctcaatctcccaagtagccgggattacaggcatatttcaccatgttcagcttaaaaattatatacttcttgtgtgtgttttgaattggcaatatattcacatgatacaaaacacaagattgatcacaaaatatctaccttttattcctgtctccaagccttttagttccccttctggaggctgccaatgttactatttaccagtgctctactatagcaccacaagtcaccccaatatccaagcaggtttcaaaattcaatctgaggcttgcttagtgaacagaaatgttttcaaactatctgctgtctgctcaaagaaggggttaatggagagcagaactctgaaatgcactgtacataatgaataacaaatacccttttaagatgagtattttaaaacaccaacatgttattatccaaaatgtataaaagtgtctctcttttcttttttggccttgagtactacattgaaagcattacctaatgcccactccaaaagattagatccctctgaaagaaaagagtcaacatgcataacacatcacagcaccatcctgcatcttttccatttgggttcacagttagacattccctggtttaagggaaagagcatttgcaaaatggctcttggggcttaattggtatttctttcttttgcctgccggaataatccaggagaggaaactgcaaagcaatttaagaacattagcattgttcctaaatacccgtccaaggttagtgaatacaactggaaaagcccaaagagcacctagggagattaagggaggttttgaagcagaacgcatgattctaatgaacttgggctctgcctcatggaagaagaatctatctaaatacattagggccaacagagcagacagcagacgggaggcagctacctaaatgcgagagatgctgttctcagtaagttgtgaaacgctgcaaatagatttcggtgggtttgaagccctgagtcgctatagggtgctaattatgatttccatactgttggcgagagagacactccccagcagggtgtcgagagccacaacatatgcactccagctgtcctcgtgaaccgcccccttgtacccctcacggcggaggtttctgcttggtttcctcctctcactgagcagatgaattaatttgtttgaagattggagaaggatttttggaaagaaaagagtccataataggttagtgccaaatagaaatcattttgcacaggatcattgttgcatcctttttactgcaatatgaatgttacctaaacaataagatgtatagagtcaatatgatcgcatttcaacacctgcatccaaaccacaagaaataaaatgttataggttttaaacaaatctcatttttgactcaacaggaagtgtacctgatcttcctgttgaggttttttggtgaaggggacatctggcatcaactgtccagagccagacaaagcttcacaggttgtgggcaaagccctccacaaaactgttctcacttcagataccagttgcaaattctggagtccccaggccttcctccctgctgaccaactgcctataaattcagggtttatcactatctcttcaggtttcataatttgtcagaacaacttacagaactcagaaaagcactctacttatgattatagttatagcaaaagaatacaaatcaatcagaatcagccaaaaggagagacacatacagcaaagtcagagaggatctcaaatgtgaaacttcctttgtcctctcccatgcattcagggtgcatcaccctcctgataagtgataatacagagtattacacacagctgagctcggtgtccatggtttttactggggcttcagtattcaggcataaatgattaaaccattgactatatgactcaatctctagtcttttcctccctaaagactagttcaatatcaaggtagctgaaagcctctataatctcatggttggtctttctgtcatgaccagcctccatcccgagtcttttccttaacataaactacctacagccctatcctgagtcacctcataagcaaaacctatcatgacctaccattaatagcaaagacactcttattacttaggaaattccaagggtttggaggctacctccacaaaactagggacaaaacccagccaaatccttacagggacagaggaatgggattggtgggagattatgaggtcatccaggaagcaaaaactcaagttctagttagagtttattatatcttctcacgcaggttacttaatcatcttgggttttacatctcattcttttcacttacagcagtaattactgataccatttaatgagtgcttactatgcaccagatgctgtgctgagaactttgcctacttaatctcatttattcttcaccataaacttgcaaattttgtcattttattatctctattttgtaaagagtggagaggtgatagagatttcaggaggttaaataacttgttcaagtaattggaggagctgtcactcaaccacaactgtgagtccaaagttctgattcttaagtttccattcataacactatactgataattggcttacaggcatattgggaaaataaattagaaagatatatgaattattataatctgaaagggaataacctcatgagtcaaggttgtaagattaccattattattatgtcactgattattactattagcaatattatttcactttcatacttcacatgaatctgtctacttattataaaagtggtttctacttactatatgagttcctattataaggaaagaactctcttttagagagaaagcaagtctttaaatcataataaacaaaattccatgtagtttctgaaacatttgttaagtataatacctactatgtgccaactcgtaatgtgcaacttggaaggtatagaaagatgggtaagacatagaccctcaccagcaagacaagtgtgcatagaataacacaactcaaggcagaatgtaataagtgtccaaacacacacagaaagccctctgctgattcagaggagagaaagatagcacacaagcctcaagagatcaagaagaatttcatatccacatcttgaaggacagacagaatttggagagacttggatgggtaagaagatgggattcctgaagaaaggaatctagtagcaaaattagaccaggatgtatcacacttataatacatcagtgggtgacaatacagactattaccaatcaagcaagctcagcagagcttctgtatccacagtttttattggagcttcattatgtaggcgtgatttattaaaccattggccatgtgccattaaaacaggtgcaattcagaatgtttgaaaggatgggaatgagtgtatagtttagtggtaacatatttttgtgagataaacacagcatttaaaattttaaaaaatttgcttcatcataattttattagctttactatgttgagcaaagctctaactcctccagcaccactttgcccattctaaaaatgagggtagataatgcctagctcttaaggcttttgtgggagttaaatgagaaatatattgaaaaactcatattctgtgaactaaataactttaagcaaatacaaggttttacaatttctgttgttgtttgtttggattaaaggaaaccagccaagctatgttaaacaatatcaatgaaaaaaatattggaaccataccctggaggttggggatagtgtggctaggatgccagggtgaggaggctgagctttgtccagtaggaacagtaggcacgaagaactcagttcatgtcatgttttcagttgttttgttttggtttggtttgttgaaggtgattataaaagcattagtacttattatttcaagaatagcaagcattaactctgagaaaaagtaaaattgtttatctgaaattttcagtgaggataagcatggaatgtggtgcaaatttgtctttgaagattatttgagcaggtttactttttcagtggtaacactttggagaaaagacaaaaggttaaatacacttacctggcttccccattaccccatctagaagtcagagtatgagtacgatggtctgtgaagacaactttcaggctgagaacttgaagcacttccagcaataactctagcagtctgcataattatctttctgcgtcacagtttgccttatctagtccttagaagctgagggaatgagaaatatgactcctcatttggctccataggcagagttgtggagagtagagaaaaatatttatcactttaaagtgtccaaaatattcatgtacaattaattttttaataagagatttcaaagagatttaccttaagtaagtctgaccatagaaatttaatcaaatcattttaattaacttatttaaatatctaggtgggctttaatatcacagagctagaacctaaatacttttatttgcaatactgagattaactattttaaattagtttattgtaaaatgttcaaaattcaaaaacacaaaaaggataacataataaatttttctatactgttcacccatattgaccaagtgtcaagattttgctgtacttactatatctatccatccttccttctcatcttttttgatggcatagctttcagtttgtttatatctactttatatctttaacaaatgtataaaagctttctataagttttgcaaatttggttaagtttatgcataagtattttttgttgttattgtaaatagatttatctcctccattgaaacctctaactagttattggtcatatttaatgaggttattaatttatatcaggtgattttgtattcaattttaccaaattctatcattgtttatagtagtctttttcactagttcttgattttttcaaatatataatatctccattattacatacatttctagaaattctacaattttactttgtattttccatttaactcgagtctttaagaaagagttttgagctgggcgtggtggctcacgcctgtaatcccagcactttgggaggccgaggcgggaggatcacgaggtcaggagatcgagaccatcccggctaaaacggtgaaaccccgtctctactaaaaatacaaaaaattagccgggcgtagtggcgggtgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaaagaaagagttttgataacttattgattatttctggtttaacggtaattttggagggaaaagagctggattattatgtctattttctaaaattaactgaggtttttctttgtgttttaacgtacagtaaatgtctacaaataaccaaaagcactaggaaaaaaagtatattctttactatcaggattcagagttcaatgtatagctatctgaaccacctttttttaaggccttctatattcttaatattttttaatctcactgtcttgaaaaagtgttataaaaatcttctgttaattgtgtctgtccattctgtctttcatattctatgttttctgtttgtaaaagttgtaaagatattagtgactattacatctttactgtatattgtattatttaggttcattaaatggccttcatgtctttcaatgtttgttggcatgaaatctatatttttctgatattcagatcatgtcctctgccttctttttattttacttgactgatatatcttcatgtatatttttactcttagcctttctgattcactttttttccttgatatgttttatataacaccatggagttagattttgctttgttaagatcaactttttttttcttttataggtaagtaaagtccatttacatttattaatataatcagtattttttctcagttctgacatattgttttatatgttatttctttgttgaatcatgtgtaattgctaatagcctattgtttatgacctaccaaaatgccaattgtatccataaatatttacatatttacatatgtctatgactttttatgctcacagacatatacaatatgcatgcaaagtgctttactttgtgatttgctttataattattctttctttagaaatttagaaagtttttttatattctagtggttatcattatttaatactctaatttcttctataaaatctcaaccaataatcattttttctcccctcttcccttcccactatccacattgtctctagtattaacttaatgaaaaattttaagaaaactcaagcttcaactacttccattgtcagactcaagcaatatcctcttgctcccacctagcacatatcaggcaatctgtaagattactcttctttccatttactcacccctttcttgtcctatttttgttagtttttattatatgacactgtcaaagcacacatcaacagtacactttttaaattcttatctccaatttcaggttgttattctacatttaagtacattcacacttatctctgaaaacttgtactgaattttctagaattacttattgcttgtctggagctcattctccagtaaatttctcaggaacaactcatgagagtaacattccatgagatcttgcagttcacaatgctggactttttcctgttaacacatacaacctttgattctcatcttcttttcatgaaatcatttaaaatatttctctttttgttgttgttgttgttgttttgttttttgagacggagtctcactctgttgcccaggctggagtgcagtggctcaactgcatcctgggttcccgccattctcctgcctcagcctcccgagtagctgggattacaggcgcccaccaccacacccggctattttttttgtatttttagtagagacggggtttcaccatgttagccaggatggtctcgatctcctgacctcgtgatccgcctgcctcagcctcccaaagtgctgagattacaggcatgagccaccacacccagtccttctctctttttttttttaacagaaaatgatgctgttgataattctgatttttatgtgtgtttgtttttgagacagagtctcactgtgtcacccaggatggaggagtggcacaatcatagctcactacagccttgaactcctgggctcgagtggtcctcccacttcagcctcccaaagcgctgggattatagctgtgacctgagagatctaattcaaatctgattttttatctcttaaaatgacttggtctctttgtctgaattcccaaagaggttgtttttgtttttgttttttctaacttttaacattcagttattttattaggatttccttggtgataactgttatgggttgattcctccagttaaaataaatatgtaaatcttaaaacttctatttcagcaaactgttcctgatttataattttaatactcgttttccttccttagggactattttgttggatcctcctttttttcattatttctttatatttacttgtcttctcatccttcattttctctcaaataatttttatcttttcctttatttctgtttgatttccttcatttttccttttttatcttttgatttttctcactgtatttttccatagtatctttttcccatgtattgctacttattagtctttatttataagtgtattttttaaaataactttcctgagttctgtaagttctcaattcatagccattggctatttaactatttcttctatttctggtttatactattctttcaaagtgtctattgattttttaatttattttctctcactttgctattgcatctatgatattatgattttatatactttatatataaacacacgtatataggttttcattcaccattcctggatcatgactccgtaactctggttacagtttttttataatctggggtgcttcatgtctctggaacaggcctcgagaaacagaatctctctctttaacctcctgtcctcctctcacctgcccaaggcaggactctatcctgattatgggttaaaagactctcattcagagcgggtcctgccccacaccctaaaaaaaaagtctgggcaaacaggccttctgggtttagatcatgcactttttgcccaatcacatgtctacatagttgtccatcatgcttatgttatgaagccaccataaaaacccaaaaggacagggctgagagagcttccagatagctgacacgtggaggttcctggagggtgctatgtcaggggaggacgtggaagctccgcaccccttcccccgtgccttgccttatgcttctcttcatctgtatttgcttctccatgaaacaggaaaaacacccggtatttccttatctatgaaacagggatctttagtgatatacttgtaatataccttataatacactggtaaacttaagaacttaagtgtttccctgaactgcttcagcaagttaatcgaacccagagggggtcgtgggaaccccaacttgaagccattaggtcagaagttcagatttgcagcaaggagtgtctgccacaagggtgtgttggcgggggcagtcttggggtctgagccctcagcctgtgggatccgatgctatctccaggtagctagagtgggaattgaactagaggtgaatttgaggtgaattagaattgaattacttggtgtccactgtttgtcggtggggaacccccccccccccccaaagaatttggccatagaagtcttcttttgtgttcattgctgtggcgtgagagcaaagaaaaaatttgattcgggtgtttttccgaaacagaatgttatagttttcatctgctttgtgtccactttttctggtgttatttatttcgttattacctttttttaaataataactttgaattatttagactatttttttttctgtgtgttccctgtttaaatgaaatggcttttcctagactattaagggacagttcctggtcagtgggggccaggggatgaactagggtcactctctcagcttcatcttttcttgttattaagaaggactcaaaatacatcatcccatccatctctcaggcctacgcctggccaagaaggtttcctgccttcagttctatgtttcccagagctctcccctttagacaagttatttttttcttacatgacttcccgggatctgactcctttgggcccacaacctcctccccacaccgcttaccatctcaactgtccagagttactgcccggctcaacgtgtctgcttctggcggttttcccctctggaaaaggatattattggatattttggcaatcatccagggtttgctctactgcctcactctcaggtctcttgtgatgctgtctgcaggctcctgctttcacttgcaactctgagcatatcggaatagtagtttcacagttattctcaggcttgtccacacagatttttattccagattaggccttcttttaagggtgagtcttcatgggtgatcttgggttctatagcttacagggcttgtcaaaggtttgcattgagcccaccactctcttttcctgtttctgccacctcgcaccatctgaaccccagtgtttctaccctgctcagttgctgccacgactccacagcggattgcctttaggtgccatttctacatgtggttttgactacagcagtactgtagggtttagagatgtttcctatcacctagtatttaaaaatatataatctaggcatatttttacactatttctaattttctgtttggttttctggaggagttttgaaaagattaagaaactacactgccaccataatctcactaggaccagaactcaggatcaatttttcttagagaatgtggaagaatgaagcttccacatattctttataaaatcttataattttagaatgtgagttctctaaaactcttaaaggtcacagagtccaataccttcctgtaataggaaagataattgaggtccagagagtgaaaaacaaggctctctcaaagtcagtgtagaaagtagtagagccaagtataaaatacagctttcccttagtcttggtgttagaaggaacctcagggcatgtggtccatcttcttacccagtgcagaattccccaggaagacaggcagccaatatccccttgaatatcttaaaggatgagatgtctaactcaaccagttccccatgtggtaaagacaaacttgtcttttcacttttttcctttttcaaaagtataaacggagacacacaaggatgaattgatgcaggtgttattgcgtttgttccctgtttcctctcagtttagaagctgacttggaagcacctctaggttgattcacagcctgagttggacacaatctttaagttcatctagtctagtggattcattagtctatgcttaaacatgcctggcagctcactctatcatcaattgttcaggagttcttcctaaagtgagatgatgcacatgagcgtatttgtggattacacaaccttatataaatctaagattgtcagatttattatgttgaatggaattttctcccctttaacttctaagcattgttcttggttccgccctctgaagctatgcagaaaaagtctcattactcttgtactttgcagtgcttgaaacgctggaagagagctatggggctccttccttgtggctaaggcttatctttttccatggttataaacaaagccagcacttttattcctcctgtggcattgtctgcagtactcccagcaatctgttttttctcctttagcacactaaagcttattaatgtttctcttaaaacgccaaaaataaacagagtgggactcgactttctttgtctcagcatcacacttacatcagcacagtgtaagattatgagtcattccagtgcttcttattgtgccttatttgttttcagcttgcagtcaactaaaaacacctaatattttctagtgaacttctagtaaagcggttctccaacttattgggcatgggccgttgatatttttgtccttgatgtaggaaaatagctttgtaagcagcaacacaagtcctttcagaactccagtgactgactgaatctggggaccttgagtcttttgggcatcaaggttttctctgatatgctccatccctttcttgggatttaattcttccttggctatatttgttctactccttttcatttgaatatcatactcctagatatacaagtccaaagaaaagtagtgggtgaacaatccccttctcactcttggtaataatttctaccactttctactactcccctggcatcactgctgttttctttttaccactgtctgtaccagtatatcattgactacccaagcaggggtgcatgctggtctcattctcctgtttacttttttttttcttattaatacagtatttatttgtcttttctccgtcaaaccctgagccaaccatgttccccaggctgcctggggaggtataggaaaaggaacacacagggcccatcagacatggaaaaaagaactatgggaggtggagacggctccttcacatggcgaagaggatgagaaaggccaccatcaggcaaaagagccccaaggcctcccagagggcaaagcccagaatggcataggagaagagctgttgcttcagagaagcgttcctggcataaccaatgatgaggctcccaaacacagtcccaatcccagccccagagccagccaccccaactgtggtagccccagccccaatgaatttggctgccatgtctatgtcccttgaaatggcactagtttggaagctgcagctagggacaagtgaggtaaggggacatgagactgccaagctgctgagactctcatctgccattgtctccggtcatttcaacaccactgcagatagtggatggctcagcagctgtgaggtgctcttgaccaaggagggagtggagatgaatttggagcaggcatacatttttacggggtgaggggctatggcaggagagctgctcccagtgcagagaagacagacaggactctcctgtttaaacatacagtggggggtcagggagagggcatgatcaggaagacataaaattggatggtacatacagaccctctttaagaggcagatatctgctgtcagtacctcttgacatacattccccgcccactcattatccaggacaacacctttatatcttctaatccctgtatttccttatctatgaaacagggatcttcagtgataacctacctttcctttgtaggataacctacattcccttaggacattcctaataatataaattattctttctcactgccctatttactatgcagaccttatctattgaggctgtatgctaaagaagacccttatggtgctaaggagtacaccctggggccaagaattcgaaagccttcaccctagtgtgagttgtcaagtgctggctggccagtttctgtaaaggagccactaaaccactaatgagagcctcaaaaataaacataccacaaaacaaacacatggagagaaaaggttaagttaacttgtaagtactttcctatcatttttcctgatcatgcccaaatactggtcataggatttccttttatgttgataagggagaatggaggctgtgaagaggaagtaggactcaaagatgagaacaagggtgaagcataaactggtctatgagctgggattcagacggcatatatcccacttccaaaattgtggtgaacaccatgaggtcaataaacattaccgagagagagatgtattttcatatttattcactactgaatgaatataaatgaatatatacatatacttctgtatacttttgtacatccacctactcatatgccagtctgaaagacagaatattcccattacccatcatggaattcctctgtgtgcccatcaccactctcatctacttccctattctcttagaacctgttttttctgtttattgatcttctgtttttctttattgttttatggcatacatttttatttctaaacagtatattatttagtcttgcatgttttttaactttatgtaagtggaattacactgtgtatttctttgccttgcttttttgtttgtttgttcaatttcatattcctgagattcatctatgttgctgtaaattgctatagttcatttgtttctactggtatatagtatcccatttattcagcaatatattatccattctatttggattgtttctagtatttttatttttatcacaaagaatgctaggattaacattcctatgtatgtctccttatggtatggaccagagtttctctaggtgtatatcatggaatagagttgctaggtcaaaagctatatgtattcttaagtaaactggataattctaagttaaaaaaaactggcaccaattttcatttttacatactgtgtataagagttctgattgaagtcacatccttgccaaacctgaagtagtcaaacttttaaatttttgccaatctattgaatatgaaatatttccttatggtttcaattagcatttacccactaatgaggttgaatgttttgttttatggttttcttcatttcttgttctttatctttatcttcttgtagtttattcatttttatggatgtttgggtagttcttgatactttttttaatagattctatatactaattatttgacaattatatgtgtaacagaactttcactcaatttgtatgttgtatccttaacaatttttatttccctttgaaaaatcaaactccttaatttgaatctagtttcactgggtgttttttctatgcatgagataatatatctccccagtctgtccctttcctttttatttatgtaacagttaattcaatgagcaaatgtttttaattttgatatctgatttattagttatttccttttgtaatcattgttttcaatatttaagaatttttttttttttttttgagatgaagcctagctctgttgcccatgctggagtgcagtggcgcgatctcagctcactgcaacctccgcctcccaggttcaagcgattctcctgcctcagcctcccgagtagctgggattacaggtgtgcacaaccatgcccagctgatttttgaattttttaatagagatggggattcactgtgttggccaggctggtctcaaactcctgacctcgtgatccacctgcctcagcctcccaaagtgctgggactacaagcgtgagccaccatgcctggctagaaattgtttaacttcagaaaatatcttcctatttttttcaaaaatctttacattttagcttttaaatttacatctatttgttatttgttttgtatggtgaggtaagtgtttggagttcatttgtttccccatgtagatattcagttgactgagcacaatagttgaaaatactcttttttttttttggtaaggtggagtctcgctttgtcacccaggctggagtgcagtggcatgatttcggctcactgcaacctccacctcctcggttcaagcaattcttctgcctcagcctcttgagtagctgggattacaggcatgtggaggcacatgccaccatgcccaggtaatttttgtatttgtagtagaaatgggggtttcaccatgttggccaggctggtctcgaactcctgacctcaagtgatccacctgccttgacctcctaaagtgctgggattataggcatgagccactgcacagggccaaaaaacttttttctattgaattacttcagtgtctttatgaaaaatcagttgactgtatcattgtgggtttattttgaattatctattttgttttggtagttttcaaccaatatgtcttcaaacattttttttctgccccattctctgtctcttcttttgggtctccaattacacatatattaaactgcttaatattgttacatgggtttctaaagctttgtttctttttattcaatattttcctctccatttctcagcttgtataatttctaacgttctagttttatgtttattgactttcctctaccaccttcaatctgctattaaacccatttagtgactttttcattttatagtatttttcctctctaaaattttcattttgttctcttttataggttttatttctctaattatatgccccatctgctcattatgaatatatcttcctctaagtccttaaacatattcataatagctgctttaaagtctctgtcttctaattgcaacatctgcatcatcttggagttggggtcttttgagttattttaatcttcgttattggtcacatttttctatttcttgcacatgtgtattgataattgatcaatactggacattataaaaatttatgtatagagtctgaattttgttatttttccctgaagaattatttttgttaaatatgctggacttgaaactccaaattttgtctctcctgcaatgtatgtgtgttgttttcttttttcttatttgtcacacttccttctgggattttctctatgcaaagagagttaatggtcagccaaagaattaggtggattttatgtgcagatttcagggttcattcctctgtggatctctatcttctaggatttctcacctaattttctaccttttttaccagtctcaatttctattccttaacacattaagccaataagactgtggctttctgcacattgggatttgttgcattggagaatgccacaaactaaaatatatccttcacagttaatttttataccattgattcctcattagtttcttcctgtatttggtaatactcctgtttctctaaaaacttagataattctaaaaatattttcccatatttttaattgttatctaatgaaagactaatgcagccaagtttttctactgttactagaagccagaacaattgatgtatttttttaaattacattttctcagtgttttttgctggtatagaaatgcaattaatgtttgtatgttgatttatatccaacatccttgcttaactctcttctttattcaaacacattagatcattgcaggttttttacatatacaataatataattgtgaaaaatcacacttttgtttcctcttttcagattcttctactttttattatgttttcttgcctttcggtactggctaggactttcagtgcaatgatcaatacaagcggtaagaataaacactcttgacgtgtcaatttttttgccattaattaacagttaatttgaggtttcttgtggctttcacttaactgttaaataaattattctttttctaattttctagttttttaaaaatcatgtaaatgtgtagaattcataaaacactcatctacatctattcaaataactatatgattttgatttttttcttaatgtattaatgcattgaattatagtaaatgatggctttttttttttttttttttttgcaacagagtttcgctctgttgcccaggctggagtgcagtggcacggtcttggctcactgcaacctccacctcccaggttcaagcgattctcctgcctcagcctcctgagtagctgggattataggcgcctgcccccatgcccagctaattttttgtatttttagtagagacggggtttcaccatgttgcccaggctggtcttgaacgcttgaccttgtgatccacccgcctcggcctcccaaagtgctgagattacaggcgtgagccaccacacctggccttgatggtctaaggttaaactaatcttgtattaaagagatctaacacaagatctggtaatcacatatcatctttttaatccattacaggatgttatttgctaatattttgtttagaacttttgcatccatgtccataagagatattgacctataataaccatttcttgtactgttgttcaactattggtatcagcatttagacttctaagacagaaaccattgaagagtcttataactctagaggaaacatgctttttattttagattcagaaactacatgtgcagtattgttaaacggatatagtatataatgctgggatttggtcttctattgatcccatcacccaaagagtgaccataataccaaataagttacgtttcaattgtttttccctcctgtcatcctcctcccttttggagtccccagaatctattgtttacatctttatgtctgtatgtacccatcgtttagctcctacttacaagtgagaatatgtggtatttgattttttgtttctgcattaattcacttaggataatggcccccagctccatccgtgttgctgcaaaggacgtgatttcactgtttttttatggttgcatagtattccatgctgtatatgtaccatatttgctttatccaatccaccattgatgggcacctaggttgattccatgtccttgcctttgcgaatcgtgctgtgataaacatgtgagtgcaggtgcctttttggtacaaatgatttcttttcctttgggtagatacccaataataggattgctgggtggaatggtagttttttgtttagttctttgaggaatttctaaactgcttttcatgggggctgaactatattacattcccaccaacagtgtataagcattccctttctccccattcttgacaacatctgttattttttactttttaataagagccattttgactggtgtgagatgctaacttattgtggttttaatttacatttctctgatgattagtgatgttgagcattttttcatatgcttcttggccatttgtatgtcttcttttgagaattgtctgttagtgtcctttgcccactttttaatggagttatttgattttttttcttgttgatttaagttccttatagattctgaatattattcctttgtggaatgcatagtttgcaaatattgtcttccattctgtaggttgtccatttactctattgataatttattttgccctgcagaagtcctttactttaattaggtcccagttgtacatttttgtttttgttgcatttgcttttgaggtcttagttataaatttttgcctaggccagaagagtatttcctaggttttgttctaatattttttacagattgaagtcttacatttacatctttaaatgtaaaacttacatttaaagattacattacaaatgtaatattgagctaattttttatatggtgagaggtagaagtccagtttcattcttctgcatatagctagctagtttttccagcatcatttattaaataggttgtcctttccccatagtttatttttgttgactttgtcaaagactagttggttgtagatatatacagctttgtttctgggttctctaatttgttccattggtctatgtgtctatttttttttttaacaaataccatgctgctttgtttactgtggccttatagtatagtttgaagttgggtaatgtggtgcctccatctttattctttttgcttaggattgctttggatgttcaggttcttctcttgtttcatacaaattttgaattgttttttctgattctgtaaaaaatgacattggcagtttgataaaaattgtgttaaatctgtagattgctttgggcagtatggacattttaacaatattgattattctattccatgagaatagaataatgtttttctttttgtttatgtcttctatgatttctttcatcggtgttttctagttttccttgtagagatattttacctccttggttaaatgtactcctagatatcttttgtgtatgtgtggctattgtaaatgggattgtgttcttgatttggttctcagcttgagctttgaacattattggtatataggaatgctattgatttttgtacattgattttgaattctgaaactttactgaagtcatttatcaggtacaggagtcttttggaggagtctttagagttttgtaggtatacaattatatcattagcaaacagagataatttgacttcctcttttcctatttatatatttattgctttctcttgcctgattgctctgattaggacttccagtatgatgttgaataggagtggtgaaagtgggtattcttgtcttgttccagttcttagggagaatgcttccaacttttacccattcagtatattagctgtgggtttgtcatagacgactcttaccattttgagataagttcctttgatgactatttttttgagggtttttatcatgaagcaatgttgaattttatcagtgctttttctatgtctactgagatgatcatatcgttttcatttttaattctgtttatgtggtgaatcacatttattgatttgcatatattaaaccatccttgcatcctagaaataaagtgcccttggcatgatgaattatttttttgatgtgttattggattcagtttgctagtattttgttgaagatttctgtgtctatgttcatcaggaatattggcctgtagttttccttttttgttgtgtccttgccagattttggtatcaggatgatgctgctttcaaagaatgagttagagaggaatgcccccctcctctcttagaatagtttcattaggattggtagtagttgttctttgtatgtctggtagaattcagctgtgaagctatttggtccaaggcttttttttaataagtttttattactgattcagttttgtcacttattattggtttgctcagagtttcaatttctccctccctcaatctttggaggttgtgtgtttccaggaatttattcatttcctgtagattctctagtttacatgcgtagagacattcatagtagtctctgcgggtctttcatatttctgtgagattagttgtgatgctgcctttgtcattcttgattgtgattatttggatcttcttttattttcctagctggtggtctatcaatcttgcttatctatcaaaaaaacacttttccttttgttgatcctttgtacggattttttggtctcgatttcatttagttctgctctgattttagtgctttcttttcttctagttttgggtttaatttgttcttgtttttctagttcctttaggtgcaacgttaggttgttaattgagatctaatttcttgatgtaggcatttagtgccacaaactttcctcttaacactgtttagtcatatcccagaggttttttgtacattacatctctattttcatttcttttaatgagtttttttatttatgctttaatttcattgtttacccaaaagtcattcggaagcaaggtgtttagttttcatgtatagaggaaacattttaaaaagctatctagcagaatgcttcctcattcctaggggactcacttcctggttcctcaactgcttctgatgtttcttcttatctaaaaaaataaaatactgtgtacaataatcttttaattaaagcacggcattataggtgctgagtgaaagcctgccattatttgttgctgctgttgtttagcagctgaggcaggtattctggtgactctactgtgctgcttggttaccctgaatacattatttttttcctctgtgttaatggtatgttatgttttttactgttaagtacttatgtgagaataagagtaagaaaatgattgcttatcagtagcaaataaattcagagtcaggaatgatggtaatgccaaacaactacagattgtccatgtaggtgctgagatagtgacacctttgctttctgaggcttcactgtacacaaactttgtttcatgcacaaattattcaaagtgttatataaaactaccttcagcctatgtgtataaggtatatataaaacataaatgaattttgtatttagacttgggtatcatttccaagatatctcattatgtacagtcatgcatcgcttaacaatggaaatacattctaagaaatgcattgttaggcaatttctttgttgtgcaaatattatagagcttatacatacctagatggcatagcctactacacatataggctacatgatataacctattgctcctaggctacaaacctgtacaacatgttactgtactgaatactttaggcaattataacagatcattaaatatgagtattatgatatgttattataatcttacaggaccaccattgcatatgtggtctatcatagaccaaataatgtttatgtggtgcctgactgaatatgcaaatattctaatatctgaaaaaaatctaaaatctgaaacaccgctggtcccaaatattttatatagggaatactcaacctccacattcaaatactccatgtatattgctagtaaaacttccccaaattaccatacgcatgatagtccagattatcattcagaaaatactcactcaactcttttctattgtgagaagacatactttcccaccctattcttgttggctgggcttagccatgtgatttgatttgtccaatggaatgtcagcaaatgggacatggggaaaggcttaaaatgtgtctgtgcaatggggcttgtttgcttgggctcttgccattgtcatgggaagaactactcatgccttgggtagctaactggtacaaaatgaaagtagcaggtggggcagaggcactcttgctgacccacaggcacaaggaagaagatgagccatcacagccaacctgcacgatctgaagcagggcacccaggctgacctgcagatttgtgagcaagataatagacatttattattacatgccactaaatttggggatggtttattatgcagtgatagctgattgatacaggaatttatatctacaagcaggtgcttatgttaacaaaaacttaaaatatatggctcaaggaaacttaaacgaagctgaaaaatggtgacttgtgctaggtgatggtgaaatcgttggtaaaatgtctctcatgataatctgtaaggcagaaagtgtaccagatgaaatggtacagttgaattctgaggcaaagtgtggaatatgagctggcttctgttgactgtgtggaataagatacaagagagtaataagttcagaaaagaattggcttgggtacaaacagaattaagaggaaaaataaagagcctaaaaatttcagaactagaagggttggaaaacaaaactctttcttaccaaatcaaaatgtgacccatatgacacaatttcagggaaaaatccaacccaggctactttcagtaagattttaaacctgtaacactctttattaaaaccccttaaagggaccaggcatggtgacttctgcctgtaatctcagcactttgggaggtcaaggcgggaggattgcttgaggccaggagcttgagaccagcctgggcacagtgagacccccatctctacaaaaaataaaaataaaaatattagctgggcatggtgacacaggcctgtaatcccagttactcaggagactgaggcaagaagattgtttaagcccaggaatttgagtttatagtgagctatgacgctgtgattggcaactgccctttagtctggccaacagagcaagaccccatctatatatttaaaaaaaacacctctcggctgggtgtggtggctcacacctttaatcccagcactttgggaggcccaggtgggtggatcacttaaggccaggagttcgagaccagcatggccaacattgtgaaacccccatctctattaaaatacaaaaattagccgggcttggtggcacaagctactcaggaggctgagagacacaagaatcgcgtaagcctgggaggtggaggacgcagtgagccgagatcataccactgcactccagcctgggtgacagagcaggtggttctgtctgtctccagcagggtgacagacaggcgcagtggttcacgcctgtaattccagcactttgggaagccgagatgggcagatcacttgaggtcaggagtttgagaccagcctggccaacatggtgaaaccccatttctactaaaaatacaaaaattagctaggcgtggttgctcacacctgtaatcccagctactcaggaggctgaagcagaataatcgcttgaacttgggaggcagaggttgcagtgagcctagatcatgccactgcactccagtctgggtgacagagtaagactccgtctcaaagaataaataaataaaaataaacaaataaatatataaataacaaaaaaataaaaaataaaaaaacacctctcaaaggatgaagatgttctatattagaacttttatctgggccaggcgcggtggctcacgcctgtaatccacactttgggaggccgaggtgggtggatcatgaggtcaggagttcaagaccagcctggccaacatggggaaacccaatctctactaaaaatacaaaaattagccaggcgtggtggcacatgcctgtaatcccagctacttgggaggctgagggacagaattgcttgaacctgagcggtagaggttgcagtgagctgagatcgcaccactgcactccagcctggcaacagagcaagactccgtctcaaaaaaaaaaaaaaaaaaaaaaaaaaaaaaaaaaggttatctggacagaagtgtccctagaaagtctaatgatgcagttctacagaagcctgatgatcacagagtactaaaagctaagtaggggcgaaggatgagaagaaaggtgtttctcaagaagtattgttgtgatgatttttggtacatacatttgattaaaatcaaatatagagaaagacctggcaaaccgaatccagcagcacatcaaaaagcttatccaccatgatcaagtgggcttcatccctgggatgcaaggctggttcaatatatgtaaatcaataaatgtaatccagcatataaacagaaccaaagacaaaaaccacatgattatctcgacagatgcagaaaaggcctttaacaaaattcaacaacccttcatgctaaaaactctcaataaattaggtattgatgggacatatctcaaaataataagagctatctatgacaaacccacagccaatatcatactgaatgggcaaaaactggaagcattccctttgaaaactctctcaccactcctattcaacatagtgttggaagttctggccagggcaattaggcaggagaaggaaataaagggtattcaattaggaaaagaggaagtcaaattgtccctgtttgcagacgacatgattgtatatcttgaaaaccccattgtctcagcctgaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaccttacaagggaagtgaaggacctcttcaaggagaacaacaaaccactgctcaatgaaataaaagaggacacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcacatggaaccaaaaaagagcccgcatcgccaagtcaatcctaagccaaaagaacaaagctggaggcatcacgctacctgacttcaaattatactacaaggctacagtaaccaaaacagcatggtactggtaccaaaacagagatatagatcaatggaatagaacagagccctcagaaataacgccgcatatctacaactatctgatctttgacaaacctgagaaaaacaagcaatggggaaaggattccctatttaataaatggtgctgggaaaactggctagccataagtagaaagctgaaactggatcccttccttacaccttatacaaaaatcaattcaagatggattaaagacttaaacgttagacctaaaaccacaaaaaccctagaagaaaacctaggcattaccattcaggacataggcacgggcaaggacttcatgtctaaaacaccaaaagcaatggcaacaaaagccaaaattgacaaatgggatctaattaaactaaagagcttctgcacagcaaaagaaactaccatcagagtgaacaggcaaaccataaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccattccattactgggtatatacccaaaggactataaatcatgctgctataaagacacatgcacacgtatgtttattgcagcattattcacaatagcaaagacttggaaccaacccaaatgcccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaagccaaacaccgcatattctcactcataggtgggaattgaacaatgagaacaacacatggacacaggaaggggaacatcacactctgaggactgttgtggggtggggggaggggggagggatagcattgggagatatacctaatgctagatgacgagttagtgggtgcagcacaccagcatggcacatgtatacatatgtaactaacctgcacattgtgcacatgtaccctaaaacttaaagtataataataataaattaaaaaaaagaaagaccataatgtttttgagagagttgtattggcaaaagtgttacgagcctggactaaaatagtctaagactgtgaaagacattataagatctctggacctccaaatttctataagcaggaagccaacttaaatagctattcaactaccaaaaagggtatgttctcccatactatcctcagaaatggccaaagagctggatggatagagaaggaacttcaaaatggagaaaccaagagctagggacaatggtggactagaatatgatattacaatcttatgggacctgccactttcccaggggcctaattaattagggcctaattgaaggacatttctcactctcaaggtaggggaaattagcaaaaactcagaatattaaggatcattggcttcaccattccttgttcttcccctttttaaacagagatgtgtattgtagttgtgccgtccttgttcaaccgtttaatgttgggtgtgtcatggcaattaacttgtcatttttttgcacctagatttttaggttaagaggagcatacccagtctgacataaattgtaagatcagatataagatctgataaaaattgtaaggactttgagcctgttttataatttgctgagactttgtgggatcttggtaaggtatattttatatgtgcaagggacctgaatatttatgaacaagagatcagactggaacagcttggattattgctcagcagagaatcactaccttctccgagacttcatcaaggcttaatatgtgccaggacattaggacttgacatctgctcttcatccaccaccataagaacaagccccagatagcccaatcaccccagataaataagaaatatgtggagcagagctgaaaatggcatgctggtgcaaccgtagtgggttggctacctgcttatgcagtttatttctcctttagttcttcttgagctcaatcttggctataccacttgcttcttataataattgctgctacacccacccaacttataatgattgctgctaggtccacccaactttatgacttgggaggtctggttgattcagcttatgaggggcagttctgaatctgtggtcatttagtatcccatggtccagtgttccacagctaccagggcccaatagcctactaggaagtatttttcaaaaggtacatgatgctctgctgtagatgtcatggcctagctccagaatctcagggaactgtattgtgattcttcccttggggcttgccacgaactccacattgcatcttttcctaccattgacacctctaacaccaaaagatctactagatgacagagttcaaaaggaggcactgttcacaccacagcttggacctattgcagagccccttcctgctccagctcccacttagagttggcaccctgtcctatgacctgggatgtggcatggagaggaatgtgtaggtatggaatatgttacttctggaaactaaaaagacctacagggccaggcgcagtggctcatgcctgtaatcctagcactttgagagggtgaggcaggtggattgcttgagcccaggagttcgagaccagcctgggcaacatggcaaaaccccatctctacaaaaaatacaaaaattagctgggcttggtggcacatgcctgtagttacagctactcaggaggctgaagtgataggatcacttgagcctgggaggttgaggttgcagagagctgtgatcatgccactgcattccagcctgggtgacagactgagaccttttctcaaaaaaaaaaaaaaaaaaaaaaaaaaaaaaacctgtttatttgtgctttcttatttgtagttggatgcaagatacagaattttttttttatttttattttttgccttggacgggattcctggcaaggaacccctgaaaacttttatgaagtggcagtttactttatctttgtagagttcatcatctatcctctgaagcacatcattgtattaaggcccccagcagagtagtcgctttagcttaccttgtccaattagcatgatatcacagatgtactggatcaatatgatatcctgcggtatgtccagatggtccatatctctttgaattttattatcaacaagcatggcagagttaacatagcactgaggtaaaactgtaaagaaaggtttttgttcattctatgtgaatgcaagcaatttttggtcctcttttctgatgcataaaaatatgtgtttgcccatttagtggctacaatacaacacccagcatggcagatgtattcaggaatgttacttggttgagtggtagtctacagttatttcaaggatttatctgatttattcagggttcatggacaaattaaatggagctaggataggtaccaccagtcctacatcctttagagctttaagagcgacactaatctctgccattgccctctagaatgtgatattgttcttgcccatgggtagagggggtggcagtttcagaaagttccacttcgcattctgcacagcaacaattgtcacccaacaagccaagaatccagggtgcaggttactccactgccacgtattttaatcccagttatgctcttggagactcgagaaatggacccactgcaagcctgatttaatcctgtttccatttatttcctggttcctgtatgctccattctaatacgggggccaggataatactctggatcattgggtatcaatgtcaatgcattatctgtgtccaatagtcatcaaaatgagtattcccttttctcccccagtgtatagtcatccaagtaagtggtcaaatgtccctttggaaaagattcctggaggaatctttgcagtatatacttgctgtgacattatatgattcttactccaactcttaactcaataggttctgacgtgaaagttgggttaggcctagaaattgagcaacagatcatgatattttattagtgcaactagcatcagctttctgcttttccactctcaccctgttttaatcatatatattcagaaacatctttcttggctccccatctgtcctgcccttcagctctcaggtataatcaaccatcctcttaattccccataagtgaccctcacttttggatcctgtgtttgtttctcagctgtatctaatcatccactgcaggtgataatgacctctttttaagctaccaataaagctgtctggccaacatgcttaatttttagctgtttgttaactaccctgtttctctttatcacactgtagagggtcaaggcaacttagtaataatgagtcaatcccactgtcccgtgtgcattgtcccatgtacctttccaatttctgagtcttcacattaggaagggcattccttccactgggacattttccaggtccacaactgttgaaagttttaccaattgggctgccaccttatgctaagaactgtccatgaaccacataccatagccagatggtggtcagagattcaatttccaaaccccatcttgccacttgccttcttggtccagttctggtgacaactgtgtcagtttggattctcaaagatgcagatatcaagacagtgtaagaaaggcaagcaaatcactgcggataatacctatgaaaaatataggagcaaaggagcaggagtcagcaggggtgaccttcagactgcaatgcaaatccatcatccctgaaaggatagaaggaaggaaggaggatgtggtgggaagagcctcagaagactgccatggagctctgaaaaagttttggcggtatgcatgttgggcagaaatggcaaagtcttattcccgtgcctacatatgtacccttatgctcagttcttggctgtagccaatggaggagtgtatctcctcagctcaaataccatgcaagggataatttcccctttttaagccaccagagaactctttggccaacatgctgcagctggagactgttggctcacagcattcgtcgtgaaagcttccctcttatgagatgatctgagcagtgcctgttctcctagaggatagcagcagccctgcagaacaggcccagagagctttccagtccattcatatcaacagaatcaaatatatatatcaatcttgctatgtttattgtaggcctactatgtgtcaaatagacttggttcacagtgatacaaaaatgactaatgcattgtctgctttgtcactcagagcctgcagagaactaagacacataaaatattaaatatggcacaatgcttgggcacagttgctcatgcctatagtcccagctactcgggaggctgaggtgggaggatcacttgagcccagaaattaaaggttgcagtgagctataattatgccactgagctccagcctggatgacagagtgagaccctgtctcaaaaagaaataaataagacacgatgttgaaattagtgcagtgcaagtatgtataacgatcttaggagcacaaataagagcttgattctttctgccttgaccagtcagggaaggcttcatagagagggggtgatcaaaagaagagcaagagtttgtccagcaggtcatagggccagggcattacaggcagaggaaactgtgtcctcagagcacctaacatactcacttagctatggtaggagcccaatgactatatgctgaaataagcatggtgctcaaagtgggaatctttaagctgccagctacagaaactaactcaagtacagtgaggcattttaagggtccctagaaatctcatagtgtgtaaacaccaaaaatttaaaaatacatacagctgggtcccatgggaattttaattgagtactggaaaagcatctgaactgaagccctttccgcatctctgtgtcccacagcagccacgtgcccccactctcctcagcacgtctgctccaagtctctctacaaactggatctatcacttctcagctgtctacgactcaacccagtcatctctctctctctcctagtctacatgaccttctagctccagcactctctgtaagttaaaaacagatgccacattctatgtgtctcactgtagtgatgtgtgcaacttactttcacatgcattaaaaaataagatatattgatggatcactagaagaacggctagagagatagatatgtaataaaatagatggtgaaatgttaatcattgaatcctatggtggctttataagtatttaatgtgtaattttttcaaattttctaaatgtttcataacaaaatgatggggggaagcaaacaaattctcaagagggggaatctgattggcccaggttatctctgtgctgggccacatgagtcctaggttaggtaatgagttggctggctaccttttaatcaggttcaaatcaggtttgagtcctggttcagtcagccatggctctggggacaagaagttccatgatacagcaggctgcttctgcaacaggctgtgtgtgaggctaacactgtgaaacatgcctccataccaggtttaatggaaataagggaagaaataaacagaggaactagatttctaccatactcaggatgagaacactgtatctatgtatgtaaacctttgggggccaagaggaaaggaaaaactatacagttactctaaaaagggagtctgctgctcagaaaagggagtctctgccccttcttttgctcacctcctctgaccttcatgccaccaaaaattctgtcacctagagggaatgcatttccagtctcagcaacaggcagattggtattatctgccaggaagtggtgagttttgatttaaggatctcttaggtaaggaatagaatgaaatgcaagcaaggccagggtgaggacagagggtggcaggatgcaggagaaacatatagaataaaacaatttttatccactgacaaaatatagatggtgaactcagaagttttccgccataataaacaagaagaagaagtgcaagaagtggacatataactttatgacctgagaaattgaattgcctcttacagatttttactttttgctggacaacgaagaacttcgtcatctcagtcaaggatgggtcataaaagccactggaaggagaggaatcagccctgtctgattagaatccgggaggtcttagtttgcaggccatgctttatatatctgagcttcacccagtggaagctctgagctctgtgaattacagtgcttcacagccacaaaagccctgtctcacccatcataaacaccagggaaagacaaggccaccctctacaatcggtagcctgagagagatagcaagcccagacacaacagggcacagaagacagctgcggagcccccactagtgatggcagctggacccaggcctgtagctaattaagatttgagatcccactaaagggagattccttcactcaccccgacctaccatgggctatattgagtaatacaacttatcatatgaacacagctcaccttacaaaagacgaaacacatcatcttctatatctatcctagataggaaaggaatgaagtagacatgagagagtcagaaaagatttggtccttgtacagtcctgccaattactggaatttgaattcaagctccaaattactcagttctacttactttattttctaaacattttttgaagctttcacctcttctctgtctcctttgccccttctctgtccctgccagccctgtcctggtctttcagatggattatagtggctgaccaactatcttccctggctccagtagggtttcctccaagccatattctgtaaactgttagcagaagatgtttggaaggaaaacctggtgaaggttctacccttcagtggagcttcacatctttcagtaaattccattttcctgaagataaagttcaaattggttgacttgacattcatggtcttctgtaacctcctcatagaaaccattgtgtatccttagggtgggctgagttccctgcatctgtgcttccagacccccctgggtataatgctgatattgcaatagtataacaggagatgcttttcccttgtgtgatgtaagattgcaaagtttggttattgttctctattaggatggaaggagctgatacatgactgaagagacagacgaagcccagttgagggattgacttggactcactatggacggaaataaatctgtgtaaccatctaaagcctcttctccaatttctaaccaggcaaccgggtccaacctgcctcacagactttactattctaaaagatatttttgtcgttttctaaaaactgcccccaggcaatggaatctggatggaatttgggttccttgaggctgggaatacaacggggaatctctccctggatctacaggaaatatagggaggtttaatcagtctagaaagggaagaattggaaatgacaggacatcaggataaatagaagggaaggtcaagacctgagggaccagaggctggaacaaaaatcacacataaggaacaaatttgataggaaggtacgggtgacaactagagggtggcttgaacaacaggctcagaagccaaatggcagttgtatcttagttttaagtgtaaatgaatacgtgacagggaagattgagggcatctttaaaaactatgacaaaacaaacaatactttaggaaaggtaaaacatttcagggtcttgcaatgaggaccccactctaaaagaattaaatttatcatgaaattagtgaacctaaagcttcagggcctttcacgtgcatgtctcccttttaaggctctaaatataatttttatttgtaattttatattatttgtcttgtattaccttcaggccccacaaaatctgtaacacctctaccttttagcattgccaagctaggtaatttaataaggttagccagagttttctatgtcaagcatacaagtattactctcatcagagtatgtctcaagataggagtcaataaacccttaacccaaactgccaagcacaaaggagcttgtatgtctaagcaaaggcaaggaaaccggaagaatatcaggatccaggaatgccctttctagcctccactgagtaatggtcatcaaatagctcacctagtaacatcacttgagaatcagagcttataaagcagggaaagaggaattatgtgtatgaaaaccagagtgatacaactaaggaagtatctgtgtgtgtgcgcatgcgtgtgtgtgtgacagagagaaaaagaggagagaaagggaaaaaaggagaggggaaatgaaagagataaagtaagatatagagacagtgaacatatatggaaatagagggttcagaaggagaaagacaaaaggataaagtcagtttaattttaaaactatgaactgcacctgccaaataaatttctccttcccttcagtgaagagcagagtagaataaaaaccaatatcttgaaaattcaaagagatggaaaaacaaaacttaataacaactcagtaatagaacaacaagttcttgtcagtctggatcactgaggtgtcagtccagacacatcaagcagcagcaggcagggaagggaaccccatccaaggcatatgtgtgtatgtaaaatcagcctgaaatatacttagagttacatggctaccttacatgtgtgatttgagatttgagaaataccagggagacactccagagcaaatacatttccctcaatcagctaagaggctgcctgaaattccattattagagcagaacattggaggttaaacacacttttcatgtggtcttcattcaaatggcaaatgcccttgataaggtcaacacaataaattatcagcaccgttccataaattaggacatttacattcttacagtgattggagggctaaattatcctgaaagcccagggaagcccgagatgagttagaaattcaaaccaagcttctgaacttcttgcctcccacatgtatgtcccccactccccacacacatgctattagaatagttttgttcccaggctgccacacagaccttactattctaaaagctattcagtcaaactagtcctggggcattagcaaaactggcactgatagaacatccaggcagccccaggtgcctggtgatggagctgccaccctcacattctcatccatgaggagctgctgaagcctgtccatgctgctcttgggttggcagccactggaaaattgacaaaggagtgaaaatcaaaaggcaaagtctcattttcatttgagcattaggagagcaaatgaaaaagatgagaatcaaaagggtttttattcaagatgcttggttttgaggaggagaaaaatatgggatatcttcgtcccctttccagctcagtgatggtgaaaataaagctccaggatgatctataatgtaaaagttgggagatgactttgttttgagggaaaaacagctctggaacttataaatgtcaggcagtctcacagattgctcacaggagaggaaggcttggcaacaacattgctcagtgcttgacagaattaatggccagggaggaggaggatgtacacttgtagacctgacaggatccttcatcaaacacaggaccaccatgtggaggagtgagcagcaagggaggagccccgtgctgtgggaaacaggaaattcagcacagcaggcaacataccaattggctttgtggttgtaggaaattgtgggtaccccatgaaaatggagaccaaggaaggagaggaagtagatatcactacagaaaaaatagtgtttgactcactgactctcatagtggaaaggaatttttttatcggccaatctcgattctacaaataaaatctaagcaaatgacaacatctaacaggtagtgagcacctactattgtaccaagtgatcaaatacacaagatacataaattctccccttcaatcttcatcatgcttcttcttataataggtgttattatcagaattttacagaacgctaaactgtaaacagagtttaaagggcttaagtagcttgtcattcagttaataagttgtagacccatgttggtccagcatctgcacttctaacctctgtgccttgaggtccaaagaggcacagaaatttgtgccacagttagttgggggctgagccaacctcaaaattcaattctctcaatcccaaatatagagcccttaaatcaccaatacctattgctccctcctgagccaggatgaacaaagtctcagttatgtctcccaggtgctcacgagacagcacaaaccaggcagataattagtactgagctatcgactcactcagatttgcctgagaatcagccagatgtctgagggaaatagatatttgcttgtattggtaagagaagattttgacatctgagaaaaggtgttgtggttcataatgcaggatagcaacacatcattgaaacttggacacctatcagaaacagggtatttgaattttcacttggaaaagtgcagttagggtgatttttactcagggagcacattttctgaatgactggctataaaaggcttcaggttaagggagaccttgagaagttatttagcccattgcccttcctccaggcaggatggcatttaaactatctttgggaagtgatttgttttcttttaaaaataaaaataacaacaaggactgctacagtcctctcgtgttaaaaagtttcactcatccccagggccaaaaaacgttctcctgaatatctaagccaaagctttctttctttctttctttcttttttcatttttctttctttcttttttgatagagtctagctgtcaccaggctggggtgcagtggcctgatctcggctcactgcaacctccgcctcctgggttcaagcaattctttgcctcagccccagctaatttttttatttttagtagatatggggtttcaccatcttggccaggctggtcttgaactcctgacctcatgatccacccgcctcggcctcccaaagtgctgagattacaggtgtgagacactgcagctggcctaacccaagactttctaaagacatacaaacctatgtcctcttctctattttaccgagttctctcctgggatgaacattatgtatacagcatagttcctaggactgggcatctacctggccttggtcctcattatggtagaaaaacattcagccatctctgatatatgtgatatatgtggtttgtgtgggtgggatgaatagcctacttagtgggccacaggagtatgaggtgtgatccgcaaaagtgaaaatggtctttaactagaaacttctcattaaccccaaatcaataaagaataaatctaggcctcccactggtgggtcatagaataatcccaaaattcctgaaatagaattgtggtgggcttaggaaacagtgttgagaaagaccaagcacgggtttggggatggattttgtaagaaagaacagataagcaagtttccagctagattataaataaaactagaatctaaaaatctttgggagactgccagatctgatgttccagttgtaaactagacatatgaatgcatttcattcatgcatacattttggtgtatagcttcccataatagctgaactccatgataaattccaattttgtctaggttaagtcagggaggagaagaagtctttcttaggttaggaaaactttccttgcacaatggagataggttattgggagagggacaatgcatacaacagactcccagtgactgagtgggtagctatggggttggtaagtcagacttgagacctaggcatgtccaggatatatagaggatgggtactcaagaagcatcttcttccttcactttagtgagtggaagcagagtttccacttttaacatgtgtctctcagagcgacagaaggataccaagagacaatgctgtgaatatggttttctgtaataacataaagaacagctgacagagacaagcaaacatgtggagactaaggtagtgcagaatgtttcaaccagagtctgggctgtgattctagttggatcacctcttctgatcttgtctctccactctcaattggcaatcccatttatgtgcatggcttccaaaaccatccgtgtgtcaataattcttgaatttctatctttgttccagacctttcaaatgaacttcagaatcatagagccaaatccctactcattctctccactgagttcacacacacacacacacacacacacacacacacacaacacaacaacacaacacaaccaactcagaactcaggacaaagaatactcttggcaatcagacagaatcagatttttgagttagggcactatcatttattgtcatcagtttccttaggtaagccacctagtttttccaaatgtaaaatcagtgttttggtaagaatccaattagataatattgtaaagtgcaatgctatctcatgcctggcatatgtaaatcacatatttctacatattggatgcttgttgactaatgagtggatgggtgggtgggtggatggatggatggatggatggatggatggatggatggatggagggacggatagaaatggagattccgtgagccataattacgaaggtcacacatgatcatagtggacagataaagatatgcaataaaagaagcatggaaaaaacaaagagcacttctgtttactagatgaagacctggaatgctgaatggaatggaggagattctataaagaacagaaaagaatgcaacgccttttggacaacacagttttctaaagctgctaagatctgattgtgacacttcattcagttcattagctggggaaaggctggccactgctggatgagttgtgagactgaccaagaattgttaaaatggcaggtggcaagtatggagagggtataaggccaatgtattagtctttgcccaagatacctgccatctgtgaacatattctacatcaatagcagatgtaaatggcaaatgtggcctttagctgagagaaaaatctaagatacaactgcaacatcagacctggaagtcccccaaagtcaaaactttgaacatatcaccaagattaaaacttttaaataaaattttccctaaagtgtttcactataaagaatctttacgtctgaggtaaatggtgcttcaaggatttagtcatctctaaaaagcagtgaagaaaggaaattttttagagtgaaaaacttgccttgtcttgattgtagtggtggtttatacaattgtatatgattataaaacttcaccaaaatgtgtccctaaaataaataaatcttattgcatgtaatacctcaaaagcaggagaaaagtggaagaatccagaagtaaatcaaatatttacctaccccaatgactagccagacagtaactcagtaagaataaagattttgggttcttgtaacagaagactgggtgaggtgagaggtggggaatgataatggaagaagctgacttactttgagataaacatattagaaaaagaaaattctagtagtcacaattagctgtaataggtctaaaagaatgaactggctggagacatgggataatagccaacaccctgtgggatcccaacaagctgtgggatttcttgtttcctacagttaagatcagaccctctaacagaatcatatttattcacataagaaaataaaatggaaatttgggggaaaatttgctagagctaaggagcaggctctgagtctcagagagagaccctttaaagggccagaggcaggaattatacctcctcccatgaatgaggaaaactacctcaattccagaagaaatatagccccttgaggcaagaagatatggaagcatcagccaaatatgtgtgtactctggtaaaatcagacagcagacatatttgggctcagtgtgtctctgaaccactatttcctgcatagccagtgaagccctgaaaacagctgcttccccggaattgatggtaggcatggtacggagcagggtctcaggcaccagagagggtctgagtagccacagagtggagcaaggtcaatggtagtgggagagtctacagagagaagccagtgtcatttggacacaggagatcacccccggaaagggaaaggagagggatgaaatggagacaatgtggaaaaacttacgactccacacagcaggtatcacttattgagttcatcctagtcaggatcaagattagacagtgattcatgtaaacgaaaaaaacaagaatctaaaatgtagatcaaactgcaattcatgtatttggaatgagaataccgtttgctaagtgaacagaatactggaatacaatatttagagctctcccaggcagcagaaaacttggaagcaaaattcctcaccacagcattgctttgatgagcatagtgggaagtgggtggccttgaagggtggctcctagaggccacaggaaatcctgatgtactacacctgtcccacatgagttcaactccccaggggcctgaatgctcatttccttcacactcagactctgtgtcctctgggtgtgtgagatgaacgatgaccagttttggtcctttggtatccttgtttcagcttcatgaagacccacttgttaaatgtgccacatactatactaaccactgcagacattacctcattaatcagcacacaactccaatgacttaccagttatctccatttcaatgatgaagaaactgatttccatagaggatacgtggttcacaaagtcatctgaggcagggatttaaatccagttctgtattcctgagatcacgctcttcagcaccatgctgtggtctcttcaggaaggaactgattgatttcatcaggttttactgttaagttaatcacattcaaggccagcccttccaaagcctcccttccattactagccccatatcactcagctgtccatttacaaaatgtctttctggtttcttctaaaaaatgaagaatcatgtgcgtcatatacaggttttgctactttaactctcagaggagaatcatacttttaagatttggtagggaaatttgaggaatattaagaaaacgttgtcctgtgtgaccagcaaaaatgtcttttgattcaaggacacagaggttaagatgagagcggtttcctgcagacaatcagtaaagcccatggagcaggcttcatgacccctactttgaaatgctctgctctttgcaactgagactgaacatgaagcttttactggatctaatgcattcttcttgggtagggatgacaacatctagctgggcagagcagatgcacaaggacataacatgcctgtttctggatctaaggagcatacagaattggataagagtgaactgcaacaggattaacgacagcaacaggattacacactctagccctagggaggcaaaaagacagaaagaaaaagtttaatctttcctagtatcaataatacctcctcttcacgttcacaggttgtaaccaactcctatctgccatgttctattatcactccttcatcagctcttcaccttgcaaaagtctatctgattattttaattcagtttgtaatcattcaaaaattgtttacctactatcttccagattctaaggaaacatgtgaacaaacatgtaacttacctgtgttcattgttgttatattcccccaattactttgtccttttgttcctttatgattgtttcatggagcttgggtaactggagagagaaatgtgtcatcaactaaccatatatattcagaagttctatgatcaggctaagggtttacttatctctcttggatacaggaatatctgagagtacaatggggttacatgaataaaaatgtcagcctaacattcccaaactaatggactagaagcaaggcctaatgggactttaaaagatatggttatggtttatacaaacccttcccagtagaagtagcctataatattctcactctactttttagtcatgagaaacatttcaaccttactcagggttgtctcccattgatttcatatttgaggagttgcccaaaagttctcttccctttgcagaaaagcatccccattgcctataaagtccaaattcttcagcatggtatcctaagcccttcctgatttttctgccaacaatattttagccagtctcctggaacatccccccagtcattgacatcacatttcactgcttctcccacaccaaacattatattatatttatgcctgctcatgctgtttcctcaacctgaaatatactccactcccttatcttatatagtcccacgaataagctcattgttatttcctctctgtagccttccttgatccttggtcaaaagcatttcttctttctgatgtatgcctacaacacctcttcgcacttctgtttaggacgttatcttggcttgccttgtagttgactactaacatctgtttctcattccattatttgaaagcttcttgaaggcagataggaatataatatgtaaggtaggcattaaatagatgtttatttgtttaaataagtttcttaaagagataaacatatttgtcatggaaaatggattaattataaagtcaaagttggaaaatacagagagttgatagtggagaagttcactctacccaggaaccagtgacaccaaattgtgcagcaaaattgttggacttcaataatctgacaaatgccctccctcagctttgtgtgcctggtgagaattctctcctttgaagcatcacttcttctggtgataacccagagcagacatagctgtccctaccttacactcccaaaacattttgaacaaaattatatttgataaacactcatgctgtgttgtaatgccttctttgcctctatcactggaatatgagctttatttttttctaataggatttcatatgcacagaattggattaattataatttctggtttatcactagactctgtgtagtcccacctttcaatgtttttgttgttaaataaagtcttatgtggctagtaatgtgctagggtctgggaatctgaagagaataaaacacattccctgtcctcaatgagtttagttaatgccttctcttctttgtatcttcagcctttagcttaatgcctggcacatggtacatgccccctataacatatgtttcctctgcctgattcttgaatttagagagcccctgagtttagtttttataatgcttatcttccctatcaacatactcctgaaattctcatctagccctaaagctataagtactatcccaaacacatattctcagtttcagtctacaccataaacttaacttatacatccaacttcctccgtgaaatctccaccaggatatctcataggcatctcacacttaaagggtctaaaacagagttcttgacccagtcccagtctgcctgccaccaaacctgcttctcctccatggtctcctgttttgtagatttagctcaagctaagttccctgcattcatccttggctctttttttgtctaacatccccacagttaattcatcagaaatattgttggttttaccccataaaatatttgtttgctcattgttgagtcttccactagggataagtttagtgaggctagacattttgtccattttgttaattcaagtacccctagcacttagcatatggcaggaactcaataaacattggttgaataaaatttaaacaaatatttgtgaaagaaagaacaaataagtacatgggatctcagacctgccctctagataaataaatttagggaacagcagttaccatgtttttcatttggaatgagccaacaatcttgttttcggttaatactttagaacgcagaaatcaaacatggaatacttctataataaaaaagaaaaattgtttttaaatttgtccatctcataaaaaagtaagctatgtcagaagcgttttgtccagaagatagaagatgtcataaatggataaaacttctctgactaaatattctaatcaaatactggcttctgctataaaataaaatactactcattccaacaaaacctgtctttattttttttttcagggaaagggagaaaagaaaaacacaaaaattggaacccacagctatatctacgtgtctcctgtttcatgcaagtggtaagaaatgaaagaatattaaaagagagactgaggagctagaagtaattattgagtgtctccagtaggatgtgaatcaaaattttgctatgtgtggtttgcaaaaagattaaatgatagcattaaagcttgtgtatacccaactgccccagatggaagacctactatagctgctgtaatctgtccaggttatttcaactcttgatccagggaagagttcctgataaataaagttagtcccagaagcttattcaagataatgttttcataaccctacagtgcttgtataaatccactgttcaccccacttcaccaaaaaaaaaaaaaaggttgcagcctctttccagcacttgtaatcttttgagagaaatagacgaatcataattgcacatatagataacattgccattttaagtctctatatggaataacatcagagacatttatggtctccctcagagggattcaagaagcaggtttaacaataaatgtcagctcctgttacctagagtgccatacacagatcacatggtgaggagtagaaaggtaacacatttctagaataaaatgaattctgcacacagatggaaggttccaaaaccaagataaaaatctaagagttcaacaggttttttgggcattattttatactgtagtccttacctttaaatgcaaaataaataattctatctgaactgctgaagcctagtggaatataaccaattgaattctcattttccaggagacatagtctctctggtgcctgcgactattcgtgttagtccaagttctttgataaacagacaccaagctgagattaaacatggtgaaatacttttatggagaatatacctgtaagagaaaataagaagggagctggggagacgcgaagagccatcagactaccatgcaagtctgagacttccaaagaaaaaagacaggaagaaagattgggtagaattgtcttagatcaccatgaagactcaggacagtacagcagggccatagggcaattatcaagatgaaatctaaagaatccggtatttcctagagtttggtttgccttagtatccctgccaacctcagtcactgtccgggagccacctctgggaggtgtgaccttggcataagcacagtaatgcagctcagagcccagcagctgggactcttggttaactatgccccccaggagttagaggtttgcatggggcattctcacagctactatactaaggtgctgggatagcatcagtgcaagacagtaaagagaatatttcctaagtatggaatgaatgttaattccctctttctgagcaaggaattaaagctcccaaagagctaattaatgatagttcagaaaaaaagactgtctgctaacttccggccctaaaagatctgtgtttctctccagtgttaattcatcccagagcacttaacagagttaagcagcatgaaacccttgaactctaagcaccatcaatgagccttagagctggattcttgagtaagttatcatcaaattctcaattatgacggcaaatgcatttctcagagagtttttggattaatttataaaccttaaggctaaatggaatgaaatataccttatttcaaaggctggaagaacttacgaggttctggttgtttgaatgccctaccaatgagagatatacacagggctccccacgtgccttgcttccggaatgggaaaagccacttgaagcatgggaagaataatccgcaagaatctagaaagggttctttcaacgtaaagttccctagattaaagtggaggagaggcagggaagttacctgcatgttccataaacagtgctagtctgtaagacctttggcaagatggcaaaccagggagcagaaatctgcacatgatcattttattccaagtagatgtttgaaggggagagagagaaaaagagacagagagagaatgtgtgtgtatttcagtggggcagagagtacttctccttttacttcctaggacaagttctaagaggaaaaggatttgccaaggacatctaggcctctgcctagatgacctccagacgccagcttcaggctgcaaggccaggggagggccagtgaaactgagaaatcaagggacttgtttcttgaattctcgatttcttgaatgagggccaagtgccagattttgtttttgtttccctggacctttcttcacctgtctgggaagaaaagttgggcacggaggaagagcccaaaacaaggagaagacattgcagtctctccacccacgaccaatccgggaatggtatttctttgctcctcctcctctagggtctaaatcccacccagaggtctggctgccatttcctagattggttctgcccagagtgcaaaagggttccagaaggcgggagccaagggaaaacctaaaaaaagtaaacaaaacagagaatctacagccacctcagatgacagcaaaggataaaagaaggcaaagtgatccctgctcacagaggagaggaaggagggaggcagcaaatatatcacccgctattgctgaaaggcttacaaaaatccggttatattttttaatcatcttgcattttagatctttaaagtacaaatatggatttcaaacataccaagggaacaaattaacttagaaaaatggtaatgctttccaaggttgcacctgccatgaaattgctccaagtttgcattttccccaggtctccagtgtgtcattaggccagattgattgcgctcctcccccgaacagctcccccattacagggttattgtatggaaattagtggaagattgggaacatttttttgcagctgcagtggctggagtcagttttgattaagtgatagaaacctggtgcagacggggagatctctttgctttagctgcctcctttattatcactcaagtgcagcttctccctgtgtggatcttttgctgctttttagacagtgctgtttacactgagtcatctttgtgtttttttaatgtttcccaactcaatttccccattagtattctaatttgatgtgaaacttaaaaccagtctattcattcctcattttctatttccctgtctacacccctatccccacacccctgctccatcccgactttttggagatgcaacaataaagtggtgatagtcctcatcctccatccttctatcctacttatcccctaagataaactattgaaggggcctaaaccagcaatcagagccatggtggccccaggggatttcaaggtgcaaattaagccttggactggctgctccaagaactgacaagtgagggctgacagttttcctctcctcgggttctgtcaggagcttgcaaatgtcccagaaaaactggggctctggcagattaggagttgatctgcttgtcatgcagggtcaacatcagactacagcaattgagggcaacaagacacgatggaacagaaaaataaaggacagtttaggtgcaaattgcctgcagtaagttggaagggggagagcggctgggggcgggggagcacataacctcatataggcctttcctatctatacactggagatctctctttctgtgctctattcttttctacattcattcaagccttcattcattttctcttccagtatgtactgagtacctctcctaggtactgtaatagatgctgaaactgaagaaaaaagtgaacgagaatagtctcccagttccattggagaaggtaggcatattaacaaaaagttacaatataatttgtacagcaggggcaagtgttctagcagaaatttactaaaaattatttgcaagaacagcagaggaaaccacaaaatctgccttaatcaggaagtgtgcagaagggcagctaccagaggaggcttttaagtgaggtgacattggaactggttcttgggcatccccctgccagagcatggtggaggagacagatttcagtgagagggaccagcaacaagctcaggtagaaaagagaagagcacatccacagggaaacgtgtggtttctaggggctggagcagacattcggggcaaaaagtaatgggagatgagcctggaaaagcatgttgaaatcagatgatgaatacagtaataggcatgctggggaaccaagactgtatcaatgatagaaaccaggagtctctggaggtttttaagcaaagggtttttttgttttgttttgttttgttttaatgcctttttagaaattacacactgaaaacagtgtggagggtagcagattgatgtggggagacttcagaggatgagaccaccattatggacattacaatcatccaggtgaaagcccatgaagcctctaactcatccatctacccaaacgcctgtgttagggcttttcgcctgtcaaaaaacgatcccaatatcctctcagagctcatatgccaaggacactttttttaaagttaactttaaaatattgccatctagcagtttagtaagttccctgacacattgaataacatctcctctctccagcaagtgaggatggggtcaatctaaaatagatatttgccagtggtcaagactggatgcctggacttgattgatgtttccaggacagccactgagtgggttgcacagcccacaccattgacctcatgaatcttttccttaatccagagagaaaattagctcctgcctttgaagaatgacatctgcccctgaagctatattccctctgctgaacaagagcagtcctgatctttcttcccaaaactcagtctgagaggcagctccctttggggactgagatgatacctgccatttccaaatctgtcccgcgtccctccaagtgccaatccacatctctcctctatcctcatgtcctgtccaaggctcccacctttcacattctccatacctaggataagctgctgctgctgagagcacctgctgttatcagagaaaagcaagaggcaattgtccattactatctcaaatgcctcctgcttaaatcagtgtggggattaccgttggacagctcaaaaatgatatactgggagccaatttctctttcccccatggtcagtcaccttccacctggcagagtaatcctcaaagctcatttaggaatccagctcatcttggtccctttaatagccttaaagggacaagctgattccccagggttggtaatttactatcctgatatcatcctcttgggagaaaaagagggaggctccagctaaaggctccctcctcctgagatcttgggctacattcctgcctctcccctttctttttttcttttcatctacccctcccacaaacagtgaagtacaaagacagtgaaaagtcttgtgaatctctaaccagtaggcattgttgcaagaggaaagttgtgattatttcagctcctaaagtgcttggggcacttacactgtttttcgttgctctaaactgtctgcctgctatttggaaagggtagggtgatgccaggtcatgatatttcacttgttggagaagatagttctcatgtaaaaaacactataatcacatcagtttgataaaatgcttcacaattgaagactccatccccatttccacttggaatatttaacttctacaatattccagtttaggaaaagcatcatggattcagggtaacctgattttaggatttcaagacagcaaaagagtaatctcaaatgtgtcttcaacccaaggtgtcattaacatggctcaccttatttggtcagtgcccctctgggcataattctgaaggcaaggactcaggaacgtacttacggagccttccattggttgccaaaagtagatgacctaaacatctatacacatctatgtaaacagcaagcacaaacagcccatttgaaaaacacgtggagacactgataacaaggacacaggtagaccaggaaacagacagaagccaatggattgccaagtggacaaaggatagcagtcaccaggaagattctacaccaaaaagcttaggccaagatagaagggtgctagatcagatcagtgtgtagacaaagcattctcagtcctttcttctatgattgagcaaccctagagaactcttaaaggataaacgtccattagaaaattcctacctagtcacccactttcatgttctaccagtccagactcaattagatacagagacactaagtaccacaaagcctcctctgagcaagaagaccccttcaagatcctcaagatccacctttaagaaatgcttaaaggtagaggggcatagacttacttgaaaatctgtggggatgagagaagagggaagctatagactctccctttcaaaaaatctcacatatacagaatctttatttataatttcacaaagctcggtcaggtgtggtggcctatgcctgtaatctcagcactttggaaggctgagacgggtggatcccttgaggccaggagttcaagaccagcctagccaacatggcgaaaccctgtctctatgaataatataaaaattagcgtggtggtgtgtgcctgtaatcacagctacttgggaggctgaggcatgagaatagcttgagtcagggaggcaaaagttgcaataagctgagattgcgccactgcactccagcctgggtgacagcgtgaaaccgtgtctcaaaaaaaaaaaaaaaaaaaaaaaactcatgagatccccgaagcctcatgacacacagccaaataagaaatctctaatgtaagctccagcaacaatgcctagcagagaaatgaatcaatttatgcattcattccacaaagttatattaaatgtgtacaaagtgcctagacctatgctagaggacatgggagaatataaaggaaaaaaaaaagacacttttcgtcccccaagaaagttcagtgaggtatgaaagcgctaagagggactgctggctaaatgacttagtgggggctggtgacttccctttccccagagttcatttccactgactgattcctgtgggaatggggacctccctatggaaaaaaacctcaattctcagtatggggaattcagaaacaaatagggttttctgaaaaactgggataagtttgagaaagatcctgatgaaggccaaactacaatggaggtgtgtgagatccacctctggaaagcagtctactctgagagaagaaagaacctgcctagcatgatgaggtgggcttagcagcatagcacagggagtggggaagagaactggttccactacagcagggagcgactgaatgcagcctcctacaagcacatattttttccaagaaaacaaaagcttgtctataagcattaacaaatctttaattttagaggcccaagcaacactgctctggagaccctccaaaaaagtacaacacagagaaaaagtagttattcaccttccagaaagtgaggtgacaactggagacctggtaaaagaaggactatcagttaacagctcagggggagcagcagtgggtagagctgtagtgtgagtgaatggtgccaacccaagtagaacaacgaaacatgcagctcccagaggaaacattagtggtcaaagagtggaatgcatcagctttataggctgcatcccaagaagaatgacgtgactgtggcttgatacagaagcacaggtagttagcactaagctgattggagaaaggaggaagatggcaagtgggaaatgctccaatcatggcagctgtggagagacttatggagctatggctaggcagaaagtgagggcagcggcatgggaagtggctccaatttctaccggcacaagagacctttgagcagagattcctggcatccagtaatgttgcaggtacaggcccccaagctaggtatcaatattagtgccatctcatttgccaaacagactgatgagccccgcaagcatttagatgacacagacacaacatcatggctgatgttcaaaatttctaagaaacccgtatgacataggcatcagctggtaagaagaaacaccagccaaggactagagctgggtaatgcagacgccttaccgcaccaggtgttaacccttaatcgttagatcacaagatctagagaggtgccagagaaggtgccaggacagcctggatgatggttgggcaatttaattagggatttagagtaacagttatttactaaccaccaaagaattattttgatattttaacaagctatacaaccatgtaggacgataccagcggaatatcaaccctagacaaagttaagcaagaatacagagcactacttgagtaaatgtcacttgagaggcattgtcaatgctagaggatgtcatcaggaagaaatagccccattggctgaagaggaagactaaaggcaggctgtttgctaaacaggaactttcattctagaaatcagagagctgggttctgatcctgacccagcctcttcctagtcctgcaacttcagacatcactgttcaaatgtgagaagacttatagggaacaaacaccatggcaaagcaggcatggatcagaccatggaaggctgtgagtgccaggcaaaggggcgtaaactataaagccatgctgtggaagaagacaatattgcccaggggtgtgggataagaatgaaggcttcaagttcctcagtaacatatttcctgagcaggtgtttggctagagatctgaatattgttattgtcatgtggccaaaaagaaaatgtcaacagcaacatttaatagatttggtaggaataatataagaaatctacgcacaaggagaactagcaatgatttgagccctgtccaagtgactgccaccagccattatgcagaaaaagaacacaaggaaggaaaaataacaaggcatcataggaacacaactcaaaggacggcaatcaatgggcttatgtgcagcctgggaaatgaacagagagcaggagagaaaaaaaagaatggccagattcctacaaagccactgctgccacagttcaaaagactgctgggcagatgataaccactcattttagaattggatctgagcaggaagtggcaaagcatacttaatgtcctggaacttgcctcctcttctctgaaggctagaaggaaaagaggtgatgtagatagcgccacacggcatgaatattgtaaatgacaagggggtgaagctcagatctgcatgttgccatgcctatgcagacctgccactggggcccctgatgtgaatgatcccttcaaaggtgccttcttctttgccacctgtcccccagtactgtgacatccagtgacttgctggagtgcagtggcacaatcttggctcactgcaacctccacctccctggttcaagcaattcccctgcctcagcctcagaagccctaggattacaggtgcatgccactatgcttggctaatttttttgtatttttagtagagatggggtttcaccatgttggccagactggtctcaaactcctgacctcaggcaatacgccctcctcggcctcccaaagtgctggggttataggcatgagccattgcgcccagcctggaaactgcattctaacgcttatctgaatacctaaacactgtcttgtatcgctttggagttttatttgttaatttaattactctactaaactctaaattccacaacggcattgggtgtgacttgcactattttgttgttgatattgttgtttttgttttaaacaacacacaatgctttgtattctgctggaaatatattgggaggtatttaacgagtaattattgaaatgtatttaagtgaaatcattcattcaacaagaatttactgaatgcatgctatgatccagttgctagatcaaagcaagggagaaagtagactcaagcatagtgtaggtactcagtaaatatgtgctccgatactgtgaagcacaaagtgccaagaagtctatggaacttcttttctttctttcttttctttttttttttttttgagacaggatattgctctgtcacccaggttggagtgtagtggcataatcatagctcactgttgcctcaaactcctgggctaaatagatcctctcacctcggcttcccaagtagctaggaatacaggcatatatcactacatctggctactttttaaatttttttgtagagatggagtcttgctatggtttccaggccaatcttgaactcctggcctcaagtgagcctcacaccttggcaccccaaagtgctgggattagaggcatgagccaacacacctggcctgtgggacttcttaacctagatttctctgaagaggagaagcatcagaaagcagtaaactttttaagttgccatcacaagatgtgttgccccagcaggcaatgatactagaaactatcacatcactaggggaagcattcaagaccacttcaacagaatttgttgtccaccataccagcaccaaacccattttgcttcacattttggctttctctggcctgcccagaagtctctagagagattcaggaaaatattgcatctacaaaacaagaacaagatgctataaaaaaaggattaagaaattagaaattaaggggttggacagtctcaaaaaatgtataaataaaaaattaaaaagagctggaaaaaataagagacatagccattcaatccaggagatccagcattgactaagagcagttccagaaagttggagcagagaaacagagaagaggggactatcaaaaaaataacaggagacaatttcccagaattgaacgtagacattagattcaaaatgtaagtaccaacaaaattctaattagtgtaaatgaaagacacatgcacaggtatgttcattgcagcactattcacaatagcaaagacattgaatcaatataaatgcctatcgacgatagactggataaagaaaatctggtacatgtacaccatgaaatgctatgcagccataaaaagaaagagaacacatactttgcagggcatggatggaactggagaccattatccttaataaactaacacaggaacagaaaaccaaataccatatgttctcacttataagcggtagctaaatgatgagaacacgtggacacatacaagggaacaacacacactgggactttttggagggtggagattgggaggagggagaggatcaggaaaaataactaatgggtactgggcttaatacctgggcgacaaaataatatgcacaacaaaaccccatgatacaagtttacctatgtaaccaacctgcctaagtacccctgaacttaaaataaaagaaaaagaaagacccacccctagacagatctttttgaaatttcagaatactaagactaaagcaataataaagtcttcccacaagggtggggaagcaaaataaaataggccattgatcaaacaagaatcagactgatgtcaaatgtcaaattgctcatcagcaacactgaatgctaaaagacaactgagtgacattttacattacccacttaattttgctgtcacgccaaatctgtgagatagctactctattgatgtgtccttccatgtcgagggaactccacatgggtaacgttcctgaactctctccatctcttctcagggaggagtgacttaatgcaatttgtgagttggattacacatgaactgcacatgtggagatccaactccttcttcctttccccttttcttaggaacaagtttcccatgggaagcataattgtgctctgcctctacaggctgcaaagcaaccagctctcacccctcatggagatgtctgctcagtcctatggctccgcatttgaagcctgcttgcctgcggatacatgatatttcacctcatggaaggcaccatcagtgaaagtggcatgatgattttatgtatcacaaagaaagaaaaacactgaccatgaagcaatactttccattctatcactttgaattttttaatgcttactgaataagattgtttctttcaaacatacatgtttatgacatgtcactcttttgtgtacataaaaaggaaaataaattgctaatgcatacctttaaaattcacatttagagtctgttttgaatcacattttgactcagagttatgtagctacatgatttacaaaaatatatatatatttcctccttgccatcaagatacagccttggtttcttattattctggaattttcttccaagctgaagacatccattctgttagcattctgtcttttagaagacagcaaaggaaggttttagacaacaaccaggactttttaatttattcttccctaaatggttcttagtattttattgatggaaacatcaagagatgcagtggcctggtttgccaccaagaataacccaagttcatgtgtgtgcaggcactaacaactatgtcacgactgccacttggccagcagcaactgtaacatgccaattgattgtgaaatgcaccctcagtgaaaagatgttaaatgtgaagggaaagtaccttttagtatcaataaaatacagtagccatactctttagtaccagcttaatcactaataaaacggatgttcagtttctcttctactttattattttgttgtgtttttcaatttgttcaaaacttggataggaaagagggctgccatttattgggtcccttcgaatcccaatgggaagtaccgctgttatccctattttacaagttaaaaaaggaggctcagtaaagttaaataactttcccaaggatgcacaactcaggggcacaattgaactgaatcctggattgctgtactgcagcactaaccagcaagttcactgccctttgtaaaccacccaatgaaagagctttaaaggatgggtaccagctaactttgagaaggactaaaaatgtgcatggtcttttcaggaacctctaagctttcctcactgctggagggcagaaagtaacacaaagggggtgtatgaaaaaagagcaaaagggagcattgccctttgcaaggatgatagtcaattttgtaaaataatttttttttctagcttaaacatggttgccagggaagccttctctacttttgcactccaggtgaagaggctctgtgatctgatcccatggtaacttgtacttcttcaatcttagaacttatcacactttactgtaattactggtttaaccatctctaactacaaataagctctgtgagcagaagattgattctatctaagtcatcatcatattcccagaattcagtatgggaactggcacagagtaggtaccccaaaactggctggcatctgaacacacaacccagttagtggtggcatggtctagacagcaaacagggatattacttaaaaacaaggggaactattggataaatttaaatattagaccaatgtaaccagggttatgttttggagagatgtctctggctacaaggccaaagggaattagagggaacagagtaaatacagagagatagttaggaggctaccacagtggcctggacatgaagtcctgcagcaagaaggtgacaatgatgggatgtcattagcatttaagtaatacatagtggattcatgagagacctgcataaggaaagggctgatgaagaaacctggggaatacaaacatggaagagatgagtgggaaagaagagtccattaaaggaggccaagaggaagcgtctagagaaatatgaagaacagaagagccctatgtcagagacactgaaggagaacagaatttatagaaggaggaggaagatgtgatcaacacgttcaaattcagccaagggtagaagtaagatttccatgggattagaaataagaggtcatttatggccttgaaaaagcagttcgcctgcagtggacatggaggccttttctgagctgaggctgggaaatgagagcattcgagagagcatttgagaaagtttaattttctaggagtgtcaatgcgaagagaagagaacaactagataacaaggaagcgaatgtaaaaggcaaggagaattgttttgtcattcaatcagattgaggatgtaagtaaactgggggtgagaagccattagagagggagagagtgaagacgtggagaagggatatgtctgactcagtgaggtctcccactacctgggaaggtctttgcagagcaactggatactgtgagcttccataacaagggacacccaaggctgtatgtgttgacttcctgggaatcaatgcagagggattatgttctactcaagggacgtcaggataaatggaaagagagaagtggaaggaaaggggagaaggacatcactctcatcaatcagataaatcactcctctttcagcaagaaggcacaaatgaaaggaagaaggaccagaaatattccctttatattggaatgtgcaaagaaatcccctctgtgcccatggataagaagtagagtaaatatgaaccatccaactcccacccctacccctaacccagggcagttccccagccctcaacctagttattaaggccactgcaggagagtaacagagaagtctggtgctgggttcctttccaagatatgtcagagcttgacagcagagggtaatagctattggtgggagggtcctgcttcatttatttgaacaggctcagagagaatatctcagttttgatgtgtgggcatgagaacaaacccggtgggctctatgaagatccaaagatcaatacccataagctatccaaaggctatgcataaggcctgatcattgaacaatttcacatcccaagcacaccaaacatttgtgattcccaacacatttttgcaaaccatttgatttcgcttggaacagactgctgtcaggaggaacattttccaggtgggaagttcccctttgtttcacccttggcagcccttcctgacattctcaggcacatatctgcactcttctgctgtgaaccttttccctctaaccctttccggggctaatggaaccctctcagcagcaaatcattccttgagcctgtattacatctcttcttcccaggatttgctccatggttataattggctgcattctgctcccctctgtccataacaccatagatcatacaggcagagatggatccctagtgaactagaacaagcttatggcttcaggaaggcattaagatatgtatattttattttatcattctttgggtatagggtagacaaggcttgtgtcttcctaaacaccctccctggctaaatagtatatggataaacaatgcattatgtaggttacatccaataaaatccaaaggccacttataggggaaaacaagtccaaaaccttcccttctcatgactcttttctttgtgtgattgatgaagtctgcacttctgttgcagaacatgaactcagttaaaacagttcctatacattgctgctggaatcacttttgaatgtccccatcctataaacatatcatattataatatcaatgtgaaacctgctcactttattgcctcagtcccttcacagttcattggtttaccagatgccaagcatacatcccctttactgtgtgtgtatgtgttttatggtggaggatgcattatcagtcccatccaaagtttctcgctgaggtttttcctatcaattgtttccttatggttcgtagcatatggacagtttattctctcatcaatcctcaatgggccattcatgtccttgataataataacagcattaatggatgtgttcccatttcaggatataccattatctcaagctaatttaattaaacagcaccacagccctgtgtccctgctttctattgttcatcatgctgttctcccacaccccaaaagaatgagttcctgagctgataaagctcattcttccactttgagaagcatggagggtcattggatgagggttcatggagactagaattggttagtgggtgcagagtcacaaggggaagacaagaaaggattaggcaaagaaattaaagttctttctacccaagagttttgtggtctaataaaatgagcatggacagaagttgatgcaaatcacagctctgccacctaccaggttttgaccttggaaaatttgagtgcttttagttttgatgtcttcatctataaaatggacataagaatagacttttaaatggctgtttaaaagaattaacaacataatgtaagtagagtccttagcacatggttggaactttaccaatgttagcttctttcagcttcttcatgtctctcaacctgtttctgcagtggatgctgttagtatatactgcaggtgtgtgctgctctacacagaaggtgtgtttctaaataaagggtgtaaattaaattagagaaatgagtcatattttaaatgtagtggagagtacgctgtttaaagttctgaggtgttgcattctcttctgaaacaaaatcaccttgttacccataacaagtgtgcataaagcaatagactgttgtacaacagactttctagagctgagtgatagaacttcctcttctctgtggtcactgaaataatgatactgtcacttaataacatttactgagagcttactatgtatactttgctagtattttatttgtattatttacattctcttgaaatagataccatattatccccatcttatggatgacaaaactgagacatagaaaggtcatgccacatgttcaaggtcacatagtgagtggcaagctcaaatttaaactctagcagtctggctctcctgagagaccttagagtgggagctcattttaaatggaaccccagaagaaacacttaaaatgtctatcttccttaacccaaggcttcttaagaacctaaattgtattttgtattcatctgaagaacctctaattgtactctcaatttaaggttcttaagcatgtaattgtactcttaaagttttctttaaaactgcatttgccccttagaccacaactaaaatctgccacctggctgctcatcctgccagaaaaacaagatggatggcattttagagttcatcttaaactttgcaattccctgggctcttccgaaagaccaaaagtctcactctgtccatccttatgtgaactcatgctatctaggaccctgcttgtgcattagactttgagatctagagaagtagaatgggaacgttgaagagtctgggaaggtacagaacggagaaggtgtaagtaagcctcatcaatttaatcaatcgagattgaagaaagaaggtaggaatctaattactcattatcaactatgcaccaaacctcatgctgggtattttcaaccaggctgggcaggaggggtgtctagggtgtaaaatttaaggaggttctcactcccagcgttgtgcaagtacatcagtcctgattttcatacgctcattttacttaaccatcagggaaaacttgataggtgagtgtcttagttcattcaggctgctataacaaaataccttagattgagtaatttgtaaacaacagacatttattgctaacatttctggggcctgagaggtccaaaaccaaggctccagcagattcagtgtctggctagggcccactcctcattgatggcactttctagctgtgtgcttgcatgtcagaaaggctgaggaaacttccttaggcctcttttataagggttctaatcccattcatgaggagtccatcctcatgataccactcaaaaacttcctaaagaccctacttcttaataccatcactttgggggttaggtttcaatgtgtaaattttggggggacacatgctatgtgttcagatcccagcagtctgtattaacagcttgacacatttgtatcccatttgaaaacagataagaattcaactccaaagccaacctatgttatcagacttgttcttagaaattcatcttttcagtatacccttatgttatcccagatttaactcagaaagaatttaggagatgaggcttagctttataatgtcatttatgctaggatccatgtaaacaacagatgtctctctactattcctgtcactcaaagtgactcatcataatttctccactttataagacatggttccctcatcctcaaaaagagaacaataagaatatagcccagggtatcatggggctcggtgggttgcaaagatgtacaacattgcacagcattataaatgctcagggaacccaaccttagtgattgagagtccctgtgctcaggagacagtggagattccagatctcaatcaaccttctacttcctagcctagaaagaaattaaggcaccacccccctcagccgccccgggcaaataaatgacctgtgggaaacctgagactcctagagggtggggttagctcaagactatcctcccaatttcggcctcagggaagacctcctctcgggtctcatagccttgtttcccccacctctatttgtatctcttcctggggaaagacgagtgccaaaggcaggatatgaacaagtagttggaaaatcgtgactcaagcataagtcattctccaaaccctgaaaaacccttcctatcacttctactctcttctttttcatgattcctcagggaaaaaaaaaaaaaattattggttcaatgtcatggaaagaatctggtatattttattttatcaaaatggttttgagatttggggcaagaaggagtcactcacacatttctgaggatcccaaaagtttggatcatgcctcctctgtggctggtccctcccttctctctgaagaagctcagtgcctacctcagtgtcagcttcattcagtcaggtgtcattttcaatgccatgtcatttgggcagggctgtcagtcttattaggattgttctccttggcactggcaatagcctatgtcgtgcttctcccagcaaacagcctcaagactggacaatcacaccttgccgaataacttgagctggccagagtcgaatgctcacctctgcagacggcttgtaactcacattacatggacttcaggacggagaactagaactcaggagacataactgaaaaaaaaagaaaaggagaagtttttcttgtggcaaattggagagacacacatgaagtgcacaggagggcctgagctcaactgaaaggagccaaggcagctcccactctgtagagactgctggtctaggagtgacctcaacatacatttcactcaggccttattaaatagtgatagtggtccagtttgtccggttctttaggcctgctactaggtcagacattgtcaccagaaggaggcagttgtgtgagccagcctgggaagatgttagcaaaataacagtagctgcaaggccctgactaatcacttgtatattctcatgacaagcctagtccctggtacgtaagtagttaagactactttcagaatgcagtcttaaaatatattatagaagatgggtgcagtgggtaacacctgtaatcccagctactcgggaggctgaggcagggggatcacttgagcccaggagttcaagaccagacttggcaacatagcaagaccccatccctaaaaatgtttttgtttttgttttttttttttttttttaattagcctggaatggtggtgcatgcctgtagccccagctactcaggagactgaggcaggaagatctcttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttctgtatttttagtagagacggggtttcaccttgttagccaggatggtctcgatctcctgacctcatgatccacccgcctcggcctcccaaagtgctgggattacaggcgtgagccaccgcgcccggcctggaagatctcttgagcccaggatttggaggctgcagcgagctgtgattgtgccactgcactacagcctcagtgacagagagagactttatctcaaaattaattaattaaaataataatttagaaatttaaagatatgtagataggtatattattggtttttctttgcttcactttccaactctcttggttgactctactgatatggccattaagaaaagagacaatccgcagatatagacatattccttggccatgtctcctgatgcaaaagctcttggtagacctatgaggtctccagctctaagaagtcaggtcttagaaagcctgccaggagcttattaatcttccttaagatcttttcaggaattagaaccaagaaaatttcagggttaaaattcaagtaccacctggctgactaaaacccggcatgcctgttacaaatggcactagtctggaaccgggaatattgggccagctcagctcatctgccctaaggatcttatcttaacttgaccatctgcaaagaccctatttccaaatatagttacgttcataggtattgggggtcaggacttcaacatcttttgggggaacgcaattcagcccaaaacagaaggctttatgatgctcttcgaacttgagttggatcttgaagaatgtaaaggatttatataggtggtgaggaaaaagtctgttgcattctaaggaaggaaaatggcacatgaaaaggacatggaagctgagcatggtggctcacgcctgtaatcccagcactctgggaggccgaagcaggcagatcacttgaggtcaggaattcaagaccagcctggccaacacagcaaaaccctgtctcttctaaaaatacaaaaattatttgggcaaggtggcaggcagctgtagttccagctactcagaaggctgaggcaggagaatcgcttgaacctgggaggcagaggtggcagtgaactgaggttgcgccactgctgcagcctgggcaacagagcaagactccatctcaaaaaataaaaaataaatttaaaaaggacatggagtttggagtaagcaaaagcttactccatggggcaataaagaagccagctaattaaggaggaaattcttcgaaatcaagttgaatagggagtgtgggtctgatgatggagagtttgggctgatgggtagaggctttttaacttgatatagtttgaaaagagagcaaagaacaggcatggtgaaagcctgatgtccagaaaacccaggttaagacaaaggataaaaattatgtacattattaatcaccaaccatattctgattttttctaggtgctggaaagagattggagtttcaggaaacaaatattatccctgtttcatattcatggattttctctctctaactatgtaattataaattgagacaagtgctcaaaggaaaaagaacttctctctctagagtgcataatgaaggagcttgacctagacaaggtcaagaaaggtgtctctggaaggggatgtttgctctgagagctgtgggatgtgtaggagttaagcaggggcagtttgatagggaagaaggaagccaagttgtatggaatagaagagtagtgcagtcaaagtttctacatgggcccaagcgctgagcactcagaggatgttgcctagaaagctgttttaaaagtataaatgccattcaggacataggcatgggcaaggacttcatgtcgaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaacccaatcaaaaagtgggcaaagatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaagtgctggagaggatgtggagaaataggaacacttttacactgttggtgggactgtaaactagttcaaccattgtggaagtcagtgtggcgattcctcagggatctagaactagaaatgccatttgacccagccatcccattactgggtatatacccaaaggactataaatcatgctgctataaagacacatgcacacgtatgtttattgcggcactattcacaatagcaaagacttggaaccaacccaaatgtccaaaaatgatagactggattaagaaaatgtggcacatatacaccatggaatactatgcagccataaaaaatgatgactttatgtcctttgtagggacatggatgaaattggaaatcatcattctcagtaaactatcgcaaggacaaaaaaccaaacactgcatgttctcactcatagatgggaactgaacaatgagaacacatggacacaggaaggggaacatcacactctggggattgttgtggggtggggggaggggggagggatagcactacgagatatacctaatgctaaatgacgagttaatgggtgcagcacaccagcatggcacatgtatacatatgtaactaacctgcacattgtgcacatgtaccctaaaacttaaagtataataaataaaaaaaaaaaagtataaatgcctaggttctacccatgcattggagatcccttgtaaaatggaaacgcattccctggggatagagtagcaagtgtatggcctaaccttgatctactaaattggtcttgagtagcacacaggaatattcttaagtctttcttctgaaccttggccagttttggaaaccactagatcagatatctagggcctcacctaaataaagaaggaaagttttgttctcagtgttgcctttttctgctgtcagaggccaccacctttcttctccttaccctctacccccttcccgtccatagtccatgcctatcttgtgcaggagtacacatgtgcaggcacacacacacacacacacacacacacacttctagtgcccatttctctgcttgccaggatgtcttccgaaatccttctctctggcctgctctcccaagctgtgccccagactgagggcctttcatgatctctttctgcaggaacactgaactgacccattttgtaatcacttaggaccctgctatctgctaattaataaagttatctacagttacatattgactggtaaaaatcattccagataattataatgataacttacatgtaaggatatgtggtaccataacttaaaatggcattttaagcactctcatttagtatttctagcagaactaaactgttgtgtaatactagccacactcaacaggtgatgtgtcatcattgaccaaggttaggcagcaaacttgctactctatccccagggaatacatttccattttaccaggggtcgccaccctccttcttaaggcagaggaatggctggtattgagttcatcttaaagcaagccttgacaggattagggtggggatacagggtaactgggcaggaggaaacttttagcactacaatatatgggagacaatacagtagagggattaagagcagtatgtctgggctttttaatgaaaaggcttgagttcaatacccagtgctgcaatatattaactgtgttgtcttggtccagttgcttaatctctttgactccagcttcctcaactgaaagtggggttaatagtagtaccaacctcataaaatgggtgtaaagcttaaatgagataattcattgaaagcatttaacaaagtgtctagcacatattaaacctactttttaattgttgttattaaaccacttaggcaactgccttcccttttgtgagactggccttagagacagccaacagaaaatgaaaatggatgtgtttgtattagtgggaggtgggaagataaggaggaagaattgagaaagcaaagggaagaaaagactgcaaagctctctgctcacttggccctcttctgattccaccagcacaggtaggccattttcttgccctgccagaaggagtagaaattgaactgtgatctggagagctatctgttctgatcattagtcaaacaccgggagccagttagacctaattgtctttgaaaaatctgaagaccaaacacttttttttggaggtcaggctgcataactgagaaggagtcagaggtacctgggatgaaaataaaggcataataggttcatatagttggtctgaaaattagctttagggatctccttatgtttgtttcttaatggtgtgaaacataataatggctttggccataataaagatgaattagggtttttttttcctgaaaaataatgaaactttagtaaacatcccaggtttatcacttaatttatccctagctcatggggaaagagacctccccccaacccagcccccatttttaatattccaagctactagatttcaataacccactctccagcaatgtgtgtctcatttccctggacagaccaaataggcaataacagcctctcggttagaacactaatgttgtgatttagaacttctgtcaagatgaaagatctttgctgggatcctcagagggcccacagcaacacttcaacccaggcccggataatgaagttttcattattaaataaagatattttaggaatgtcataaaccataaatccactctcttctattgccctgccaccttattgtgtttatttctagcaaaagtccatcctctctcaattgccccaactcctccaagcttggtgtttcttgcctttcaaccccttaatcccactgtgatgcacttatgttgccatggcaatagaagactgtgtcttctcccacattgagacccaaaggctataaaaaaggtagatgtctgcggagaagaggagtgcctgctccctctccctgttggcttcctcctccccaccttgtcctgccaatcagctgagagactgactccacacagctttatctcacctcaaggaaatgctaacatacgccatcaggtctggctgtacttaaaaattatggcacaatcaatttttaatgtgaatttagtgctggttggaagctttagactctgagtcctaggaaaatgattcatctgtttattcatttgccaaatattggggtgtggttttctcaaaccccacctgccttaacctggttgtgctcttgccgctaagatcacacacagtcttactgaggctgctcatgccaggctcaggaacctgctccctgtagatccagccccatgctggatagcagaggggaagaagaatggacactcttactttcccaaggcctggtgacacaacagagtcagagggcaaagagagctcagacacttctcagcgaactccataaataagagaagcaggacatctgaaattaggaactcatttagccacccccaacccactattgaactacacctgacaagccagctgtcttaaagatttaggggaaactttccagtctatcccaggaactcactcatatttgcatgtaaccaaatgtctctttgctgtgaattaggctcatattcaaaggagatgaagatctacttataacagaaggggagtgttaatacttagggaactagcttgtacttgtatttttgtttatactcatgatccaaatgaaagcaaaaggaactgtaagattaatcaaggatgaatttgtagatatatccgaggacaaaaatgacgactccatatggcttccagccatctctgtgtagtttcttccatcacagtgatatttgacattgaacagattaagcaataagatatagtttttaaaaatcactttttcatctccattgctcaatgagcttcaggaacagttggtctcagcaaaaaacactcttttctgaaaacatctgagaatccaaattatgaattatatatattatatatatgtgtgcgtgtatgtgtgtatatatatatatatattttttttttttaaagtccatctagaagcacacatcaatcagtttgggctatttattggaggagaggacacaacaagccatagaatgttatcagcacttgaattaattgaaaataaatttcccctcccagcgctaaacaaatgacgaattttttgtatgataacacacaccagcctgcaataggttgctaagattccattaatttaaaaaaatctcatttgaagatagttaacggtttctgcatttccacaaagcgctagtcagactagtcagattacattcccctgaacttcagggtctgtgctgattactactcaattagttttgattcaattcactgaagaaaaatgtccatttcattagtgtggagaaataaccattggacacaaaatatatttctcagcattgctatggcaactgagatgacacagctgagctcagaatgttaatgccttccctgggactacgtttttaagtcagcatgcggtcattaagccttgctgggtgggggtggctccgccacatcgccatcgcaattggcaggcagaagaacccatggcactcccaagaaggcttggttcctgccactcgcctcccctgccacgcccctgtgggctgggcatatcagcaatagcatagattgtcatcttgcaagtccccaaggcccctctttatgtgacatgcagaagtccagctgggcagtgaaaaatgcggtctgtcatctagatgtgttttcctatgtgttgtctgttttgtgaatgcatgcaactgtccgggtgatgaactgacttttgagcttgtcattgttgcattccagccagcacaccattgacagagaagtgaggagcaagtggttcagcagttcagtaaatatggcggtcaacctgaaacactctgcccacttgaggaagacttgactgtcatctgcaccccgcaagacatgtaggcaaaggacgggaaagcagattctagattacgaagcaaataaatggatctgtttgtatgcaatagggagcaaacatgccaataccagtcttcaggaataatagatgtggccattatttagatgttaattagggcataaccaaattaaaccataacaaaatttcacttgggagactgaattttccaggttaaatgaataattgcccatattttcccttaagctatggtggcataatcttaggttaccaattaataattgattgctgtatactgtgttcaaggctccatgccttaggttacaaagattaagtacatggagcctacgccctcaagggacagtttagtagggagatagcatatgaactattaatgaaagctactatgtattgagtactgactatgtgcctggaagtgtactaagtactttatatgcagtattttaatgtaatcctcatattagtattatgaggaggatgttagctctattttataaccaagtacactgaggcttaaaaaagggacttggctagtcaattactagttcaattatggcaagtaactgacagagctggatgcaaacataagtttctgactccacaatcacttggaaccaccatgcacactgcctttcacgtacacatgaatagaaaaggcaggctgtaaatattcagggcccagtgacttacaaaagtaaatacctgatctgtaaggaaagtagcaagtctgattgcatttaattaatttaacttcccttttaaaattcatcttcaaaataatgggcaaaatcagagtgttccatttcttccattaagcagatgttctgcacattgccttcctgctccttctgcgaccacagggagaggaagcacggctgctgcaagagctgccaaaaggcagggagcaagagctaattccacaacaagagcaagctcacagtcggtgatctcagtgtcagagtcccactctaccctcttgggatcctatgtatctgagctgctctatgtttaatcatcatcatgtcaccatcaaaaatatttattaaaccgctgcatacatatgattctggtcaccccatttgttcttgctcccttggcacattatgtaatttcactctatttgtttccagtggtttgacataattttatatcatctttatacctcttcagatacagtgctcaaaacacccagacccagacctctctgagttcacagagtagattcttacccttctctttgcctgaccacagcaggagcagtggatcttggtgacagggatctttgttcagggctggcccaatggctgtctcttccatgtgaagcagaattaaccaacataggtgggggcttgcaatctaaaattatgccacagataaaacatgcaatgagcacacatgccactctgtagatggattttgttgctagaataacatttgtgaaaatgtattctaagaaaacctaatttcttagaatattaaaggatgttataatcatgcagttcagaacatgctactccaaaacatggcaccttggcatttaagaaaacaacagaagcaggacctttgccattctcccctgaagtgggccataaaataattctctgacttttctctagggtagggcataagaccctcattccagaggagtcctccctgtacccagagaaaaggaatgaagacacagggacacagagaaaaacatgaacaaggccatgcgcagtggctcaaacctgtaatctcagtattttgggaggtcaaggtgggagaatgacatgagctcaggagcttaagatcagcctaggcaacatggcaagactccatctttacaaaaaaaattaaaaagctaaccaggcatggtggcacatgcctgtgattacagctatttgggaggctgaggcagaaggatctcttgagcccaggaggtcaaggctgcattgagccatgtttgagccactgcacaccagcctgggtgacaaagcaataccctgtctcatttggatttttttttaaaaaaagaatctgaacaaataggccttgctaagtttcccccaaattattaccattagtaatattcctttgtcctccaatcatacttctgcaccactgtgcataaaaacacaatcttttctgtttctttgggtcttcatttctgaaggctctcatgttaggtaaaacttaaatatatttgtatgcttttctcttgttaacctgccttttattatagcggtctcagccatgaacctaaatgggtaaggtaaatatatcacttctcccctacaatagaaaaacaaaagggggaagaggaggttctccagtcaattatgtttaggagatgctgggttaaacagtgttaatcaggttggtttgtttgtttgttttctgccagggttctcagagatcttaatatactcctgtattgtatgattctccaagtgaagagaatggagggaagcattatctacagatccatttttatgctgctggagcactgaggcaccactcttttgcaagttctggaaaaaacagagcaggggtcagtttagaagcctaacctgtatacctacatcaggaagctcggaaaatggcttagaccactgggacattttgcacgaagattcctaagcttcatgggggacatgttaagggctttgggactgatatttgagcccaggaaacagagctaccaaattaaggcttacaaataagacaaggttaaaaaaaaatctggcccccaatcccagaaagagtggcccaaatgggctggaaactagccaccctgaggtaggaaagagttcaggaggtaggagtgaaggaagtaggaagaggttcagacctaacctagcacaatgatttataacttttagagaaatcctctgtatagaactgaatactttgagaaatgtaagacagaaaattctgattgaattaatttcaacaataggcacattgatacactcagccagtaagaagaccagggttcagaactttagaatctccgtgattctcttagttcacaccgcacattgtttcttggatcccacatcagcctcttccttgagtttgctctttcagtttgctggagtagataacttaggaaggatacattgaacaaattttctaagtccttgcatgtctacaaatattcctgttttactttcacaattgattaacagttggctaggtctaaattgaaaatctaggttaacaaatgttcttcctcaaaatattgaagtcatttctccattgcctgttggcatccagtgatactgctgagaaattcaaagccagcttaattattttcgcttatgtataactttttcttgcattgacttttaggatcttctttttaaccttaatcttctgcagttttgactttctaaattgggatttatcattgttttaccctattcagacctcattgatccctttcaatctgcaaatggaatctttagccctggagaattttttctagtacatctttgatagttttctctcctcaactttctatattgtctccttctgaactcttttttagcgtttggagcttccggatcaattccttatgtcatctatacattctctagttttctgtttatctccctaattgttctagattctagaaaatatcttcaactcatcttcctatcattctactaatttttaaaaaaaattaaatattaacacttacattagttagggcaacactatctgctgctgtaataacccccaaatttcagtggcttatcataataatcactaacttcatattagcataactttttgaacacaggttcccctgtttagcaggcagctcctccccatccaaagaatcagagatttggaccctttccaccttttgactctgccgtcctccaaggcctcacattgccttgcattctgccagaagagggaggaaggtgatgaaaatcttattctcaacagccttggcatgaaaatgtcacatgtctcttctgctcacattccaactggtgaaaatagtcatttggtcccactagatgcaatagggaggagtagggtgcactgtaaaatgtacttcctggttaacaactgcttccccataataactacatacttgggaaggaggaacacaaattttgtgttcaattgatgaccattagcagtctttgctgtagtaattatatacttttttttctttttgtgagctcagtcatgttctctgattgttccttgcctagagtatacttatctcttttgttcataagtgattgcatctttttctttttttttttttctttttttgagacagagcctctctcgatcacccaagctagagcacaggagtgcagtgatgccatctcagctcactgcaacctctgcttccctggttcaagcaattctcatgcctcagcctcccaagtggctggaaccacagacacacaccaccatgccagggtaatttttgtatttttgttagagaaagagttttgccatgttgcccgggcaggtctcaaactcctggccttaagcagtctgcccacctcggcctcccaaattgctgggattacaggagtggcacttttgtctaagatcagctattctttgttattttggccattcttttttaaaattatttttattttgcagttttgaagcctgttttattttgaatacttgttcccagtgatcttggccactctcattcatgctgttgtttcctttagttctggagatccttgtttatgtatattaaagaattgagatgtaggttgattattctgagtagatggattgagttcaactactgtgggcttgtaggcctaacacccccagcagtcctctttcttggcgggagagctgacgtctttgtacaagggtggacttatccactagcagtttcactccaggttacgtggaatcagaatgggagagtcagcagccacagactacaagctccacagggaccaggaaaggaaagactactctgggccaccactcccaattaagaagccttggttactccaggaaattcatctttagagaagaacatctagatgttttcctagggagtttgccggtcattctgtgaacaggacaggacaggagagggtggatgtaaccagcaaagccttccacagatgaatcatagattaacccacctctttgcaattactctttccccttctgccctccttaccaacaccaagctgcaagtgtgtccaggttttaatcagcatgacaatcctacctgcactgcagcctcacccagcaaatgctcaagcctggaccgcttcccccactgtttcctctgtgaacatgcttccattcatcctgtctgatgtgctgtaacctctcagctgatgaacctgcccacccccatacatttgccaccaggtattcattgttttgtatactttccaactatcattttgacgatgcccgacgagggggaaagtctccatttgccagcctctacaaaattagaaaaatacttgtaaatgtcctttggagaatatcaccaagttttatgagaaagaagggctataaaaaataaaaagcagcggctaatagcattctaaaaagatgttggtcagctttcgggagaaattacctttcaatttacatggactgactccatacattcatttattcgttcatttttttgtaataaatactgaaagtttattatttaccacaggctaccacaggtagcagggcaagaaccatgaacaaaaatggtcttctagtcccatcctcaaggaatttagaatttatgggtaaaattaccatttgaaatttgaatttatttgcacactgttagaagttcaggatactaagaaagcacattttaaaaaaaagcacagaaaccagactttgtatttcatggaaggactactggaggaagtaatctgagaaataaaatagaatcagccacattaaggcatggggtagggtgggattgagtgttccaaatagaggaaatagtatgctagagcctcagaagtggctcccacctgcccatacgaaaaacttcacacatgaatattgactgtgctcggaatgccctcccatctaccactcccaatccaccaactgtggcaaaattctcaactcaggcactcacccactctttgaggaactaatggaatcttcccccacaggtctaggcattttcttccatttgtaccttatatgttctatggttttagcaacgggcacactctgtaaaagtgtcgggttcctccttgtatctatcaccaatctaaattccctgaagtcaggagttgtgtttgatttacatttatatctcctgcactggcataaagagtgaatgccaagggctacgtagacaattgatatatcttgaatgttgaatgatgaataaatggaatgaatgaagtgacagaattatgacaatatattgcttgccctcagttgtatacaaatttagtgtgactcagaaaaaaaagtcgagagttatagtgaatgatttacatattcattctatgggaccttggtataagcactaataaaagataaggctttggagaactcccctaaaactgctgtcacctataataatacagcatgccaacttagcattcacattctgagatgaattagcaggaataaggaaagtctttattaggatacctatcataataccagctttacctctcctgctttccttacctctgcaggctaagtagacatctgagaagggataaattccctctggatatgtgtaagttccctgcccatgacataaattttcttcaaatgggactacagaggcaggggaatgagagttgaggttgatctaatcaattcagcctaaattacaggttcttctcactatatatcagcaagttttatcaatggataaaaataggtattgctacaatgtgtatacatgatgttatgatgatgcacatcagaaggagttttggcataagtgaagcaagacagaagatcaactgcaggagagtaacgggtaagagccacagcacataatcaagcaggcaccaaagaaagatcacatatttacagcaaagtgtaagaacatggtcgcatgggtatttaagaaaacacgagtatagccaggacaagaaccaactcagctcaaaagtaacccagtgctgaagaacaaccaggtgaatagggttggaactacagcgactgaatagacactgggagactctgctgtactctagcaatctttgctttgctcgcttgtttagtgttcaattctgtatcttgagcacaataaaaaactgagaacaatggctagtctaatatttgcactgttctgctaatatatttgggtagataaaatacatctttagatttctaactctgtatttaatcatcaacactaagtattattaaacttccataattgaaaataatctctattattagagtgaccatgcatcctactttgcttggaatactcctagtttatatctattatcccagatccagcacagtttaacattcatcctagaattttcatttttttggcaaagcctgaaaatatactaagatgagtttggtaattcccactttgtatgtctagcttctgctagggtcttgtctcatagtacgtagtggacagtgttctgattaacacatggtttaatctgacagatgataagtggtagcttaacttatttttcctttccctttcaagacacgtggtgccaacaccttcttttcaaggacagcatacactccctgataaaaaaggaggcttgtaataggtggcgaaggaccactaactcccctgatctcaggcagcaatgggagaagtattcactgttgctgccccttctggccacttggtgtatcagcagctagctgtgctgtgaccaggacaatgcccaaagccacagcctgtgagttccagaagtcatcaagccactgctcagtaggatagtaggaattgtcagaaatcttacttttggaatatgtaaactatgtacaagcaatatagaccttactgtcataacatagaccacagagagagtcgtttgaacactttttttcaggggtgtggtatttatagtatgtatgatctaaatctacaattatgtatgtactttactgtttagtaatgctttgttttattttgtccttttcaaagaaataatctcaaaaagtgtaacatttaaggaaatattaaatattgaattttcatgtcttaaaaaagttgatggtgaagatgcaaattgcacaaattattggtgcacatttaccatctacctgaaatctaccagaaggcacacatattctgaagaagcattagcatttaattcaaaagttagtgattattttaagaagactatttccaaagatgtcaatttaacaagtatatacagctgcagaagtttcataatcaactctgagaagcatgacttttcatttggatcaatgttctaataaaattaagaaacttctggagcagaactctagttaaaattggttgcactaacctgttattcataaagtgtgtcccaacatgcttagatatcaaaatagaagcagtatttaaagcagctaaattataaatctttgtgacaacattcatgtttaattttttttaagtttcagtatggcaatgcatgttttatctttttacaacaaaggactgaatgtttatgtcccactaaaaactatatgttgaaatttgaaccccaaagcgatggtattagaaggtgggacctttggagggttattaggctgtgatagtagaacccttataaattggattagtttctttataagggattccagagagagagatccttcacctcttctgccatgtgaggacatagcaaaaaagtggccatttatctaggaaccaggatacagccctccaccgacaccaaatctgctggcactttgatttaggacttctcagcctccagaactgtgagaaataaatttccatagtttataagccacccagtctatggcatttttttttatggcagccccaacagactaagacactcatcattagatttgtaaaatgttttcatttttaaagaactaatttgtagatcaacctaagtatcttacaatagtattgaaccttattgtaaaacagtcctccaaattaaggttgaattttgtttgaaagaaattgcaattttttattcaaaatgtttgacacatgcacgagtatgttcattgcaatactattcacaacagcaaaggcaaatcaacctaaatgcctgtcaatggcagattggataaagaaaatgtggtacatatacaccatggaatactatgcagccatataaaagaacaagatcatgtcttttatgggaacatggatggagctagaggtcattaccgttagcaaactaatgcaggaatggaaaaccaaataccgcatgttctcacttctaagtaggagctaaatgatgagaactcatgaacacaaagaagagaacaacagacactggggcctacttgtgggtggagggagggaagggggagaggagaagaaaaaataactattgagtactaggcttagtacctgggtgatgaaataatctgtacaacaaacccctatgacatgagtttacctatataacaaatctgcacatgtacccctacacctaaaataaaagttaaaaaataaaataaaataaaaccgctttcattaaaaaaaatgtaagggaacaccaaataatttcaacttttgaaatggatatcaaattgtaactattgaaagaaaaggttgacaccagaaaaacgatgaaatttaatcccacaaaagcaaaggaagaactgaacaaactagatgataggagatgaaaggcataaaacatttagttttgaaattctataattacattttggaatatgttgacctctgggaagaatcttgtgatggggttcccttttttactattggataatcttatattctgtactggaatagaactatgttgaggtagccttccaatgtggagataattcattgacaaattttgtttggtaaaattattttttgaagaaatggatgcaaaaagatagtacatgtgaaaacatttgatataaaatatttatatatttaaatacttttaaatggtttcaagaatatcttccaatcagcagatatactctgagcttaccacttaccccaatacctgaggaattttctcaattagaaatagtattgcctataaagaaaagtcagttgaagttatcaacaattctaaatttattaagcataagatgtagctttgagggagactgcagtcaactttataaaaaaaattgaataataagccatattaagaagtcttctttagaaaaatacttatagtattagagattgatacaatcaataaatgaaatttgcactcgttcatgtatgaaaagatataccaaaaataatgattgacctatgttattttctgtgttcacagaaccaatataaaggaattttatcttactttaagtatatgatacttgttccttgtatttttttaaaacattcaccttttttggaagtaattgttgaatagaactaattcatatattctcccatatcataaacccattcgtaagttaataaatgcatatttcaaaagttatatagtctgtattattttagtactcccttccactctaccaactttgcacttacctcatgggcaagtcttgtttctcatggacaaagtggtagacaatttctctctcaatgtaacaaggagagcctgtatctcagagctcctgccccagtggctgtattgtcctgaaacagtcgtgatttagggacttcccagaaaatggaacagacactagctggagcctcatcctagattttaacattaactcatggaaacataaactccaagctagaaagaaactaaagaaagaatgcaatttagacctgtcctacaactgcaacttccactcttagattggtatagtgcaccagaaaaatcagcctcaactctttttccaaacagtagatcttggaaactagagggggagcagtttctcaatcaagccatcacaatagcaaatgtaattttatggacacactaggccttcactgcaggagtaagagcccagttgataaaatatatattctgtaaccatgcagatttttgcaaaaataaatgtatttttaaataaagtcattcatagactatagatatgttaagtatctctcaatgtgttctctcaatcaaacatattggttataaaaattggaattcatcagcatattacacatttatgagaatctgccttctctacagagggcaaaggcacaggacagatggcaggtgtgggactggctcaagctgggagaaagtcttgattgggaactttaaaccaataccgaaaacgatacatttaaaatttctattacacacagaaataatggctttttaaacatgtttataaaacttaacagtcagtgtaaaaattatggaattagcatttccaagtccttttatttggtatcttaaacagcgggattgttttattaagcagagaactgattttagacatactgtttttagatttttctctttattggagcatatcatatttgtcaatttttaagaggactgccctatctgaaaatatgtacccttctgaatctggacttgattgcatattaataaaccaccagaaatgataaacattttcaagaggtagtagaggatatgaaagtagattttctactttttgaataagttgattgtcttctctaacatatcgtaaagacaggaggagcaacctgtggatagcaaagcttgaagttctttcaaacacaattgtctttccttagctatgagtcttgtctacaagaaaatctactggtaaggaaaaaacaatattaagagcctattatgcattgaatgatttgcatacctaattttactaatttctactgaaaatattcatttttaagatgagaaaatttcagcttagagaggctgagtagctggcttaaagtctcccatatagtaagcaatatttatatatttaaatactatatgagatggcaaacccaaatgcatgcgaccacaggatgcatcctccttcatcccatcacacagccttctacctagtgtctttgcacatctattctttattcaaatctcacctggaatgacaatgatgtgcagggaagagagggaaagacactcacacatttgaaagccttcatgagactcagttgcccatgttcactgtaagctcagggtaagaccatgtctgtattattcattcaccactatatactaagtacctcattctatacacatggcatacagaggccagcaatatttagagggattcaataatttttgttatgttttgaaagtcatgagtaaaaatcgtagttggtgaggggaatggagagaaagactgaaactgtatttttgacgctattggctcacagttgaattaacctttccaccgtttttccagtcattcattcaataaatacttattttcatgagttctgggcatgagggatataatagtaaacatgttgtcatcttcaaggagctgacattctcagcaatcaagaaatctcacaatcagttttgagtccctgcagctgccctgtgagataggtgaagtgggtgttatttataacttgctgactctctcctatgttgcaaacatgtctaactcatgcaattttcttcgacaaagtacatcaatggctcaaataactgaacatgtattttgttattccagattcccttttgtcctcaacacaacataataattttgtattattttattcactaattttcctaacagtgatgcacacatgcatacacatacacaccctgctactaccgaccccgattccatcccttcctacccttccaccacagtgcttaattgagaattatcattactgtgtgtgatgtgcttatatggttgacacctgggccttgttttatattatttttaatctttccagtaacctcaggaagtaggtatcactatcctggatttaaagatggaaaaactgcagttaaggagatgattttcctcaagaccgcaaggctagttagcagctgagttcaggtacccgtgcatacctgtcttggtcttgtctgggttttcttactacatgatggctctggcaggctttctcagacacgattctcttctgcctttaatccattctccacagcttcaccaaagttctattttcaaagcacaggtttgatcctgtagctatcctcacaaagtattaatggatcagctcagcttttaggataaaacgtgaaaacctctgcgtgaaacgcagggtccttcctgactgtccccagactcctttgccagggtctcccaggctgctcttccccgccaagtgtttcttcccacaacacagctgtccttttcctggctgtttgttcacacacttcatctctgccctatcctttttctctctctctagcaaaaccccactcttcctttcatacctacttcaaaggattcctcttttggaaagctctctgtggcttctccagagagttactccctcttctaggcacccatggcactatgtattaacagagtcatttgtcacatgggtttgtttacttgttatcacctttgtttacttgtcttcccctttctcccttactttcccctgcaccactacagtggactcctcgagggccgaaccaagtttctatttgcctgtattcctggagcatagccctggccttgtcacagagtaaggtctgagaaatcctaagtgaatgataagtgaagctttctttcatgctccttcctcaagccagctgaaggatggccagaagtgatccccgcaactgtgagaagagccagcctccggggtggtggtggccccagccaacctcgagatattgcccagtagaaatgtaattttcagattgtcttgatgtgacttgatcatgtgataattgactgattgtgtaatgtaaaacagtctggctatgaataggccactctcagagatgaaacgtaaatgagagactgtctgcataatcagtgtgtaaatgcaagcatggtacccacattcctttttatttttaaagagctgaaatgagaagagcttccccttcccaaggcagtctctctcagtctctctgtctttctctctctctcttttcttctcactaataagctttgaacaatttggtggaaaggtgtgatattgctctcacagacaaataaccaaaaagtcataatgttgatgtgattatatctcactgactaaaaggaattaaaggtagattctttttattagtttactgatcctgggcatccaacacctcataactgctcaatatatcatgctagttaatcattcttgtcattatctttaatgtcttattagcgggcttcattcatctggtttttatctgtttcattggaagcagttttaatctcatttcagcggcgctgatgataagcctgttagtttgcacaaattggttttgttgacaatgtgtagatagcaataatgtgtgatttccaaatggaaaagagaaatctatacaagtccaaaaaggcaggtgaagacagcaaaggagctgcgaaagttggagacggtaccctcagtttcctaacggaaaagtagagaaggtggaaaagaaagtgagagaaaaataaaacaggaaactcagataaattgctacagccctccccccaccaccacctttcacccagccacaggactcaggaatgctagctgtgatagctgcatcatcagaccactgggcaacctaactgactcaacagtgtcccattgcagaggtagaagaaggtagcatatgcccaactctcaagattccactgagagtctgttctctgtacaaccagacatcgtccctcacagaccttctcgagtcttccctcctgctctaggggacttaatatgaggctgtctttgtgcaatttatccagctaatggagcagcttgatcacttccacccaacattagattggcctgacactggccctcttagaataaaggagacaataagcccatcaggctctgactcaaaattgcattaagtgcagatgttaaagtaaatacagtttcctctggttcccagattacaagtcatcttctggcaaggggaaaaatcaataacccacccatctgagcaggaaatcttggaatggctatctgatttaagaaggcagcctctcttgaatttcctgattccttcgcttttggggcccaggtaccaaagccaggaaatgaggctttgtgtgtattacagcacgggcccctttcttgggagctctgatctggaggcaggtgtctgaaaaccagaatcaccctccaaatggactgaactctctatctgacacacccttcacaaatttaaaaaaaaaaaagaaaaaggaaaggaagcatttcaagggaaatgtgtgtcataaaaggcttcaaaatcacttgtctctgagacaaacaaatactagccgaatacagacagtcgattacgtggtggtgtttggggcgggagagtgctaatattattccaaaatcccaaactgccaaaacactttgcagtttcattttcagtccctctgcttttctaggaacgtttggtccgtgtttgtctgattcattctcacaactccaaatgttcatataaagtctgcttgtaagatcctgagactttttttccagaaacccagaaggttacatttccaccgaacctaagtgaagtggcaactcctctctattttagaatgtgaaagtcttcaccagacatttcaggtagtctaagctcagaaattctcacaatcctcctttatcccatgctctgatattcctggtttaaaagcatagatatcttgtaactattctgtgtgagcaaagagttgggataaagtttaataccccgcttctgatctgagcctcggaggaaaacggaatctcaagaccacagcacaaataaactgatttccagcaagttccaatagcatacattagagagagctgagccctgcctcctgaacgatgtggccaccaggcgcttgttgccagcagtaacatcaagaatccagtaaatcagctagatttgcgtttttattcaactttatgttgttccttatatggaaatgatagcttaggacagctgggtacttgcctagggacatatgagtatagcgtccataattgcccaacccaaatggggacatattgcttctgcacatggtctgacaagagcatggccttgtgaagccagatttggcctctacaatctaggacccaataccagcacgagacaaacaaagagagccatggagcctgctgtcagcgctgtctgttctggaagttctcatggagatttaacttgtacatgtgtgtctttgtttctcttctaaaccatgctgctaactctttggaacaaagtgcacttttgcccagtgtggtctgcttaacagccagtgtgtaccatctgtatttaaatttgttgtcttgtggttttggagatgaactgaaaacctttcagtgaccaccctcccctcccccactggatttcccactttgaaatccagcttcttaaggtgagggctcagatctttgattattttctgccaccccacactgccacagaatgcactgccaagtgtccacatagcattgagagtcttgtgaagatctatgccagcagcaccaatgcaaagccaagcctgctttaggtgtgcagagggtaccatacttgactagagaagaaggacctcattcctctactcctccatgtccttacaataaccagaaactgcatgtgtaaggatgcctatctgtgtaaagtgccgagtgcctaggagtcagatccattaatagcctgatccaagtttgcaagtgctgttggaaaacaagagccaggaaaaacagacatgtggtaaatggtccatctgcctaggtctagaatccagatattgccaacctgatgtcaggaactcggatggaactgctgactggggttcctgccaaacttcttcaaaactttttgctgtacagctgacacctatttgaaagtttctccctccttcatcccagagagataatgtaaggtttatctgacctgtgtgcagaggaaaaacaaaaataaaagtaagctgtgaggtcaggagcagtggctcatgcctgtaatcccagcattttcggaggccgagacaggcagatcacttgaggtcaggagtttgagaccagcctggcctacatggtgaaaccccgtttctacaaaaatacaaaaattagccgggcgtggtggcttgcgcctgtaatcccagctactcaggaggctgaggcatgagaatcgcttgaacctgggaggtggaggttatagtgagccgagaccatgccactgcactccagcctgggcgactgagtgagatctcaaaaacaaacaaacaaacaaacaaacaaaacagtaagctgtgttgctcactctccattagcctgttctatggcagtcacagaacagagtttttgtgcctctgtcctcgtgtgattacaaacatctctctaactgcaggtggtgtctgctgattctctgagctcctctctgacagctgctgaggccacagacacctgagatggaggtgcagatccctcggaagaggcttcagatctcacaccatctctctgccaaagctggttgcagtgctccaggactctctgacgttgcctggtgctggtgacaaccagtgaagcagagctttctgtaacaccacttcttgtattgaatttattgtagaatctggaccctgaagaataggtatcagaattttccctttctttctcactgaggtattgtcccagaccaagcttgtactcctcgatcttctttctctaggacataatctctcccaacatatcctcagtatctcatacaagtggataccagggagacattgagggtgtctccccaggtgcccagttttaggataaaacagcataggttcaaagtgagactgaccccagcccttgaatatatccacagctacccatcccagggttcaggatactttggggtatttcttccatttcccatttgatcacatctatcaagttagatttaacatttggggagatgtatgtaacccagtaaatggcccactcttcaactagattcgcgttcaaagaaacccaatctctttaagttttttgagaattttaatgtttatcagagtctctttcaataaaagtgtcaaaggaacccaatgcacagcccccagtaaaaatttaaaattctctttctccattcctctgattctaactctctcccacatgccctagctgatctgaatcctttcctcaagaagacattctggttgtctaggtgagctcttgacttttctccttcttcttctattcttctgtctctattctttcattcctcccatgagtaaatctgtccttttatatgcaacccctccgtccttgcttctcctttcggtctctcaccactcactgccagaattctgcaccacagaagtccaagagttgggcctcagagggattcagtaatatatctcacaaggtagaaaccttcctagagaatgagaggtgggagaagctgagcatgccaagactgtgttctcttaagtgtttggggtctagggggaaaggggaactgtgactctcccatcaacattaggttggtgcaaaagtaattacttttaatggcaaaacccacaactacttttgcaccaacctaatactttttgtctctaatgcataaagatcaaggccgagtttaaaaaggacttttaatcttatgcctctctctatggattctaaaccagttgagaaataggccctggaagtataaggaagtccaaatataaatttatttgttggtgaaacaagattggagaatcttagacttgtggtcaaaataaagctccttacagctttctttcatgctcaatccacagggctcagttggggggagtgggggttgaagagctgactgcctcatgtcttcctgagctaaagatctcaaggcccaagagacagaaggacaactagaccctcttgcagaagggcagggacagagggctgagaaggcctgcaagaggtcaaaccatccttgtgcccctgcctgtcatccagtctcccagtcagataaatcgtcctactgccatggtccaaggcaaagagaagaatgcgaaatcccttcccaatacttaaaaagctgtttaaaaacctcaatatttgctaagtaagattataaacatggaaatagggagaaaatactctgtaattaataagccatagtttttgcccacaaaagctcattctagacattgatctttcaaaagattacattgcctttcttcattgaaagaaacaggctaggaaagaatcagaaaataaaggttctaattcagactctgccaccatagttggagtttcgtgttgagatttgttccccaaattatctcccaggctcagcagccctgtcatctctacacccaaccccaagggccaatctgggcccagtgccccgagttgtcacttgtaagggaaagagaacacatctttcgtaaaagttttattcacttaaaaaattagccatgatctgaaggtctacagcagtacagtggctgaacagcctagaggggctatgaattgtccatagagcactatctacctttgttcaaatcttgaccccatcactcaacagtcaagtgacctctggcaattacttaacctctcaatttatttctctgtaatatggggaatattaacagtacaagccttacaacgtggttttgggaatcaaatgagttaatgtatgtcaaacacttagaacaatatctggcacataggaagtgacatgaaatgtttaccagcattattatagtttagtaaattcaagcacagaaataaatagaaaattgtaatgtcatcaccatcattttatgaacatttctagcaacatgaagatgcttatgcttcataattaaaagtcagaattaaaatgttaatgtgtcattttgaaacatgtttaaaaagtatagaaaacatctaaaattgtaacaaaatgctaattggttatcttggatggtcagatgatgaaaagctttaatttttctttatgttttcgtgcatgaattttctataatagcatgtattcactgtaaagaagacaaaatgtttattttaatattttaaataattttggtgtcctgagtggatttaccaggcaaaaccatcttcaacaaaataccactcttccaatctgggtatgtcacacattatacagacaataaatcctacttttgatggaagaaaaacattcctttgccagcaataaattactttatttctatccccaccctcttaccccaccccacaaaagttataagtgctgctctctatggtaggtgtttctcctggggctgcattccatagctctatggtaggtatcaaattctgctattcctttgagggtttatccatcccaaagacagttgctgctcgaagcacgaagctttgtgaaccccacctgcccccaccacccaataccaccgagtcatatttaccaaagtattaagtatttgatgacagagtgtgctaaaggccaaaaatgacagctaagttcacacttctattgcagctccattttcccctgaaggtaaaaactatttggaataataacaaaacctgaataattcttgccacaagttcaagcctcagcctccagatttttaactctctgagttaaaaattcccgagataggagttcccaccttgaccctcatctttgaattttatttctagttttggggagctggaattcttcccagtgtttatgtgattagcttctgtaagccagaagagctatctgctaaggggatcgcaggactcattctacttgtttcggcatccaacccaaagaaaaagcaactacctggacaaatgttgtcatccaaagtttaaatcaagcttgtccaactcatcttattttgttgttgttctgttttgttttgttttgttttgttttgttttaggctcttagcagcctgaagccatggcttttagtttctgcctctagtgataagtggaaaagagggatgaggaaggggctttactggcccaatcagaaacagaaactaagaatccattactgtattctctcccttggataccccaaatccatcatgaactcactcccaccctggttcagagcccagcatcagagaagattgactgaggtccaggccactcacacacaagttctgccttgtcttgcctttcttgttcctttttattccattgagctcatcaaagcccacagaatagtataactggcagagtttagccctgctcaccttgctctacccatcacacaactagatagaaataatagtagtcgtgacataaacaaacacaagaagcattcactatggccaagcactattctaaggttttaaagatagcaactcatttaatctgcaccacaaccccgtaaagtagataccattattatcatccccattttatggttgaggaattgaggttcagagagcttacatagctttcccaagttcatgcgaagccaggactcatgccggctcacatgaggcagggacccttggtctgtttagtcaccattcagtggtttttgacttctccccctcagaatataaagctattgcctagaattcaaaagctaatagcagcagccaacacgcttagaaccttcctcctaagtctgctgggccagacagaaactaaacaaaatactgtaatcacagaggtgaaaaaaaagagtccctttgactttatctcaaaaacgttttctgaccacctgccctgtatggcaggtgttgcaggaaagtcagggatggataaaaacagggcactgttttcatgcaacttagaacagaataggggaaaatggaagaatgaaatatgtgttgagtattaatacaagttgcaggaaaggctttttatctttttaaggagtaggcacagtacaatcatcaaactgcagtgaagcagagactcctgggcctcccacagacatccctttcactcacccctgccctcaacatcagaccctcagctgaggctgtaattatcaagggaaggggaaaggaatgcatactggttgatgatctcatcggtgcttacaaggatgctagcaggaagccagtatgaaccccagtttacagatatagtttctgaggctcagagaggttcaataatttgccttaaaaacataaaactagtatgctgcaaatacaggaattgaaacctggtctggccccagagtggatgcacctcctactgcaccacactccctccctccactaaattgattgctgagactcatctcccaacaaagcctttatccatgggtcccgtttggtgagtgattgatgagcatttctgagcgatgccagcccctcctctaggcctggcctggctgctttgccattccagaacaaacccacgtttgatctacgaggctactttcttgccatgaaaggatgtgtctcccaagtgacctcttccttggtagttggagagaaagtgtgataaaaagcaaaagccgtgtcctttgaagataattcatacattggccagtagataagataaagtagctggaaatccagcacaagctacaaacaactccacattaaaggcatctgtgtttaataaaactgataaatcaaatgctgttaggtggcgtctcctggctatgttttaggcccataattggtgcatgcggatgatacaagaatacaaggcactgagccagcagagagactgctaacctctgacgagcccctcaagtacttccaggattctctccatgatttgtttggagaagtttgtccaaatagagtccctttcctagaaaagtgccaggctatcaatttacatacttaaatggggagtgcgtcctctctctgggtatcttcaaggacaacaaaaacaccagagaggaaggtaaaggaaaggtaggaatggggaaaaaatgtaagtacagcatattgatttattgtgcatttcatatgtgcactttacatgcattttctaattttctcgtcataatcctgtaagagaggtggcatcatcctcctgttgcaggtgacaaaatatatgccagttaaatgacttgtccagtagcagaactgattgactccaaagcaggaggagaaaaagctagagcagcttgaagtagtcactgttgagaagataggactaggaaaacagctcctctaaactttaggctggtctaagattattatttaaagattggaaacctattcgcattaggtaagagaacaaaagttatgggtttaggtacagaaggagaaattgatattaggtatctctgagggccaggggacctaataggaagtggtggaaattttttgcctggaaagagcctacatccaccagatagtctggtgcagtcatgttgtagaaaggacattagataaggtccatgcccaggcactggctcttacaagcagcctgactttcagcatgctgcaacctctctgaccttcaatttgctttgtaaaatggagacagtaataactaatttgaagtatttgtggaaagcaataaatgaaatgatgtatgtaaaatgcttggtaaacactaaagtgctatcaagcatggggactgttattattccacctttctggaatttttatacaaaatacagcacagaaacagaggaatggactaaatgacttactgtggctccttttttgacaacagaagtagatttttgacaagaagtagagcttgggagtgaagtcaagctctctttagggatgatcagctttatagttttcagaaaaacctcagcccaaaataaagattccttatgactccccctccccagcaaaaggtttcagtggcatagtcagccccatctctaccagagttaaagtgccgtggatcaggtcaaggtcagctgcctcctgccaggaagaaagacaattaggatgaggagtgagtgttataccaaagggggttcatgatttggggctaaaagaaattgaccttttgcttcagaggctatttaactccaagagattccaagctttgcttcccttccaggggccaacttaaaaaaaaaaaaaaaaacaaaaacaaaactgtggccttaattatcataacagaatgattagtcagggacagatggcttaaggtctattccccattctccctatagcttacacgatacacactaaattcatcttttaatcaatgttgtaaatagctatctcctttcattaaatgagagatagtatcaatctttaatgatcagtaatatataatgtcagtttcgttcctgtctgatgtctatgggaagaactgtgcaagctggtagaaagggataggctcaaaaatgttaaaaagcatatagacatacaagaatatataagtagaaattcatatagatacacttagcatatgaattaaatgataaagcagtctgagatcatatctgcagtttaatagtgagaagctccagctacttcataactacagccttattctctcaaagctcacattgaaaggccttctgatttttaataggataatagcactttggcccttttgaaagatgtggggtacaattttgataaactttcccacaccagtcaccaaaaatccttcataagactaacgaaatcaccaaaagtaactgcatttatcgaggaagaacctcgcaggttaaaggctaagtcagcatcagcctggtacaggaaagttgttcttgaatgggagactttagctcaggccacagaggcactaccggacggttttcttcttacacagctgctgagctttttggagaacctttgaagtcggcagtggtggactaactcagccatcccctttcacactgcagtcattgttgagggcctactgatgcagagactatgttcagtatgtaatggcaaataccactttacccccgactttccctcaaggagcttactgtcaagatgagaagacagggcaatgcttcaagtcacaagtggtgaccctagtttgcctgaccttcatcaatagataggtgggatgacacagagtcacttggacctaaggatgtcctgaaaaggcccagtgagaattcatcaagcctccggtgtgtactcattttttgttagtgttgggcaaatggactgtttgcagaacattatcttaaagccaattaacatcttagtggtcaaaggaattttccatttgcctcttggatatccaatcccagtcctcgcaagaggaaatttcaatgcctacaaaagcataatgttcaatatagcactggaatttaaacctgaacttcactgtcaaaatgtaatattgtcatcctttgcattgcggaattatttctactttataaagagtgttctatttggagactatctcatcttcatagaatttagccatagaatcaatttccaaatataatttattaacctcaatttacacatgaagtaactgaggtccagaaaagttgttcaagaccacacaaaaatggtgagcagaggcaggcctcagacccagggccctccaactccctatccaggcagggatatgaatgtgtcaactgcagtcatctgacatcaaggtaagaggatgtgattaatggctgtttgccaagtatccacagatcctaggagaaaaacacattatacaagtgcaacatattaagctaattagtacaagggaaattccttgaagatggcatttcaatcagaagctctctttagaggttccccaaacagtaggtagctctgtaaagccagtttttcccgtggtgcagaaatcataaccacagtttggtcatgcatctcgctcaacacagagacctgaatagaataagaaactgctttcaactcacagcgagatgggttagagactgaacatttgccctaaacctgcttcactgtaaataaaaccaagctttaactccaactaaggctgggtactctggacaggggagataatgtagaaataattgacggtgatttccaggagagatgggggcaaataaaggaatgtttgttgaatacctactgtgtgctaggcattttgcatggatcctagcacttcgtactcaccacatcttatgaggaaaggacgattgtattcttctaaaggatgaggtggtcttgcagaggttaacaaatgtgctctaggtcacataggcagtaagtagcaggctcccaacctgcatccaagtacatctgaccaaaagcccacgtttttcccattctcaagtctaagacaagccagtcattgagatgatgctgagaaagaacagagtcacatcttagagagaaatttacctctggccataattttccacagtaggaccagctatataacatatatggagcccagtacaaagtaaatatgaaggactccttgttcaagaagtattaagaatttcaagacagtgacagcagaatatgaaatcaaagatagggacctgctgaacaccaggcaacgtacaactgcacagattgtatggctatgaagctggcgctgcaccactgaatctgaaggaatgaacaagtgagaaggcaagagtcttggagttggggatgaatctggaaattcatcctctgaaacaacttctgtgtggtccacaagagcctcatatctcaccaaggacctattcacacacgtgtgagcacgcgcgcgcgagcgcacacacacatacaggcacacgcgctgcctaggggaactcacagatcaagactgataaaaattacacggcaaggccctgggggcaattggaatcctttttctaatctcgggaaaattcgaaatagcatcccggtgacacagcgaatgagagaacatcacccctattgcagctgtcacttgtatctgcaatctggtgaattatagagattagccacgtccaagaattactgcactttttgcatggttctgtgcatggcccttcttaaggtggaattgctcaggtttgtactcagcctctggagaagacttaggaagttccgtgctgccacctagtgttcagaagcaggtgcaggagaaaccgctgaaggcctcactacttctgtaggggctggagccttcccagaagccacgtagaagaacgctgcaaagctttcctgggcctcaggcaagcttattttagaggtcgcatcctgcattacttcaaagacactaaaatgcacccacatcccacactaaataaatttacatgtagctaagagttgagttgcttttgagttagttggcatgttttgtagacagtagttaaacattggttttctttttgaattatggagccaatgtgagggttttttgttgttgttgtggggaggagggctttttcatattttcctaagaaaaatatttgaaaagctcctcggccctaagcttggtgcctttactggccgctacagtaagtagacaggaaagcagaggaaggccatagaagagaaaacattggcgatatttgcatctggttgcctctggggatcagtccactacaagcactagtctttagttatgtccatgtaaagttgcagccttgggctgctgaatttatgtagaagagtcacaggcaaactgtggccaggatctatcacaacttagtatcaagattgttttttattttattttatttttatttttttgagatggagtctcgctctgtcacccaggctggagtgcagtggcacagtctcggctcactgcaagctccgcctcccggattcaagcgattctcctgcctcagcttcctgagtaactgggattaaaggcatgcaccaccaccacacccgactaatttttgtatttttagtaaagatggggtttcgccatgttgatcaggctgttctccaactcctgacctcaagtgatctgcctgcctcaccctctgaaagtgctgggattacaggtgtgagccaccgtccccggccccaagattttattttaaaataacaaaaacaagaaactcctggtcaggtgtgctgcctaatgcaattcccagaaaaggcccctgtcctcccacagctctgtgagctgctgacaggcaagaagccaatgacaagtttcatgtccttccttccctgaatccctccagggaatgaagagaagagggtgtggagaatgacttttaattacatcagaccataaatgctgaaaccccttgcacagctcttggaacagagacacaacatgcaaatgttaatcccctgcttctcccgcctggattgtgcctctgcttagcagggacgggcaactccttggtatacgagcacagaggcaaaaccaggaggtgcaaacataaccagcttcatttaaatgaggacaaactggagcaggaaaagaaccggcaaattcatgttggaagaagctagagcgggcatagctagcagcctgctctctcgcacagctgaaggaaatctatgtggatcaccttgttacttatggatgggttttataatcctgcacctttgtggatttaagatttctgtagatttagggcagggttttattctaccaattagtctttcttttcctccctcccattatgtgttcttcaagctctttaattttatcttcaactgcactggccgagaccgtttcccccattaactatttgtgatcacagtttactgcaagcctgcttgacccagcttatatctaaggattatggggtcatgtgattcagagttgggagagaatagaatccaactccctccagagccagagtcttcttcccaaggctctttcagaccctgcctcagttctacttcttcaacaaggaggttgtcactttctgaggaaggctgcttcctttcagtggtaaagaagcacatctgcaagaaagttctttcttctcctatccctttaagatttaaaccaagatgagtgagtgatgctgtgtttgggagtaggcatttgactcctttctgacaccactgggagccccacacggccttgggccttggcggattccacagggaactgacaacattctttggagagacactgaaacaaccagccccactctatcctctcgaaatgcctccaaggatcccagacttttgtgaaaggaggtagtcgaaggactctagggacgcttgagcctagaagacgatgaacaacctctttcttacacttgagtcagggctcagttctgctctgagatcctgcaactcttctttgtagacaccagccaatggcactcttgaaatttttgaaaacaggatcctacagagacttgtgtgtatatctccacagaccaagtattaaactaccacttcagcgccatggttctttgtgattttaaatgtgggtgagtgggtgtccaagtgctgaaacctcaattctaggcttctgaaatctagaaggaataaccatctgagtgtgaaggaaagaacacaatttctttaaactctacaccagctgcacaaaaagagagaagaaaactagaaaattagccctgagtttctgcatcaggtggaaggtcagcttcagagagtagactgtagctcctggaatttgatccttctattcaaaagcaagtgactgtgggctgagtagctcctgggcttggtgctactcaagggatataggaatgcgcaaggtaagcacagatccctagcattcccaagtttaaagagaaggaaacaattaaacaactaaaaatagtctcgaaaccaactttacggagtagtgattcttcataaggaggatctcttagcctactgctgattgtgcacattccccaactttaactatggcctaagaaagattgtccctaaaccaaaagctcttccatgtcctactcctcctccacccagcagagcccgatagagggcggtgattttacaggcctgagaaacgtgttgtgctcattttctactgctgctgtaacaaattgccacaaatttagtcatacaaatttattcccttacagttcttaggtcagaagtctcactgggagtcatgagagagggcatccttgtcttgtaccagttgagggaatgcttccagtttttgcccattcagtatgatattggctgtgggtttgtcataaatagctcttattattttgagatacattccatcaatacgtagtttattgagagtttttagcatgaaaggctgttgaattttctcaaaggccttttctgcatctattgatataatcatgtggttttgtcattggctctgtttatgtgatggattacattgattgatttgtgtatgttgagccagccttgtatcccagggatgaagccaacttgatcgtggtggataacctttttgatgtgctgctggatttggtttgccagtattttattgaggattttcgcatcaatgttcctcagggatattggcctaaaattttctttttttgttgtgtctttgccaggttttggtatgaggatgatgctggcctcataaaatgagttagggaggattccctttttttaccatggaatacaatacagtcataaaaaaaggatgagttcatgtcctttgcagggacgtggatgaagctggaaaccatcattctcagcaaactaacacaagaacagaaaaccaaacaccgcatgttctcactcataagtggttgttgaacaataagaacacacagacacagggagggcaacatcacacacccacgcctgtccaggtgtggggggctaggggagggatagcattaggagaaatacctaatgtagatgacgggttgatgggtgcaggaaaccaccatggcatttttatacctatgtaacaaacctgcacattctgccaatgtaccctagaccataaagtattttaaaaaaagaagaagatgtctcactgggctaaaatcaaggtgtcagcagggctgtgttgcattctggaggctctaggggagaatttgcttcttagctatttttagctgcttaaagctccctgcattcctaggctggtggcctctccctccatcttcaaaattagcagtgtaacatctagcagtgtaaatctctatgactctgaccctcctaacttcttcttataaggaccactgtgattacactgggcccacccagataaaccaggatcatctctccatctcaggctctttaacttaactacattttcaaagctccttttgccatatcacctcacatattcacaggttttaggaattaaggtgaggacattttggagaaggggccattagtctgcctactacgtgtgtcatttgttttttaaaacaaataatccatgttcactatagaaaaattagaagacacagaaaagtttaaaattacagactacagaaaataaccaccttcaaaatagctccactttgttcgttaaaaaagaaaacctgactaaatattctcactttataatataatatgatcatccttccacatcaatagatataaccctatgtatcagcattttaatgactgtacaatgttctactatgatattgtactataatttttgaacatgtaggtttacagtttcctgtacactcaaataatgctgttatcaacaatcctgcttatgcatatttgtacatttgtctgatatcttctgaaagtgagtttccagaaacgtactggctatgccagtagctgtggctccttttaaggctttcaatatcaatggccaaagttccctgcagaaagcttgagccaattcacagactcttcttcagagctggggactactacaccaggagctcagaaccctggacagaatcaaacgttcagtactttaccaaattgatagataattgaaattccatctttgttttaatttgtatttctttgatagacagtaaggttggacatttttcatatatttattttctacttatagttcttctctcaccactttatgtcctctctatattaaagtgcttatatttttcttcatttttaataaatctgtatgttaaccctctgtcatactttctacaaacaattttctcaccttggcatttttaaattttttattgagtttttattgcatggggtttctatttttcttgtagttaagtctgtcgatctttttatttaaagtgtctgccttgagtttcatgcttagtatcatggcatcacagtatcatgagcctcactcaatttaatattatagaaacaatctctgctggggttagtcatccatcttgattgttttgcccaaaatatatgttggtccatttgctacaaggattctgtgaaagcagccacttgaaacatgaagatgcaactccctgtgaggttgacaacaggttctaaataacaagcatatcgtgtggttatgtgcaaagccttagcagcggtgtctttaattggggttatgagcgaggtcctaattcattgtgctttttaaatggagtaaggaaccttcagagagaaagaacctaccacctctttctattcaattgtgataaatatgacccagcttgtgcttttcatggtggaacagtttattttaattttccatgtcatttatttccccagctctttggatcactgaggtgtgggcagagattctatgagatgaggtccaggcccatggagttcttggctctggctgtgccgctctaggctaaggccaatagggatcgggggagtgaagggtttaggaaagtagaacttaaagaagtaactgcaaatgacctgtggactactgcccactgctcggggggagacatttctttgttcttgtctcacctggaggggtagctgtggacttactctgcacgtgttttctgctgagtctgggctggtgaaggaaaaccaggctggcatggaggggaccctgcttaccaaacaggttttgccgcactgcaaaaacctagatttagaaatgaaagtacttctattttcctaaaagtctgagtcccagaactttccattgaatagaagaattatatacagaattaacttcctccctgcctgggtctgcaaatgtgggagtaaagaatccactggggaccaagccccattaccaaggacatccctcattaagtaggaaagtggacctgctctttagttcattttcccaacaggtggttatcgaaggcctgcttctacacctttgtttatgccgttccctctgcccagcatgccttcctatgcacctactccatgagatcataattttcaagctccaactcaatatctgcctctaacttaaagccttactcaacatttctccaacctttccatctcttctccatcttcctcctctcaagcccacttataccagtattgtttagtggctttggaagcaaatgaacttgggtttaaactgattattccacctaatccttggtacaattagaatttgggggatattgacttaatagctttgagcttcagcttctacatctagaagatgaaaagacactaccttacagaagggtgttgctttgtgaattaattgagataatgcatgagatgagtaagagaaggtctctgacttccatgtgcttatattaactggttaaaaccatagcacaagacaataacactatcagaaaagggacacaaaatgcttcagcagtacagaaaaaaaagaggtcttgtcaacctggagtgatcaggaaaagttaatggaagcgggagcgttaagcctcttaaggggtaaagtctaccaggtaaagcttctgggaaggacagggttgattgagggaactctgtaagccaaaagtaaagaagcaaaaatcagactctgtccagagaaaaggaaataggtttcagcagaactgttaacaaaatagaattttgtttttaaattttaaagcttcagaaactaaagatctctaagcataaactgatatcattagaattattttgagaaagatcaacttagtgattgaataaagtttagagggtattcactaaccaggtaagaaggaaatacaatcatccattttgaaaaaacaaaacaaaacaaaaacagacttaattctggagccaataaaattacaacaaattacccaaattacaacttgactggatgtgaggaaatggatggaggtgttaaagagaacttggagtatggtggcatggtgggggcgttaaagaaaaatcaacccttagagaaccaccgtttgacatgctgggatggagatcccaggagaagaaacaatccagtgggaattagaagcagtagaggttaggaaaatggttggctcacaagataaaactttggagtttattcacataaattagtcagtgggaattatgtggatggatgagatatccaaaatataaaagaagaccagtgacagaatcttaagtaatttctacagtttagggagcaagaaaaggaagcaagaccaggataacgcaatatcacatccatatctgcttgtgatatttttccttcatctgctatttttccttcattctatgaggttcacttcatttatttacattaccattattcttcaaggtgtaacacaatactaacataaagtaattattaatagtttgaatttattgagcatgtactgggtgccaggcatcacccaaagtatggatatgacctctttcccataaccacatgatgccagtgcattaattatacccattccacagatgagaattcagattcagggaggtttaatgattagctaaggtttaacaggtaataaaccaatccaggttgtgtggctccaaaaatcaaattctaacttctttgtcacactgcctttaatgagtccccagtatctttgggataagatgcaaaatctttgtttttatttatttatttattttgagacagagtctggctctgttgcctaggctggagtacagtggtgtgatctcagctcattgcaacctccccctcctgggttcaagcgattctcctgcctcagcctcccaagtagctgggattacagatgcccaacaagatgcctggctaattgtgtgtgtgtgtgtgtgtgtgtgtgtgtgtttatttttagtaaagacgggctttcaccacgtggtcaggctggtcttgaactcctcaggtgatccacccacctcgccctcccaaagtattgggattacaggcatgagccactgtgtccggccaaaatctttattttttaaagccctatgtgtgatcccagaaataccctatatgagaatcttgctatgtactgcagtggtgagtagcaaatctggcctctgccttaatagcacttgtggctttggactaagtgctcaacctcctgggtcttcgttacctcttcttcagaacagagataacactcaccttacaggatcagtgtgaaggttaaatgaggaaggcatgagtaaagtgcctaggagcttttgctattactattattgctgttattgataggcactctcccacctccattgataactccctcctcaccatggacctagtctaaatttctgtctgtgaatctgacttctcaggtagcattcatctgtggtgctttttaattgaatggactgcttattcccagggaagcagcattttacagcagggcttaatggtcgtagaatgtcaaaggggtttgcatatctggggagaaacaacttgacccactcaaactcggttagataaaccatgcagctgatgaatgagactggcccaagccctcattcctttcctctttctgatctgcctgcctaacaatgccaataccctgacttctgttccctatgggggtgagcaagaagcagcaggagtacacctcagctccaagagaatatgccacctgagcatacactgtccccacaccggccagctcctccccttccccaccccaagctgatgaatcgggtttgttgacatttggggcctagtcccatgaacaaagctaaattccctgaagcgcgctgtctcccaagacctttcccttgaatgctacagcatctgctcctgccaaacctcactcccatgttccacttccaaaaggggaaagcatatgggctgctattttttgccaaaaactgatcagagaacagaactcagttctcataaaaattgcacagtacctacttctctttccttgctgacaataaaaatgaaacttgagttcagggagctatctttcaggaaggaaatatttttcattcagatccaactcctaactctgtcaattctcacctgctcaaacatcctgactgccaagggaaaagactgtaaataactgaaattataattttgttaataattatattttatacacaataatttctagatattgtcactgaaatccattgataatttgagaaacttccttacagaggtagaaaggaatccacagtattttttttctattttaattactcactgaatacaatctgaaagtgtttaattattagatttatgcctcaagatgagttcaatggtaattacaggatgtctttttttattctaattccaaataattaaatcccaaacacattagatcattatgattataattagaataaaggtgtcttacatttgaaaccaaagtttggctttttgtttaaccttttttgtacctcatcaaagggtaacgccttggaaagaaatctgtttcaatctctctaatgctgctttaaaagaaaattttaaaaattgtctgcaggaaggcttttccattgcaatattggcagggagaagtgagcactgagccttcgggttgcttgagtttccaaggcatgctgactttctactgccatttgtcgtcctcggacacagagagaactcagaaaccaggcagtaaggtgacaaaaatgcagcgggaatatcaaggcaatcaagggagaggatccgtaaaataatccatcacctcctcccaccccaatttgtcaatcaatttgggggtaactttttctgagctcctctacattaaagataaatggatgaagatgggctgggattggttagagaccttagagaaagccacacagagaccagaaaatctaaagcaaaaattcacaaaataagacctctgactaaggctcaaaaggtcttttatgcttgggcccaataactaattgagagaaaatatgcccatatttttggttgtgttgataaggctgttgaaacccttgctaggatggctcaaacagcgtatgaagttagcttatcatccttcaggtatctttgcaccaggctttgggatttgggaatgggtaagggtaatactttgtggtttcaagggggagttgcaggatgaaggttcaggaaggagaggagacacacctttttaaaaagaataaataaacgcatatgtcttcccctgcctggtagacaggaggagagcacttgcttattggaaagcatttgaaggatagggaggtgagagcctgggaggagggaagcaaaaaagctataaagagaaggccagagagcaatcctaatacttagaaaaatgtcacattaaaacctcagctgccggtggctggagggaaaggagttccagacaatagctgaggggacaagttgaatcttgtgttcattcctgtggttaaaacaagtctgtacgaccacaaggaaaattccattctcctcagaccttaactccctgcttacctgagctgcagagacattttgttgaaaggctccttaaagtgggaactgataatgcacaaaggcctggtggccctccttccttaacctttcttctgtgcctgcaccttcacatcttaagaattacctcctttcctttgaggggcctgataaccactttgactacagtgtaaagaataaagcagggttcaggaaaagaacaagccccctcgacaccttccccactctccaaccacaacctacactcgttttccaaaccctgagacctgtagatggcaaataaaatttttcactaattcagtaagtgcttattgaaggcctataatgcttcaagctccatactaggcatttacagaagacaaccaaaatcaagctattatgaagaatgtccaagtcaggaggcccaagatatatgagattccatatgctgctgattgtatgacagacacagtaaatgttgtacattgtgaccattgaatgcagttgtttcccttcctttttgggggttttcatgagtccagctgacaagtgggctgcctgctcaaatcagtccagccaagcattgctcttcctcatccaaaatcccaacatctgctcctttcttccctcccatacaagccttaggtcaccttgctctcctattagaagaaggagattatcaataattgtcctgggtccaggggaagatggaaaacgagtttcctgtcttaactcctttgattcctacttcagcaagttctgatgaacacacctaggagagggagaatctactcacagaggcatggatgatggtaagatcaagcatgtccccacagtgagaaaaaaataacatcaagagtataatgctataggccaggcacggtggctcatgcctgtaatcccagcactttgggaggccaaggtggatcacaggtcaggagatggagaccatcctggccaacatggtgaaaccccatctctactaaaaatacaaaatttggccaggcgtggtggcatgtgcctgtaatcccagctactcaggaggctgaggcaggagaattgcttgaaccagggagtcacaggtggcagtgagccaagatctcactactgcacttcagcctggtgacagagcgagactccatctcacaaaaaaaaaaaaaaaaaaaagtgtaatactatagaaagcaggtatgtttgaaagactgtggcacttaatggagattgtaacttatttacagttgaactgggagagatctgtgacttgacgtgtcctctgtattcatctacaaaactttccatacaccccaatatgtgtttcataatacacaaagagagctataggaactgaccagtgccctcagggagcttatggcagtgatgtgctggtaaattttaacgatcagtttttcaagggaaaaaagttctgctttctagctttggccaatttccatggtgtaaatattcccgcagtggctgatttttagaaaccaagaaggtatcactgagagaggagatgggaagatatgtgcatagtcagctcttcctaggtggtatgagctggctcctgaacaccagtggcttaaattctagtatattgatacagataaagacaggatacaaaggcagcacctcctgatcaattgactgattgacatggatgaaaaatctttaaccaagactcaaggaagaacatactttaatggtagcagggcaaatgatgctaggtgaacggtatctgactgtattgccccttctggttcctcagaagcacaaagaaccatgggaaagactacaaaaactttggagagaatcagaatcaatcctccaccctgcctcttagagaaagggaaactgagacatgcaaatgtgaagtgctttagattgtctttgcttcaaacataccattgtcatggatagttttggtttccctgccattgggctgaggtattgggcagaaatgttgccaattaactgcatgattgaaacaggaaatcattcagaattcactggggctctccaagcacccgtagaggacaagtgactgtctgtacagctgatggagagtgggtgaaggtaccaccagcatgaaggcacagactctgtctgaatttcttattcagtaacttgccccagacgtaagccttcctgtagaatagaaacaaactgaaaagtctgccaggctctggctggcttagcctttgaatcattggtgagaaataagctctgtctaggaagggaaaaaaaatacattcccctgtgaagaaacccagcagtaattttctgggcgggagaactactgctgcatctcttgggcaaatgtaatgggatagcaaagtctttggtgctgaggaagctccagctcctttctgcctgtaattcatgatccctgagacaattatgagcaatgaaaaggcataagtcaaaggaacatcgagcatagctagatttaggaaaataacacattacatttaaatatccatatatatttaatctgtgtttaataatgcaaggaatgcattagtcaaggcttaggcagattacacatttacgttagttacagaacagcctggccctctgatgttccccagccttggcgccacaggaatgaaaacttctggaggaatggagcgtgtcattgcaaacctggggcactgcggaaatgcaaatggagaaattgcaaaggtcatcacaaagtcaggcttgctgcagaagatagcactgtgggtgaacaggagatacccaaagctccagcttctggactgacttactccatttgctaccttctgtaaggcacggctgggggtaggaagtaatgtcatagagaaacagagggaccagactctctattccagctgttgttttatctcagattttctctcctatgcttagactttaagcctagatgaccagatggagaatggctgcccaggccgctagggaaaatcaggacatgtctccaggggcaaatgcctaggctccaaagctcttgctaccatctagagggatgaagcaggtgagtgtagtcagggatgaaggaggaatgacaggcatgcccagcctttggtgcagtcatggtcctccaaaagctggaaagggaaccagtggggacatgatgccgtatctgccaaatactgtctaggacctggagagagggattaagaggctatactgcccaagaagcataagaaattctcctgtttgatttggccatcactcaatataacaatcatagatccccaagcactttgtccttgtcatgactcccttactccacttgggcaactcattccccagactctagagtcctgctctgtgctctaagttactcccaacctcgactaaagcagtctcaggaacaaagttacaggaagaaaatatctcagaggccatctaactcaatcttctgattttacagataagaagactgaggctcagagaagcaaagcagcccatccaagtttccccaatgagtaagtagataaccaggatgaggtccaagtctcattccagggatctggccatatacaacactacccttcctattaagcactgtatcagttttggtggtctgtagtagaaggaaggcaagcatgcattaaatgccagacactctgctaagagcttgaatatacattatctttaaaagttataaaaatatacaaaatatatctttaaatatataaaaataataacctactcagtaaaagtttacagtcaaaaaggaagcttagctctaattctggctctgccacttttcaactctacgatattgggttggtcactgcacttctccaggtatccctctgccccgacatctgcagagcctccctacttcatccactgagtcactgaataggtgctagtctagtgcaaagcacaagtgaagggataaggcaaaggaaacgtagatggggcagcaaatgaacgtgcccctcactgatgcctgggagaaacagaactgtgatgaagttgcagatgtggcccaatccatactttttagtaagtcacaaaacacgtctattttcccatctgtactctagaactactcatcctaactccatccctataaaagtcattccatgagtcaaaacacgccaatctgtcccaagaaaaggacaacaaggagtatctccctagtttgtttcaggcttcctttcaacgactgattccctcaagattcaaactattaaatatctgaaatctaatctcacacaaggctcctgcctgggagggaaagccaaattacctcttgtgtctctttaggttaagcacaactttgaggagtagactcatcctagcagttggaacttggaaaaaaacatgagctgtgactcaccagtcattttgagccaagtattttgaatttgctcagggcaggaaaatggccaggagggtgggatgggaaggggaggggaggactcatatggctaagaactatctgactctgttccaaaaaggcaagtacgggggagactctcagagcgtatgttcctgttcctgttgtttcactgccaggagtctcctaaatcactgtgaaatgactgctttctgcctacctcgatcatgtattatggagcattaataaataatgggaggttgtaggaccaaaaggcgggaaaacccaaagggaaggtgatggacaggcaaaatttaacaagtaaatgaaagaagctattaaatcatagttaaattatgctggcactggcaaaaaaaaaaaaaaaaagagagaaaggatttcccactgcaaaatgctttcaataaaatactgaaatttctcttatggctgaccgaggcatcttccaatcataaggataaggattctgtggcctgtggctcccattaaatactgagcttgggtagggtctctgaagacagagtttccaggtgcttctcagtacacagctttcctaggatgggtcacattcactattaaatgccccatctatgatgcagaaattgctagggacctctgtagccagttcatgaattctacacctatttctctattgactccctggtgcacaattagggggtcccacctaaggggaggagaaattgaggtttccaaagttgtgacttaaaaataaccctttgactgtaggtacaagcttatgctttctcaagtaccatcacatctattaacaattttgcatttgctaccacctatcaggtagaaggggaactctttcagtggggaagccatatcttgttcatttttgtgtgccccaagcctaaaaaaatgcacctttaataaatattgaattggatggatagatggatgaatggatgggggtgggggcagggtgaatgaatgaatactcacagctgataggctcagagaggttaagtgacttgcccgggactgaactacacagtgtcagtgtagtaaccagcagccaggctttcagagtctcaaccctgtgctctttcaacacaccatgatgtctctcttcaagatcacatagtaaactggatcaaagccagtatatgggacccctgtaattccacacaagcgaaaagcaggcacatttttctctgctgggattgtaattttgactgtggcacagactgacattcagcatttgaaggacctttagggtctctgcatctcaagaaagtttttgcaattccctagcggaagatccacacagaagccaggacgctttgcaatgaggctcttggttttttttttttttttttcccagggatatttgctttggtcttggcagaaaaacttgctgtcattcaatttctcagacatgctggggccccaagcgccagtgggagaagcatatgtaccaacacgccagaggaatacagtcacagcagagtagatttgttaggacaggcaggcttagtggtctgacaaggtgtgcaagacactcaccctactgtgcagtttaagaagcagctacttagcaaacatattggtattgggtggctaggggataagtgtatccaggtccctgaatggtcacagatgtcccattggttgggacatctttcaagacagtggaagggcctcaaaacctctctccaggaagtaacgactcagccaaactatacttgcttagaagaatcgtcaaaccaggaaagaagacaacaagttcactttagagggtagctctcactagcaggaagtatggtatagcaggaaggggccatacccttggctttggaatcagacagaaccagcctccaccacttacaactttctacttacataatgtgaagcaagtaacttaacctctttgagccttgctttcttcctcttttaaatgtgaatggtcaattagtattagattcagctacgagtaatagaaactctaaaacccctagtgacttaaaacgttaaagaggataaaaataatctggatgcaaggggttccggactagtatggggactgaacaagtcatcagggatccaggttcctttcatctggctattctgtctttctccaatgtgtgctcaaaatggcagcaagctctagacgctttgtccaaactcccaccagcaggaaggcagagcatgcatcatccgcctctaagaatacttctcagaagttctacttaactcttcctcttatgttctactggccagaacttagtcacacggccatacctctatgcaagggagtagggggcttggagatttagcttgtgttcccagtggccacgggcccagctaagactcagaggttccatggttccatttcttcttaaaacatatgagtgagtactggggtataattagtctgtcctgtctaatttacaagataaaatgagataatgggtgtaaatcatctatttcagggtctagcatgtaggtagcactcagtaaatggtaatgactgctatagttaaggttgatgtacccccccccacccaggaatacatttccatgagaagtcttggcaatacccaacacttgacttcatcccagggacacagtgtaataccatcagatttatcactgagatcaaagtgaagatcccaataaagtcaaatagtgaacttgtagagtgctcaaaggagataagtgaagacgtgcaaagccttgctaaacaggacccatgggggagagatttgaagaagccatcagggttttgactagaaggcaggggtcctcaaagctgtgaaagtctgatctatcagaggtggctgccaagctgtgctttcttctgcagatggcaaaagaaaaagatgtgaaacaaggtgagagttagatgatactggggtccgcgtgtatttaggttttcaatcaggaaatggaggaagtggaagggatactgtcaatttaaggtagagctgttttaatggcttagtggatatctaataagcattttctgaatcaaataagaaattacaatctttctggagtaacagaatatagacatgaagattgtattagtcaattagtcatggttctccagagagacagaatcaataggttgtttgtgtatatatgtttatatatacatcttatatgtgtgtgtatgtgtatacgtgtgtgtgtgtatgtatgtatatacagagagagagagagaaaaaaatttattttaaggaattgcctcatgtaattaggaggttggcaaatcccaaatctgcaaggtagaagagcaggctggagattcaggggacacttcatgttgcagtttgagtagaaggcggcctgccactgcctagagagttctctcttccttggaggaagtttgtctttttctgaaggttttcagctgattgaatgaggcccacccacattacggagggcaatctgcttcactcagagtctactgattttaatgttaatctcatctttaaaaaaaatcttcacagcaatgtgcagacatgtttgaccaaatatctgggtcccatggcctagccaagttgacacatgagatcaactatcacaaagatcttcagagtcttatccagaaatagaatcatacccacttggggaccttctgttgctatcagattttcctcactcaaaaaagcttttagtggacaaaacaaacagattactcaaagaaatactttgaaatgtaaaagggcatcaacaaagaggttaggctccaggcataggtcatgaattttcctttcagagttaaaataataataataaaaaccaaagcaaggggaggtggagttggacattcagactggacagcaaactgaaatgttagaaaatgattaaagccataggaggtggctgattgagagccctaacatatgaaaagtctgttattgactaaagcagtagatggaaatttcatagaaattaattgagtttttgcccttattgctcccaagagaagcagggtagcagaggaaggtgtagagtgagtaagtgggcatgctgaatgtgtaagtgtatatgtgtttatatttcagacatgtttaaatggaagagagaggaatgagagaggaaggcaagaatacaaatatttaagaaagctttattttcctgaagcaaagaatgacacttgaaaccgagggaatctcaatgtccaccttgcatttccatgaccagcaagagaggggaacccctacaggtaatttgaggggtgctgtgaacgtgcctatcatctcccttctcctcctgtcatatttcttgggaaacccagcacgagtcactcctttgggttgtagcactggatgggctggtacatggagtagaatcagtccttggcatttaggagctacaagccatcaggctcaggaaggaagaaggacaacatccgtgcatatccaaatctgagtagcgtccaggaggactcctctcaagcccagccatgattgtgccttgctcagctcagaagacccagaggcccccccatccagatgagttcagtgacagcatctttacccacacaacatggcctgactttccctcttggccttccctgctgctgcccctgcctgcatccagcactccagcccacctttctggttccagctccctgaacattttcaaggcttgcctgtctctgtgctttccttcgtgccgggtcctcagtctgaaagaatcctccccaccccttagcctatccacagagttttccaaacccagtcatatgccaccttcaccatgcagtcctttccttttcgttttagttgcaaaaggagtgaattttattgtttaaaaaatgcagtcaaacttggaaagtataaagtaaaaagtttctctatgccgcacttcccactgtgactattgaaaacaacaaactggtaccaaggtaccaagttataatagctgtgatcttgttatcagtttggtgggtacctaaagccctctgatacccccttctagatcactgaataagatttctccaacctctgaacttccctagcatttggtaccccgttatgatgttttaccttgttctgcattgtgttatagttatatctatacttaccttaattgatccccacacttcagtctttgctgactcaattgatttgagggtctatatttccctgtcacagagcttaggacaattggctgcacatttggtttagtccatcaaacctttatgaacacgtgttctgggccctattgacctaggggccaaggatacagaaacaaataaaacacagcccagccttaaaggaacctaaagtttaggtgacctttctttcccaccaaaaaacaaaaaggcaaacaaaaagttcgcagaactgttagacagtaacaacacagaagcagcagatcctgaatctgtgcaggtagcactcatttgaactaataattgctttagaaatatttggctgggcacagtggctcacgcctgtaatcccagcactttgggagggtgaagcgggcggattacttgaggtcagggatttgagaccagcccggccaacatggtgaaaccccatcttttctaaaaatacaaaatttagccgggcagggtggcaggcgcctgtaatctcagctactcaggaggttgaggtaggagaatcacttgaacctgggaggcagaagttgcagtgagccgagatcatgtcactgaactccagcctgggcaacagagagagactccatctcaaaaaaaaaacaaaaaatgaaaaaacaaaaagacaaaaaaaatttaagagcacttacaatgcaactatgaaatatgagcaaatgatactgagctcatagtggggagcaaggaatgagaagaaacattggttgagagggggttaagttcaaggacttttgcaaagcttccagaggagtgtgactgagtctggtagttgagcacctgggacattatttatgatgcattgaaggatgtcaacagcattcttccggagaattttgcccgcaaggggaggtcattaaaagaggaggcactgccacaccggaatgggtaaagccttccagcttctactttaatccttctgacccgggagatgaatttctttttctgttgatcttttctgtgcctcagtcatcgactagtatttatattttcaaccagcatagcatatagtgaagaggtgttgatgtcacacagaccaggattcaaatgttggctttgacacatacccactgagggccagggcaactggggagcccaaattttctcctctgaaaaatgggaataacagcatctaaatcacaggactattgtgaagatgaaaattaattgcgtttgggaaggtggcacaaaacaaatgctcaatgcatgggagctattgttattgttaggcccattgcctctaactagaggcaatcattttaaagagagggagaacccatctcattcttctctgtgctcccagagctcagcagagtttctgcacaccaagagcattcattaactgacactgaatttcctgctctgcttaaagaatgctgctcccaaaggaaatgcaaatacacaagctcctatatcagctcaccaaagagggagccaacaagtgaaaggagtggatgaaaagtatcccataaagggacacaatgtggtttacgggccaggcagtggatgaaaagagagtatcagtaagtgcaggtgtatagatgaccaaaggacattttccagtggactgggcttgaaattcattttccaaaactcagcttcttttgttttttcaagacagggttaagtagaaagagacagtttatattttgtcccatgtaaagaaggtatttatgtgaaatatgacagctcagtgtgcaagaatgcaaaccacagcttgtgagataatgtggctatgaggcaatgatctgaaatctggaagaaaatcgatcttaaatctttatattgatccaaatatttgaaagtggtaggaaggaatatgcttgctaaagaggggatgaatatggatggcttgttccagtttctttaggccttacaaaagcaaattttacaccaaacctcactctgtatacttactttacataagatcaaacttaagggagacgagatcaatattgaagctctgtctgagattccatctctttaatacctttctcatttcctttagtagtagaaagagagctaatctctgtctttcaaatagttgttttgcattttttgatcatggggaattaaattgaattagatgggtctggagtggttattagaaccattacatttggcataatagatacatctagagaaaacatttacataaggaaatcaaagctggtctcattttttatccagtgctctgacctctttggagttctgacaagcaggatttatctgaatatttcttaagatggtatgtataacagtaaaatgcaccccctaacacacctacctaaaccagcatttccttctgaaaaaagaaaaaaactgcttaaaaaaggaggtattttcatatacttacagacatattttccatttggatccttatttgaattttactctcatttagaatataattctgaaatctccatcattaatgctaagcctggcaatattccataaaaaaaaacccaccaataaaacacaaaagctagatgtgaagaggattatgatgtcatattaaaagaagggaagggagaattaaaataaaagatctatctgaaatgatcagaaatgaaattctctttgggataaaatggtctcttccagaaatgcagccatttaaaataagattatagtgatattttataagaactaaagcagaatacaaactatctttccctgaattaactcacagttatatacaatgaacagtagatacaaataaggcatttttaggcttctccattttgcttggcaatttctcaacacaagctcctgcattaataaaatcaggggtctgggtaaatgatgcaaactttagggccctatcacatcaaaatcagattgtcctgggtatggggtgggaagattctgcattttaaaaaggaccccaggtaattctaaaacccactggtgtttgagactccagtttagagcatctctgggaagcatagggggaccagcacagaattcaaagcatacttcatatccagcaactctaatagtccagagtttgagccctgcctatctgttactactagagtgaccttaaacaagtcacttaatctctctaagcctcagttttctcatttgtaaactgggataatttgcttcacaggttggcttgagtattaaggaagtgatgatcctctattaaagccctataagaagctgggcaccatggcttatggctgtaattccagcactttgagaggccaagacaggaggatagcttaaggccaggagttcgaggtcagcctgcgcagcagagagagacccttctctacaaaaaaaaaaaataataataataataataataataatagttgggtttggtggcacatgcctgtagtcctagctactcaggaggttgaggtgggggtatcattgagcctaggagtttgagactacagtgagctatgatcatgttactgcactccagaatgagaccctgtctcaaaaaaaaaacaagaacaaaaacaaaaaaaaacaccttacctgatacaacttatttcttattaccagtattgttactatttggccacaagtgtgataacaaaagagagccttgtctacctggcaacactgccactgtcaagagaaggaatatagagatgacaaattaagtagaccagaacataactgggcagtgaaattccgtgtgatcatcaaatacattttgagagtaaatataaacaattggttggcacagagctaagatgaaaaaaaaatattgatgggaatgataaggtagaattcagttgggacaaagccttcctgaagtgcaaatgatcagatcaggatggctgttgggaagtgtgtggttctgtttctcagagacatctggatgataaagagtggtgagacctccgacagtctttgtagaagccccagggacaaaaatgagagaggaaaaaggaagtttccaaatacttgtgtctgcgatgaagaagcatggctggatggaggaaagaaaggttgaaatggcatttagaaattagagcaaagggccagtccccatggcacaagcctgtaatcccagcactttaggaggcccaggtgggagaatcacttgaggccaggagtttaagactagcctaagcaacagagtgagagccagtctctacaaagatcacttgagcccaggagttcgagatgacagtgagctatgatagcaccactgcattccagcttcagtgacagagtgtgaccctgtccccaaaaaggaaaaaagaacagaaaagaaattgcagcagaggaacaataaggaatcctgagactaaagttgatttccaactctgaaacaaatgatcagaactccaaaattgatacaattttaaaatatttccctgaccaggtgcagtgactcatgcctgtagtctcagcactttggaagtctgaggcgggcagatcacttgaggccaggagttcaagactagcctggccaacatgctgaaaccccgtctccactaaaaatacaaaaattagccaagagtagtggtgcatgcctaaaataccagctactcagggggctgaggtgggagaatctcttgaacctgggaggcagaggttacaagtgagctgagatcatgccactgcactccagcctgggctacagagtgagactccatctcaaatacatatatatttccctgatcacaaatgatgcaagtttggtgactgaaagccacagccctgccctccttgtaggttccttgtatgtgtggttggggatgtggaggggaggagggtgctatgcttctcctggaataagatctggaaactctagggacaaaagtagctgcatgtcaaagggctctggcttcctttgtgtcatgtgcttggagtttagatataaagctctgaggatccctccttttggagtctgtataaactgatgttcttcctggaagccctatgctgtgcctggcttttactcattctgttcccttaacaggaatgttcatcctctgcctctgacctgggaagtctcagtcatccccgaggaccaattccaaatgtcaattcattcaccaccattgcccttgtcattgcatccactcctcctctctctctgacttgtgttaatggtaggtaactgtgtatgaatctaggctgggggtttgtctttgaggtcaaggactatttctgattcactgtgtgtctccctaaatccttcttccacccagcaaagatgctcaaaatatatatacaaatgatagccctttgtcctgtaccttttctgagctttggaatgtctctctgtactgatagagcatcatgcaacagacccagcagaggaggaaatagctgtgagattatctgcccattatagcaggattcaaagaaagctgctttcatgccaggaagccaggggatcgtagtaaacggctgtctttaaccaaagacagggatcttccactattaggagggatcttccactattgaaagttgagaccctgggacccctgtctcatctatctctgccatcagacctgccgcttctcacatagttgcatatggacaagatgcctcattttggtgtgcactgggagatctggcctatccatgaaactctctccattggttgcctgttgaaagggctccctaccaatttggtcataacacagaccaaattgaggaggttaaaagagatcaagtgtctgaacatggcttctttggactctaggaggagttgatcaagtgtcactccagtgcatatactgtttttatgcacagtatggatttgaacatcctggtgagtgagtccatgttaacagtatgttctcaagcaggaatatgcagctctagcttctgtttttagaaagctcagagattttttgcactggaagagaattagacatccaacatcctcatttcaaaaggaaactgaagtcagagaggagaagggacttcccaatggtacataacctgctattggcaaaggtgggaccagagcccttaagtttttcaacttctccagcaaattcctcatatctaagagcaacgcttcagttttccttaataaagtgccccagatcctcacattcatccctttcagagtgcaacttcctacttggtttacaaatgagtcaagaaaagaaaatctcctctttagcaatgtagtgtgggaccagctcacttgagtatgcaaaacttgtccttgagagctgctagctctttactattttttctgggtgcaacagtgtgcatgtcaccccacccttactgcctggctgtcttcacacatcaccttctctgagagtgcttctctaatatccccacccaaagagctccccacatatgcaaatccattgattatcatgtctctttgctttttcagtctccatgaaaattattgagacctaagatgtaagacctatttctgattattttgtttattggttgtcttctcccaccagaatgtaagccacatgaggttaggagcctctctgtcttattctctgtagtatctctggctcctagagtactgcctggtacagggttgctacttcattatttcttactgtatatgagaatgaatgagtgaattgaaaagcaattgaactctggttgtgccttacaggtatagcagaagttgtctgcacagagaggaaggaaggagacgatctttgatatgaattctgttggccaatgaggcctagaatgttaacaattaatggccacattttcctagttaactacaaagcaagagtgaaaaggagataatgttggactaactatttgactacattgtctgatttatccaaaaggtggtatggaattttgatccagtagtggtacatcatctttgataatacacacgtacacataagggagtgtacacacccatatacactcactcacactctgctattgcctactacctattagatactcccaacaaaagctcttaaactaaaaatgacatggtgttgttaagtttctcagggaaatccacctatctatggaactcaagagagcagagggctggtctctggagaaaaataaaacagggtcaaaaaccaattttatttgttatttttcactggaaatacatggttaatccaagaactagcaaagaggtgttgaaaaagattctctgatgtcatttgttttttctttttctttttttttttttttttttttgagacggagtttctctcttgttgcccaggctggagtgcaatggcacaatctcagctcactgcaacctctgcctcccaggttcaagcgattctcctgcctcagcttcctgagtagctgagattacaggagtgcgcaaccatacctagctaattttgtatttttagtagaggcggagtttctccatgttggtcagactgatctcagactcctgacctcaagtaatccacctgcctcagtctcccaaagtgctgggattacaggcctgagccaccgagcccagcctcatttgttttttcatacagatatatctcatctgcattagaggtagatccaagattaagatgtgaacatgttccagctttaatttcagttgtttttcttttttaaataaagaaaagccagcaatacaatttgtttctcattgagcactatacacattcagctatgactgagaatttagaagatacaaattcaaactccagtttaatttcctttttcctgtttgactccaagctcagtaggtgatcttataagttgacaggggtaacattgcacctattagcacttgtcaaccaaaagtagattgttcgggtttcaataaatgtttttttgaattggatttaggttggtgagaaaatatattaagtcagaattctttgaggcaaattacatattgaaatgaacagtttggtgttcatcctgtctaccatccccctcaaaaacaaagagacagacagaaagaaaaaaaaagcagaagttttgcttttctaagctacgagaatttcttctgctgctacatctgtgaacgctttacaaggcaatgtctacagtttgagttttacagcccattttgattgcagtttacatgacatctggggctctatttttggagaaatttcaaagctagtgacttccagtttttaatcagcagtgtatttattttctaccctagcataattgttcatggctccacattgatttttttataggagacaatgcaaaatgataatcagagtgaattagtaatttgatcttgtatctgtcaaggcttgatggcttttacctgctctagaggctagaaggcaatgtgctgacctcattgtgttgaaaaaaattgaacacatcgtggttgtcaaggacaagacattctcagtcataagaacaaagagagcaagaaaggctaatgagggaagaggccatacaaccctgaaaagtacacagcctcctgcccctctgctcagaatctggggtcatgtttgcagccacaggtgccacatgcagaagtgtcagaggtgtgaaaaccagagcaactccatcttgaataggagctgggtaaaataaggctgaaacttgctgggctgcattcccagacaggttaaggcattctaagtcacaggatgagataggaggttggcacaaggtacaggccatcaagaccttgctgataaaacaggttgcaggttgcagtaaaggagccagccaaaaaccaccaaaaccaagatggccgtgagagtgacctctggtcatgctcactgctgcactgccaccagcgccatgacagtttacaaatgccatagcaatgtcaagaagttaccctgtatggtctaaaaaggggagggattaataatccaccccttgtttagcatatcatcaagaaataaccataaaaatgggcaaccaatagccctcagggctgctctgtttacagagtagccattctttatccctttactttcttaataaacttactttcactttgcaccacggacttgccctaaattctttcttgcgcgaaacccaagaaccctctcttggggtctggatagggactcctttccagtagcgcatttaacagaaggacaggctgtgcagacattattttcgctcctttctactgagaagggaaaacaccacaattgagcagcctgctcctctataagtgaatgaataagcacttgcttttcattgtgggtgagtcaaatggcctggcatatatgcaagtaagaactagagcagaggctgctcacctgcaaactcacatcagggcttctgcccggaattacggtattttttgtttgtgtgtgtgttgttgtcattggcttcttttcataggggtttggatgaagctatttaaacacatgagacagcagccactaggactgtatctaagaaggtaagtggtttgcccagggttacatggctagtggaagagctagtctttacaagaatcttttacataaaccaaaccaggtgaggtaggatcaataagagggtgaagtgaggaaccgacatttttaagagctccatgaaatgaaggagcttggagagaaaattgatagatggtactttcagtagcccagcctcctcctgtaatttctggcttcacctttctctaagccctcctttgctctgagttctgtctgggcaagtcccaagctcctggaatgcatctttgccttccttatctggaagctaatcactaaatagcaggtggcggagattctggttttcatccctctttctctctccctttctctcttttactcacttcctcagggctatgaatttctgaatcttaaacaggaaacctccctgatttgttcacacctggaatgccattctatctttgtttgaagagtgcagaaattagagcgcgggagaatcaagagaaggagctgttgtgtgaagagggaagagagaggtcagcatttaaatgtgaacacacacactgagaggcacatatacatgcacacagtttaatctaagctaagcattctttctttcaactcctgcatttccctcctcatctccactgccagcaaatgtcttacaagacaaagagtatttactgtgtgtcacttcagttatcaacactctgcacaaataggttgacagaggaaacaggcaaagtacctttgcaggcccatttggggttgaaatagcaactagactgcctagaggctgccagatattagcttacttattgctcctgcaaatgttagaagctggctcttgagagaacctgtcatcaacatccctgtccccgtgggtgtcaggaaggttcggccttctttaaggtaggcactgtgtcctcatggactgttcattttgggaagaaccttgggagatcacctggttcaagctcctggctttagtcattgtttgtctctaaatccagagaccaatgtttgtgatctactgactcgtaagctccctatgaggaaaatggaacaaaatattgggcacaaagacataaatctaaatgcatggtttctaatctgtggaccctgagatcccacaggagcaccatatttgcatgaatcagtgcttataggttgaccaaatagcatgattcacacacatatattataatacttctaatggttttattcattcattctacaaatacagtactgctttgtgccagaaactgtggtaggtgctgagcatataatagacagggaataagtcaaactgactctgccttcatggagcttcctgtccagtggtaaaaacaggcagagagagctgcagaaacacagagtgaaagcaataactcagatttggaatattatatagataaggttatgattaatagaactcaaattcctttaaaggtagtagtctctgtctgctattaagcatttgctctaccaatgcattcctaaatgtatttttatctacatgactatacatgttttcagattcaaatgtgctctcctgactaaaaagattggataccactgacctaaatcatctgctaggattgccttttctatcccaggtgaataaattaaatagctatgtagttttccctttgccactggaagtttcactgaaaaatcaactcatgaaaggcagattaataagagaaaaggcatagatatttgttcacattcatgcgagaatcacagggtgatttcccaatatcccagtgggttacagatgcttgtatacctacttcttgagggaaagagagatgggacattgtggatgactttagggacattagtaaataattttcagggcaattcaatggctgtgaagaatatacaatggcctgggagaaagtctgttgggcccacagagcagagagtagtttgtgataaaagtctgcccatgtttgttgacagacttcagtttttcttcctgcgatatgagttcagttaatgaaaattcagagaagggatcagaagtaattgttttcgtctttggtaggtgtagatcttaggcagataagggaatttcagagaacagcttcatccttctccatgatagaagtaaaggattgagagacagaagcgggtagagagggaaaaacaattgttctccttggtgggtccgtctgatctttacgtagatagggggaaagtctcctccagcatctgttgatctcaaaggacctttaatttaaaatacccattataccagggagctatattttgggtgaagtttcctgtgctccttcagcaagaaataatattttaccaatattccagtaaccctcagggaacaattttttcatagttctacactggctttgcatcactgaaaattaatctcagagttctctgtaccccataacccaagaatgctacgtctctggggaaccctgcagaaacccagaaagagcatgatcatttggttataaattccacctccctagtgggcagcctcatctctgtccttgacatgggtgaggttggaggcaaaggtttgttgttgattttggtatgctatggaataccaggcctggagccacaggacatgacttgttgctctattagacatgctaaataagctcctgaaacaaagaaatcaagcgaagattagatgggaggattttcttgtcaagaattatgaatgcaaaaataaccctgaaaatatagctatagttgaataggggctgggcaagacaatggacagaaagatttgttagacataagatcccacttaaatcaaaatgatccaccaaggctcagctcccaatggggtctctatgtgcagattcaagggtagaaatattgtagggacgtttttagtatcaattctgcattagacaatgtgataggtatcaagcctacaaataccaatgagatatagtcctttaactgtcttcttttagttaaaaaaaaaagtaattgtcaatactcattaaaaatataaataaataaatagtattttaaactttgtgacaatgggcagaacagcaacaaggaaagcaggccaaggcactgggtttggagtcaagagatgggttttatcctggttatatgttgaatttacttcccaccttgggcaaatcacttccctatctaatcagtttcctaacctgtaaaatgacaaaaatcacttccacttcctagttttatgattccaggtccaatacaagaaggaatttcttttaagggcccccttaatctggtcaaagttatccttcccagcagggcagaaacttcacctgtttgcattaggcctgggttgtgggataagctatctcctgacagaccccaagagtctccatcttccagtcctccccaagtgaccccatgagaagacgtattaaaggaaggaattcaaaacagtatggcccatgtaaagagtatcctttaggaacaggatctgtttacttagtggctggaaacttaaatgcatgcattgtataccgcccaacccccaactccccacccccactgctatcatagccattaaaaaaaggagcatagcagatctctgacagttagaccttacccattttcagctctggactttcactgaggtaatatctttacctgttgccaactagacctgttggtgtgtgtaactgtttcttcattctgactcatcacaccttgcttgtggcagcgaacccaggcgccattgtttcctggtgatctctggcctactttttcccaaacgctgtgaggcagccatggagccttgtgaaagagattgactttctctcaggtagccaagggcctttgggacagctacctcctgatcccctttaaccccagggggaactctgaaggctgagcccctcctaagttacaacatagaagttagttccagtaaaactttccaggctctgctaattccataagggactcttaaagaatgagaaatggaagcccaaggtctgcataaaatcctacatgtgctaagcccgccaaaatcagtttgttgaggagaaggagcacagtaggaagagcttttgtattttcaattcagataaaccccagtaagactagccatagggcaacatagaactgcttatggttccatatatcttgctgtattttcattccatgccttaccatttaaaatattatttaattatctttttagtgagtattgccaattaccgttttctttgctaaaagaagacagttaaaggactatattttcttggtatgtgtaggcttggtgcctatcacattccattccaaaaacatgtgcctaatgtttctggaatgtcctctcccagtccacagcctctcttcactgagctaattgctacttgtccttaacactcagctcaaacatcacctcctccaggaagtctccactgacctccccctttgcattagatgcctgtcttgatacatccccctaaggcgttctgtgtagctctacctgtgcactttaccatattgttacatatttacccatctttctcacctaggctctacaccttctgtagaactaactcatgttattcatcttttttcctctccatagcttactacatggccttgtatgtttattgtatgaataaacaatctggttcatccacttattaggtgtgtgttctgggcaatttaattcacttctctgagcctcagttttctcatctattaattggaaataacaatccatgtctcttagagatattgttcatatgaagaggtgacatatgtaaaggccttccacaatgctgacacataggcacagagtcaattcacctagggctgtggatttgcacaggaaatgaagaaaaaacacaaaagcagcaagctcagagcaatgaagactcttgctgtcagtgtgcagaccctttcctccatggatgtattgtcccaaccagcgctcccttgctgcaagggagcctggaagtcctttttttccctttttttccttccttctttcctttcgttttctcctttattccttccttcctttcttcctttttttctctcttttcgtaaatgagaaacacatgagtgaatcatttttataagttttcctgggaatccagcatctctagccagaatattaataacgtggttactctgatgatttctcccattgaccctaaaaacctagacattctcttttataggtaggtctcttcaagtgaggtcagcttctccagataatttctggtgatttatgcagacaccttggggaggaaaaaaggaagcagcactgatctgagcctcctggaaactcaacaagtggcctgacccttgaagggtttcttcaccgtgtctggtaaagtttccaaattctggagatgtggaagcagaggcacattaccagaaggccaggtaataagcatgttggcaagtactactgctggccctgacccaccatatcataccacaggaccatccacacccatcccctatcccaaaaccacacatccacactccccaccaccaccttaacacacacacactgctcatttccctctggagatatgcagggctctccatggtcaaatgaccctaaatcctctggtgaatcaggttgaatcagagcccatgagtcatccagagcacatctaacccagggttaatttattcagcaatcattaagaaagcaagttcctactgccaggtgccgtcctaggcatgacaggctgatgtttctagaacatatttgacagcctttctccccaagtcacaccatgaaggagaaaccatttcagttaagaatggtgagtcaagagcttggcatggaggtattaccaaggaagagatctgtgttgagcctgtgtgcagatccttagcatttaatttattctgcaaggacacacaaggtggtaggaaaccactccagggaacccaccgaagagtcaagcaaagcagagcatgggtgcaatcacaagtcatagtgtggggtggagaggcaaggatgggggaagagcaaagaaaaggaggacttccctcagaagacctgctacttttaaactcaaccttggccaaagaaccaagaagcactttagcaacttccccatgctcgtctccaaaatttcctaggatctgagaggtggaggagagggagctccttacagggaaatgaacagagagtgatggtggggcctagtttgggttaggcaatgtgggctactgtgagggttttaaaatataaatatgcagaacacagagggcttttagggcagtcaactacttttatgatactataatggtagatacctgtcattatacttttgtccaaacccatagactgtacaataccaagaattaaccccagtgtaaactctgaacgttgagtgataaggatgtgtcagtgtaggtttatcagttgtaacaaatgggcccctctgtgggggatgttgataatggggaggccatgcatgtgtgaaggcagggagtagaggggaaatctctatactttccattcaatttagctgtgaatccacaactttcctaaaaactaaactatattaaaataaaaaatcttaaataaaaaaaccacatgtctgcaaattatatgacaatccccttagagagagggaaggccagctgggcacagtggctcatgcctgtaatcccagcactttgggaggctgaggtgggtagatcatgaattcaggggttcgagaccagcctggccaacgtggtgaaaccccatctctattaaaaatacaaaacattagccaggcttggtggtgcatgcctgtaatcccatctactcaggacactgaggcaggagaatcacttgaacccaggaggtggaggttgtaatgagctgagatcacaccattgcactccagcctgggcaacagagtgagacttggtctcaaaaaaaaaaaaaagagaaagagacagagagagagggaaggcctatagcatttccccttgtatctgagcaagcttctaacttacttgtaatcaaaagaatgtggcagaagtaatgctccatgacttccaaagccaaatggtaaaagaccttgcagcctccatcttgttctctggaacatttgcacttggagttctgaaccccaagccacggtgtaagaaattcaactgccctgaaaccacaactacaatgaaaggaatctcaggtgtctggagcagccatgtgtaagagtgctgaaggtcacagctgagtcctaccccagagccagcatcacctgactgacttgtgaattaatcaacatttcatgatcccactctcccacagccttgaattccccacagcctttgagtcttcctagttgaggctcagatgttgtggagcagaggtaagcagcccctgccatgccctgttcaaattcctggcccatgaaatctgtgagccaaaaaaaaaaaagttatttttatgttttatgctcctaagtagatgcaaactgtagtgacttgcagggcttccttgatccaatgatgaggattgggggtgttggagggtgacctgtgtcagaaaaaggagaaagaggaatgcacagaccaggccatgccactatggaagacaaacaatgatctgaacagtgctatttgtacagacggtccacaacttataatggtttgacttacaattttttgactttataatgacacgtaagcaacatgtgttcagtagaaaccatacttcaaatatccgcctaccattctgtttttcactttcagttcagtattcaataaattacatgagatattcaacacttcgttataaaatgggctttgcgttagatgattttgcccaactgcgggctatgtccttgtttgttgcacgaacattgttcaagtatgtttaagatacgttaggctaagagatgatgctcagcaggtgaggtgtattaaatgcattttcaaactataatattttcaacataccccgtcataagttgaggagagtctgtactatttgcttttttgaggtgaaaatggaacctcatgtaaacacatttcacgaaggatccctgggcctggcctctggcatcacagccttgcagtggtcactggggatgcacacagcctctcttgactgctaccctaatcaacagcagacaggagcctcctcctcttcagaggcccttcccgtggttggaagccaaacaacttcatagtgggacatctgtctatttcgcataggctccttggagaaatgctggtggacaggatttgaagacttgcagtcaggaattcattcctcccagcaggggatgggggctcaactcctggtgactcagaccctggcaggggcttctgccacttcttgcttgttccctcaccacctcccaggggtttttttaggtgatgacaaagattgtgtctccccaaaaggtatcccaaaaactgccctgagatcaagtttttaagttgtcatcttaaaaagttcttttaagttgtcatcttaaaagagaccctagtcagcctgggagtgctggtttacatttagcttcagggagttccttgttgcagagagctctctttatttactctttgtctttctgttatttccactacttggaaaaaagacccaccttctcacccctacccttcccaccatacctctaagaatatttgacttgtttaaacagccactcattagaactcaagttcattttaagaaaagcctttgacatcctcattctaggaggagagggaggatgcactcgataggctcagtgggcaggtcacaggtagggagcatccaggacctctggagtccttgggacaggcatggttagactccatacattcagtggagaagtggagggtgggtccgcatctgcggggcttacccattaacctgtgtcttggttttctgaacagctccattttttacaggtccacctgtgttgtcagaggccttgttatctactttggttcactctgattttaattgcctcctctaacttggtgggtgaatcggacctgaacttacagactatttgaatcagaagagcccttagaaatcacctagatcagccttcagaaaggaaaagtgacctgtccatggtcacacagcaatagttcttcagtgtcagagctaggactagaaatagggcccctggcttccaaaccagggctctgtattgtgctctcagactccccagatgggctgcttactggagaggatgaaggaattcagagaacatgcttgagatcaaccaatcacaagacttctgctgcctgaggtcctgtttgccaaaacccccactctttcttcctcttccacagcccaatcccagccacctaaacctctagaatattttggagctgagcacaaacaagctgctaaggcagtgttctattctttaggcattcttgaaattacaatttctgcttattttagaaattaagactttcccacccacctctctttctcctctttttattctcctcccaaccctggctctaaattcatgtctgcttttctgtttccctggctcataacatatttcacatggccaagctgccataaagaatatttcctacaaatgcaaacactgtacttggacataccaatgaaacttaatttctgtcaatgtgctgtttggggagtttttcaataaaccatattccttgaacacattttggaacaaactgaaataccaagaaaagaagaacatggttatttgcagacaatggagggaccacttcaacataaatattgtaatagatggacagattgtcctatattatagctctctgtgtaagtatctatttttttcccactggaattgactcctcaagggtttatatcatttctgtttcaattccacatccctcacaactccaaagttcttttcatatatgaaggcctctatacatgtttattaaatttaatgttttttaaatgtagtgagggcatactatgcaacgtaggcagaatggtagatgttttcatggctttaaaaaaagttgatccctatggccatcctgtatcagttatttattgcctcaataatgacattttataaaccacccaaaagcttagtagattaaaacaataaccttctatttttttttttgtgggtctacatgttggctggccaattctgctgatctgcattgggctcagccaatcttcatgaggggtgttcatgcatctgcggtcagccggagggcagatgggggaagttgatctaagatggcctaacatagagcagctggaatgattggggcttctcctcacatgattttttttttaattttccagcagactatatttacactcatggtgaagagagcagggtttgaaagagcaaatggaaacatgcaagacattttgatgcaaggcttagaactggcacactgtcacttggaccacacttttttggctaaagaaagtcacaaggccagtcccagattcaagggctggggaaatcaaatccacctctcaatgcaaggagcaacaactcataccacaataggtttaagaattacagccatttttgcaatcaattcactcataagtttaattttaagatgaaaaaataggtcaaaagttttatgaaaaatgttataacactggattatggtgatagttgcacaactataaatttaccaaaaatcattgaactatacccttacaatgactgaattttttgatatgtaaattatccctcagtaaagctattgaacaaaacctgaaactatttgtaaaactttactgaagatcatttaagtcataattgcccaaatctgcatttaaattcaggaattctagcatgaaactcggtaatccttccattgcaatacattgtatcatacctaaagcattagattctcagaatcagagaatctaggaactagaaagaacttctgcaggttacttagtccgtccctctttcaagcagttgaatgtgtaaagcatctagtgcaggtgcataagacctctcttgggttgaaaaataggaacagctctacaggaaacctgagccaggtgaaaaatatgtctcatcttctcatgtgggatccagtatagttaatactggaagaaaaacttgaaccactgttctttccagaaacagaaaatacagacaattcttttgattttacttctttcatttcatgatgaactcgtactgagtagccaggataccacaggtactcagattctagtattaatagcattagcatttttcttccattttagtacccagagtccaaatctaaatgtcttctttagggctgaaagtggtcatattcaaattaaaggtcacccaaataacttcttttgtgggttaaaatctctgacatgaggactctaggaagaagaacagttttttaaaaggtggacatgtacaatctggtccttctattgaaagccttaaggggtctgtgaagatgatgaacaaatgggaagtgttccagttttatcctataattcggacttgtttctggagggaaaaaaaaaaaaaagtaaaatccggaggagatgcatccaagctctccataaacagagctttgaagagcaaattgagcggctttcatcaatcacacacagaccacagcaaacacagcccgaggagaatcactcacccagtgtcaggcagggtcaggcaaacgttatcaaacgctctttcaagctattatgaaccagaatcagagggagagaaggaagtagaggagtgccaaaaataagatcccgaggggaagggaggcaaataaggcaagaaagagatgcagtggcaaagaggatgtggagggaagagaaagagaggaagaaagagtgaggaaaagacacaggaaaatatataagtaggtagcaagacacagagagcagaagggaagcagagagaatggcgcagcaaaacagaacaaaagtaaatcaacagcagcaaaaggaaagctggaaaacaaggtggagagaaataatctttccccatgggtggggtggaggccacactggcagccatctgtcctgaggatatgtcatctacgtgacctttcattgaaaattagccaaaatagttcaagtttctgtgtatagaggaatatcatcatgtctcagtgaaaggaaagaaaaagcaaacacttcaatcatcttcctctccagctccccaaacttattcactaggagggactatttgatcattctggatggtttcactcaggacctgaaaatgagaacagccattagaaaccagctcgatgcccacccaatcccccacaggagtgattttaccttttattacaacaaagctcaggcagtcatatacccactcaagttgtaaatctgccttcttcacagatcaagttcgattttccaactaattagagaaaaacaaacccactcctgggtcaaaaccaagcaaacatccccatctctgtataggacctggctctgtcttaattaagaggtaagggcctgggtgcctgggtgttccttggggaactttgaggggccaggggtcagcaggagggcaaccagtgcaagaagagagccagtgcaccaaggaaaataaatgaggaatgggagatagaggagccttctccaaaacaaactttgctaatttacacgcttactccataagaagatattgcaaatggcaatgcatgaagagacagagtcctcaagacagcctaactattggtacaccctgaatatcagttacaattaggcgaggtactaggagccagttgatagtggctcccaattcttaactgaagagttcagataggagctgagagaataacaatagctagaatttattgagccaatcatttttacatgcaccattttatttaaccctcacaataaccctatctaatagacattcttctaattattattcccattttactgatgaagaaactgaggctcaaagaggttacataactggcccaaagtcatacagtgagcaagtacagaagtggaaatctgagcttgcaactgactccagagctggtctcagccactctgtggcctgcattgctccagtagcagatgggtctgatagaagagcatgttggccctgtgtacttgtgaacagcatgcaggatggagagaaaggggacagtcctggaagcagggactcagaagcagcctcaatccagttgggaaggaatcagggttttgaataggatggtaacagtccatgtcgcaaagatgaggccaatttaccatatgaaacaattttgagcttttggataaatggcacagtcactggctgagacaggaggtagcattactgtgggcagcaacaagtttagggagctctctaaactttcctatttctctttatgaaagcaaaagaccagaaaattatctataattactgagccatcagcacttaattacagcatctcttgcatgggccaacatggcaaatgacttcacaccactaatgagtgtcctgagctcctcttcccactcccagtttgacctggaatacactggcacgaacagcccttccagtccactctatacagcagaggtatcagagtacaggctgtgtggccagacagacctgtgttcagatcctgtccccaccactcactaactgaggaactttagacactattcaacttctctgagccacagtttcctcatctgtaaaatgggggctgtaaaatacatcagtcctggggaatgtcaggataaaataaaaagataaatgcataacatctaggacaatgcctaacatataataagcactcttttaaaaagctattattattgtatatttccaccccttcatctgactcatttgaagctgaaagaggaagaggcaaaccgagtgaaattgcttacataaaagccagatagagcctggctattccaccgaaggcaataattataaagctgcttcagagcacagagagttccaagaatggaatacgcatttgaaacaagttcattaaaaaattgcttactcataaaagctactatcgttatagcctgacaaatggaagacacgacactaataaataaggagccggtggtaaacaagctgactacaccaagaatcccttgatttctctcttccccatccttcaactgtttcttaatcttttatgggcttataatgacaagttcaggtgggttttatgtgcctgtttactctgagttttctccaaactccaaatggaagggaagaagcctccaggcttctctacttagtctcccagaatggaatgaggcagtctcggcacccagcaggcctggctgccacctctttgcaccacagagtcagctcaggcctttcctcacctccacatcctatctagagacctctaaaccctcacacctttgcaccaatgcatctcctcctgcctcatgggtccattccaaggagagtgtcctgctgttttgcgggacactctcccagtcagtgtcccgctgtttttcccttccagtcagtgtcctgctgttttgccccagcccaaatagatcacattctcagttgtggaatgagtccctaacagaaagtcaggagactgggatgattatgcagtccagatgcttactagctggacattgccactcaacttccctgagtctcagttttgctgtctataacctggggataacaatacttccctcacagtgttccagcagaggttaaataagtttatagtgacaaacttgccctatggagtgtctggcacatgtggcagatgttgcagttactcagtggcaataattcagcaccctgtatctgagctccgtcctgtgatcttgggtgtgggggtggcaatgaaaagagaggagaatgcccacaacggtctaccctcagagttttgactcaccatgcaatcaagagacttcaacttgctttcaaagagtttctaagtgcagatatgacctaaggaaatggggtgaagagagtggggtgctggtaccctcccctgcactcacctgcctccgccctgccccagccctgcaggacttgactatgtcttgctcccttgccaaaaaaggacagcaacatcagacaggaagcagcttagcgctttcacagagcctggggccaaacaaacatgtgtcagcatttaccagaaaccctggtaaatcttacaaattcttacataacaaaagcatgtaatctctgagtccacatattcctttttcaagcaagccccacctacttgactactgtttttcaggaggttaaaacaaaaaatgatgtgtcacttagttacacaaatgaacagccgatttggactttgaaaaactcttaggtattttgtaaaaacggagctaaatactaagtaataaattttgggagccaaatccttccaaaacaaaatttccttgagaattgcccttctgcgcatgggtaactattgctctcagagacaagaaatggcttgcttggattcaaatatgcaaaagctaggttttaggcatccactctcttattctagaaagatttattgaatacacactatgtggaaagcatcatgctaggtgctacaatacaaagatcaaaaggttcaagagatagaggcaagctgtctctaaactaagatgctgctggggacccactctggggatctttttagcctgacttagcaacaggccatgtatttaattagagtcttcattctactgacgcttcctccaaacttgcaccttgatcagaagataaaggtcagtccctctgatctcactgtaagctttttggaggcataagaacagggtctttgtcatttttttctccagcaccagatgtaatgcttaccccatccctaagaggcactctgtcgggagttgagcaggcctcggctccgatcactgtggcattctaagcaggtgccactgacaatgtgactcagtttgtctaagctgcagtttcctcatctgtgaaacagagatacttttgatctgagaaggttggaaggaggaacaaagcaagggtctggaaggggctggccaagaaacctgtcatgcagtcggaggtcagcacttcacgggagctcctagtgttaaatgtggaaccacccaatgtcccctgtgagggagctcagtgacattaggggcagacaaagatactagaatgggaacaatcagattctacagctaaaaaaataaaaaagaagaaaaaaaagcaaaagtgaattttctccccatttcactaaaataatatgctctaagcctgagaccttttccctcctgtctgctgcctgaaactcatttctccaacagagatctaagccaccataaatctcatcaggggtcaaaatggctgacacaattttaactacaagcaaccacagcagaaatggcgtcattattatccccaagggctgctctctgccttttctaagggacaaaagaaaaagtcatattttttagcctggaaatatagggatttcctgcattcatatatatatatatacatatatatatgtagtattctagaattttcaagggacaaaatcaagaacccagaagcacaaaaactgtgaaaggaaagtatgaccagacataaagttgagcactatttctgccttaaacaaacaaacaaagaaaaactccttgctgccatgctacccaaaaacctagaaaaactatttctaagtaatacaatcagctatgtctccaatctcctgtgactctcggttttctacattctataaccaggtctcatctacggcacttgctccctgactgagtccacatgctttcccctggggaggcacagtactgcaatgtgattctgacactaatcacccagagtcagtgcagacttcacagatgaaaggcacagcctccaaaagactgcctcacttcagtcaccagccacaagttcaagggtcttcagaccacctacacttctggctgcaaatttgggggtttccacagccccctcaaattcaataattcactagaatgactcacagaactcagtcaagtgctacgcttaggataaaagttttaccataaaaggtacaaatcagagccagtcaagtgaaaaaaatacccagggcaaggtctgggagggttcagaatgtggagtttccatgccttcccccccatggactcaggttggttcaccctcccatcacattgatgtgttcaccaatcagaaaggtcatttgcactttggtgtccagcgttttcactggggtttcatgatgtaggtatcactgattgaatcattggccaagtggttaatctccatcttccaatccctcccggaggttggaccaatatcacatggctcaaagcaccaactctctaatcacacgattggcctttcaagcatgaccagcccccatcctgaaattatgtaggggctcactgtgagtcacctcactaacataaacccaggcatggtcccaagggctcactatgaataacagacagtcttatcacctgggaaagttagagggtttgtttagaagttccatcccaggaacgcaggacaaaggccagacaaatgcttcattatacaaaaggagggaaggcttcagcatcttagatactaacaacctagacccaaggcttgtccccctgttgtcactttcagcaaattaaactctcccttgctgactcctcagtctcttcatcatctggtaccactatgcctggccaatctcatttctgctgttccccatcataaaatctgcatcctacccctcctggtctatctcaatctccccacacaagttacagaatactgagataacctcaggcgtgcacatgaataagacctgagcatggacaaataagaccagtaggaccgaaccaacattagtatttaaaagtgagcaaagaaagagaagcccatgaaggagtctgaagaggtggggaaatccagctgctgcacgtggtgatggaagcccaggaaaagagtttttcagtatgcaggaaaggaccaacagtgtcagccgctgcagagaggtcaaggaagataatgacttaaaagttgccattggattcagcaataaagtagtcatctacaaccttgctgagagcagtttcagcagaacaataagggcagaagccagcttgcagtgggtagaatacagaatgggaagtaaagaagctgagcgacagatacagatgcctttttaaagagaaagcggtggctgaaaagtgccatggggccagcaaggaattgaatatacaagacggaaggcttaaacatgtttaggtcctgatagagagaggggaaaagagagagggacagggtgaagggacagggaagagaaagggaaaagtgatcaagccaggctgctaaggaggtaggagagaaaaactccagaggacaaaaaaagggataagctcagacagagagaggctcctcttccataaaatcagaagtgaagaaaagaggcatggtggcagatgtaggtaagttgtaggtttgatggcactgagttaaggggtgggatgtttccatctctgggttctacactttctgtgaagtaggaagcaatgtcaaatgcttaacttgtgaaggccaaatatttgaggagtggaggagagtgaagaaggcactgaaaatctagtctagagaactagagagagcggtgactaaggaagcctagaatgatcacaggagagtggcagggagcagtggggtctgggaaatgggagacagtagtacaatgagtctacagatcgtgtgggtttctctatgacatgcagcaacactggcagagaaggctaatagtttgttagctccagggttgaggttttgccatccaagtatgaaagaaagccaatagggcaacaatattagcaagacagaggttgaagtaaaatgaagctgagagggtatggtatgagaaggtatgactgaaaagagagagagagagagagagagagagagagatcagtggtctgggagtccctagttttgaaatagaaataatgtcaatgattgagtacaagaagtagaaagatagaaggttgtggtgtgggaggtgacctaggggatgatgaggtccaggtggggtggacgtgttgagaagagaagatgcaggaatgggggggtcgagtgttgctgggcatcttcatgagcccagaagaagcccaggatgaaagcagggttcagatggaagaaaagactgtgtaacacatgctggtgtcattagtgaatggggagaatgactaagagagtgttagatgaggaagaggaaatgcagagtggaaatcactaatcagaggcctgtgggccaactcagacccaatagccaggtttcatttggctgtcatggtgttttttcttatttttttttttgatgatggtttactatctaccatttttaaaaaaaatcaggaaagttcatataaaaatctagattccttgaaagccttctcttagaaactataaagatctgggaaaaggccgggcacagtggctcaggcctgtaatcccagcactttgggaggccaaggcgggaggatcacctaaggttgggagttcgagaccagcctgaccaacatggagaaactctgtctctactaaaaatgcaaaaaattaggcaggtatggtggcgcatgcctgtaatcccagctactcgggaggctgaggcaggagaatcgcttgaacctgggaggtggaggttgcagtgagccgagatcacgccattgcattccagcctgggcgacagagtgagaatccgtctcaaaaaaaaaaaaaaaaaaaaaaaagatctgggaacacagggtttatctccttcaactgtgaactgcggagcaactgtgccctttttgagcatcatggggtctccagctcaccactgaaccccctagggcttgtgtcactcatttaagaggcagacctgcccttgtcacagtacactggagacactttggagagcactggcaatgccagtgagcttgagcctaaaagcggccaagactttcacttgaatcatttggggagtgaagatggggagcagggatggtgccaacgccagcggctgatgctgagatgcagcagaattagcagtctccccttgagaaggctacagagaacacagaacactcgagggagaggcaggtgcagatgaaaaggcagagggagtgaagtggtcaaggaagagtctgaggctacgaatgagtttattcaccatggacattccagaggacagacataaaactgttggtaggagctgggccaggcaaggggaagcacagggtgatggcacaggatcggaaatcacctggggaaacatttcaggtgtaagcgtctaatgagaagtctcaaaaatgtcaagctaattactcttgggagcaacctggtggttgggttggagtcactgacctggaccctgggcacccaaattgccttggcacagagacctttccaggacagctcaggcatacctaagaatcaccttaataccaggtcaccgggaagtgagtcaggctaaatttcaaatcctcttcctctgctctgtccgtgagtcacagaagatcaataggaggaatctcagtcagattcgacactggttatcccaagcaagagccctttttatagcattcttacaacaatgaatttagtcaccttgcgggccacacaattcgctgacaacaaggggagagaggagcagaaagggaagatgccaaaaacatgctatgtctatttcaaaatttccccctaatttggctcaaggtgcaggagaaaggagtagaaactctctaccttctcctccctcaccacatagattccaactccatcaatctaaaactcttagcaatacatttccaacaaactagtatgtattaaatggactgttgtgtataggctgaaaaagctgatcaccatattaaagggctaatttgaagtaaattgtgttccagattctaaaaacccaacttgtaaactccagcacacagctcatcagtagggtgaaggctgcctatatactaaaaccaaatttctgaaagcatataaaagtttcagcttgttttgttcaggaacactatcaatcaaggcaccctgacttccaccttctgacaataatgacccattcgtcaaagactctctttgttcatcttacaaacagcttcctgcccacgcctccctggaatcagcccaggctcctcctgcagtcctttgggagatgtcaagaccctgtggacatggtgcacctgtggttttcactgcagacctgagcccctaagtaggggattattggggtaaagggtgtgaactcaagaatgaacagggcgataatgctgatcagtgggtcccctcattctacaacatagtgaaacatcccataggctctctatacccttcccctctcaatagcttgctatacaatcttaaacaaactcaaagaggtctgtgatcaggatacaactttcctttcagatttccaattgtagattttcttcctcttttgcctttttgctgttctcctcttgtcaaaaaggagcaataaaaggaattgggaaactcatactttcttaccttgtctcacttcagtataaacaagacaatgtcttatttaaaaaaaagagggtggagtggtagtgggagaggggagaaaggtgatatttaatttattggggaggacgaatcattgctggagaatgcctgtggctaaatgagaccatcaaaccaagagcagagcggcaaaccgcatgcacaaatatgaagtaatatctttctactctgagggaagctgacactcaatttcagaagcttcaggctagcagccacagctaccttcttggaaccatttacaactgcttctactctctgcagtgaaagcttaaaaatgcaaatgaaatggggccatttaaagaaaaatatcccttctaactgtgctctgggaaagaagaaaaaaaaccctacagctcagagggcaatcttaaagtaaatgaaactcggcggtgctagctgatgcctcattctgatggataatgtgtgctctcctcccccctcctgagtttagaagtatttaaagaaaagggtggaatcaccctgtttaggagattaatttcttttctgaaaaaaatgtctgttttccctgtcacttctggtttgatgaagggtaaaaccagagcttattctaaatgtttgctgctgaaaattaccaaaggcatgtgtgtggaagggaatgatgacgggaacaaaattctgaagagatcaactcctgccccgtctccttaggcaaatccatgcttatgttatcctggaagccattgtaaaagtgtttcttcagggacagagattctaataatatgtcaaatattttttgaacactaaacaccaaggactgagcttagcactttacatgaattatcttaccttcaaaattccctctccccagcaagcacactcatagtaggtcccattactctacccgttttacaagcgagacaagtaaagttaggcagatcaaacaacttgcttacagtgaaatagctgaaaagtagcctggctggaattccagttaagattttcaactccagagcccagagctctgtgtggtccataacatcctctcaagggatgttcattttaattccactcactaaggctcaccaaattaacataattcaggaaatgatgtctcactttcatttttttttttttatgtttgaaatgttcacaaaaccaccgcactgatgacacaatgtagtcagtgtttggtgagcaggcactataaacctaaggctgagggaaaaagtggggttgggggcagttcaccaaaggacatgtggcacttcacgcccttcacgtgcttaggatataattggaagcctgtctctgacaagccacttaactcaatagaagcacctacattgatttggaacctaaatttttcttggtgtgcagctcaagtccattttcccactttatcatgaggtatttgagccaggctaccaacctcaccactttctctaattcttaggtgaagagtgcagtccgaatctgacaacaggcagagcaataagaactctcctacactgctggaggcaatgaaaattgatagaatcattaggaaaatagtttggcattatctcagaaattcagagatgtgtatatcatacaatccagaattcccaaccttatgcatgagcaccagaagtcacgcatatgaatgttcctagcagcagcatctattacaaacttttgacaaatgatctattgaaaataaattaattacagctgcatgcatgtatcaacatggatgaatcttataagcataataagctacagaagaaagtcacaaatgaaaacataccatatgatatacatgacattgaaaacagacaaaactatactatgctgtttagagatgcataataggtagtaaagctattttgtaaaaaaaaaaaaaaaaaaaaaaaaaacagatcatcacaaaagtctgaagagtggtcatctccaagaggagggaatggaagtgatgggttaagggcatctgaaagggttggggacttctaagatactggcaaattctcagtattaaacctgtatggggactagaaggagatccatttttaaaatatttattaaattgtacatagtaaaatgcatatttgttatataacatggtcttttgcatgtatgatatattatatatgaatatactcttgcatatgttaatacatatcaagaaagtatgcagccttactcaatctgaggcacagagtaagcctctgttttcatgtggagttacagacgttctgaaatcattgggattgcttctcaccctgaaatgttccctagagcatgtcaccctgagactgtccagtcccgattttgatacttacagttacaggaaactcaatacctcgcacataagcccattccttcttctttgtttggtttattccataggcaatggagcccccaatttgtttttcaactgtggtaaaatatatataaaatttaccattttagccatttttaagtgtacagttcagtggcagtaagttcgttcacattactgtgctaccatccatctctagagcttttcatcttcccaacctgaaactctatacccattaaataacagcttcccattgtcctctccccaagtccctggcaaccaccattctcctttctgtctctatgaatttgactactctagcacgcatgtaagtggaatcattatgatacttgtccttttgtgactggcttattttacttagcacaatattttcaaggttcatctgcattgtagtatgtgtcagaatttccttccttttgaaggcctaataatatttcattgcatgtatgtaacacattttgctcatccactcatttgtggatggatggttgggttgctatgaccttttggctattgtgaataatgctgctataaataggcatgtaagcccatttcttcttgactgctagttagtttttccttatactcaattaaaatttgcctccttgtaacttctgccggttggtcttcattctactaccttaacttcttgcaaggcaaaccctctccattttccttacaggaaacctcaaatattggaagacaaccttgacattttagtcatctcttttatagcccagatacgacaagttcttttagtcgttcaatcattcctcatgtaacatattttccaagcccttcaccaacctaacatgattctctggacacatcttaga

SEQ ID NO: 420 - DNA, 20001 bp, Homo sapiens
tggtgatcggtgtcatgaaagaaatacaacatggtggggaagagtgtgctggggatgttcaggtagggcctctgtcaggaggtgacatttgagtggagagcaggtggggggctcctgagcagaggtgtgtgggaagagtattccagcagaggaaacagcgtgtgcttgctcagctgggcagaggaatagtgagagaatggtgaggctggaaccaggtcaccagatgttatagtcattagagggtttcaagtaggagtgtggcctaacggaatcttgattttatcaagatcactgtgcagaacagatgaagcagagtctctgttaggaatcgttgtagagatcccggcaggagatgctcggttcctggagttgactggtggaggcacagctggtgaacagtaggcccaatccaggctctgtgttgaaggcatgctgcctgtgttagaggagtgaggaacggctgtgactggggctgaaactgggtgactgaacaggccttctagagatggcagatgcaaggaagcaggtttccaggaaggggttgggtttggggttgaattggtggatttgggacttgctggttttcagatgcccaggagacaagtggggatgaccctctgggatagaaagctgtggctggaggtggaaatctggagtcaccgtatgtagcaggagctggggcttgagagggttgagtgtgttttgagaagcagccccagggagggcagaccctgcgaaatgccagccctggaccgtgggagcccaaggggttagtggaggagaagggagagaaggggaagtaggaggaggaaagtgagggaggacgagggcaagagaagggggtagggagagctgctgccgccttgagataaaaggaaaattgcaggtgtggagccctggaatccaagtgagcacctgtgtttcaaggagagaaagaggtcagggggataaatcctgcgccaagatcaaatccgatgaggaaagaacactgcccattgaatctggtagagaggcccctgagcaaagcagacagtggagctcctgggctagggcactttctggaagagaagggagatgagagtggacacagccctgtggagaaaaacggtctcatcttaaagatgggagaaattgcagtgcatcgcctggaggagggagggctggcacccagggcccacggggagccggagggcagggaaggctgcctctggacctgaggcatgtccacagcatctgggcagggagagcctggggcaggcttcttccaactttgccaacactccagtaaaataaggagcaagtgtgacgttttattttatgaggcaacttggctagctgtggtactcagtttttgttcaaacaccagtctggtgtttctgtgaggctgttttttagatatgattaatagttaaatctgtagactttgaatgcagcgggttaccctccatagcgtgggcgggcttcatccaatctgtcgaaggccgtaagagcaaagactgcagtctcctgaggaaggaactccccctgcggcgcgccttccgacttgctgcagcttcggctttctggatctgcagcctgccctgcagattttagacttgcaagccaatcagttccttaaaagaaaacagtctccctcatctctctctattgatctctagctctctatccccacccccttccctccccccactccacatgctatttgttccgtttctctggagaaccctgactgctacacagggcccttaagtgacagggagaaagagagggtgaaatgtgagagcaggaggaagagggcgtgagacggccatcttgcagagtggaaaggtgaatggacgataacaaaggaaagggtgaattatatataacctggaaagtgaagtgtgcacaaggaaatgtgatgtgtaacctaaagccccagtgctttgcaggtgggcagccgttccactgtgacatcgccccccaggtgggcagccgttccactgtgacatcaccccctgcagaggaggtcatcattccgcataatatgcttgtagactgatgacaaatacaggtgtgcaaatatgtgaagccccatcactggaccaaccacacctgccttctctgggagctgtcagtacccacaggccccaaccacagcttgcgcggctaaccaggcaccagggacttgcatgctttttgcaatgtgagaagctctgttgtaagctgggcatagtagatactcaataaactgtggctttaggaacagtcctaggaatagtagtgctagttcttactgtgttagtcacagacatctagggggcatggacagcaaggcattaatctggtcccttattgtggcctgtggaaaggggtcagtgagaagctgctcagtgaaacagctttgcatgatgacattttctcactatagaggcctcccagctgtcacagaggcctgttcatctattttattttttctttttttgaaagcaaaaacactttgagatttgcaggtaggctgacataacccactctcaggggctccagtgaaagtacctcttttaagtggccaagttgtcactaaagagatgacatctttttcctggaaatcagcgttggatgctacagtcaagaaaataaagaccccaaacattggtatttggagctattcttgagcattgggttgttcatgtttattcagctggaccatcagggacaagcttgtgccttgacaaattcagatttgcagaaatgaccagatttatcgtcttgattcagtgagcgggggagggcacccagaggaggctggaatatggcttgataatgggagaagtatttttgcgaggtttgctccggatggaggaggagaaggaggaagagggggaggggaggaggaggatgatgtcaggtgtgatgtaagtgtgggagtaagtctcccttgtgggatctttaagaatcactcccaagtggctgcagcaattacagtccaagaatgatatgaaagtacaggatttatgctgctccaaggtcctggagagggaggcaccgcatgcgtgcagggccgtgttggatgagagccaagggcccaggctctgcagtgcaggtggggggtcgagaaagagagagaacccgtgggcaagtacctgtgtcggggggtcagggtggggcacacaagcagaaggtatgaggggattttactggtgcattggaatgtcgctgggtcacagtcgggggaaggcaagaaggggacctggaggcagagaccaggcttatcacaccagtgtgcctagttgcttgggggactcacagcctgtgtgtgatactgaggcctcatggaagtatgaagttttaataattgataatgtatcagggaagtgggagtcgcatctgcactggttgttgtttagaggggggctcagaagaagtaggggttcactgagggtgatgggccgtcaggaggcaaggatgccttggttgttgcgttcccccagtcataaatgagtgcagcaagtgggtctagggcgttcttggttagaaagcaggagtccatctgtcaagcgggcgttgtggcgtttcgaagctttggcaagaccttggggaaaaccacgtgtcctgtgaatgcacagtgggttactcgtctgtcttcttagcctgatgaaaggcagggctgcctgttctcttttctcagtccttacagatcttgtagattttctcacattcgctcctggagaggtttttttttgtttttgttgctgttgttgttgttgttttgagagagtctcgctctgtccccaggctggagtgcggtggcgccatctcggctcactgcaacctctgcctcctgggttcaagcgattcttctgcctcagcctcctgagtagctgggattacaggtgcccaccacaacgcctgattaatttttgtatttttagtagagacgaggtatcaccatgttggtcaggctggtcttgaactcctgacctcgtgatccacctgccttggcctcccaaagtgctgggattacaggcgtgagccaccgcgcccagcctggagaggttttgatgctcttaggagggaaacgccttgatgttacagttccgcagatgtttccatgaatgtgagtttgatcctttgtgatcgtctttgttgtctgctccttaaatgcattgaatcctagcatccttggaatttcaggagggaaactgatgttcagagaaagaggatagtggtcagggacccagtgttacaggggtatgtgtgtgtgtctgaatgagggagggatggggaagtagactttgtacggaatatgttcagcatttgctaggtatattatctgcattgtattgcctaattctcaccaccatcccgggaagttggagccctgagtagtgtttggactctgccttccagaaaagaagggtttgctgcaggcctcaaatggggtgattggttcttgggtgagtaaataccagagtaaactcctctggtattgtaggacagtgttttggtcgatctagtaaagggggaaaacatccttactcacagttctggaattttatgtccagctattccttgtatgccatgtcacttaggaaaatttaaaaagtatctggctgggtgtggtggctcacacatgcctataatcccagcactttgagagaccaaggcaggaggatcacttgagtccagaagtttgagaccagcctaggcaacatagcaagaacccatctccacaaaaaatttaaaaattagctgggcaaggtggcacatacttgtagttccagctacctgggaggctgaagcaggaagatcacttgagccgaggaggtgagctatgattgtgccactgcactccagcctgggcaacagagtgaaaccctgtctcaaacaaaacaagtaaatatcaattctgttcagcttcctgccaccttactctttccatagcattttctgaaattcaagtcacctctgacaactccacatttttctcctcacatctagtatttgccaattgataaaaagtctgggagcctcaatgtgtcttagatttatttttttctgtgcaatcccacttagaaaccctaacctatatcttgatttcacctcatagcatagcacagacctcatcctggatcccacaccctgatgtgtgtcctgattccagctcagagcacagaccttatcctggatcccagaccctgttatgtgtcctgattccagctcagcacatacctcaccccggatcccacaccctgatgtgtgtcctgattccatctcatagcagagacctcatcctggatcccagactctgttgtgtgtcctgatttcaccttatagcacaggcctcatcctggatcccacaccctgatgtgtgtcctgattctagctcagagcatagacctcatcctggatcccacaccctgttatgtgtcctgattccagctcagagcacaggcctcatcctggatcccagaccctgttgtgtgtcctgattttaccttatagcacagacctcatcctggatcccacaccctgatatgtgtcctgattccagcccagagtacagacctcatcctggatctcacaccctgatatgtgtcctgattccagctcagagcacagacttcttcctgacctcagcatctctctccagcctgctcactaaggtgcagtttaagccatgctgtccctaccctgggtattttccctctgtcagacccacatacagggcaattctatttctgcccccttgctatctgtgttgcttaagtggtgggagatgatgggttaatttttccattcataaactgttgatacacctggcccaaatggatagaacaaaatctggcacttaaatacccagcgcagagttagagatacttagcaggtgcttgctcatcacaatccttcttcctcctctattagctgcatataaacttttaaactttatagtgtatgacatttctcattttagtgtatcttaatctgcccttctgccattgaacactgtaataattaattttcggtgtcaacttgactgggctaagggatgaccagatagctggtaaaagagtaactccaggtgtgtctgtgagggtgtttcccaaagagactggcatttgaatcagactgagtaatgaagatttgccctcactgatgtgggctggcattatccaatctgttgaatgcccagagagagtgaaaaggcagatgaaggaggaattcttttttcttcttgagctagagcacccaccttctcctggtcttagacactggggctccaggttcttgcagcttcatactctgacagtggccccccagtttcttaggccttcagcctcggaccgagagttacaccaatagcttccctgcttctccagcctgcagattgcatatatgaggcttctcagtctctacagtcatccaagccagtttccataatgaataccgtcttcatttatgtgtttcaatctgcatcctgctggttctgtttctctgaagaaccctaatacagacgccacctgccagttatttgtgctcccacatgaagtattctgaattcctctctatctccaaacattccaagtactttctctaagtcttttattttatttatttatttctctgagacaggatctctgttgcctaggctggagtacagcggcacagtcaccgctcattgtagcctctacatcctggactcaagcaatcctcccacctcagcctctcaagtagctgggactacaggcatgtgccaccatgccctgctaagtttttaaattttttgtagaggtgaggtctcactatgttgctcaggttggtctcgaactcttgggctcaaggcatcctctcacctcggcctctcaaagtcttggaattacaggtgtgagccaccatgccaggccactaaatcttataagcatagcatgatctgtagcaggaattccttagcactctgtagctaccgttttttttaattttgccagtcttcttccatccccgttccttcaggcccagttcactgcatgtgcaaatgggggtggcagggagggtcttgtaatgggtaaaattgtgtcccctaacatggtttatgtcctaacttttggttcctgaaaatgtgaacttaatttggaaatagaatatttgcagatgtaatcaagttaagatgatactggataaaggtcatcatgagttagagtaggcccaacatccaatgacaggtgtccctataaggccatgtgagatgatagagacggagactggagggatgtgtaccaggtcaggaacaccacggattggctgtcactcaccagagtctaggaggaggcaaggaggggtccatattccgagccttcggagacagcatggccctgcagatgccttgatttctgactctgttgtttcaggccactcagtttatggcaatcatgacagcagccctgggaaacacaacagaggcttgtttcctctgacacccactgacttgactgacagtcttaggaaacttgctgccatcctacttttctgcttgttttataatgattgttaccagactgttcacattaaatgtcttgtaaagctgaaaccctgcactgagacttgaagcttgtcaccttcagctttacccaccaacacttttttttttttgagatggagtctagctctgtcgcccaggttggaatgcagtggtgcgatctaggctcactgcaacctccacctcccgggttcacaccattctcctgcctcagcctcccaagtagctgggactacaggtgcctgccaccacgcccggctaattttttgtatttttagtagagacggggtttcaccatgctggccaggctggtctcaaactcctgaccttgtgatccgtccacctcagcctcccaaagtgctgggattacaggcgtgagccaccgtgcctggcccactttttcctttttttgaaacgaggtcttgccacattgcccaggcaatcttgaactcctaggcccacgtgattttcccaagtagctgggattacaggcacacaccccatgacctgcttttcccctgccttttagttcccacacctcactggttaaaattgacaatgtcctccaactccgatccatcagctcttttgaattctggttgccttttgttgagttgtctcatggaatatcgagataattgccaacagatctcagtgcctttctttctttccctctgagttaattcaacttggcatttactgggtatcaaatcagacagcagcctcactcaagcgtgagcaagtggggcttattctggatgacctggaaaccccacgggtgcaatcggaagatgaaataagtgagactgacagtaatgcaacgaggcgggcggcacctcccggggagaggagcaaaatgcctccctggtgagtcccccctcccaccaacaagacagcgtagcagccgagggaattgccctctgaagatctgctgaaaaatcaactgacaaaattcagatgaataggagaaaaggcatacagatttgttcgatcgtagttctaatgactcatagttctaaatgactcagaggccttcagaatgaaggcccagagacacagggaaaactgtctatttttttttttttttttttgagatggagtctcgctctgtcacccaggctggattgcaatggcacaatctcagctcactgcaacctctacctcctgggttcaagcgattctcctgcctcagcctcctgagtagctgggactacaggcacatgccaccacacccagctaatttttgtatttttagtagagatgggggtctcaccatgttggtcagactggtcttgaactcctgacctggtgatcggcccacctcagcctcccaaagtgctgggattacaggcgagagccaccgcacccagcggaaaactgtctatttttatgctgaggttcaacaaagtgtagatagcaacgcagagaaatgattggggaaaagggcatgatctaaggctaacaggctgagtggggaaagccagcagggcatctgcttagattcttcctggctttcctgtgcagcatgtcttctggctatggggcagcccctctacggaatggtggggggggttcttatgacctaccatcaaaaaaggtaggtcagattatttatttatggtcagtttttatacagaaggttgggggaagttagattaatatttttaggtataatggctggctttagggaaaagggggttctggtttcactttggagaagaattctagtttctattgttggcctcgggaaaatgagaggccagagacaggaaggcaggagaaggtcagaaaatttgcttctgaggctgctactgaggttttcattttggggtatcatcttaaccccaagaacaagaagcttcattccctacagaggtgttcacagccaggaggggcagcctacaggtgactagggcacagtgcatttggagaagaactagcaggacaatcagcaggtccacattagctctggacttccctgccctgtcatcagccaggggtggctccaagggggcatcttttaggttttgtttcaggcttattggggattccccagcttaaaagaaagagggaagggcatccaggagacctacacaaaggtggggcctgttttttttttttttttttgagacagagcctcactctgtcgcccaggctggagtggagtggtgcgatcagctcattgcaacctctgcctcccgggtgcaagcaactctcattcctcagcctcccaagtagctggaattacaggcatgcaccaccatgcccggctaatttttgtaattttagtagagatggggttttgccgtgttggccaggctggtctcagaaactcctggcctcaagcaatctgcccaccttgacctcccaaagtgctgagatgacaggcgccagccaccgcgcctggccaagcctcctgaaaacactatttggagggaactgtgtgacagacttggcaataagacctggaggccccccggtacaccatgctgaagaatttggtttttactctgcaggctggagtttatgattttttgcctgcatccccaagaaaggcacatgctctgataattcctgctgtattctgttagaagaaggcaggactaggccgggtgtcatggctcccacctgtaatcccagcactttgggaggcatgtggatcacctgaggtcaggagttggaaaccagcctggccaacatggtgaagcaccgtctctactaaaaatacagaaaattagttgggcgtggtgtcagaggtctgtaatcccagcgacttgggaggctgagacaggagaatcctttgaacctgggagacggaggttgcagtgagccgagatcgcaccactgtactccagcctgggcaacaagagggaaactttgtatcaaaaaaaaaagaaaaaaaaaaaagcaggactgctattgacaaagattttctcgaccaaactctactcatgctccctgaactcttctcaagccctgatttttgggcttctgtgtttatctctgcacattgtctaatcctgctaagtcagtttagccagaatcctgcaccgttgatactgatcacccttgatatctgattgagttcctcatcctccatcatgcctctggtgatgtggtatctgatcaccgtgatatctgatcaggttccttgtcctccatcatcccccgggtaaagtctgatcaccatggcctgccttcagcaagagtcctgttaggtccgttcagccagaatccccatgcccatggtgtttcttcttagtaattttctgctgacccccaccctgctccttggctataaatttccacctttacttgtgttcagagttgagcccaatctctcttccccactgtaaaacactgctgtggtggtccctatacttatctccattggccacctgaataaagtctgcctaactgttctttaatcagtagtatcatcattttttcatcaacactgtcacatgttataatgggtctttcaagcaacaaagtgggccaggcatggtggctcatgcctgtaatcccagcactttgggaggctaaggtgggcagatcatttgagcccaggagttaaagaccagcaaaggcaccatctctacaaaaaacaaataattaagtaggcatggtggctcacacctagattcccagctacttcagatgatttttttttttcttgagacagagtcttgctccatcacccaggctggagtgtagtggcaccatctcggctcactgcaacctctgcttcccgagctcaagcaattctcctgcctcagcctcctgagtagctgggactacaggtgtgctcaccatgcccggctaatttttgtatttttagtagagatgggatttcaccaggttggccaggctagtttcgaactcctgacctcaagtgattcgcctgcctcagcctcccaaagtactgggattacagacatgagccactgcgtctggccttgaaaggattgtttaaactcaggaagtcaaggctgcagtgagctatgattacaccactgcatctagcctgggcaatagtgcaaaatcctgtctctgaaaacaaacaaaaaagacaacaaaggtgttagtgaaaggttctcatcaggctaagggcatcttaacaggtagcagggttcagttagcctatttgagaaggacaaactgtagccccaaggccaggagagaggtgcaggtctgtggttcactggccaagtgacaagaaaagatgacgccgcaggtggaaaagtgcacacttgaccttgtgatggttatatcctgttctttaaaatattgtacaacagtagctttgggttataactacaagatgtatataaaacataaatgagccaggtgtggtggctcatgcctataatcccagcactttgggaggctaaggcaggaggattgcttgaggccaggagtttgagatcagtctgggaaacatagggaggctgtatcaataaacatttttaaaaagggtgcaatggcacctggctgagcccaagtttgagactgcggcgagctatgaccccaccactgcactccagctgggccacagagcaagacactggcttttctttttttaaagaaagaaaaatgaattttatgtttaggcttggttcccatcttcaagatatctcattatgtatttgtaaatattccaaaatttaaaaaaatccaaaatccaaaacgccactgctcccaagcatttcggataagggatactcaacctgtaccacagactgggtgacatgaacaaacatttatttctggaggcttagacgtctaaaatcaaggtgctggtataatcaaatggtggagatcccctccctggttcatagagggctatctttctatggtgggggtgggtagagctctctggggtctcttttataagggcactaattccatttatggtgttccatcttcatgacctaatcacctcccaaagccccacctcctaatgccatcacaatggaggttaagatctccacataggaatctagggggacataaacattcattccagttatgtccccccagattcatatgtttggaccgggcgtggtggctcacacctgtaatcccggcattttgggaggcctatgtgggaggatcagttgagctcatgagttccagaccagcctggacaatatagggagaccccgtctctacaaaacaaaaataaaaaattttatcctggcgtggtggtgtggcatatggtcccagctacttgggaggctgaggcatgagaatcacttgaacctgggaggcagaggttgcagtgagctgagaccgcaccactctattccagcctggacaatagagcgagaccgtgtctcaaaagacaaaaacaaaaagttactttgcatgctcatttattgtgtgttgaattagaatttacttccatccttcgtgtcactttcaaaaacctgtgtctcaccatcatcagtctacttaacataatttcttctaaaagtcccgcccccccccccccccgctcctatgtaactgctcctatcagcaaattctgagaattctggggactctgataagtcctcagaaattatccagtatcgtattatctaattgagttgaaaccaaggccaggaaagaggaaggacctaaagcgctggaagaatttctgggccccaaccactcccagtttcggtctctttctaccagggactggtgcaagactgtctagaattccagagccttctcgatgttcgggtcagacctccatgctctccagcaccactcctccccaaccctctccaggggtcccctggcttcgcacggttcccctccccggcccccacctccccatccccagtaagtgcaagcagctttccggggcaggcagctgccctacacctggtgcttacagggaagtggagaggaggggcaggcggctggagcgggggtctccaaggtgggcctggagcccggcgggctctggggcgctgagctcatctcgccacgccctgcgcgcatccgcgcagaaatttgggaggtggggttgagtctcgcaagctcctctccgccaggctgggccgcagcggacgccggctccccgatcacccgctcagcagctttggcccaggaagacctgcagccctggctcccttgcaggggtgcagctggggtctcacccaattcccggcataaatgaatggaagaggcctaggggtgaacgtttatctccacattactgtgcagatcattcaaatcgggactaaccagaaccgcagtcttcccatttctagggaggaaagttgctcttaaaaatttttacagtaaataattttcctagtggacctcctttaaagggaaattgccgtattcacccctcagttgttccagtgctttgtttgtgtcagaaattaaatgaataagccagagagaacctcttggacctgctgcaccaaattcacaaatgaaaagttcatcaccgcttgagggcgagtggcttctggggctcagctctcagtgacctttaaccacggctcctcaccaggttccagtgaatttggaagaggaatccctttttctcttttccagaaaagtcgctgattcccagtgtctttcctactgagggctttttgaagcattcggagttcagtttctctggattgttatgggcccagcttctggggcccgtccagtaaataccactccatttgagaagagaataaataggcagttacctctcttggacaaaaacgttccgatccatcccctctgaacttggaaagaaatcccccccttctcaacaggtcttgcaccgttgtttttcaccctatgagttctgcatgttttattcaacatggtgggtctccacagatattttttagtgaaagaggctggtggagattagatgtgagagtgtattgcttttttttttttttttttttttttgagatgtagtctcactctgtcacccaggctggagtacagtggcatgatctcggctcactgcaatctccgcctcccgggttcaagtgattcttctgcctcagcctccctagtagctgggactacaggcacccaccaccgcgcccagctaatttttgtatttttagtagagatggggtttcaccatattggccaggttggtctcgaactcctgaccttgtgatccacctgcctcggcctcccaaagtgctgggattacaggcatgagccaccgcgctcggccgagtgtattgctcttatctgggaaataactcatagacgtatttctgaaggagggcttttcacatctgccagcaggaagcgtgaggggaggctccgcccatcagaaaccactgcttgctttagcacagcccttacctccaacagttttatgggctctcttttttgaggaaaggagacatccttctctaggaatagttctggtttggggacccagtaggaggtagatctgttacaggaaaggggtcccaatccaggctcccagagacggttcttagatctcaggcaagaaagaattcagagcaagtccacaatgcaaagccttgtgtgtccataaaacctaagccctggctggtgttcaactcccggcctcaagatctcatcagatctacccctggtggatccccaaactaaatccaagcctcaccacggccacctgtctggaccccagaatctaaaggctcaacaccagagacataagctcacggacaaatcaagcaagtattcaaaatgtcacaaaacaactgttttatgactttgaaacatctagcagaggctgggtgtggtggctcacacctgtaatcccagcactttgagaggccaaagctgtaggatcacttgagcccaggagttctagaccagcttgggccacacagtgagaccctgtctctacaaaaaaatttaagaattagccaggcatggtggcacccacctgtagtcccagctacttgggaggctgaggtgggaggatcacttgagcccaggaggttgaggctgcagtgagccatgattacaccactgcactccagcctgggtgacagagtgagaccctgtctcaaaaataaaataaaattttagccatgagactgaaaaaactcactaatttaaaaggacatttggggccaggagtagtggctcacacctgtaatccaactgatatggtttggctgtgtccccacccaaatctgatgttgaattgtagctcccataattcccacgtgttgtgggagggacctggtgggagataactgaatcatgggggcgttttcccccagaccattctcgtggtagtgaataagtctcatgagatctgatggttttgtaaagggaaaccccttttacttggctctctttctctctgttgcctgctgccatgtaagatgtgccttttgccttccaccatgattgtgaagcctcctcagacatgtggaactgtgagtccattaagcctctttttctttataatttacccagttttaggtatgtctttatcagctatgtgaaaatgactaatacatcaactcttgaagaggccaagacaggaggattgcttgtggcctgaagtttgagaccagcctgggcaaagtagccagacctcatctctaccaaaaaattaaaaaaaaaaaaaaaaatagctgggtgtgattgtgtgtgcctgcattcccagttgcttgggaggctgaggtgggtggggtcacttcagcccagaagttggaggttgcagtgaggtgtgattgcaccactgcactccagtgtgggcgacagactgagactctgtttctaaagaaaaaaataataataaaaataaatgaaaggacagttggattaaaactgtggccctgtaaatggaacaagttaatctgtcccacatagctgagttgtagagaatatagggcagcaaatctacacctcaaagcagagagagagaatttaagctttttttttttttttttttttttttggtgagacagactcttactctgtcacccaggctgaagtgcactggagtgatctcagctcactgcaacttctacctcccaggttcaagcgattctcctgcttcaacctcccaagtagctgggattacaggcgcctgcaaccacacctggctaatttttgtttttgtttttgtgttttttttgaggcagaatctcacgctgttgcccaggttggagtgcaatggcgcgatctcggctcactgcaacctctgcctcctgggttcaagcaattcttctgcctcagcctcccgagtagctgggattacaggcgtgtgccaccacagccggctaatttttttttttgtatttttagtagagacagggtttcactgtgtcagccaggatggtctcgatctcctgaccttgtgatctgcccgcctcagcctcccaaagtgctgggattacaggcatgagccaccatgcttggcctaatttttgtatttctagtagagacggggttttgccatgttggtcagactggtcttgaattcctgaccttaagtgatccacctgccttggcctctcatagtgctgggattacagatatgagccactgcacctggccaaatttaaacatttttaagaagaaatttgtgtgtgttaggtaaagggaggttaaaaatggatgccaaggttaacacagaatcataggaatttacaagagcatataaggagaccaattttaggtagttttcaatgtagtacctattagaaatgggttcccttaatcattgtatccctcccccatttcagacggagctgaactcccatttccaaatgggtggtttccaatttggtcttcattttccagctgcaccactgagctcagtgcagagcccattaatgaatagggccaacaaagcatttgcagttttcagggcctaatacttatgtatttgaaaagcaagcacagctggaaggcagaacacccagatcctcagaaatcaaagaccctgtttttacatggagtcctgggtgtctcagagctgtgttaaaagcccaagagggaaatgtcatgggccaggctgagcaacacttccaccatgcaccttgctgcaaaggtattccccctgggctggtggatggcccagtgccagtcagcccactgtgtgatcagcccatctctcatgggtatctttttttccagtattaagtgttcctacagtctccaagtttccaaacttcacatttcttatctaaatgttcaaagaaatgagtactcccctatagtagtaaccatttgccacaactgtagtctgccacctccaagattacacttgccagtgactcaccagccgtaacacacccgaaggtaatgtgctcttacaatacaaaatactcctggtacccataaaagccaaaaaatatcaggaaactcagaccgggtgcagtgactcatgcctataatcccagcactttgggaggctgaggcaggaggatcacttgagcccaggagtttaagaacagccagggcaacatggtgaaaacccatgggtacaaaaaaattagcaaggtgtgtggtgatgtgcgcctgttgtcccagctaattgggaggctgaggtgggaggatcacctgagcctgggagtttgaggctgtagtgagccatgatcgtcataggaacagaaggcagagaaattctgggagggcagttccccagccaaggccccaccttcaatctgaaaagcctgatactgccgcccaaagtgagaacttacatccctgttttcccattcaaatggtgccttttccaaaaccacctgtggcctgctctgtcccccatcccgtgcccataaaaaccccaggctcaactggcagagagaggggaggcagctggacttcgcagactgtggttggatatgattgagaagtggcttgacttcagagggacagcttgacagcatagctttagagaggagtccagctggggatggccagacttcaagggaagattaccttcctgctccatccccttttcagctccctttgccactgagagccactttcattggcaataaaatcccccacatttaccatcttttcattcatgtgacctgattcctcctggacaccaggcaagaactcaggtgccatgagtgtgagtgcaaaaggctgtcacactgaccctccactgagctgttaacactgaagctggccatggacggcaaagctaaaagggcactgtaacacttcttctggggcttgagggattgtgggcactctcccctaaatgctgctgtggggccggtatgcagttcgcttttgccagcacccaaaagcactcactcaggcttctgcacctactcactggtgctccctctccgaggagtggagcagtagtgaatggagtttgcctctgctggtgccaaagcagctggctggttctagcacccgtgcgccccggtttctgcccacaaaagggtcaaggaaatatcctgcttcaattgtgtgagaaaacattttcactggtccattttcaaggcctgataaatctaagcactggcagccagtctgtaaatgtaacaaaccacatggctcatgcacccagaaggtcacaataagcaaacagaatgtagagaaggggtcagtccataaaagggaagaaagtttcgttatagggaaatcaaaacttaagtgggagctgggcgcagtggctcacacctgtaatcccagcatctcggaaggctgaggcaggtggatcacctgaggtcaggagttcgagactagcctggccaacatggtgaaaccccatctctactaaaaatacaaaaattagccaggtgtagtggcaagcgcctgcaatcccagctactcaggaggctgaggcaggagaattgcttgaacccaggaggcagaggttacagtttgccaagattgtgccattgcactccagccggggtgacagagtgagattctgtctcaaaagaaaaagaaaagaaaagaaaaagaaagaagaaacttaagcagggaaggagactggggtataaccttacaaggaggacaatgaaacttagatgacatccgggaagatcgtaaccccatagtactcgaccaatgaagaactagcggagggacttgtgtgctagaagataaattacctgttgtgactgccccagttgtgcctgcccaccagacacctgatcttgcaagaccgttactaaatgtctccttttcactgttcttcaggcctctaagtccattctctggatttggacaggtgagtgtgtttctcacaagcatgggggcccatctgggatccatgtgcctgtgtgaagtgggactttggccgagaggggagatgtgtcccacctgatttaggtggcccgctctatctgggcatcccagcttcccatagaaggcataaacaaacccaagactattattcaggaggcagcagaagcaacacagggagaaaagcaggcactgcgggaaccaggcaaactcatgcaccagccaaggaaggaaaattggactgtaagtactgccttggtcatggggcatttttggaggtctcg

SEQ ID NO: 421 - DNA, 51638 bp, Homo sapiens
tgcctacattaataaacaagaaaaacttcaaataaataaataatgatgcatcttcaataactagaaaagcaagggcaaatcaaaccaaaaaatactagaagaaaagaaaaaaataaagattagggcagaaataaatgaacttgaaattaagaaaaacaatacaagagatcaattaaacaaaagttggtttttcataatgacaaaacaaaaatcacaaatttttagccaggctaactaagaaaaaaagaaagaagatccaaataaacaaaatcagggatgaaaaaggagacattgcaactgatcctgcagaaattcaaaggatccttagtgaccactatgaatgactatatttcagtaagttggaaaatatagaagaaattaatagttcctagacacatacaatctaccaaggttgaaccacgaagaaatgcaaaatctgaacagactaataacaaataataagactgatgtataataaaatgtcttccattaaagaaaagcccaggacttaatggtttcattgctgaattctgccaaacatttaaagaagaactaataactctcctactcaaactgttctgaaaagtagagaaacagggactacttccaaacccattctacaaaaccagtattaccctgatacccaaaccacttaaagatgcatgaagaaacagaaaaccacaggccaatatcactgataagtgttgatgcaaaaatcctcaacaaaataccagcaaaccgaattcaacaatatatttaaaagatcagaaatagaaaaaccaatcctaaaatttatatgaaatcacaaaagatccagaataaccaaaaccatcctgagcaaaaagaatgaaactggaggaatcatattacctaacttcaaattgtactgcagagtgatagtgatcaaaacagtgtggtactggcatttaaaaagacacataaaccaatggaatggaatagagaatccagaaacaaatccacccacctacagtgacatcatttttgacaaatgtgccaagaacataatttggggaaaagacagtctcttcaataaacagtgctgggaaaactgggtgtccatatgcagaagaatgaaacttgacccttatctttcaccttatacaaaaatcaaaatggactatagacttaaatctaagatttcaaactacaaaacgactataagaaaagactggggaaactctccaggacattggtctaggcaaaaatttattgagtcatacgccacaagcataggcaactaacaaatgctgatggggatgcgaagaaaagggaactcttgtatactgttgataagaatataaattagtacaaccactctggaaaacagtttggaggttgctcaaacaactaaaaatggagctaccatccaacccagcaatcccattgctgggtatgtatccaaaagaaaggaaatcagtatatcaaagagatatctgcactcccacacttgttgcagcactgttcacaatagccaagatttggaagccacttaagtgttcatcaacagatgaatggataaagaaaatgcagtactataactctgttattgttcctccgctgtccagaaatctacaatggctctctacatgttagaataaaacctgtaatctttggcttggatttcaagtcctctatgttttcccactttcctcacctcatcttcctttttacagccttatctcactcgtctagtgacatctcacatccagatagtgaactactctgtccttcaacacgtttccatctttcaacctctgcctttgcaaaaaaatatagtcattatcctaccttgtttgtctccatgaactcttttacatcttttaacatagtggccttcaaatggtttttattttgttttactgagactcactgtaagaaatatattttacattgtaacccaacacacatacacagaaattaaaaaaaaacagaattttcattaaagcacatccttgccccccaaaaaatgcagtacttatacacaattggggtactatccagctataaaagagaatgaggtcctgccgtttacaacaacatggatggaattgggggacattatgttaagtgaaataagccaggcatggaaagacaaatatcacatgttctcacttatttgtagaatctaaaaatcaaaagaattgaatacatgaagatagggagtggaatgatggttatcagaggctgggaatgatagtgatgggttgggggcagacagacgtaaatggttaataagtacaaaaaaaattgttagaaagaatgaataaggccgggcgctgtggctcacgcctgtaatcccagcactttgggaggccgaggcgggaggatcacgaggtcaggaggtctagaccagcctgaccaacacggtgaaaccctgtctctactaaaaacacaaaaattagccaggcatggtagcgggcgcctataatcccagctactcaggaggctgaggcaggagaatcgcttaaacccgggaggcagatgttgcagtgagccgagatcgcgctgctgcactccagcctgggcgacagagcaaggctccgtctcaaaaaaaaaaaaaaaaaaaaaaaaaaagaatgaatgagacccggtacttgcgagccaaacagtgggactttagttaataataatttaattgtacatttaaaaataactaaaatagtgtaattggattgtttgtaacacaaaggataaatgcttacggggatgagggggaaaaaaagaaaatacactacttaaattaacaaatctactatggactttgaagttttgcaacacctaattagtttataaacataaaaggcagatcaatgttataattcctgctagtttacatcttcaattttattataatttaattattaatgaagactatttgcaacacttatcttatttgatctatctcaacataggtctaacaaatgcatggcaatttaatgttcaatacaaaaataaatgaatttagaataaatcccactataattttaggtttaaaaatatgttgcaaaatacactatagggagaaaaagcatgggaacaaagattaccagacctctctgaaaattaatcatcatgtaaaatttgtcattggaacacttacacggaaaaaaatagatgaaggtttgtcccttttcacccacaaagccaattctgtgccttcttgcttctttctcaccaaagaataatgtctttttgtacttaccacagtggtcccttttggcaaatgaatatttttattatactagcatttggaactttaacaaagaaagacagatagagatatccacccacaacattaaggttttgcttttctcattcatttacatcaaaaaaagagttacaatatttaaccaaagttaatactcagaaatgtttagattggacactactgccacattaaaaaattcatattaagtcaagctctattttttcttaatgtatatagcacattggaagtttatcacaacaaaatcattacaaaactttaccatctttatctatgcttctaactgaagctacatcaaacaaatacaatctccccagccctctacatgcacatttccttctctgttttaatatggaatctgatgctggatttttgccagaaaggcttatgagagagataaacatttacccttagtcataatacctattataactctatggtagaaatttagagcagagtttagatgcaaaaaaatatacttttttttctagtttttaaagcctacatttcccccccaatttgaaaaccagctttttaaatcttttaatcttcttctgaccattggtcttataaaggggatctccaaaatttactgtttcataagaagcaaaattgtttgcaaagcagaatttttggatagaaaattaatatcaaccttccaacataaaatttttaaatcaaatactaagatattaatttgcatattgtttatcagcatttgtagaaatgataccgtaaataaattgatcaaaatatggtgctaaatttaatggttgatgttatagaaaaaaatctatgtgcatttaatgattgatatttcctattgtctatagattggatggctctctgtcattaacaagtaggtaaaacagttcaactgggtctgtgttttaactcactaaactaaatctaattcatggctgtggtttagataaagtaacagatttcttataaagaatactcttcagaattattttacaattgttcttatcaataataaaatttatttccacagaatgaaaagcctttgaaatgaattatctttcactggggaagtccctacgtgagatacaggacactaaggactcacaggtaacttcataatgtggaagttcatttctttaaaaagaaaggacgagaaaaacaaaggcagtctttactcacaaacacatcagataccaggcatagaaatgatgttggaaactttttacatttaaaaaatacgtgcaaagttgaaatgtggcactactagaatatttctttcaattatttctccttttaaaaaatacagaatttacacaccataacaagttcctacagcttctgttaccccagaaataagggtcagagattttgtttcatatgagtggatcccatgtcaagtgttaatgcctcagatagtaggtcacatatgatatctatagccattaattgaggagttaaaccagcctattttgtatgtcagattttcaatcctgattatctagcatttacaaattcagatgtactctattacactgaagctatgaaatgctttttcttaacttcctaaaaagggttaaaggacactcatctaagaaacaacttactctctatttgtgattattctcctcttagtcacgatgattcaaatgattaattccacatgctgttttcagaagtaaaaataactctatgaatataaaaaaaaaagtctattatcaaatactactctgattttggtccagtgtgtttatgtatcctcgcccccagttagcttctctgtacagtattaatactgttgcctaaataggacagtactatattattttaatagactattgccctctcccctttttggcatttttttgagaatagtttggaaaagactatcatcttgtgctacaggctgtcgctccacaaaacatcaccaaaagcacaagaattgactaagcaagtatttaagtatttagcaccaaagacattacctagacattttgggaaggaggatgcagcaaagacattggagtgtttctttttctttttctttctttcttttttttttttttttttttgagatgtagtcttgctctgttccccaggctggagtgcagtggcacgatctcggctcactgcaaactctgcttcccaggtcacaccattctcctgcctcagcctcccgagtagctgggactacaggcgcccgccaacacacccggctaatttcttgtatttttagtagggatgtggtttcaccctgttagccaggatggtctccatctcctgacctcgtgatccaccctccttggcctcccaaagtgctgggattgcaggtgtgagtcactgcacccagctgacattggagcatttcttagctttcccctgagttaataatgagtcagttggggaatattgtaccaactcgtgctatttctttgggacattttccattcaggagaactgtaaagcaacagaataaaaatagcaactaaaatgatggccacaggtgatttagatggtgatagagggtaatccgagtggcctagacctgaaaaatagacataggttttagggagcctctggattttttttttcttttctttttttcctttttcgcacaattgtatttgtgtatcagaaagactgctctggaaggaatatgaagaattagctaaaggaggagagagtttattgtgtaggcatgataagacacgtgtctgacctcaagcagcagagtgggctagagaagaatattatattgacaagtgagatagagttcataggatgtgataattgattggatataagaaggcacgtggaaaaatggagaattcatattgcatgaccttctcattgggggaactaggtaaatggtagcagcactcacgcacacaaaaataaggagataacccatctagcacaagcatttccatcttaaggtttcctttcacattcagtcattcatttaactggaccccaaacatactccaattgtcaatcaacttggtatttgactggttctatctgattaactgtcttcatttgattaagttcttgtctctccaacatttcgtcttacaaaataattctcgattgtgacctctgcatttctcagatatgtggctttgcatcattttttctcattttcttcacttttccccttaattaattaaaatttgattactatctcctgttgttatgtctgcttcccttgataaacatttccctccatgttggacataatgttgctaagagggaccaacgcagaggagaacaagttttgttttgtattagcatgggcatttgagacaatttcaaacccacatggaggcccagcacggtggctcatgcctgtaatcccagctacttgggaggctgaggcaggagaatcccttgaaccctggaggctgaggttgcaatgagccgagatcacaccactgaactccagcctgggcaacaagagcgaaactccatctaaaaaaagaaaaaaaaatcacatggagttgtgtccttcaattcaatgatcattaaactagctccctcttacatacagtgccccgggctgaaacatgacacaataatgaacacgacagagtctcctctgatagatcatggtctttttgaggctacagctacataaactgatcatttcaatgtaacaggtccagactatgtagtattggaaaattggtggggaggagagaaggcattctagagacagcagagagaagagattggatgacacttccagggaagatgtccctactttgagagttgcaagattacgtaggaattggtcagagatgtggctaaaaggaacataaatttaagagagtttgatttaaggatgagagatacttacagaggtgtggcacaggaggaagcagaggaaattgatggagtacggttgcagaggagacagaaggaaaagaaacacgaaaacagattaacttggtagagaagtaagaacacattgtaccaagatgaacagagttcagaataagtggagaagccaaagcatgtatgtggggggggaggcagattttaggagagtttccttaattatagtttttatattctctttgagattgttcatcctcaataatggggaggggtttggagcatttctaacacaagggaagatcgctggctaagaggaagaggggtagatggttaggtcctttgaggaggagaggtctgggttgtcatcagtgatagggaaaatggcagttatcgaggcaggacataaaacaaaactgttgagctctagcatgaccttcccccaaacgccatgcctcattgattagcggtggcacaaattggaaggctgagtgatttccttgaaaaagggtcagctgtttaaaggtgggaatagaaatcacagatagtttgatttacccatagttagaggattgcataaaatataaaaagataaggagaaaaggaatcaagcacttaaaaataaagcgggaatcgagatattggagctatatactagggacttgatcataagagcaaggaaaagtccattttctactgtttttgcacagaaacaaaataggtctaggagggttaattcattgattactcctctaagaagctaaataataacaactaaagtatcctctggatgttacaggatagctcttagaaactgtcagaattaaatatacaggcagaaattgtctcttcagtaatgttttaactctgaggaagctggaaccagggtaagtcctctgacttagagttcagagaattaattacatcagaaaacaagcaaataaaacagagatatgataatagaaatgcttgttattttgactattattaaaggtatttgactattattaatgttatttgtgagcatctcttatcattgcaattaatttctgaaggcagatttttgcctgattcattttggaaatgtaaattgtacaaaaatggctcacaaaataaatgtcttataaaaatgttcaacaaactattcttcaaataaataattaatgactcattcatttattaaagtaataggagccacgaaatatgttcaatgaaatattcctgaatgttgttgattatccatcaagacattcttgaacaaatacaggcataaatgaatgaagaaatatttggcatatgcatcatttataagctattcagttcttctagaattagaactacttgttatttgtttgctttcttttaaaaccagataataaattatatgtgtattttccaagtttgattatcatgacacttttggataaaaaattataataaacatatttttacacggaacacacatatatcaggcaattactaaactggacattgccatttcccaaagaaacaacagtgctatgcttctctgaatacaggtgtacttaataggaacagactagagaccttactgatttataaagaataattaactttgacatctaagcattggttagattatgaaagttaatctctattttttatgatttagaatgtagttatgtatggtgggtggtacaggtagctcctcgcaaataatattccaggctagttagataaatttagagaatcaaaggatgtagattaaaatgtgtatattgacacaattatcctcacaggatactgctgaggggagaggcacttctccaggaagccctctggaaagttaatggatccaatcttctggattctaattcattaggtaaaaatatttaggacaaggagagtaaaacgaaggactgagtgcttagcatgaactctttgcattttctttaatagtattgtactcagaacttcaggaaaagcctgctttcccaggattgcatggtttaaacagctaatcacaatcctttttaaagtgttatttgatgatcttttaaaaaattatttacttgactttacttttgtattttatacagttgacaatattatgcttctcaccattgttagattctgtaatactgtggggtggtgggggtgtgtgtgtttactgtgccaagcacaatattgtcactatggatatattttattacgtccattgatattttatttatgtcatggagttgtgatctgttataatagatctgtgaagccacatccctgaagagagaatctgggaccaagagagaggtctggtataccaattacatatcacactatctctcttattttattgtattgtattttaaattctggggtacatgtgcagtatgtgcaggtgtctttcataggtaaacgtgtgccatggtgacttgctgcacctatcaacccatcacctatgtattaagcccagcatgcattagctatttttctggatgttctacctaccttcacccccaccaacaggccccagtgtgtgttgttctcctccctttgtctatgtgttcacattgttcagttcccacttataagtgagaacaccatctcttttttaccctactttctcaattcatgaacttgtctccttcatcataaaaaaaaaaaactaaaagcaatatcacctgaattttaccaataaccctcaattctgtctccatttgcatgctgtttgtggtggtgtgctccctcgattagtctttctctctcctggatcacatgcttcttcttttctcctaaatttttctcattcctaagccaaaaatactccaccttgaaaacaaggaaacgccaataccaaactaaaatactaagccttcctagctccaaagtcccttcaggaaattttctttcttcttttctcttcggagatgaacttcttgaacccttaatgcacgctggctccatgcatctatcttgcacaccctgttcttttacttcagcatgcaatggctgtcatagctccactgaaactgttctcataatgactcctaaatgtctatgtgcagtacggacttctcttctgaatttcaaattcaattatctaattgctcacctatcatctaaataatgtagtataaggagaggtggtataaacgaagtatttaaagataaggagacagagtaagcaagtaaaattatacctttgccatttcttagttatgtggatttgattgtttttacttaatatttttgggcttcggttgtctcatatatacaatggagatagtaatagtagcaaagttattgtcataataaaatattttaattcaaagtgattaaaactctcactggcacacagtgaaaaacatgatgaatattaactattctttttttattatccataggcatgtccagttagcatgtccaaaacccagtgcttgatttttagtcttcggatatttgcagccactcaatatctccctcctcttagtaagtggttcataccatccacccaggaggtcaatctaaaatctaggcttcccctttatattatcttgttccctcctctcctctatctaaaggtcattccagggtactgtcttatatccctactttttcctgctctgtcttatatccctacttcttcctgacacgttttccagcaagccatcatctgtggactggccatttagcttccaaacctatctcattccaattaattctccccattgcatgaagggtaattttatgagaatgtaaaatgcctcctcctagctgaaaacctagaatgtggttccattgcacataggacaaaatcaattccctagccaaggactatgaaatcagtagctcctggcctcaagcttccactattccaggccagttttgctctccatcaccataccctcatcagctgactttcaggatggcctccacctgcactggcagactccaaattccaaatgccccggaggtaacaacagaaacactttccccaatgtctgtacacacagagatgaggcatctggaaattccttgacaatgcttcagtcaggacattttcttcttagttttatgacctgagagatctgtcagtgaagtatgcccctgatgtcccttgggttttttaaacctcttaatatgattatgaattcttatagaactcagcaagcattttgccatgaacactttggccttaagactttaaatttgtttttctatgacctcttaacccaagccatctgtttcatgtttatttgtccaaagtaagatgatgcttcttcaataatcactttattttctcagttttgcatctttcatctcctctttctgccccattaaaaatacattataaaaatgaaaaattgatattttatttatgtccattaaaaaaaatgttgaatgccaatgtccattgcattttccttcggcacgattggcttgaaatgttttgctaatgtgttggatgttatgggcaaccctcctcacttcatgcccacatagaacttctaatccaaatcccctatatatgtagggtgtaaggttcacttaatggctgggtttacattgcttctcaatactttcctttgggaatagtatttttctgaaaccacatctctaaccttcacattcccagtgaaaaataacagatgccatgtgatattcatgtcattggagaaagggagagagcacaaggataaatgctcaaggatatcgatttaatttttccagccatacttgttccaccccctccttatctctgatagaatgctattcttccagtaatgccttaaaagctttaaaaattgccacccatttaaacagaacaattccaactacaaccaggactagtaggtagaaatgtcctctgtgtgtggatgaagtccttttatagaaaaaatgcttgaaaatggttctagtataccataaatcaaaagctacacatgtgactacaaataaatattcctcgtggatattttatttgccttgacattgcctatcagttgcttgtgcatactttcttaggatcttgcatcaagaaaatgttatttggtgtggctatcctttacaacaccttgtgaattaatttaggcaacatgcaacataacatgaaagaaattacatctcattagaacttcagtccatttaggaccatgaacaggtacaagattcataaacaaaatattctccataccccaaacttatttttaggatacaggttcatgtctaaagctaactgtgttgtagctaaattggtgattttatattcaggaatctgatacgttaaataaattgattttggattaggacatgcatgtatgaagactaattgaccatacattgctagattaccacagaaacatggcatctgcttgaaaagtcatcaattaagaaaattcaagaagtcttaatgctttaatctgttctatggtcacttttcttttaaagggcttatgtatatcagtatttaattaaagaactaatttgctcacatagagacttgaccatattagttatatcctctcaagctagaaaccatagaggagtattttccccctgctggatgggtttaggtttggtttaacttcagcatacagttccacgcacaaattcctgcctcttatgaattgaccagcctgggaaacttaacaaaatattattaacctttgcataaagtactttttctatatttttaacctcctaaatcataacatctcaaaataggaaggaaacggaagttcacagaacagcttcagggaacagagcagaatcactgaaaagaaagaatacagactcactaagttcagatggacacagtggaaggcttggagaccctggaatagcagcccatatatttctagacaccattttccccaatagcttggctgggagaaagctgtagccagaaaaataagagaagattataaactctcttcctgaaatgaacttgacttctgggagaaatagctaaaacttttcacaaaattcaaaggggattgtctataggggcacccaaagggagacctttgtgctcacagaggacaagcctctctctaggagtgattttgtattattgaagagaatgctttctctgcttttcactcccaggcccctaatttgttattcaagatccagtatcttgttgatatgtgggtttgaggtaagtttcccagagccttggtcacacagcagcatcgtattaccacaccagagataaggatcattccaagtctgtgtgtcagcttctatggttctgttatctttctaactatggaaaggtgtgttagagccacacaaataacagtcaatgagaacaaaagtcatagtgttaggaatttgccaactctaaggattgctcaagtggaataagcatgttcaagtggaatatgctttgtatacaaagcaaacaagaatagtcctattaaatatctctgtacagcttaataaaaagatgaaaaatgtagggtgatacatttgggggaaaggtattagaagttttcagagtttcacttcattttctaatagaagaatgaagattttgaattccatttttataaagatcagtttttgacctagggcgaatgatataaatcttcattgctttgggacttctatttctcaattagactttataaggacttagacattgaaataatgacttatgttaaatcttcagcaaatgcatagcaaatgttgcataaactactgtgtccaatagtatagggactggctgtcagaatttataaagtaagctgttaataagccaataattttcttgtctgattgacatgtccatcataattcagttatctaaggaaacagaccacgtgggatgcataatctcactgacaaagaggaggagttgggggctaagcatagcacacaggtttccctttgactctctacttgaccttatatttaatagaaagggctttaaaccaacatagttgtgaaacatattgctgctgcctaccaacacggagataaaggaagtttatatgaatcaatggattgttttatcctgattaatatgattattaaaacattatcaaatggacattcagtagtaatagcaaacccatgcagcaatagctatttcctttgggctttcagcaagtatttaatatttaatatccctgctgtagtgcttatcacaatttattatcactatttcattgtgcatactctctacccaaggagaggtccttgaggtcagggacatatcccttttggtagtcctgtcatctgacacagtatctagtatgcagtaattgctcatttaacattgaatgaaagaagagcgaaaataagaactacagagcaagattacttgaggttttttgttgttgttaacccgaatattaaataatgccagatttttattgaaggggaacagaaatctgtctgtgcatcattgattttctagtttcggtacttatgtcaaaatactaggtgaaaagttgattgccagagtaaattttgtttcgtgcaagttagaaaggaaataaccattctgtagaaagcctgctttatcaacatttctaagcgaacttgtagggcaaagtgaccgggtatatttagataaatttttggcaggcataccaactattgaaggtttaccctgactatcatttcttaatactgtgtagaaacattggatctggtatacttatgattccccaaattttagctacatcactagaggaaggtcggagtcagtggatcccaagtatgtgagtacaatgtgcagaagcttacagaaaatataaaattatagttcaaccttcaaaaattatagttttgaagagtcagcagtggaacacaaagctagcatttgactcaaagtcccaatttcttatcttcatactcaagaaacttaacgttttcaccaagtcccacttactgcatgctatctcgtcattctttcccttatgaagactcacattctcaagccaaattattctctgtccccttaaacttccacccttatggtcgtttctgttttatctgcttggtactgtcttctttaatatttctacatggccaacttcttctattcctttgtaaaatgtaaattggatgctcctattttgctacttgcctcagtataaaaaattttgatgccttctgaataccctaattacttgcacagtgttcaacaatgcacagttactacctatttaatccccagcacttcttcctgttcaggtagcaaaccctttgagacaagtagtagctacttttaaatcatctcattgcctcccaaagtggggttttttaaaatgtggttgatgtaaggaaatgtatataaatatatatttatattagtgtatatataatagaatataaatatttatggaatgaataaatatttaaaaactaagatggaatgtgaaaagtataggaaatagaactgtaaggtaacacaataattaggatcccagatacaaatatataatggttgctgtatctcagtaacacagaaaagttatgtaatgaagatgacaatgagtgaagatcaggagaggtttgctcatcttacatctgggaatgaataagggtgccccgaaaagctgtatggaaaaggtaagttttctgctggcttttaaagcagacaagcattgtttattatacttatatggaatacttaccaccatcggaggttatacaaacttttaaactaattgtattaggtagatttcagattatcaacagctttactatgcaaaggactaacttgattggcagatttaattttttagaataatcagttttcctgaagacagaattccttccttgtttctgttactgtatttagtgaccaactcctgctgagaattacaaccttctcattacatatatttctatgagtatgagttcattcatttaagcagttttgtgatagtgaacttttttactataatatgttgaatgcttatggatctaaaataaaccaaattttagagatctaaccaaagttatttttagaaaagaaaaatattataaatgtaaaatagttgcattgtatttttatagctatgctttctgccaaatcactaagatatattaattttttaaaagggaagtgtggttataacaaacaagaaatgccagcaacttaaaaataacttttttagtaacagaaaacccaggtctctttaaccaacattataggggttagaaaaggaatgccagttatgcactaaggtttacatattttcaaatgtagcagtaaagatgaatgctattaataattatatgttatcttgtgccatcagaaagaaaataaatgtcttataaaaaccatgctaaaaacacatacaaattttatgctattttcacaatgctcaattgtatctttttttttttttagtgaagccttaagactgcatatttaaagtaatgaagtttggtaatttatctaaataacttagttcttaatcatccagaaagtaatggtaaaatatttaatatatttatgtgaagtggctaggcaattttaagtctataaatctaatgctatacagatgttactatatctattctattaaatataaatctatttatatgcaacaaaaaataagtttaacattgaccattacatagaaaacaccattatataataaataggcagccaggatacttcatgtataaaaatccatgaaatttgttaagctattggatattttttctcacactaatcagatacttatttaagtagcttattttgtgtaatttttttaagaatggtcctctgagtccagtgtgaagtcaggttcatttgacaatataataattggatttgcttattatgttcctggtcattcctgccacagtagactcctttgtacaagcaacattaatcatttaaaaaagctgaaagttagaaagttaattaaaggatttattacagactcttaatttgtcctaatgaattgaaccaccatgaaactttattaattgcagttgaggagtaacacctggatatttttcctcatgcctttggtctaataaaatctgttatctctgattaaatatgtcagtttctttgaattatgaaagaaggaaaatgggattttattcatacagaaggtggagaaaagtgggacaaggagctcagcaggtgatatttcagctttaattctaagtcacaagaccatgaagaatgatgtgaacttgagaagcatacaccttaactcaccctgtatagaaatacatggtatttgtgccaaattaaaatccatatggttatttttttaaaaatcttccatattatctacatgtaggggataattttccttaaatttcaaatttgatatattgaatgaccacatatgctttgaaaaaatgaaaccaagaaaaggaaactctttacatcatgaagagatataaaaattatttgcctcaattagatttagtaggacaatgaaatgtgagagcctggggaacattgcatggtcctgaatttgctgtatatagtttatatgataaaatgaaaagtagactctgatgtttctggggtgaattcagagctctgaagtttaacgagtatttagaataaaaatcgcattctttcaaacagagagagtaaaggagtggattgaagcatggggccattaactcagcctttacttctcagagcctgggagagtctgatgatatgtattcagacatccgtgtaagaacacgtgaggtggtgaagcaacacaacaggcatacatcagactctgacgcacaatcatattgagacctgggcatattaaaaatgtgtagaagtcattattcacctttctgtattgtgcctactcaaatatctacccatccatctatccacgtatccaacaagtgtctctactacaaccacgggccatgaagaaagaggcctctgaaattctggaatatcagatatcaggctaagtctcctatttgcagggtgacttcctagacctgtgggaaaatacacacacacacacacacacacacacacacacacacacacacacacacacacacacacatatatatagacagagtctcgctctgttgttcaggctggagtgcagtggtccgatctcggctcactgcaaactccgccccgcctcccccacccccgcccccgccccagttcaagccattctcctgcctcagcctcctgagtagctgggattacaggagcgcgccaccatgcctggctaattttttgtattttagtagagacggggtttcaccatgatggtcaggctggtctcaaaaacacctgacctcgtgatccacctgcctcagcctcccaaagtgctgggattacaggcgtaagccaccacacccagccgggaaaatatattttcaatacaaggtgggaattgcaaagaatactaacttctgggatatagcctaagtgagcagagggattattttgagttggaaataagtaggaaactgtttaatggttggagaagagggatgctttttattgagtgaaatgtatccattgggtgctttattggcagtaaaacatgagtaataattcttaccagcaatatggtcattagtgttaaaagagatcgtgtgtgcagactaggtaggactagccaacacgatgccagaagaagtagggagtcagacgagaatggactaatgcccagggtgggttatgtaatcccctgactccctgctgctgcatcctctgcaaccctttacttgctcccaacctcgtcacaatgctgttttgcatagagctattgcaaaacgtgattattaaattctttattcaggtacataagtttcaatacatagtgattaaacatctactctatgcttgttgggaacatgtatatcttcttttgaaaagtgtctgtttatgtcctttgtcctctttttaatggggatgtatttctttcgtaaatttaagttccctatagatgctggatgttagacctttttcagacacattgtttacaaatattttctcccattctgtaggttttctgtttactctgttgatagtttatttcggcatgcagaagctcttaagttgaattagatcccatttgtcaatttttgcttttgttgcgattacttttggtgtctttatcataaaatctaccacaaagacaaatgcacatgaatgttcattgcagcactgttcaccatagcaaagacatggaatcaatctaatgctcatcaagaatagattggataaagaaaatatggtacacatacaccatggaatactatgcagacataacaaggaatgagatcatgtcctttgcagggacatggatggaggtgggagccattatcttcagcaaacaaacacgggaacagaaaaccaaataccacatgttctcacttataagtgggagctaaatgatgagaacacatgaacacaaagaagggaacaacagacactgaggactactcgaaggtggagggtgggaggagggagaggagcagaaaaaaataactattgggtactaggcttagtacgtgggtgatgaaataatctgtacaacaaacccctatgacatgcatttacctttgtaacaaacctgcacatgtaccctctgaaactaaaataaatgttaaaaaataaaaagtaaaaataaataaacactgactgtattttaagctgtaggaacactaagacgaatgaatgagacattgtttctaccctccccaaatgacagactcggaacttattctgtagatgtgcagcctggggtgagaatgtggatgagggatgaacaaagagggcacagaagctaggggaggcagttgtggagcacagtattatattctatgatattccatgtatatacaggtgaaactgatatctctaggtggctgttgactgaaatgcaaagtttaacaaactctacatgcaatatattctctttttttctaaaagaactcacttatttaggagcacagtttcttctcaggtagatgggtggagctctttttgcgtccttacaactctcagaaaagaaaattctcaagccaccctaatcattaggctttgcttatgaatgaaaaaaaatgagatgataaataaatgaattatctaactgacaaaagccttttagccatttcagatattcatttagaattacctgatatgagacttcaacagccatttttggtgccagcgttatatattacacacaaacacacacacacaaatcatacacacacccccacacacccacacatcatatatacatacataagtgaactgcctctctacgtgtatatgcatgtacatacacatatgtgtgcttgtgaatggttatatatatgaaaccagaaattagaaaagtgattcctctaaaatctaattaaggacaatccatggggttcaattgtaaagccctggagaaaaaaaaaagagagagagagaagaaatgtaagcaatttcacttgatcttgaccttgagtgtaattatttcttatgatatgtgaacacgtgagtacaaattattttacagatcaagcaagaggagaaaagaataagagttatggactaacctgaggaaatatatggtgtgtagatggagcagggaaaatatgaggacatcaattgagtaggaaaatgccaacatcgatggggattgggcaggatgaagtgtgttgcaggatcgcagccactaatcaaggatacagtccctggtgacttgcttttcttccctgtcgaatttctgcaagaagaggaagtttcaataactcaaatccatacagctcatcactgcttcctttcagacaggaaataatctgggtaaaaaggatcctgaaacactggcctcctcgatgcttgcagagaatcactggcctctcctattctgtgatttggatgtgactaggagtaataaaatggatttagtgtgcaaatgcctccatcagcttctccctttttcccataggagtattatcaaaagttcttaaattcttttaaatatataataaaaattgtttttgtaaatcagcataggtctttactattctggtgcaggttttccttctcatattctcaactcctgcttacccttagagataaggaagactactttgacactgaattcttttttcattggttttatatattaaatttgtctcttcaaatagattataagcagcttgaagctcagaatcatttcctaagtttggcaaccgattactgaacattctcagcttctcatgtcttgtacttggcattacggcagaggctcctcaaataaataagatgctgctgtagttctcataatgcctacctatattgattctcttttgctagttattttacaaatgtattagaaaaaattatttggttaattgctagcccacctatattgtggatcagtagtcagtatttgatgaatcttaataaaacatattttaaagaaactacccagataagcgataataataaactgggtgtccttatctcttgagatattataaataagtcttcactgtttgatttcctttgacaccaactaagagttcctgattctgagcaaatgaataattatttctatattttgtatgaagccttgcccttcttacagcagtattttctccctaaattaaatgatgagttttgcaggtgtcttttattttttctagaaaggatataaattctaatatgatgtatacattcatcagaaacaaaattattgtttgtagataccatattttctttaggcactcctccatcaatgaacttttaagttacttcagtgtcttggctattgtgaataatgctgtgatgactgtgggagtgcagatatcattttaatattctgctttcaattcctttggagattatatgtatatacatatatatccagaagtgagttcgctgaatcatagggtggttgtttttcagtttttgaggaccctctataatgttttctatagcagctgcaccactttcccaccaatgatgtacaagagtccacttttctctaaatccttgtcaacacttgctgtcttttgttattgtttgtttttcataatagccattataatgggtatgaggtgatacctcattgtggttttggtttgcattccctggatgattagtgatgttgacgatctcttcgtatacctgttggccatttgtatgtttggagaaatatctattgaagtccttttcgcatttcttaattgggctatttggttttttgccgttcagttgtaggagctccttatgtattttaaatattaattacttattaaatataaggtttgtaaatattttctctcattccatagtttgtttcttcattctgctgattgtttcctttgctgtgcagaagctttttagtttgatggagtctcatgtgtgtatgtttgcttttgtcaactatgcttgcttttgtcaactatgcttttggggtcgcatgcaagaaatcattgccaacatcagtgtcaaaaaacttttttctatgttttcttcttaatattttcatttcaggtttcaagttttagtcttcaattgattttgagttgatttgtgtgtatagtgtgagataaggatccaatttcattcttttgcatgtgaatattcagtttttcaataccgttcactgaagacattgctttccccattgatattcttggtgtccttgttgaagacgagttgagcatatacgtatggttttatttctggactctctattcagtttcattggtctatatgtctgctttttatatgcaataaaatatgatccagctttaataaagcagaaaattctgccattttcttttttttgttttgtttttgttgttgttgttgttttagtatttattgatcattcttgggtgtttctcggagagggggatttggcagggtcataggacaatagtggagggaaggtcagcagataaacatgtgaacaagggtctctggttttcctagacagaggaccctgcggccttccgcagtgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacggggttgggggtaaggttatagattaacagcatcccaaggcagaagaatttttcttagtatagaacaaaatggattctcctatgtctacttctttctacacagacacagtaacaatctgatttctctttcttttccccacatttcccccttttctattcgacaaaaccgccatcgtcatcatggcccgttctcaatgagctgttgggtacaccccccagacggggtggcggccgggcagaggggctcctcacttcccaggccgggcggccgggcagaggcgcccctcacctcccggacggggcagctgctgccccccacctccctcccggaaggggcggctggcggggcgggggctgccccccacctccctctgcgacggggcggctgccccggcgggggttgccccccacctcccagacggggcggctgccgggcagaggggctcctcacttcccaggccgggcggccgggcagaggggccccccacctcccggacggggcggctgctgccccccacctccctcccggaaggggcggctggcggggcgggggctgccccccacctccctccgggacggggcggctgccgggcggaggggctcctcacttcccagacggggcggccgggcagagacgctcctcacctcccagacggggtgacggtcgggcagagacactcctcagttcccagacggggtcgcgaccgggcagaggcgctcctcacatcccagacggggcggcggggcagaggcgctccccacatctcagacgatgggcggccgggcagagacgctggtcacttcccagacgggatggcggccgggaagaggcgctcctcacttcccagacgataggcggccaggcagagacgctcctcacttcccagatggggtggcagccgggcagaagctgcaatctcagcactttgggaggccaaggcaggcggctgggaggtggaggttgtagcgagccgagatcacgccactgcactccagcaaaaaccagtcaggcatggcggcgcgcgcctgcaatcccaggcaggctgaggcaggagaatcaggcagggaggttgcagtgagcggagatggcggcagtacagtccagccttggctcggcaacagaaggagaccgtggagagagagggagagggagagggagaccgtggagagagagggagagggagagggagaccgtggagagagagcgagagggagagggagaccgtggagagagagggagagggagagggagaccgtggagagagagggagagagagagggagagggagagggagagggagagggagagggagagctgaactttgaaaacagaaagtaactgccaaaagggattatttagggcacagattcccccctttcattatcctttaggtcctcaatggtgagggcaggggacaggagaggaattctgccgttttcagtaacatgaatgaacctggagtacattcatcaagtgaaataattgagagccagaaaacaaataataactgatgccacttatgtgaggaatcgaaaatagtcaaacttacagaagcagagcaggaaatggtggttgtcaggggttggggagaatgtcaaggggcacaaagtttcagctatgcaagatgcctgagacctagacatcgactctatagcacagtgtttatagttaacaatactgtattgtatactaaaattttttttatgagggtagatcttatgttaagtgtcatcacaaaaaaaatagtaatattaaataaagacagtgttgggtgcgatgactcatgcctataatcccagcactttgggaggctgaggcggagggatcacatgaggtcaggagtttgagattagcctggccaacctggtgaaaccccgtctctactaataatacaaaaattatccaggtgtggtggtgcatgccagtaattccagctactcaggaggctgaggcaggagaattgcttgaacctgggaggaagaggttgcagtgagccgagatcgtgcactccagcctgggcgacaagagtgaaactccatttcaataaataaataaataaataaactttgggaggtaatggatacgcttattgcatagattgtggtgatagtttaatgagtgtctacttttccccgagctcatcaagttgtgttcattaaatatgtacagcattttgtgtgtcaatcatacatcaatacagttgtttgaaaaaggaaacaaaacaatctttaagctgactatcaagtttccaaatccatttatctattggaaattatcccaattaattaactaaagagttggcagattaagaagaaaagctactcaatgttagctggagctgttttcttggaaagcagttaaactgtttctatctaatgaagggaatcgtcttgatcttaaccatatcattttttccctcggtctctcttagagtttcacacttgttctccagctatcttttatggtccaaggtcaagggccaattttcaggacaatgttccatgtcatgacccatcaaccaccaccaccaccaccaccttctcctgaaatcagagtagttcaggtagtcctagttaattgatttgatgaatatctttgcattgccaaaatgtaatcagtgcttggcatttagcaggtgaaacctagaggttagctgagttcttcccagtggaaatctatttgaatcagattcaacctcccattacgtagcctgggaggatatatactttaaaccaaagctctccaggaatttttcttgttataaggggaacagttcacctgcctggcttctgtagccatggatactctctcagtttttatcctgtgctcttttaggggcaaaaccctgccttctcaccagtctctaccagaagttattcaaattaaacgtcttattgttttcatactttaattgaagatatggacagtcacaaaatgggtttctttgcacacccaccatagccacttgtaactacaaagatgttcttctcttcgttctttttcctactccggatcaagtaagtttctatcctcatttagtactttccttgtctgaaaaattggtactagctaataactacattttaaagtgctatctgtcacagcacagaagaacgattatgtagtattctggataatagcatagacttggatccagattgttttaatttaagtccagagcctgtcatttacttgctgtgtgacattgggtagtctgcttaacctctctgtgtctcacctgtaaaacaacttcaggggttgtcaggaagattaaatggattaacgtacatataatgcatatgatagcatctggcttacaataagtgccacaaaagtatttactattattactgctattaacataaacagacttattaaagtgtcttccaaactcaaatagttgaattaaaagggaatctaatgcaagctgctaagaaaatattttttctgaatgtcaactatagaaattcaaaacatacttaatgaataactagctattactaactggcttataatatgccttgactgaaaatgatgaggcgtctgtcattagacagttttaagatatttatgaactgacactgatgagatttggtctcatttcatcatttatggcatattatctcatttatttgtggtgtgtgtgtgtgtgtgtgttatatgtaaccaaatgcatttttctctagagtgcatttacctgaatatatcttccctgcatatttttctttttatgtttattacaaccctgcaaatacttaggacatgtgctaactttcactagaaccacatggacactgatattaataatgtgtccatagtcacaaatccacattggtaatagggctgtgggcaaaacctatttccaagggactccacgactaattaatatatatgtgtgtgtgtgtgtgtgtgtgtgtgtgtgtgtgtgtatttgagatggagtctcactcttgtcgcaaaggctggagtgtagcggcgtgatctcggcactctgcaacctccacctcctgtgttcaagtgattcttcttcctcagcctcttgagtagctgggattacaggcatgcaccaccacacctggcaaatttttgtatttttagtagagacagggttttgccatgttggacaggctgatcttgaactcctgacctcaggtgatccactcacgtcggcctcccaaagtgctaggattacaggcgttagtcactgcacctggccttcacgtctaatttttaaaataagatcatgcttctagccagttcctgtcttttgtctatgactctaagaaaggaatattaagcatgtcacaaagaatagaatgtgttttactcatagagtaatgctattggagtacgtaacagagaatataaatttggtgtaatttttaatagggctattaaaatcatttaaagtaatattttatcttattaaaatctcaaaatacatactttatcaaaataaaaaataaactttctttgacccggcaatcaagtatagtgaaatctttatgcaaagtgatcttcattgcagctttgattttaagagcaaaaggcaatgttatgtagctattcaaaagaatgtaacagatctgtaggaagtaacacagagatttactgataatatgctgagcaaaaatgatttctgcagaacagcatgtacagtattattttatagttttaaaaagaataaaaagtatgtaaaatacacatgaatatttatgtaggggagtgagggagggtaagcatctgtgtgaaggttcatgcctaacctttaaacacagagactatccagaaacgggttaactatagaagagaggggaagtagaacactttactttttttgttaacgtgctttacggtatttgaattttcaaaaataagcatgtattaattttataatcaaacataaagcttcaagcacacactatgttaaatgtgtttgataaatccagtgttcagggttataatgcttgcttagactaactggtttcacatgggtacctgtgaccagcgtaaggtcattgctaggcaaaaacactgtaatttctagaaacaaatagaacgttctacatacaacaaaaaatgtaagtcatagcattttggagataatgctgaatctcatcaggcacagtcaaccaaaaccaggttcatttcattctcagaatttcatctacatttgccagagattttaaattgaataatggactgactgtgcgtgaatgaaatgcatgcatttcttttatatttctgaaatagcaatacaggctgagaccccagcgggggagcaggggagctgggggtctgggcgacagtagaggaatggtgttgtgtgagatagggacttaatgagataagggaatatgtatttttgtgaggggaaaaaacttcataacatttttcatatgaaacatacacaagaataatggaatagattatatcttatgaaatgtggcctacagtaagttactgttgcatgtcttccttccatagaaaaggaatgaattggagacattcacttataatgaaaattgtctgtatttttctcaattgagagagttcattgagacttcatagaatagttttattacatattacataggaaggaaaaaacacaatttttttgttccaataacaaccttttatctagctcgacaatgcacttccacggcagctggatcaaaaaaaaagagactgctgcaattcagagtcaaagtggagtttcttttcgaagtggtcatcaacagcttttagcaaatgaaggaagggcatatctttccggggaaaatgaagcacccctttctttggcccaaatgatggtgaagcttcttttgtttattggtgatgtttttttttttcttttggtttttgtttgctggtttttgttttttgttttttgtttttttcccaaccgttcgttaaaaagaagaaaatgagagagaggacaaaaatgtgaacgttatgctatttagtggtcatgctctagaggttttgaaaaaatagccatcagcagatgcatcaagatatgacagggttgcacattaactattttcctgtcataccaagaattctggaatcttgtattttattgcaagctgtcatctcacccacattttcaaggtgacctcaagtcttctaggttctccttctcaaacaattctcatgtttctagatttgagctcttctaaacacctctgagtatgacctgaaaaagttatttctccttaaaatatgtccgacaacttctcctatgactaccctttttaaacattcaaaatgacagtatttccactaaaaccacctctttaactgatgttcgaacttggatgtggatactccttttgtaacatggacgtatagtagatatcagtgtgtctgctgcttctgtttgttgctaaggttcatagggcatgttctcttttccaatactttttcctgaaatacattttgtgatttttgtcattgttcctttgtccagggattctttaggacaattgtttaaaatctaagcagttaaagcccgacattttggctcacgcctataatcccagcactttgggaagccaaggtgggtggatcacttgaggtcaggagttcgagaccagcctggccaacatggtgaaatccaatctctactaaaaatacaaaaattagctgggcatggtgccacatgcctgaatcccagctacttgggaggctgaggcaggagaatcacttgaacctaggaggcagagtttgcagtgagccaagatcatgccactgcactccagcctgggcaacagagcaagactccatctcaaatgataataataacaataataataataataatatctaagcagctaagaagttttaatttatttttgttgtttatttctgatatctggaattttattcagattatgtgggtggtacgtctgtacatttttagaatgtattgaagttatctttgaacctaagcctatgaacaactcttgcaaatcttccattgctctaaaaaaatacaaactccttctttggttttaagttttatatgtaaatatttattatatcaagcttgttggtgatattatttaaatcttatttgaccttacttatgtttttaaatctgtttattaataaagaaacacattgaagcttcttcttctagtattattattattattattattattattattattattattattttctttaatttttactttaaggatacacatgcaggatgtgcgggtttgttacacaggtaaatgtgagccatggtggtttactgcacagatcatcccatcacctaggtattaagcctagcatccattagctattctttctgatgctctctctcccccaacacaccccagacagagcccagtgtgtgttgttccccaccatgtgtccatgtgttctcatcattcagtccccacttataagtgtgaatatgtggtgtttggttttctgttcctgtgttagtttgctgaggataagggctcctacatccatccatgtccctgcgaaggacatgattccattcctttttatggctgcatagtattccatggtatagatgtcccacattttatttatccagtatatcattttagagttaaattctccatcaatctcaagatgattttccacatctattttgctttatgttgtttgatacataaaatgtgtgccatttagtgactttgtggtcatggtgagtggtagtgattattatatgtgatgagtttcttggtcctgcttgatgtttcgggcatacattctgccactggacttttaattttctgccactgaatgagtctctttatttacatttattaatataacctattccaatccttacttaaaactttgggggtctgggacttgaactgcagataagtggcttaattataaccttggttcatgacacaccgatattacccattctaaagcaaaacaaaacaaacaacaacaaccaaaaaagccttactaaagcaaaaagaacctgaaaaattacccagcaaatgattccccagattctgagttcactttctttttctcacactcctctttctcctcttactcttcatggttctccttcacactgcttctctttcccccaaagatttccatctcttttgtctctatgttttggctttgtgttgtgaggatttattttactttctcttgtaggccaccaacttgacaatgatattgtatcagttcctctattacactttcaaatttttaaatttctttttacctttccaggaggttttgtttttgtttttgcatgtgatctaagtctatccactcgagctgtctcatttccggttttcttggtcaaaagtatctgactcttcaattcattctccttctgttggatctaccagctgccccaggtgacagagacccttaagtatgttgctgttttcctttgtctattcactgttttctgctcctccaccacccacagacatcaggttgcttgtgtttccaggaagtggacccttgtggagtggtagaaagctaacagttctgttctctgtagaccgatgaagcacttcctggtgaaacatttctgctgttggaatgaagttcccagtttatcctagatcaagcctgtgccttctgctttttttttttttttttaattttaaaggtagaggtcagtttaccactctagtttttctgtagttccatggagattaaagtgatcctagaatcacccccaggacaggacacaactactggacacatgaggcctttacctaaggacaccagagattctgtaggtagccatcaaatcccagagagggaagccatcttgctgcccaggatgattcgccaagaggccagttgaaaaggtcacagtgttcctaggaagatcacgcaaaacctgagatcttagttgggaaggctaaatgacagtctgttttcatgacacaaaaggaaaatatcactaaataatactatggccttcctctcatgccaactcagaaggcattttcattcccatctctaggcctttccagatctggtctcctatgaatacaaactctctttatattttatctctgacttataatgcaagctccttaaggccaagagtgttttatctttgactatgttatgtacaagactgatcacagatctagagctaattggtggttttatatcatcatgatcattactatattaagtgtaggtgtatattaacctgacaattcaaatttataggctagataaatggagaatatttgctcatttcataaaagtagtttgcccagggcttattaaatctctcattcttaaaaacattttatcaatgtagaataggacttttcaacaatacacattttgtaaagtggaaaatgcaatctaaactggatttttaaaaagaaaagttttcattgtgagattcccgtttatgattgaaatctcccagcgtatgttcaaacagattccatctcatggggtctcttgagtattcttccatctttataatttaatggagtgagaaacttctcccacaaacatcctgcacgctaggcctgtagtctaatctcatgctccaatttgcatcctttctttgctctattaattgaaattaaaataaaacatgctctttactgctgctgatcttataggtataaattataaattgataaacaatttgtaagaattcattttaatcaaataatgtattagtctctcagcaaaatcctttttttaaaaaaaatgttttatcttcatctcagggtttcctagagtccttctttcggtccctctgtcataagaaattttggattctttttcactggatgcagatatctcattcaacttgtttttgtttggttttagttggtttggtttgattatttacatcatagcagatgtctgacacttgatcaactgttagacatattttattgcaagaagtaccattatatggtgttactaagcaagaaaaattactgtcaattaaactgtgagacaacactaagatgggccctgatttcaaagatgttaaaatgttaaagtataggtggtatacaagtgaagaaatatggaaataagtattttctggcttctgatgcagaaacaaagaactccttttttttttttttttttttttttttgagacggagtctcgctctgtcacccaggctggagtgcagtggcatgatctcagctcactgcaacctccgcctcccaggttcaagcaattctctgcctcagcctcccaagtagctggaatttcagtcccccaccaccatgcctggctaatttttttttttgtatttttagtggagatggggtttaaccatcttggccaggctggtcttgaactcctgaccttgtgatctacccaccttggcctcccaaagtgctgagattacaggcgtgagccaccgtgcccggcccaaagaactccttttatgtttgcagagcaacaatcagtttgatccctgccactttccttttcaacctttctgaatttctagaatagccttatcacaacagggagcacatagcaatgcctattcccaccacctgtgggtcctagtaaatctggttccctgaaacagggctaatcctggcaatgtccttacaagtcaccattttcctatattgaccacaacactgaatctttcttgaatgaatctattttcccacctggcctgatagcccctcactaaacctgaaaactgtgcaaagcctaacctggcttgatggaagacctgaaattttgtggggttctttctagttctttcagtatggcagctgggaagaatcctgtcccttgtacttcacctatgctgttcttaagagaaccatttgttgccccagtcttcctatttcctactttcctcctcctcggacatcagtgcctactgtcatcaaggctgtgaccactatctcctctggagatacacttacctgctggatttcctatacttaacctgctggatttccacatcagcggtcaactcttcttgatagtggtacttgaatcttgcaatagtccccagaatgcttggctgtgtatttctggaattcttttaagagatggggtcttagtatgttgcccaggctggacttggactcctggcctcaagccatccttctacctcaacatcccaagtaactgggattacagttgtaatcctgtgcccagcttgcagttctagatttaaaacgagttggctgttttgatgatctagagctataatgatcagcataaccacaataatgcctctcccagacccatccacacaaggtactaaactagcatccaaaactcgatataaataagataaataaataactcacctttcccacacattttcagactccagggccatagtctcctctagttaatgttgcaatgttttatattcaaaactcagctgccaccaccgaattatctgtaattggcttagattgaggtggtccatggatgtcattgtaatccctgactggacttgtgggtgtcccttctctctgtcttctgccctggcctatgaagtactgctggaacaatggttttctctgggcctctgtgagaaaagggaggaaaaggaaaagaaagacagagctatgagagcaaccattcctttgcttcttaaaccagacttcacagaatggaaaatggggtgaacacagttttgtcgaaatgaagtctgtcactctcatttggagtccataacacagagtagaagaaaggcttcataaggcagtacaagatctagtttaaaactggtagttggtctgcttatttctctgatactcaattaacccattgtaaactaggggaagactatctttcctgtgtggaccattctagcacaagaaaggatgcaaataaaaatggcaacatcaatgcagaagaatgctgtgaactttaagacattacacacctgtaaaggaaagtaattcatcatttgaataaaaatgatcttgtcacatattgtttattctccacctcctttctttctaccctggacctgacactctgaacattgctgccagctttggtgaccttgcctctaggtgaaggtgcctgcatacatactgtattcacagactgaacacttgtccctgaagggctgggtttaagatagaaagagatgtaaaaaatggtggaaatgcccgaatgtagaaggcaagtttgaagcttctgcatctagtttgatttgagattaaatggggtgctgttgatctacataccttccctcgccacacttaattttgaaatgcacttcagatctcatgctattctacaacctgaacaataaaaccatgctgtttgtaaacaaagcatttcacgtataagaaacaggcccattgtgcatttttttccattttatccacattttcccataaaatctatttgtatgcccacttttgagactgtttcattgcatgatatttaagcaatggtcaatcctatttgtgctacatttatggggatccttgaatttccaaaagtaaagaggagaatctgctgtttagctaagaaatctgttcaacttaatacagattttataccttctcttaaatcccagactgagctcttcttttccaattcttcagaaatgaagaagaccttatttctgacaaatttatggatacagtgcatctctctatcattaaaggcagacagcatctttcagatataatgagaatgtgagtcatcaccctaaaatctgatctggtcctaattcaattaaatcattaccttcttgtctttcactgattttcttgcctacagaaagccatgcaatgaatgtcttaaatggctatttttaaatagtacgtgcattcaaagaaggagaaaaaacacacacacaccatttaatgctaaaaagggaaataaattgctgtttttttttttttaacaaatggctgggagggttataatgtattagttttttttttccagaggtaatcttagatgtggagtgaatgaagtgaagtctgttatcaatccataacatctgccgcagtgtcaagcgatgaaatgggtgactccggagcccaagacagctgggacggctttcttaatgcaggagggtattgtgcaaacaaacaggccctgatacggtctatggttgtcacaattattcaggctggtgatacatcttcccgtattagctgcttgagcagccctatttcttttaaaagtaaactactgtataacaatcaccatcctggcctgtaagtcagtgagcacaaatagaataaatacccgaaataaaaataaatataaattaaaatttatcgccagagcaacaaactgtaaaacagatgcaggacaaaacaaaacaagacaaaacacctggaggagaggctgtggagagaatgagcaaacacaaatcccaaaccttactcacaacaaaacaaaactctgaatgagtagcaattttccttacgctttacagtgttaggggttcaagtgtctttcaagctaaaaataaaaacactgtttggggcatctaattttaattcattcttcttttgaggtttgtgaccaacattgtgggaatggtaattacaaatgaggaggcctaagtattaagcatgagcaaaagttctctaaaattaggaaatgacctaattcagtaatgtatgtacataaatctgtagctaaaggagatgctgaatttaattacaaatagaatcttggtttcatctatctttctagaaggcacagaaatgttctgattcttgttcgtaaatttgtctttctaacacatcaggagcctggatttccggctgaaatacaacaccgtgcattctccaatgtatagcctagctttgggtcaaaaatctaggacctgctgcaagaattactacgcactcaagttctctgcacactgagcacgaaggttcattggaaaggagactcttgtgaggccttgaagcacatccattcacacctaataattgtacagatatgaaaagtaacatcagagaagtaaagatttttctaggaggccatttaggttttgctctgtgctttattctatcacattaggctgccttattctctgttacctgcatatctatggtagtattaaaagtaagccattttcagtttgcgttaacaagatggatgtctgaaaaccaaatacaactggaaaattcaatccaagttactgaggtttgactgagatatattgattcttaaaaaacaagataataaactctaaatatccattgaaatatttttatttttaattttacgaggtgtgtactggtataaattttgtaatacacattttttagtgtgtatacattcttgattaagtcaagcccaagtgccatgaaagctcaaaaatacacaaatcagtgtttctgtaaagaagggtttatatcttaatcattattgtatttttctcaacacctcacacaatgctcacaaataacagttgttaaatgctgtttcaacttaagtatatttgttgcctttatgtaagcaaaaataagctcagtttcttagaaatcacgtgtcaacatcgtggaatatttcctctctgataatgggacatcattgcttagtcattcattcattcatttgagaagtgtttcttgaccattcttgtctggtctattcagttctccacattagagataaaacagacaaccagtgaacaaggaagaaatagcacctgccttcaagaagcttacagtctatcagaaaagaatgacattgagctagtaattctaagtattacaaagcagaaatttaggcagccacaactgtatgtagaaggaaactcaacctggtttgggaggcagtgctatgaagccataggccaattctccaaggaactacttgcatttaagctaaggtgcgcaggccgattctccaaagaacttgcatttaagctaaggtgccataaaacatttcgatgtaacaaatgggaaaaaaatagaccacacctagatactaatgctgcctgtcctcttctttcattgaggaaagaaaagccaaattaatgcccagtttcaagtagaaatatatttttggttttgcaaagagagtgttgggtttggtcacatacaaaaaaaaagaaagtcaaggaagaaatcacctgtcgggtttagatatgtagagtcagaaggatgtaatcctagacaaagagaaaggcatggacattggcaagaaaaagcacggggagttcacaaaacgtgtagggctgatctccagccaggagcgcacatttgttgtttagtgtctggtgtctattctgattggttcaaaaagactttgctgaaatggcgtcttccctatggaggcaccccagtcccactaatgcttctccttcccaaaacacttacttaattcttctcatagcacttttatttttataacagatgttgtaatttactcattgattatcctatttactctctgtattttcccattggaataaaagtaagggaaggatctgcatctgttttgtgtgttgatgtattctgagcttctagacagtccctgacttacagtagctactataaaaaattatcgaattgaacctaggggacctgacatgttttgctccataattcagtggttcattgctgttgtccgccaggtcagtctgacttgctgtagcatatagattccagctagtggaaggtatagcttttcctaaagccctgggctggaaatggtacaagtcctttgccttcaaattttattgtcaagaactgaatcacataaccacacttaactgcaagtgaggatagaaaatgcaaaaaccaccaggtgtggtggctcacgtctgtaatcccagctcttagggaggcagaggcgggagaatagcttgagtccaggagtttgagacttgcctgggcaatatagcatgaccctattctccacacaaaggaaaaaaaaaaaaaaaaagtgtagctcccctcaaaagcaacaacctccccaactttaaaaaaaaagaaagaaaatgcaaaaagcatatatccccaaagaaaggagagtgtattttgatggacaattgagagtttctcttactttgaccatacaaccaaatcactgaagggaaggtctcttcttcaaagtgttactgcttctttcaaccaaggcagaggtgtttgtgagaaaaaaaatcaagtacattcctttgccaatattagaatgtaactgaaggcattatccatcaatattttgtaagtattacagaggcaaaattatggaagagtagcacattggcctcatcaaaatatttcaatagttaattatatgctatatatttaagcattacatacctcagatatatttgtattgtcaagagatcaatcatcaagttaataaattatgcaacttaattttaagtatgattagcctaaattattaataattaaaaattacaaatgtggaaacaacatatttagaaagttacacgaaaaaatttaaaacctaatttctttttcattgattcagtaaagttcccatcatcttgtttatagaaattagtattctaactacacttatctttttagtttacaaagctaacaatcaaattgttacattttatacgtccagaagagctaagagagcatttcttgccctcttagaatgagaggggaattcacacttaatgagtgacaaatgtgtgtcagtaaatcatatgcatgttgattttccaaatagcttgtgagaggggctttggatctaggttagtctaaatccaaaaccaaaggaagttgttctaaagaggcccacaatttattaattcatttattcatattacttattagacacccatgtataaatgtctaagtgctgaggggcagaaaccttgtctgtcttgttagcaatgatagtctcagtgccttaaacattgctaacaggattatgcattcaaaaaaatctttgttgaatgaatgaatgaatgagtgaatgcatgctcaatggttgaaaatttactgtgggcaaatcattgtgctcgctgctcataatactgtgcttggggtaaaaccttgaggatattatatgaggtcccttaagtctctctctctctgtctctctttctttcttttgatttgaatcctatacttctcctatgacaagtctgattaaaaaaaaaacagtttttcaggatctaaacattcaggaagttcctctggtatttgtaattctttaatggcgcaatattttctagaccactagaaatggtgcaatattttctagaccactatttatttacataactaactcattgcatatagctcatttaaaaataccttttcagagggaggtgatgaaaatggaattgggtacttcaaggaatctcaactaaatgattattttttaaaggcaaacttggccttttgcattagtatttgaatcattcaatttctatatctgaaaatgcatttgcaagcttgagaagatatgccttggtctgctgtttttcaaactatgattgagaatcaacagagcggttaaatcaattgtgtaggtaaaaactaggttttgcaatgaaagacaatatattagaataaaatgaaatgaaatgaccaatatcaaactacactactcaacaaaggtataagtcttgctttataaaacatttttatgtatgaatgtgtatgttgagtcaagatataatcttcatgtttagaaacaaaataatttgaaaaatatctctcatgtaggcattgataattgatggcagtttgagagaataattatttttcttctaaaaggtcaggatcctagcgttatggtctatggaggtcaatgacttggcaaagacctctttctggtgtgcagtgataatggaagccacaatgtaattgacattattcaaaatagctcctgcaggtgatttcttccttgactttttttcgtatgtggccaaacccaacactctctttccaaaaccggaaacatattttttacttgaaactgggcataaatttggcttttctttcctcaatgaaaaaggaggccatacagcatcagtatctcggtatggtctatttttttcccccatttgttaccataaaaggtcttatggcactgtctacattggttgccctcctagcttctcatcatagacacctttgtcaacagaaatgactgattattcagggtatttagaattggctggaatttgccaaactgggtttcaaacacaggtcaaaaatctatacatggccaaacaaggcgctcccatttatattccattcttcactttttagttggttttggtcaaaaagaaaaattgctttaaccatattcctatttgttctgaatctatctggggctagatataaatgacacctattttaaaagttagttcaaggtgtaaaagaaacgaaatttctccttctctttcacaatatggctccttgccttatatttcattgctggacataattattacatcatttaggtcttaatgcaatgcctatgttgctaaattgtgatagcaagccactgataaagtcctttggttagtcacagacagcttctgtagatgtcagcttgtattcaccactggtgcctttaagcaattgagttcttcagtaactttgtatactccctcagttaattaggggctcatacaatctggggactcacttgagctgttggatgtcagtaccctctcaggatgctaaacagatgactccacaaattctgaaggtgcttgaggtgatgctagcagatgtatctatagctattttctaattttcactaggaaatccacagaaccacatatgttgacttgaggggtctcaaattctcttctaccaaaaactttgcccccccaacaatgcaacatggttaccactgtaactctattagagatttacttctatgagttaggtatttattccctaggtaccacacaataaaatggaattatttgaaaaagtgttaacaatttataaagcattatcatctcaagaagaaggtacttgttttattatctcctaggaggaagtccagtggtgactttatggaataagaacatgtttttagaaaaaagaaaaaaaaaagatggctttggctccagtcctagagatgcaactttctggctatggtacaggtaaagtcatctggaccttctgttggtcaggggatagtaaatctgtttgttctagtcaccttacaaacagggcagttgtatgaaataaggaaatcaggacagttgcagaaatggacattccatgatgaccaagaaaacagtctctgaaccagaaatgcttgggttcaggtcctaccaagccactgctgatggagtgacctgcttgttaacttctctgtgctcagtctcctgatcgttaaaatgggaatgacaatagtaactaacgatacaaaggtgattgtaagggatgaatgaattctatgcgagtcccttggaacagtgcctacgacacggtgtgtgccacaaaattgctagctgttattaagtcggctttgagaagtgaacatttagaaataatgtagaagatctcataacagctgggcctcagagtcccacatgaagatgaaacaaacttcataaacttggatggagcaagtataaactaccaaacataatacaaataaatgtaaattttcctttgaagttaacatatttattttattataactaaataataaaaatatatacttacaataaatattaaaaaattagtaactgactcagttatttcattaatgctgccattgctcaaaaaatatatatatatacatatgtatatatatatatattttttgagacagttttgctcttatcgcccaggctagagtacagtggcacaatctcggctcagtataacctccaccttctggtttcaagcgattctcctgcctcagcctcccaagtagctgggattacaggcacccaccaccacgcccagctaattttttttgtatttttagtagagatggggttttaccatgctggtaaggctagtctcgaactactgacctcgtgatccacctgcctcagcctcccaaagtgctgggattacagatgtgagccacctcgcctggcctgctcaaaatatttttagaactcttttcttgaattgtcttcagtcagtttttgagctatccaaggagatcagtggttttttgtatgtcaaagagatatctgcatttccacattcatcgcagcattattcagatcagacaagatattgaatcgacctaaatgtccatcaatgaataaatggagaaagaaaatgtagtacgtacatatataatggaatactatttatccttaaaaagaaggaaattctatcatttgtaacatgaatgaacctggaagataatatgttcaatgaaaaagcaagacacacaaggacaaatattgtataatctcacttatatgtggaattttagaaagttgaacttgaccggtatggtggctcatgcctgtaatcccagcactttgtgaggccgaggcaggcacatcacgaggtcagaagttcgagaccagcctggccaatatggtgaaaccccgtctctactaaaaatacaaaaaattagccacgcgtggtggcacacacctgtagtcccagctactcaggaggctgaggcaggagaatcgattgaacccagcaggcggaggttgcagtgagccaagattgtgccactgcactccagcctgggtgacagagcaggactctgtctcaaaaaaaataagaaagttgaactcatcgaagcagagagtaaaatgatagttaccagggtctgtggggagaggggcagggagactggagagatgtgagtcaaagggtacaatgttttagttagacaggaggaagaagttcaagagatctattgtacaacatggtgattacagctaataaaaatatattgtatacttgaaaattgctaagagattagattttaaacattctcatcacaaacaaataatacttatgccaggtaaagcatatgttacatggcttgatttagccattccacaatgtatgtatctgttagaacatgttgtacaccatatatacaatttttactttcaattaaaaataaaaaagaaaagaaaatcagtgatataatttaatgatcatacattatttcattgtacttttaaaaaattaatcagttggtattcctgttctgagcatttttaggttggaattaagtctaccaaattcgtgctttttattccaatggaaaagatgtcttctgtctccaaaggattcatttcacccatgattaaacagcttttcagtacaagtccagattaaataaatactttaggttttgggggctgcactgtcttgtctcaaatactcaactccactgccacatagtgaaagcagtcagagacaatatgtaaatgaatgaggatggctgagggccaataaaacttaatttgcaaaaacaggtggttggctgaattttgctgctcagctgtagttagccaacgtctgatttaacctctgtgatattgaggagataatctgtctaacattcagaatgagcattaaatgatgcagctttatacctgacacattgtcggcactcaacaaatgtctttcttcccttcccagcagctgtggttgtagtagaaatcacatgtgcttgcatccagaaaactgttcaagttacggcacgaattagctttgtaattctctgagtttcagacctgtcatctgaaaaaatcaggccaacttttatctccttttgagctcatataaaatttaaatatgacaaaaatatgcaaaatttatgccacagagaatgtaccaaagatcagctgttacaaactgtctctggggatttccatttcaaagtgttgttagaaaccttgaaacccaaagggcagataaatcactcattatttctcatcaaaagtagcagattttggaattctcaatggtgtttttggtagaaatcaggctccatgagaatatatatttaggtgtccctttttttaattctcatagaactttagaaccaaaaccaactgtcaagatgagcccatcattctcattttacaggtaaggaaactgagactcctagagattaaatgacatgcccaaagtcactcagcaactcgggaagggttcagaccaggactccatgctcaggactctcagtgtaggaatttcatactataacaggaagtcaccctactataacttgaagtcaccctactataactggaagtcacccacttcagtggttttcatgctgagtaagcttgaaacaagttctgcactctttaggccatctggttatccatgatcagattagcaaatgcagaattacttaacctgcttatattgcaaaggaaatggctctggccaatcacagagtaggacattcagtaaacaggaagggtttcccattgcacctccactgtatcaagtgaggtattcagaggacagactggctgacattcattgcttgggatagggtttcagtgacattactgaacttgtgcacctgcattccataggatcacaccttggagggcccatgacactattcttccctgctgatataacctagaaaatgtcactgcacaaactatatggcatatatggcattttgaacacactgaacaatgacatgacattttgagctgctaaaagcagagctacatggtgtctacactgcgcatatcctaaataacacccctcccttgttcttccctttccctttcttttggttatcaatcgtctttacctccattacttaccaaattttccattttgtcccttaataagctcaactttgctggagtttttttaactgcaaggtgagagcctcatgattgctatagcattttgaatgcactttttcttctgcttctctttcttcattgttacttttcatataaacagaaacataagtcaggattctcttcaatcaatcttcaaacaaggaaagatcttttggttgctacaattagagtctttatcatttcatttgagagttagtatgtataggtacatatgtattagttacttaggactaatatatattttgccattgccagcctatcctaagtgcttattatatatcttgcatgttaagggacatctctataaataagagtttttagaagtatagtttttaaaatgctgaatgtgtacatttctttatttttaaaactcatctttatttaattaaactcataacatttagagtccatggtaattgaaatggctgataataaagtacattttctacatatatatattatatatatatgttgtatatgaaaattttctgcctgctttcacattttttattaaaatattctgttgattacattcccaataaaaatcaaatgcgtagctatgtatattttgcaaggagagcaaggaaatgcaccttcctttctcacgctttcagaagatccagtatgttctaaatattggccctaattgacatgtggttgaagagtcaatagaaatgtagaacctttgttaccattttatgtcacctcatatttttccatatgcaaaactatttctgaaaatttggagctggaaggcactgtgacgcatgtcactggaatgacttgtggtgaggccaagctgccacttcatcacgggctcccatcccaacccacattttccattaggatgtttccatcaggatcaagttcctcttcagggataagagccgaccatcttgtcttcctgttcttcataaaggcagcttgagaaagcccataatcagtggagtcatcagtagctgattgagttcctcctaaatgtattggtaaaagaaagatctgtgggtcattttagtcattcaccctgatacctccctatcacaatggcttcttctcccacctctctctactcatgtatttaatatgcataatatctggtaccatttcaactttattgaaaggttttacgattatactcttgccctaaatttgaaatcaaaattttcaatatgtgcaagagtacagaatgaaagagcatttattgagataaatccaaatggaagaaaaaatacattaattcaagtatgcaaataaacaggaacattttgggtttcggtgatctaactaatgttctcaataattcatttgagtatgtaaagaagttttaaaggaaagaaaggacaaagtatgggtataattttcatgaattcattttcatcattcaaaagtgattctttctcttctactctccttgaaccattatctaaaggctgtctgcaacctaaacctctaaaaacaccagtaattttagtgtcagtatctacatgttaaaacttgttttggtctaataatttgagatatattatggttctattatttgtaattttggtagcttttttgttctattaatctacatatgaaaacatgttatatgtttaagatttttattttgatatagatcatttattttattcaaaacataatttaaaataaaaatactttcatattgccttgatctaacattcaagaagatacatttgttatgttgaataataaccagaaaggacaaaagtttgaaaacagaaaatggtgggaaataaatcttaccaaatcaaaaaagccccagtttaattttataaagaatgaagacataaggcaaaggcaaataaccactctaatttaaaattatatttcaattagcactttgtaaagtatcttaacttgctttgtctgacttggaaatgagacaaaagtttctgaaagagcaggctctgaaaatatttatgaataagaaaataaaagaaaaaagaacaattgaaagccaataggtgctaaaaaataaaaaaagagaaacattataaaacaccttttcaaaggtcttctaatgtacaatatttaaatacaaacagtaactagtgttacaccagctgctctcaggtttgcaaaatatatcaaagtacagcatattggaatgagtcctgagtttccatttactttatctatccagacacatcaattctttttactccagcctgataaagtggaactgccgcagacaaatgagctagtggagctgacataatgtgtttgtcacaaagaagcgctggataaaaaagcatgactttgatcctcaatgaggttactattttacagtaccctgaatttaactctaacctgatgccttgagtcaccgttcactgtttattggccaaaattgattctcatttcatctctaactgttaaaggactggctcctgcaatccttagatgagtaaaatctcctatcaaccaaaaataatactaataataatcatgggaaattaaaagcaaaaacttgattgatgatctctgtgtgacattataaaaactaccccgagttggggactagaggtaagcaagtaggttgacgatcacttatcacaaacccaaggtgtaatgttattattttaaaggaaatttgatttgtatttaagcaataatacataccagataatttctagataattatttatgtctgaatttaaatgtatctattgagcaaatcagatacatatatatttatgtgtatgtgtctatatgtaattctattctttctttttataaagactcaaatatttctgaaaataaagcttttgttttgagttctgaataacatgaaacatttgcctattatacccctgggctcctttatccaagcaaattaattcaatggtttttatttcattcatcaaacaaataaaaaataccataggtagaatctgtcacttgtaaacagacatagaaaagaataaaacaaggggttcctagagaccaatcctccaagcagatgagtaaacattgccttgaacagtcataatgggggaaaacgattctttctctgatacctgatactgcagcctcacacattttttttcttcttctattattattattattttttttagtttgtggatcattagcccaacaaatgaagaagtgaattgtgatgaatgaaaattagtactgtgaatccaaattactgcattaaacccaggctggccataaattacatgttaacacaattcgatacaagtaagacagaaaatactgtccctgacagtgatctttaacaattaaaatatatttcttcaactcaatatttggctgcaatatactaaagaagttatgatattctcatattgcaaagttatatttagattctacgcagggttaattattcctcacaaataacgtgctcactcatggtctcttaagtagattttttgcggtatatcttttggattgactattattgatgcacagcagtgtttacaaaatacatctccatcccttttcatgatgatttgagttacagccatattttaagccatccattaagctctttttgtaccctgcaaattcatcagtggcctacctactggacacacctgagtaagcagtagtagagcagagatgtagaggtgaatgagatctattaggtaagcagagatcagaaggaccagagaagctatagtactaaagagaagtcaggtttactgtacagaggagccttcactgcttcaagccaagaaaatctggtaacatagaaaatgtccctctgtgcgtacttttacccacaatcaattggtgagatttggtcagctgatgatttcctaaaagttccgtctgtccacgtcatccatgcagtagcacaagattcattttgatctaatgtctgaagcaagttcagataataagatgatgacaagatctgaaagatcaggctgggcgcggcggctcacgcctgtaatcccagcactttgggaggccgaggagggcggatcacctaaggtcaggagttcatgactttattagagacaggtgaaaccctgtctctactaaaaatacaaaaactagccgggcatggtggcaggtgcctgtaatcccagctactcaggaggctgaggcaggataatcgcttgagcccaggaggcggaggttgcagtgagccgatatcgtgccattgcactccagcctgggagacaagagtgaaactctgtctcaaaaacaaaaaaacaaacaaaaaaaatctgaaaaatcacgtgaaaactatgccaaagagttttgggaacttaaagaaatgcagaagtcggtgtttgttgctgtccaagttctttgagtgtatgtgagcaagagatgccactattttccactgatattacctgtatccagactgatgctaaaggctgagataaacacaagcatgcatccactgcctccatgcaagtcctactcagtactaaagatggacgcttggtaaaagccagatacaaaacattgctgccttctgttagcctggaagcacattgactaaagatgttctgattgcccgtggggtagaacaatgaaacaatgaagccagtatgtgcagaagcatgtaggaggaagacttggggccaatgaggcaacaaactgcatgcccaacacatgctccagggcactgtgctaatgcccaactttccatctggttgagtgagttaggtccagcaaatgaattccttccagcttctcatgcagttccatctttgtcccctattgaggagcaaaaacatcctgttggtaaaagccactttcagtggttcagtgggtaaagcttctccaggctggatttgggagtctgaaattgttgggaagactgaaatgattgttcctagaaatttaacccaactctgtcatgccggctatcaagtagagataataaaacaccgtcttaatgaaacttctgagatgaatctatattattttaattttataacatttaagattgaggtcaagagacaatatgcaatattccgcaagttactcagctaagaagtggaagggcatgtatttgaacctaggttctcttgtacctacctagttcatcgcttctgccatatttcctagcattcagccaagagaaactaccggacataatctgtgaggccaaaagagtgtgaacagcagagagggcttgaaacaatggagaaattcattcatctttatggtgacgctattgttgagatcagcagtaagccaaacaacaaatttcacttgtacagaatgtgaagaggttatttgttaattttactccttctctctaatgcggaaattatatatacacataaaatttagagacagggcctcactctgttgctcaggctggagtgcagaggtgcattcataactcattgcagcctcgaactcctggcctcaagtgatcctcccaccttggcctcctatagtgctggggagatgtgagccactgtgtgagccgaaattacagatgtgagccaccatgcccaaaatcttaacattaatagaagaatcatctcaaagaaagtgagaaactatgagggcatatcaaactaaaaaacaaaatctgtgttctttttaaatttatatattcattgaaaaatataattaggctcagttgaaactaataggcatagaaaagataataagaatatgaaaatgccttaccttcaggaactccaaattcagggaaatattgaatgataaatgtgactgaaccaattcaacagttttagagtgaagtctgacatcca
